United States Patent 7,420,044 (NUCLEIC ACID AND PROTEIN HOMOLOGS AND USES THEREOF) - sequence listing, part 4

SEQ ID NO: 10802 - DNA, 1355 bp, Homo sapiens
  misc_feature (1)...(1355): n = A,T,C or G
agacgagaaccgagatgctccatcgtgacaaagaggtggggctgaggcgacgggtaggtctacatgcggcatctaaggacagagagaggagcggagacggatagcaggacataggcggccacaagnctcatcagcaatatatantcacgtaagacagaaagtgtacacaagtactcgcaggcggtgatagcgtgtcaaggttgtgncggctctaagagctaactctactacgtgtactcagaaccgnacctgagtgaacagccatcncactgtgatctgcagtgagtcgcaattacatggtgtgctaggactcggctgttcgtcagacaagacgagtgatctaacatgtganatcgttatgtagtcttcgcgcaagctacgcacacgttggtgtatgagttgatagcggtaaatagattgtctgtcatatcatcttccagctaatgagattgggantgcacgcgtacggcggcgcatgtctctgcgaggataatcgcgcgnacatagctattctgtacctcgtgtatgaactactgtactgactacgcgatggcgtagctatgagtgtgagtgaaagcgaatctgcgcgcgagggtcaggctattgctcgtgcgtcgtgctgatgcagaagacgtatcgcagtcgcacacacagctcagtcttaacgaactcaagttacaatcacgccacatgttgctcactaccacgcgtgaatgctcgtacacggtcccgccgacctaagcgacgaatagaagcgatagccgcagctgatctccgcccggccgctggtggtcagcgctatcaaccacgacgacagagacgcgtagcntgcagtagtatctctaacgtataacacgtctaccgtgtgcgcacccagccttgtacncctcgttcataccatatgttgcgcagagtgttctagcagctgtagcgcgccgtccgccgctactctcctgagctgnctccagcgaatcgtatcactatgacactcgatacatactgagatgtccgctcagtactgcaaagcgagcggccacagaatagtgagagtgcgtgtcctcggtggccgccgaggacagcatgcgagaagattaagagaatataatttaaacgagcgagtgagacgtgtttaaatgatatatctgtagagagacgtgacaaatgagagcgaaggtccgccgtcggccggagcaaccgtatagcgatagcgaaagggacaagacaccggatgggcttgatgagtgcagtctgcnagccagacgtatgtatctactcgccgcaagctaatgtgaatccgaattctaccacccactatagtgctcactccaactggaggtcgacagagagcgtnaggt

SEQ ID NO: 10803 - DNA, 1616 bp, Homo sapiens
  misc_feature (1)...(1616): n = A,T,C or G
tcgtcgacgctctgccacgcgatcatcgcatantcggccgatgcctcgatcgcacatacgcaccaccgactgtattactatatgtcgcgctatctgatgccattcactcatcgcatctacgattactatcatactgagtatctagtatctctcacattcacactcacttcgcctacttcatncatccgcgcttatccncatcgagagccgagcagtgcagcgagccnagcgcactcgtgccgtgcgcgtactctcgtgtttcaagacatactctatcctgattcctacattattcgcatacgaaatnatacgcagcttaaaggactgagaagatatgtatatgtgtacagtcgacagcgcgcaccaatcactgtacgctagatcgccagacatcctcccgccnccgacgatactcagtcatggcatataancgaatctgacgtcgagcttgagcagacatacggtnatgcacgagctgganacggtgaatcacaaatcaccgtcgacacncntcactcacaccgacgncacattatagtctcatcacacacctgctaatggtgatagctaagctgactatcactcatctaccactcatatagcactgagcgcncatcgactgtanatctatgagagacttagcagtngtgctatctctccgcacacgcgctctgcctacacgacgcacataccacgtatgagttcatgantatactcacgacttaagtgagagactactgagagtgtntcgcanntatgatagtactgatataccactgcaatgtgctgagcgctatagctgcactacgatagctatacacaacgatgctacacgagcaggaactaatcggcgactgtnacgacgaatggtactgagctattatcaccgactcgccgcacgcttccactctctatagcactgtgtctgtgnacatntacgtactacatcgcaccnctcgctcgatatgctctcaccacacgctctcctacagctacatcatgcttgcagctgtatcgaagagatcgccagtcagactcacacgagtctnagtgtatatntggacaaatgtcgcgacatcgccgcgttgtcgcactaanatctgacanaatatagtcaactcggttancgacggatcttgtgtatgatgtctatntacttgcgtatattacgtctagacgtcacatatacgccgtcacgtatagtcctcattcagagctcgatcgtcccgtactctctactgacatgttgcagctcctatggacgcgctcctcgcgatcacagccgcacgcagtgtcgcacgtcaatgcctactacagcgcgatccggcgcgcctgagtctaactagctctanatacacctcttcgctcagngcatctgactctcgctctgttacagcagacgtgtgcggctcacgcgacagtatcatcacgtcgtatactcatattacantcactctaatacnacngcagccgactagcgtgtatgtacgtaacacgcagccagtgacgagtcgaccngacgcatcagcacgagacacaancgaagnagtgtgtccatgaagtgntactagatctctatatatgtgtatatactgntaagctgtcgactatacgtg

SEQ ID NO: 10804 - DNA, 1049 bp, Homo sapiens
  misc_feature (1)...(1049): n = A,T,C or G
gtcacattcacgagcagccgacaaaccgcttcaggaaacgcgcccctttcataaggaggctggcggtcaatgcctgtgcacattctaacctaaatggagtatggaacgggaggagggcattacagaagcaagcaccaacgatggaattttctgggccgaatacataggcgggtcatactccttcagatcatttcagatgatgatcaagcctattgactgaagagagaccctccgcgatttaaatgtaccataactttgtacttttaaggtggggggggaagtaactgtcacctcgtatattacttggacgcaaaccatttctactaataaagagttattaaataattgttacccgtgactatcataagggatcctattaattgacttttattttttgccatataataagcggtgtatgatcgggtatccatgacctcgacggtgggaacgtttatggtggcttctagtgcgcagcgttacttgctgagagcgtgaaatatttgcgcccgctttagacagaatgctcggccatggtgttgagcccaactaatgaccatgtacaccgctcccctcggccgcgtcgtcaggaaaataacagaagtgcgataataccatgcaggattaccagaagagattccacggacgtattcgcgatattgtcttcttacggtgtgcctgcacgtccttatatgctcgcggatcagagtcctgtctctctgaagcattataataangctcgccgtcgctcttcatgtgtgtttgtgagagttatagtataatatatgctcacgtattgcgcaatactgtntccccgtacgtcgctcttctctatatacttatatgaaaggcacatcactacacatcttgtgctgtagcccggcggngcgatgcaagtcaacagggtgtcagcgtgagcgatctaaaattgccgcagcgcggatctggctcgtatatgtacaggtaattgtctgtcttttgtcacgctgtagtgagtacgatcgcgatacgcatctgtagacatgaagcgccgctgataaggagacagtgcg

SEQ ID NO: 10805 - DNA, 938 bp, Homo sapiens
  misc_feature (1)...(938): n = A,T,C or G
tctccggaccaccacacggangagggactttcaggaaaccgcaagggagagttgaataaacacagctactcttaaagaaaaaaaagacaacaaaacacaaacctttttaggggaggcggcctgaaatttattggaaattggattctaaagcaggtccttcacaaactgtgtcttgaaacttcacatcagttgatcatgggatatccaaagataaaagacactatctgcggacatctgccaagaagactttatctacaccattgccaaggggggggggttcaaaatagtagaccttgaaaacactgcgtaagaacaatactccaccaggtgcgcatctttggggcaaaacaccaagaacggccccttcgtctctcaaaaccacgtgtatctgcactgcagtttgagactattagaaaaatgccggccccaccccggcactgcacttgctctgagggaggcagagatacccctgcgagcgcacgtgacaccgaacgggccgggtccagagaatcattggtgccaaggagcctaacaaggtgcaactatgcgtacatggcggagttaataccccgagtaacagttgcctccactcacggccacctccgaattacgtgcgtgcagcaagcggcacccctaacgatacaggcaactgagcaaccgcctgctggaaggcacgcgggccgcccgccgagagtacctgagttttggtgagtgtgactattttttgacagagtacaatcccattcaaagcctccggccgttacatagagggccgcacgaggctaaggaatgtagcgcgcccgatccccgagcgatagagacgtcagctgcgtcataagccacgcgagtcatccccctttatagccgttgtgacgcactccagcctcgggttcagaccaatccgggccttgtacaaccgtcaaaacacgtacagtgcg

SEQ ID NO: 10806 - DNA, 954 bp, Homo sapiens
  misc_feature (1)...(954): n = A,T,C or G
cgcccccacgcgcgccggccccccccttgttnctcaaacacatcatgttgacggacaacacggttcaagagggaccttcaacatctctgttactatttcagcgagccgcaggattcactatggacttctcacctcctccatttcaatgaacttctgtgattagtaggatgcccacagcaccagataagaaagcagatgctgaaaccataatactttccgctctgggataagaaggcacaatcatgtcttatcatttttttttcactagcgggcattgttgccagagctctggagcctgcttgtttacctgcacgtagacgaggtagaagtctaaattaaacataaatcgcctgcaaggaaagacatgaggtcaaccaataggtgttgtgtgaatctaggctcaacgctcgaataagggaccccggcaccgacgccgccacaagacacgcgtgcgtgaactcacgctcccgggtgccctgccgccgaaggtatccggggaacccaccggctacccgactatcagtcggacgccgtcccggccacgtatcgcggcactgccccatagcgctggtgcggctgagtataggttcgaggcgcaggggtgaaccggcccgcacggtagcgcccggctgggtgggaacagcggccaaccgaagccctcactgaactgtggaaaactaataagcgaaggatacatccggctcgcagcactcgtgttgtggaatgaatagcagacgggtagtgtggcggaggtgcagccggggggagacagaaagatcgtacgagaggccgcggcgcggcacgagggtcggctgcactcacgcaacctacgcaagaccatgacagaccgcggtttaagcaacggctctgtaagtactggctgtggctgcgcgcccttgtgggcggtctgtcttgcgtccgcgtcgagtggcccgcacccgtgctcgggggggc

SEQ ID NO: 10807 - DNA, 1129 bp, Homo sapiens
  misc_feature (1)...(1129): n = A,T,C or G
cgtgttcatcgtgcgtnggagangcgngagtggttgtnacttggcgggatacacaccttacgactgctgcggcgggcggagnggctggacgcgggcgctgtgcgtgatgtggtggatagggaccgcgtcgacgattgctgatgagtcgncatagagattgcaggcgtcgcgagggttgagttgaatatcgcacgatgtaggtgtagggcgcgtgtgcgaggtggggagtggatgtagttggtggtgagaggcgagtgggtgcgaggtgggggagctagaacacgtggagtgctgagtccagacgagacgttgtccganntactggtactggctatgcgagatgacacgcacggccgtgatgaatcgaggacttcggactaagtcgtggaggagagcggcgcgatagagtggtctacattcgaactgagtacggaacaatacatcaatacacgcgggacccgctgggtgcaagtgtcaaagcagtcctacctcatgggtaggaggtcgattagaagggtgacactactcgatgtagggagcaggagagctgttcgcgcgggctcagggagacgagagaacacaccgnaactcgctgctcatnngggcaagagaccgacccaatgatgtcatgtacactgcgaggtattcgtatgctcatattacgtcctacccagtccactatctcagatgatctagtctatttatcggttcactgctcttcgcagatactcgcccgcgcatactcgctcttggtcgagtcttacgttctantcctttccatcacttatcctatatttctctcatactatactatctactaccctcctctctaaacagcgtactatccttgtactacctcctatcatccaacataatgaaatctttcctatactactcaacaatatatatataatgcaattcttctggttatacggtgcactacaacattctaaactacacactgtataatatggcatcgatgataagtttcatgcagatcgtaaataccaagggacatccaatggcagagaaaaaaaatcatcctctagctcataactaggtttntttcttttttttctttctctnttctttacctctctttnntcnnnttnnttnnnncnttttcttt

SEQ ID NO: 10808 - DNA, 1606 bp, Homo sapiens
  misc_feature (1)...(1606): n = A,T,C or G
attatatagcgtatacgcatacagacagcagctgttgtgtcagtgantgtgnanactgatgacacagacacgtcgacgcttantncatgctcgtctagtacgagtgtatngagancgnagagcgcgcntncgcgcgctgctctggccttgattctccagcgtacatcgcgtcagcgtgtgcacggcgtagctctnctgttcgtcatagcacactgagcncgctaggtgcctngggctggtnacgctcacatttctcagtctatgagctcgattagatatacgactcgacctgagacggtagcagcgtgtatgtactcgcttgctcctcatgagcactgatancactactctctatcctcagctcatcctccatctcgtcgctcttctgcgtctactanatgtctgagcantantacgcgatcgantgtcgatcgtagctcgcgatgagtatattgtctagtacacnactgcgtggaccgatccacacaactcactctcatctctcgctctcgttgcgttgagtgtcatatatatgtgtatcaccaaagctacacgcatgctgtnctggtatgtcgtgtatagtgctancaccgacactcgactatcgcgtacgntacgcgtganttgagtgtctgctgcncgtcatgctgcatatcgcgtangnanctgcatcttatcctctatacgccgtcttaccgagacacntncactcgcgctcgatcgcgcnganacaatgcggatcgatagctctctcgcgatatagtatatngnttactcctctcctatccagcgtgacagagcgacagacgacggaggatacaatcgtacaactataactagcgactacgcgtattcaagtatcatgctctattttagtcgtcatgtcacgcacacgcatcgcctcnccgtcgttctgangctctctcatttatctatcacgccgctcgacatatggctgtgcattgaacagctatcgtgattatatgtgagtatagtataatgantnttatnctacgctgcactctggtgcgtgtagatacatcagcttttcttgangcgtatgatgtgagtgagattctntcgatctctataaatcgtcgtcatctactgtgtaccatcgtattgatcgtatgtatatgagtagcggatgcgagggatgagacaaagtgtgatgcaagtagaagatcgctgatataggcgagnaaagaggancgcaacgtagttcttgtgtacgtcngtgatcctactatcatgctgtctccttactatatctcgatagtcgctctcgtcgtcgtcgtctgcgacgcacacgagcacagatctgtgcttcacacngtcnctgcgtactgctggtgccacggtcgtgtcgctcgcgctacgcgccttactcctgtgctatctgttccctctagctacttactcatctacatcataccaagaggtaccgcgcgccctccgatacaataaaaatacatacacatcacactgagcgcgcgcaganatatatagggtaatctgcagtacgtgtaaacgtctcgatcaccactcaatctctatcacacgagctatacacatactctctaantatatatctctcgtctctctc

SEQ ID NO: 10809 - DNA, 1405 bp, Homo sapiens
  misc_feature (1)...(1405): n = A,T,C or G
ctgatgcgagnccatgcgcactcactcgttgtgctcatgctgtctatcacacatatgtctaccctctcgagtatgcgtcaatggatncgtcagcgtgacggagctacgagtgncttaggtagtctcgatgtgtgcagacgntgatgatctgtatantctagtcgcacagtgagtcgttcgcgcaatggcgcacgtgagtacagtgatntcgataacgcgatgcatgagataantgagcatgagattatgcntcatgantggtcggagtgtctactcgagtcgcgcgaatcccgtgcgtacgtctgtgtccgtaggacagacgtgatcgcgaggtagtgcgtatctnggagcgtgagactcagatgttgtatgcttatcatgcgcgcntctccagaatcctccatcagcnccatgagatgcatgcatcatgtatatagattcagacgctgcatattgtcgtgcanccgtnggtgttgcgtagtactgtggagcactcnactatacgtcagcacatatctgcgcacggcacagcatccactcccactctttatgtatctcancagacgacgcgcttctcgcntgttgctacgcgcgcgacgctgagtcgtgtctcgttcagatatgcgtcattgtcacgtcagacgaactcatggtaagcatagtcggtgcgtgtatgagagcgtgacacctgttgacgtgatagtgacatcgccacctctactctgctagcgtctcgtcgttactagcatnactacgtatatcatatccaagtcatacgtacgtgcatgtatgctggangtgcttctatacatttctatgttatctttcttgttggtcgatgactagcagatgtgcactctggcatactaccatagtggattattcgctcgcctacactactagttttctgcgatattctntggttatttttcatatgtatacttatcgtttccatcactctgagaatggcggtacaggctgaatgaggatttcgtctatgggatttaaagaaatcattaatgtcgggcgttaaatatcgagacgcttcgaggcggggctgtccttcgttgagctgcgacatgccctcattcctcacccaatcctgttcgtgccatccgcagtgagacggtgcctgcacgctgaaaaacgagagagcggggccggtgggtgtgactgtttgtcgagctgctttgcgcgtctgtccctcgatcgtagttgttgaagtgctgatcatcacattgtccatgagcggtcctcgtctccgcaccccgccctgtcgtcgaatgtgggtccatgatcattttatcgtatcctttcacgccggcggataatatgagggccctcactattttgcctctcacttcccaatagatggggtggcgtcttcgctgcgggtctcttctgc

SEQ ID NO: 10810 - DNA, 1298 bp, Homo sapiens
  misc_feature (1)...(1298): n = A,T,C or G
cgacgctcatgacaatactatgtgtacgaccgattatatctatccatcgatatttacgtcntgataaggtgatgagaagggatggtcggaggctctaggtggagattgactgagagcgcatatatagtatattatagtgngtatgatgttacggcgtctgacgtcggcacgtgtctgtccgagtcgaggtagttatgacgagtancgatagtggtatanacttatcntacaactctcagcgtgaccgtgctatgagaatactctatgntactcgctagtcgtatgtttcgtataatncgtgatagtccgactgccgcatggctccatctcgcgtcgcgttgtgctgtatgtcaatgtatgttctagagacatacatgagtgtaggcagacacagtgagatctgtcgtggtgcgtcgtcgcgttatnacgtggtagatctgatatgcgcgcacggatccagtcgacgtacgcgctattgctcttctctcatgcacgatcatatanagttgctacggcatctgatacgatcatagtgccgttggtcgtaagacgaggtcgagagattaatagcctcgttatagtgtcccttccatatcgtattctcncnctcatctgtcttctgtgatgcgtctctcgtcttatcctctcaatctgtgtgcgtccgtgcgggccgcggtcgcgttcgtgtgtggcgagttgtgatacattgggaaggcggagtggcggacaaggtggcgaagtgtgacttatcacggatatatgtgcccactttacaagtatatcaggaatacatgggacggtgtgaagtgggatgctctaccgttttcttcatgttgtgactacgatctccactaggtggacgtggcgtgtaacggcgatagctaagaaagtaccgcggtgcgttcccttgtgctcgtgattcacgatgtgaggaatcctcgatgcggttggtagtattcggtctacctctcgcnctgcgtactcgttgagtcgttaattgtagagcctatgaatggtgtttgtgtgtgttatatagtatatggttattgttactgtactccaagccgcgaggctgtgatttcagtgtttatacttagttgcatgcacatttccgcttgtcgtttacaacaatatctatattggccttctcttctcctcatgaacctgaaggtccatatgtctaaataaagaattaaaataatggctctcgttggctaacagcgcggttagtgttttcccgcctaacctatcgtgtttatggttttttctttttttgttggtctgagtgctgcccggct

SEQ ID NO: 10811 - DNA, 469 bp, Homo sapiens
caggtcctggctaatgctgggaaacaccaagctgaagaagaatgtttcctgccctccagcaaagagatagagtccaagcaaataactacaacagatgtgaacgcggaagcacaaaggaagaagctaatgcttcctgggagaggtgacatttcttctgggtttcgatacttcttctagtcctctcacatcttaaatctccattctcagtattctcagtggagcattttattctgcttctatgatttggggcaaaaagaagagaatctatttgataaagtacttctagaaagactggcagaaaagactctgaaagactttctcaggagtaagaaacaacacaactttcttaatattcctgtgctgttttcacatgcaaaaaatactttccccctcctacctcatcggtagggcaatggacaaaatggcttttcttatagtaaatagcatgttccatgtaaaaaaaaaaaaa

SEQ ID NO: 10812 - DNA, 427 bp, Homo sapiens
  misc_feature (1)...(427): n = A,T,C or G
cctaggggcctgtattgcaggagctatatgattgaaactaaatttccaagaaaccctgctattggaatccacaatgagagactcttgctttggactttgagggtaaaagagaagcttttgtgaaattattgcttcttcagtagtacttgagagagatggggattttgacagatgggaggttttgcaaaagtattgtctagaaaattatccaccttagtggtggaggcagccttgagcatcactggtgcttccagtggttcctgcaacttctgggctccttgcaaactagatatgaccccacggtctagaagaggactttctgactcagttgtccttcctttattatggatttgtgggcatctaccttactgtattaactgttgtcctataaatatactttcccgcttgaaaaanaaaaaaaaaaaaa

SEQ ID NO: 10813 - DNA, 1663 bp, Homo sapiens
  misc_feature (1)...(1663): n = A,T,C or G
ctcgatgaccgtgcgactgctgagttggtgtcgactgcgtctctatagctngtacttaaatacagtatgtgtcacctgaacacgcggcgtgtgcgcgtgtgtcgtcgctgtgtatcgtcgagaagctagtgtgcgtgagatagatccgctcggcttcagtcgcanctatctgtgtgtcgngattcggctgcgacacagtctcactgtactccaatacactccgtcgcacagctggcagagntacnatcataccagtaccagatatcaaaatatatacgaagcgacgtacactatccacantgcagcgacatagtatctgctgtgagatacgcgtctcgatgtgcacaagcattagtgccgcgttgcgcgttagtcacgtgcttcgacacgccacgtagcgaagatggtctgatagtgcacgatattgtccactcgactattgtgagcgttgtcgcggtcgaaatgtgacgcgtgcgggctgcgcgtgcatgttcgatatgctgaagtagaatanatagtaatgtggcgcacaagatgtganagtacatgttatctgggaattgacgtgtagcgactacaacactcatgtagcgaagtgaggtnggtatgacacctcatggacccaccatcagatccttgccacgctgtaccatgctgctgcattgcgcatcgatgctacatccacacgcatcatatcagatgtcacgctnatacaccatctgccacagtaaactctgatacattctgactactgctctctgcatgtatatatgataaccgcacactcccgtacantcacgtctngagctgttgtcgtgaccgcctatgcgaccgctactcattctctacacagatgcgtatcataatcggcgccgagcgccggtcatcgcaatgcgtgagcgagagacgcacgaagcgcnctaacatcgtcagcgagtatttgatatcgaggttgtataaactatgtatgaatgtcgtattgtacatgtatatagacactnatcgtacgtcgtgtgtgagggtcgcaatatcatcgtcgcgcgctgtgacncgtcatcngtttcgcactccttatagtcgacacatatctntacactcatctactaatgtagtggcgtcnatttatatactgtatcgatttatcaattgcagcgacatcttcaccgcactgatggtgtantcagctagtctgagagtgagtagacgtaacaattagcaacagtatgactgacgtagaggcaccagaaccgctcctacgacgacagtcgcgctgcgtgtgcctcgtgggtacgagagtgctagtatacgtgactagtagattgcgatgtgacgtaattagtggcgctctacctntctgcagtcattgagtcgactcgaggtgganacagtgacggtgangcgcacgtctaactcagctgacgactagactatcacacatctggtatgatgtganggacgatacgcctcgcgatgccgnancncgcgactagctaaagagacatagctagttcgcagacgccgtgcgagacagtgatatggtaggangcatctccnagaccgtatatangttcgtcatgatcatcaggtggtgcattagatagatgacagacgcactcgcagagctctatactatagtgtcgtatcagtatttagaatgtattac

SEQ ID NO: 10814 - DNA, 689 bp, Homo sapiens
cccgacctccggacggcgcacgcgtctgtgtctagaagatatagttgggacgcgagccctcattgccataatcctgcgttataatgtctgtggtgccgtgtctcgtgcctctcatgtcatcgtcgtgggcgcgaacccactctccctcgttcgcctctcgccctacgcacccctgggggctgccgctagagtgccccgtgatctcccatgctgtaccacatccttccaatgcaggtacgagtaagcgagctaatgtacaccacgatcgccgactagggggccgcgtaagcctcttctctctatatcgaatcctcgcttgctcgcgcgcggccaatacggaacactcgccttgttcacggcttcgccgaaggcgggtggctctctgtagtagaacttctgcccgcgggcccttctttaaaacagagatagacctttccgccggttagttttttctcaacgccccgcgggaaaagaacactcccaccattgttgaaggtcctccccatagttggatttaacggcgctttcccctcctgtccgctcagaatctccccacgggcctcctttgacccttcgcgcccgtgcccccatgttttcggttccccctactcgcggagtgccaacacaatgtttgcgggtaggtgttttctcatatattgcctccccccgaaaaaaaaaaaccggcaatt

SEQ ID NO: 10815 - DNA, 545 bp, Homo sapiens
ccctaggtcttcacttgactggatattgcccaccagtagctggggaagacaatcggctatactcagtctaccatttcaaatgtttgtcatgcagaaatactctcccagacacgcccaagaagatgtttaaccaaatgtgtgggcagccatgtcccagtcaagttgatacatgaaatcaaccatcacagacacagtgtttttctgttaggtgagttgaccaaacctctcttcgactctcaatcgactttatttccttgggaaatattttaatttcaggagagtccttttttttttttccatctgatcaatgttaacagccaagaattgagaaattcggaataataaagtaccatagtcctactttgggatgtgactgtaagaattttaagaaccatgagacataaatatctcttcttgccaaaaggacatccatccgatgggtttgtttcttccccaatgcccaagtcaattgcatttttaatgttgtattctatacctgtcacgagttaaataaagccaataaactcatggcctcgttggcctca

SEQ ID NO: 10816 - DNA, 196 bp, Homo sapiens
gtctcaggcacaaggagacattttagctggaggacttggtaggaagacgactaaagggctacatcatgtcaaaccctcaagtaggaattattgcctttcttgcctcagttcccagctgtattatgtcaccaaatcacatcacagtgtaatcaaagatgaataaaatatttttttctttaccttaaaaaaaaaaaaa

SEQ ID NO: 10817 - DNA, 124 bp, Homo sapiens
cctggctctgcgatgtaccatgtatgaaatgaacaaaaatgcatgtctcacgggccatagattttagtgggagtgacggacaacaacaaaacaataaatgagtacaaatgtaaaaaaaaaaaaa

SEQ ID NO: 10818 - DNA, 271 bp, Homo sapiens
  misc_feature (1)...(271): n = A,T,C or G
cctanaaagaggagcatgaatgccaatgctggaaaaaggaagatgtaataagtttctagaagaccaagaaatcatatgttttctccaaaaaaaattatagaaagaggagaaagagagaccaggaggcagacatgagagtcctgatcccctactctggcacaaaaccactagtacatatgcagtagagagtttgcaaaaggacagaatccccaatgtatccactaccactgctttaataaaagtaaatgttaataacctaaaaaaaaaaaaa

SEQ ID NO: 10819 - DNA, 147 bp, Homo sapiens
cctagatctcccgatccactgtcttctgattgagggactccaacttgatccagcaatcaagctacgtagacgaacagaaacagaattaaagcaattaagtgagtcaattcaactcaccacacttcggtttttgtgtgtacctaataa

SEQ ID NO: 10820 - DNA, 242 bp, Homo sapiens
gctagtagccactcgggagaagtttaaattcattgacctggaataggataaacaactatctttccaaaacccttcaggaagggggagtgcccccaatttttaggacaaaagagtttttacagatcatagtaaatcaataactcgtagacagtatgacagatacagaatatccttacttaagatgaaaaacaaattgtacattgagatctttaatcaataaaaagctggcctcgttggcctga

SEQ ID NO: 10821 - DNA, 382 bp, Homo sapiens
  misc_feature (1)...(382): n = A,T,C or G
taggaatacgtgtggtgttttctatttcattgcgagtgatattttcaataaacaatatgagggctcatgcgctagagaagggtttcacaatcaatgagtcaccatccgtcccttgggagtcactggatttgtaggagaacccctgcctgtggataggagaggagacatttttgattacatgcagangtatataccgggatcccattgaccggagcgaatgaaggctgtctcctcactgactgactcaacctaataggagtcttagttgatatcttaacctttgctatgtaagggtgtttggtgtttttaactgattgtttgttcttcatgctattgattgtgatgtactcaatacaaccctgggctagttagcctcagcagg

SEQ ID NO: 10822 - DNA, 776 bp, Homo sapiens
  misc_feature (1)...(776): n = A,T,C or G
agggagatgncggtgcagtatatgtcactagacctccctcgaaagatttggtctcgagtttcacccatgacagactagtggggagccttatgttggactggcaccgttccaaaatacatatgagggtcatgcgctaaagaggtctacaatcaagagaatgcaccatgcagtccttgggagtctttggatatgcgcgagatcccctgcctaaggataggagaaggacacattggtcactacgtgcagagtatgtaccgcgatccccttgaccgagggcgaatgaaggcatgctccgtcctgacttaatcaactcagacgatgcgctggtgatagagttaaacttgtctctctaagggcgaccaggcagacttcccccgattgtgtggtctgagagcgacggatactcgggaccacgggtatgcctacggcgctccacccccacgccgggccggctagcccggacaaacctccttctccgcgtcactcctcacgctcccctacactcacgccaccttgccccccccccccacccctcctctactcctgatgctcactagccagtcagcgggctatcaccgccactaccagaatccccgctccgcccacggccccggtcttatttgtctcacccccctgacccgcccccatctaatcccgaccgtcagtgcttgtgttatgatacggcccaccgctctccgccgcgcctcctgctgcccggcttttataccactcgccccaatctcgtcaccccactaaggtgataggctcaccgcggg

SEQ ID NO: 10823 - DNA, 601 bp, Homo sapiens
  misc_feature (1)...(601): n = A,T,C or G
cctanggagcaacaaaactatttcattattcaatgggacaagatgtggcccttgggaatcatcttattagcatgcaagaacaactcttccagcaaaagcatgtgttaaaagaacagtgctttcagcaatgcattggaaatcctttagccagtacgcacacacttttgtggggaaaagtcatcaatgtgagatgctccatgacacctcaagaatttaaagaatgacattcaaggaactgatttgtgctaacaattctaactgaaataacttttccactttattttaaaaacttctcacaaaaggtatgttaggttatatgaatagtcagtggaaaaaatattattaatacatgttaaattcttaagtgttccggaataagccagaaaaactgttttcaattattctttcatttttatttatttaagtaattatgaaatagcaaaattcataaggaaaaagtccccagataattttaagacaataattacatagttgttttattaattattaagctgtgcattttctaccaaaggaatggtggtgtattttctatttttatgtcaacattaatgtcaataaaatcctggcctcgttggcctca

SEQ ID NO: 10824 - DNA, 269 bp, Homo sapiens
ccagtacgcccccgtgagccgtaatgcaaagtcttcccgcgacttgaggacaaacaactatgcagcttatttaatcagacaatgctactggagacttccacatgtcgtagagataccacaatttggggtgtgggaaattattaaaagctcagcttgacaacaattgatgtaactattttagagaagctaccatactcacattagatctgctcaattcatatacaaagctgaaatttcatagaaataaacaggtggcctcgttggcctca

SEQ ID NO: 10825 - DNA, 154 bp, Homo sapiens
  misc_feature (1)...(154): n = A,T,C or G
gccagtactcgactgactcatcgcccgtatgggccggcggagaccgggcgccttgagtgggaaacaanagctcttcgttcatgtggccagaccaagtacagttctagacatcaaagaacctacaatgaataaagcaatggcctcggtggcctca

SEQ ID NO: 10826 - DNA, 167 bp, Homo sapiens
tcataggaggatcatatctggatctgatatcgggaatcctgtgcctgactcacagatcttggattttgagctgcgacacagtcaccagatgagatctctgtgttgctctccctgggcaagaagtgataatattctgtgtgaataaagggatggcctcgttggcctca

SEQ ID NO: 10827 - DNA, 394 bp, Homo sapiens
gctagatggaccctcctctgtcttccagctggagcgcagtggcatgatctcggctcgctgcaacctccgcctcctgggttcaagcaattctactgtctcatcatcctgagtagctgggactacaggctcatgttgccatacctggctaactgctgtatttttagtagagacggggtgtcatcatattggtcaggcttgtctccaactcctgacctcaggtgatcctacccacttcagccgccaaagtgctgggattacaggtgtgagccactgtgcctgtcctcaagccagtgtatttagaatatgcatcacctcaagtatatatcatttctctgtgaatgcattatctttaaactggaagtttgtgaataaatcactggcctcgttggcctca

SEQ ID NO: 10828 - DNA, 344 bp, Homo sapiens
  misc_feature (1)...(344): n = A,T,C or G
ccagtaattaccacataacggaaggtcccgagccacaacctaggaaccctgctcgtctctttaaacatgtgtactcaccaatgtcaaagacctctcaaatgatgtgtaatantaaccagggaagggaaagagttagtaatctttggaagatttattaaaagaagggggatacgaagtggatgattgacaatatacacagtctccttgtcttcatcaagaagtgaagatgtaggaggagaaacggtacaaatttttgcctctccaaggaataaaccaggggggtaaagaacagaaagtaaaggacaaaaaaccaagcaaataaaaacctggcctcgttggcctca

SEQ ID NO: 10829 - DNA, 366 bp, Homo sapiens
  misc_feature (1)...(366): n = A,T,C or G
cctagtaagactaccgaggagaaaaggcttannatgttggaacgaacaagcagtccatggagcagttacacacactcatcaattaaggggggctgtgttatatgagggaaattcatggtaccccaaaacaattaccatagtaacattaaatatcactgatcagagaccaccataatgatataataatgatgaaagagtttgaaatacttcaagaattaccaaaatgtggcacaaatacccaaaagagagagatgctgttgaaaaaatgacaatagacttgctcgatgcagggttgcaacaaaccttcaatttgtaaaaaatgcattatctatgaagcacaataaagtggggggctcgttggcctca

SEQ ID NO: 10830 - DNA, 364 bp, Homo sapiens
  misc_feature (1)...(364): n = A,T,C or G
gttgagactcactacctggcccctgaccctgcctttgctgtggtctttctgcaaccatgaagagctgagtgtcccanggggggctggggggatttgcccannatngtgccaancgggccgcgaagctgcacgggtcagcccccttctgaggaaaggtctcccttgtccatcaccagcccctgtttcatatgaaccagtgtggcctggcttggactacctctcanggattggaggtgtcgatggagtgctggattatggatttcaaaaaaagaccanagctgaagtctgctcccctcattgtgacaacaccatccacagagcagtgaaaaactcatgaaataaaccactggcctcgttggcctca

SEQ ID NO: 10831 - DNA, 855 bp, Homo sapiens
  misc_feature (1)...(855): n = A,T,C or G
aacgacaaggagctcacgcacaaggcgccccaaaacgtttggggggaccactatatttatggacgacgcccaaatgggtttggggtgtgcgtaattcagtccatagcaccgcccaaaccacagaagctgccccgagctgatgtcccgctatcggtgcggctgcaggacactgtcccattgctgcatggagcctctcgctgtctgagcctcacctgaagccggcccacaccattttcttactctatgcattggatcttttatgccgaagggactacgatgggtgattcctaaagctatatttggctcagaaaaaaatgcattaggaaaactccctgcctgaatgtttctaggtattcacagcccgggtgactgtgtttccataacgattggcttctgaataagaaccatgggccgaactgaccagcctgctctttctactatcaaaacctcgcctaaccaaagatttctcatgtaaaaaacgcggccccggaaatacacagcctggcccttcgttggcctcaccgcgggaacctctgcgggcccctcccctcataccgagggctaacccatgagcctcccccactgaactccgttgcgctaggncgtccaggtcgcggagaccgccccagcttcctccaaggcgggatgtccggtttgtcgctcaacgcgggggtcccctgccagtacaaccgttaactatcagccccccaagagccccggaacccccaaggaggcgcgcctcgcttgggtttctcgcatccctttcccccggctccgagcagtccaaaatcctaccctccantaagcggcgacccccccggccccacttcactacatccacgttgtcccccctgg

SEQ ID NO: 10832 - DNA, 374 bp, Homo sapiens
taccttgtgaagagcatcacaagacgaaagatacacagtatctacaacccaacaaaatcgcaaatctacaacccagaattttagaagaatgatgaagattatcacctaatgtctgaagcacatgacttgcaaaaatgattggagagcatgatagtatgacagactgtataaatcaatcttgggggaagaaacaactcaacaaccagcagaaatcctgatagtaactttgatcttgggttttgtccacatagatctgatacctctctgttttctcatcatgggtgttgatgaataggtttgtggttttcttcgtcaataaatagatgagtaataaaaagctggcctcgttggcctaagcggggagctctcggcca

SEQ ID NO: 10833 - DNA, 343 bp, Homo sapiens
cctgttaataccggccatctgactaatgctttccaatagaacatgaacagaaaagcaacggatggtactttgaggctaaagggttaggggccaacatttctccattttccttttttaatacaggctaaattcagatgccaagacagactctagtggagggtagagaaacaaattgaaagaagcctgatttcctgaatcactggagagaagagcctcctgctaacttcagacatctctggggtggtcgtcactgaactttaggggacctatttgttacatcagtttagcaggccctaatgaatacagcatctctctcaataaaagggtggcctcgttggcctca

SEQ ID NO: 10834 - DNA, 134 bp, Homo sapiens
cctaggtgtgactgtgcagcctgttgaaggaagccacaaggaatccctacttccatttttaattaaggaactccttcaacatgggttacgagtgcacatctgctcacaataaatgcttggcctcgttggcctca

SEQ ID NO: 10835 - DNA, 132 bp, Homo sapiens
ctaggtatgactgtgcagcctgctgaaggaagccataaggaatccctacttccatttttaattaaggaactccttcaacatgggttggggggcgcatctgctcacaataaatgtatggcctcgttggcctca

SEQ ID NO: 10836 - DNA, 155 bp, Homo sapiens
ttaggccacaaccaaccctgatgttgggcggatgctcgcacaacttgtcagaggctggcagctggtgtgcaaaccaaagcggggtgggggctggggcctaaatgtcaacctgtggctatcaggacaggaataaaggggtggcctcgttggcctca

SEQ ID NO: 10837 - DNA, 156 bp, Homo sapiens
  misc_feature (1)...(156): n = A,T,C or G
cctaggccacaaccaaccctgatgttgggcggatgccggcacaacttgtcagaggctggcagctggtgtgcaaaccaaancgcgagtggggggggggcctaaatntcaacctntggctatcaggacaggaataaaggggtggcctcgttggcctca

SEQ ID NO: 10838 - DNA, 241 bp, Homo sapiens
  misc_feature (1)...(241): n = A,T,C or G
ccgtcacccccccaatgccccgccccttccgcccccccaccagaaaggttttggggctacagntagcttgagttcaatgngacagnaccnaataattaaaatccaccacctaaagtggagaaatggtgtaatggttatataaaaagcatgtcttactaagaaaaattaagcagcaatatattctgatctggtgaagaacagcaagttaaacatgacaaaattcctggcctcgttggcctca

SEQ ID NO: 10839 - DNA, 489 bp, Homo sapiens
ctaggcagagcaacagatgaaatgtctcactgaggacagaagcactgggatgcctcctaacccgggacggcttcctcttctgcagcgtccgtgtttgtcagtgtctcctctggatcaggcaggcctcagacctcactaagctattccactcaactctttcttcccgtgcttcctgactccaaggtatcaggcaaacttgttgatccatttagacttcactctcaccctgcttgtctcttttcttcgcgcacaccagagctacccagaaccgcggtgatgcctttccctggcagggtcaggcctactgtggcagtgtcatgaacctttcctaagcaggatttgtgaagagggcaaaagctggcatcagcaagacatgttttggtttagacgtctcagtagacattgcagcaagttaactattgctgggttcttgttcgaataaaatgtactaaaaactagggcaataaaaagatggcctcagtggcctca

SEQ ID NO: 10840 - DNA, 303 bp, Homo sapiens
  misc_feature (1)...(303): n = A,T,C or G
gctaggtgtgacgnagaaaaggcttttcccaagcaacaacagtatcaaaaatattaaagtaacagtcataagtgttaaatatatgcataatgcaaagtggtcatcagtgcaactgccagttattgaaagactaatctttgagatagcagcaagttgttggagctgaatctgagtcatcaggaaaatcactggaaaggatcaaagaagttcacagacagaagattctcttttgttgctaaatgaagcaaccattaaatctctaaatgaagcaatacatccctggcctcgttggcctcagcggcc

SEQ ID NO: 10841 - DNA, 155 bp, Homo sapiens
actggggctgatagaagctagtttacttcacagcctctaaggatccagtgatgtatggatgaagagaggacacacacaaagccttaccagacacatggctgtaagatctgaaaaagttttggtttgaaaataaaagtatggcctcgttggcctca

SEQ ID NO: 10842 - DNA, 153 bp, Homo sapiens
tgatgaatcctatcatcttgattggaccccaaatttctcaccatgtgcctcttaactacagtatatatggctgcttctgaagatggcacaattaagaagatgactattttaattgaggagctactgaataaaactgtggcctcgttggcctca

SEQ ID NO: 10843 - DNA, 366 bp, Homo sapiens
ctagtcgtgaccaaggcagtggtttctgttgctgctcccgtcaagaagtgccttcctatcctgcccatctgctcacatttctatcactgcagctcacagacttcggttgtctttcacaccccagacagaaatgcagatggcggacacaagaggcacttgcaaaccagggacacccagagtcaagtggttgctttctatggtttacggctgtcctccttgggaagaaccatcccaaaagccatgcgcacacggggctcctgaggacatcatttcagcttgtgtcaggaaagtgcttagcagtggatcaattgccagtcttctggtcaacctaatgagcaaaataaagtcctggcctcgttggcctca

SEQ ID NO: 10844 - DNA, 154 bp, Homo sapiens
ctagatgaggcagccgaagctgatagcaatgattccatgggtctgaaaggctatgcagtcctctgacaagtaattcctgtaacctcattctttcccttccccctctcctgatggccccctctccaggaataaacagatggcctcgttggcctca

SEQ ID NO: 10845 - DNA, 206 bp, Homo sapiens
cttgggaatgcgccttcacaatgtgccttcacatggggaagaacttgccttcatatgaagatctactcatcaaagccagcagagcctgatatttaagagcccaggctctggttgtaggctgttcacaactggcttcatcattcatggacagagtgaccttgggcttaatacctctgtgtgtcagttgccccacctgtaaaacaaag

SEQ ID NO: 10846 - DNA, 322 bp, Homo sapiens
  misc_feature (1)...(322): n = A,T,C or G
ttgtttaaggattatcgcagtaatttgtgaaaagccccaggctagtnatgctgtgtgttccggtcacagatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaaaacctggcctcggtggcctca

SEQ ID NO: 10847 - DNA, 386 bp, Homo sapiens
gagtgactcgcatgcccacatggtcgagaaattgaaggttcttgcaaagtcacatgaatgagctcggaaaaggaatcttcagcctagtcaagcctcagagactgcagccccggtcaacagcttgacttgagagtttccaagtcagaaccacccagctaagttgctcttggattctttacccacaaaaactgtgaacgttaaatgtgtgttgttttaagcagcaaagtttgaattcattaaataatgcaggcatctttggtgttacttggcagaaagaggcaactcccatattgttactcatatattacaagtgcacttcttcatcaatgttccctaattactctccacacagcctcctgaataaaaacgtggcctcgttggcctca

SEQ ID NO: 10848 - DNA, 313 bp, Homo sapiens
  misc_feature (1)...(313): n = A,T,C or G
cctacncttagttactggctttcttgtcctgaagtgaaactgaccagaacattaaactctctgtatgaatcatatggaatgaaaattgctactcagtgaagcaaacagatagtccaaagtgttacaaagtgagaagatgcttatcaagaaaaatgaaagagttgatgatatgccagaagtatttcatagacccattttcaacttcctattgaaaattgttactgaaaaagaagacaagagaagactacacgttatgaactaagagttggcacagggaaagaggaaaaataaaagcatggcctcgttggcctca

SEQ ID NO: 10849 - DNA, 248 bp, Homo sapiens
cctagaggcgtacactgatgtctgctgagagagacacgaaggaataatgtaatatgaaactccctaacatgatacatatacaaagactattgagaaatcaatgtggaaaatgcaaaactaagggagaaagcattttgaaccactcatctaagaatatggtcagtattaaaaagacaagaatatcagaaaaatctcccaagttatgttcataggcctagcagaataattttttggcctcgttggcctca

SEQ ID NO: 10850 - DNA, 364 bp, Homo sapiens
cttgggagctccttaagcaagccattaaagggcaactgtcaacttgctccttctggaaatccctctcctgactaccacttccaccttactgaaaatcctcaacacctacttcatctctgaagccacctttaaagaaaataagaagtcaactccagatagatagtcaaagaattcagaataaaacattgtttaactttcataaagcacagaggaaagcagaatcccagatgctgctagaaccgtgtatgatggctaataaatggaattggccatcagaaacgagatggctaaacacaattatttttttaaatcttttgtttaacaataataaaaaggaaataaaactctggcctcgttggcctca

SEQ ID NO: 10851 - DNA, 216 bp, Homo sapiens
  misc_feature (1)...(216): n = A,T,C or G
ctgnactagcgggaatcaggttcctcctggttctcaggctgttgacttctcagactggaactatgtcattggctttcgtagttgtcaagtcatcagatggggactggaactatgccactgccactcctgggcctctagcttgctgagtacagattcatcactgcttgagtcaatgccttgaaataaacaaataaacccatggcctcgttggcctca

SEQ ID NO: 10852 - DNA, 525 bp, Homo sapiens
  misc_feature (1)...(525): n = A,T,C or G
ggacacagcnaangaaaaagtgcanccngnggcngngggaccagcncntntgcaaaggcatnccngnggnaanaggaccaggncttntnctancaanncnagntnataagggtttgggnctccaangtancanttgccaaccnnnnnagggccagtatcangggnncacataacccnttantttntacattgcaaangggtnngnanagacacnttcncgaaaaaaggcatncaaatggcntaaacntgtaganaaaanaatgtcaacctgctngtcatcaggnanacgctnatcanngccacngtntcacngcncatctatnagaatngctgttttcagncattcnnaagcaaagaagtgttagtaagcatgtaaaggaaagagatncgcttgtacgcngaggtggtaatgaaccttaggacagtcttntatggacanntgtatgangcttccgcgctnntnttgcgcntagcatttccatatgatnngnaattgcatcctcggggcatanatccgnangcaat

SEQ ID NO: 10853 - DNA, 930 bp, Homo sapiens
  misc_feature (1)...(930): n = A,T,C or G
ggtgtgtgttaccactttgcgaaagaaaaaaaaaattttgttttgttgactgcacccgcacnngtgagnnganagaccggaggacgaanggatgactgaggaaggcaagaatttagaagcaggggtggggctagacttttaagatggaatagagttcttaagacataacacttacactgaattgcgttaattatgtgcagggaccatataacattttgtaaaaaggtagattagaatcaatgaccgtgcgctgattggactcaaatggtgaaaatttgtgtgtcgggggggtggaccgagggcgaaggagaggaacgcggccactggcaggaggaggaaaaggggaggggaggcgaggagaggcaagccgcaaaaaagagggccagaaaaagggaaagccggaaagacggggagagggcaggacgagaaaggagagggcggcacggagcgaggacaagaagcggaaaaaggaagaaagaggagaggaggagagaagagagcgaacagaggagaaggagggagggggggacggcccggcccgcaggaggaacaccgcgacaaggcaagaaggaagccaggagaggaagagagaaagcgcgccagaagagggagcggggggccgggcagagggagcaacggaaaggccggcgagacggaagagagagcgggcgggaggacgaaagacaagcgggggggagacaggcagaggggaggagagaaggagcggaagaaggggggcagcggggcagagggcgacggacaggagagagggggcaggggagagagagaggagggagagagcaggaggagacgagagaaaagagggacgagaaaggagggggagagcggggggaagggagaaaggagggcgcacagagacgagggacaagagggaaggcccgagcgcgcggggagagaaagggaggagag

SEQ ID NO: 10854 - DNA, 890 bp, Homo sapiens
ctggttgattaacacctatggaactttagaatgggaacagcggtggaatgcctttaatgaggaaaacctgttttgctcagaagaggggccgggtagtgatgataaggctactgctaactctcaacattctactcctgcaaaaaagaggagataggcggaagaccccaaggacttttcttccgacctggtgatgttgactgagttatgctggtgctgagtaatcgcaactcttttcttcttttgctatggggggggacacaagaacagacgcgcgcttgctgatccaagaaaggtagccgagacgtgtgttgtgccgcgtgcgatccgcgaggctggccaccactaatcctatcatactgaccattacttgcgccccgcggctgtgcgtattgatatattaaatatgacaagcgcgcgtaggtaccgctcggcctatgtccccagatatcctcaccaaccacaccgtcgtccttggcccagaggcaatacacccgaatgaggcgtcaccgcgcacctagatggcaccggtccggcgcggcgagtcggccagacacgcggatagactcccaccctatgcggccatccgccccggcgcaggtttttatgaggatcgccgtgatgtcccgccggcgccgcgcgtgaatgctatgacggcgaacgcctgtagcgatgaaattatatgcaaggagctaggctggggtttaataagctgctaggaggagcaattgctttaactcggggcccagggtatctccgggtgtatccggggaattccgtcctgtcttgggagccatggccgccccaccgcgacgtagggtctgagatgagccaacgtatcgacgacacgaggtggtacgggcatcaggtgcactgtttcacgtgcactgttt

SEQ ID NO: 10855 - DNA, 1439 bp, Homo sapiens
  misc_feature (1)...(1439): n = A,T,C or G
aaggaggaaaaggcananttatatanagtgncgananacaangagaaaaaannnnnnnccgtgnnatnttgcttnncatccgacgcgcnccggnnncnncccttttannangggacnannnaaaccanagncnacnacacaccanacnnaananagnnnggananaccnnanggaccaangnnngngtgtaccnnacgagagcagagacgagaaaagacgcggcgancncangagaaaagccngaaagggcacacaccacaccnaccangcncgagacanacgcgcgacaccccncacnggcgcaaccaagaggacgcaaaacgcnanncnncgccacaaccccaccaccagacnaagaccacacgaagaccnccggcgaaccacacaaaaagaaaacnggcagcgacacccacaagaccagaccncgagagaacgcagacgaaaacacgcccgctcgatcaaananaacgangagaggagnngcgagcaaagacgggaaagcgnagaacgaccgagcagccgcacaggcaaaacacgcaacgcaccacncgcgagagggcgcggccgagacgacnacgcccgcaccacagacacacacgaggcgcgcacggcgaacgccaaccgagaacgcgagcgacacgggggcagaaacgggccaaaacgccgaacacaccacaccaacngcacgcgacgccggccacgcacgccgacnccaaaaaaaggacgacacagcaccaagacaacaacaacgcaaccaacacngcacgacacgacacgccgcgcgacgcncaacgacgacngcncaacagcgcaaacaggagaaanaccaccagccgccacgaccaggacaagcggcagagaaaagcggacacgaagaaggaggaccacgcacccgagaagagcgagagagcggcgacgaggcaacgccggacccgacaagacagaggcaacacaagcagcaccaacaccacacgngcacacncgcagaggacaccacangacagagcggccgcagcacccgcaaagagggagaagaacaggcaccgcgcacccacacccgcacagcagcgcgccggcaagcccagcagacgcgaccacccaagaagaagaaggagccaaccccgaagcccccgcagcacaccgcgacaccacagcgcccccgaccacaaccgcgaagagaaaccacgcggccgcacgcacccagacggcggncagcgcagcgaacgagccccacaccaccgcacagcacccacagaagaaaacccaaccaaagacaccacacaacgcgacccacacgcagacaccgaccgacgagccacgcgcggcccacccgccggcgcggacgagaaggagccgccacacaaggaacaggcgcgggagggggagggaccacgcacgacggcacagaaccacagcccgcagcaaacgcagggcacaa

SEQ ID NO: 10856 - DNA, 1995 bp, Homo sapiens
  misc_feature (1)...(1995): n = A,T,C or G
aggtaaaggggggagaagggagngnagggnnnagnggggnagggnnnannnnnaannnnnnnnatnnaagcagacagatanannagagangntanacatanannagnnatanngnaanntnatnnacagagagatgannagagtgggtgtgctgagggaggggagaagagaggagagagagagagangaacgcagngaggtgtgtttgctcncnccnacgcacagaaatnnataatcncacanctccatagacgagtgagcagtcgganatagcggatagacngaggcgacagagacagcgctcggatgcgtagtccttttttggagaagnggtgtgagaggnagccggnaccgcgcgcgcacagagagcgactgccncganttccacagcacaccnacanagcatacgancgcctacctacgtagtngtggagcgtgtgtacagcncgcgacgcgcgagtangagtggacanatgtgtgggtaccgcgacggtanagcgtagganacgtctaggccgacgcgagacgacacacatgcggcagtggtgcgcgagtgccgagcgcgagtcggccggcgcgtcgtcgacgcgcaggatgaggacgggacgcgngtgcgagacgcgcaccacngcccgcagcgaggcagcgcgnacgcagcgaggagcaggacagaggatagagagntagcgagnagacgnaagaggantgcagaagagagagagagagacgcgacgaatagaacancatcgaatacatgagaganacgacatgtangtcagcgcgagcgcgantcgcnacgcaacgnacgagacgacngcggagaccgcgggagacacgagcgcgacagaggacgcgagtgttgctaggcgatcccgaggcgggnacacgcgtgcaggagagaatgtgacggcacgcnccgcgacgcctcgagcggcgtcagcagcaagcnacgcagcaccgacgacgcacgacacagtccacacaacacgcgagncacacactctacgcaaggcacgactagcntcgtctcgcgcgagcngctgtcgncnttcgccactcaacgtcggcgtgtgtcgtcgtctcgtctgtgagtacgnacgccagtcgcaggcgcgctanacctcgagtgagaggngcgcgcgcgcggcgcggtcagtatcgagcgacgagtattcagagtgtagtgtgagtgacgctntangacgtgngtactacccgcantacggtcgtgangacgtgacngactgaacgcacagtgtggaggnagagtngcagacgcgacncaagaggcacgcgacatncgatngttgcgcatgatatggtctnatangaagntgacagngtacaaggagtagagntgcgcgagcagcgcgagacagagccgacgcgaccgacgntcgtcgtgagtngtacncgcngtcgcagcgcgacgncgcgctgtacgcngcgcgactgctactgcagcacgacgagcgcagncngtcgcgcgcgatgacgctcacntncngcagacagggacgcgacgngcagtcagcagtcccggcgacgcacgacgatgccagcgncacgagcgacctagcggctgacacnacgacgcagttagcagcgancatcaacgtcgacgctgcgcgacgacncagancggcgagtcccnacgtacgctctatgggtacatatataatcacacagacagnccgacgccgncgngacagtcgacgacgtngtacacgacnnantgcaggcgcngncaggagcgnacgtccaggcacgcgagagcgagccttagacagcactcacgtacagagatgcacgtacncgcagctgagacgaagcnggaccgctgcgccgcagagcactaganacgatgacgacgcgcggaaggagagatgcgagcatgagctccgcgcagagacgatcactatcaccaggtcagcgnatgacagagcacatgtgagaagcggactggangacgtagaagcgtgcaagtagtgcagg

SEQ ID NO: 10857 - DNA, 904 bp, Homo sapiens
gattatatagaatacagacgaagaaaacgccggtttcggttacctaataagaatataaggaaggcaacaacaggagaagatctggataaaagatggacccgaggaaatagggggagtgagcaacaggatcagtaactattgcattaatatgaccgaggcttagattaataattatatatagtaaatacacataagcaaaagcaaaaagaaaagaaaattttagtaaaacgatgagaaagaatttttttataatcagtgggggcttatagtagaggagtgagcttaaggagataaagagtggggtattagaacgttaacctttaataaggagtaataaataaaactgggaatattagtgcaatgcaatatgagatgaggttgtgagaggcggaaataataaatatattctgaaaagatctaccaaatgaaaaaatgagggacgtcactataataaaaataggaaaatagatgtttagtataggggttgataaaattaaggtattaagtgtgcaaggtgaggacaaatcgtcctaattcagaagagtgtataggatgatgaaaattaaatagatatcaaatcaaatataagtgtgtagttcttatgatatggaagaggacgtttataagttgttatataaaaaattatatagagataacggatagaaattataagtaggtaataacgttattgagacgttcgaagagattggagggtcatgaaagaataacatatgaaattaagagttatcgtgtagtataaagaaaaataatgtaaaagtagataggagagagatagtgtaggtacgtgaaaattacagcgaagagattataattgaaataaaagcgagataaggtatgagaagagaggaatgaatagcgatagcatgatgtggtacgaggtggt

SEQ ID NO: 10858 - DNA, 114 bp, Homo sapiens
caggagattaagagaaagagatgccatcttcaaagccttggtggagcaacttctagacctccttctcatgataggaatgacgtttaaaataaaatcctggcctcgttggcctca

SEQ ID NO: 10859 - DNA, 282 bp, Homo sapiens
ttaggtgacttatatcacagtttactaatgttgaatcaatttccccattcctggaataagccaatactattatcctcaccagtgctcagtcattgtctcggggcgcaaagcaggggaagaaagtgtggttttttcatgaacaccaagtggatctaaaagggtggcatccagaggctgtcatcaactacgctcctcatagcagcttctcttaaaggaaatttgagcggcttattttctgcagccggcacatgagtcaataaaacactggcctcgttggcctca

SEQ ID NO: 10860 - DNA, 289 bp, Homo sapiens
  misc_feature (1)...(289): n = A,T,C or G
ctccatctgatggncatcccccccaccnnttgttggggaanaaacccccccattcctggaataagccaatactattatctttcaccggtgctcaggcattgtttcgtggcgcaaagcaggggaagaaagtgtggttttttcatgaacaccaagtggatctaaaagggtggcatccagaggctgtcatcaactacgctcctcatagcagcttctcttaaaggaaatttgagcggcacatttttgggtcgcgtgcacaagttttaataaaacactggcctcgttggcctca

SEQ ID NO: 10861 - DNA, 1266 bp, Homo sapiens
  misc_feature (1)...(1266): n = A,T,C or G
aaggatgcgtgtggagaagagagtgttgaatgaatggcactatacccgaatgagagagagacgtaaaagtatacgtagaagatagatggtggtaccggtcacggtcttacactagttattatagtagtctaagacgcgtgggagtgtcgcctgcgttagaggcccacccacaaggaaaagcagagcaggctgcggatcgtggggagggaagcgtatgaagccgtgtgtatatattagatcggcatacgccgcggtaatctgagtgctgtattgtggtggagacgtagacggaaagagctagagaaaattgagctcagataggaatcgtgaaacaggtgggcggatgtatgtgggtgtggttattatagaaggaggcatgggtacggatgataacggtaagtgtgtgtgtgcatgactaatactatattgaataggtgattgaggtatggtgtnggagaccgcgagcagaaatacatccgataatctcataggtctcgcccagttcgttctcttgtcgtcagtcctatcgagcttgtgactgctacgtaatacgttactaatgcgtatcaaaattatatatggatgttttgttagtgaattagtcgactaagtagtgtatgtgtagcggttcgtagcgagaggcgtcgggttgggttgtgtcggaggaagttggagtatgtcacgatcgtgttatcctcgccggagagggtcagacctcgcggctattgatcgtgattgtatctgatgaaggtttgagtgtgcggtatggcttggatgagagtcgatgtggattatcatcgcatgcagtgggggaggtgagtagacatgaggaacatgcgtgcggtagtgggagtggattataggctggtgtattggtgtgttacgtgttttggtgatatgaggcaggtgagaagtgatgtactgtgatgtatgtaggtaggaccgtgcgacctaaacaaactgagtntctcgatgcgccagtcaagcgctgcgtcttggttgtagtgtatgagagtcataggaacaaacacgggtaatggtataagtgtgtcttatataatagagattttatgtgtttgggatcagcactttcttttcttctagagcacccgatgggagtcggctggtactgctgggagggagagctgggctgtgatatacggttgatatacagatctgctggggtttaatttgatctttgcatgtgtagtggtgtgaggtcagtcgacagcatggttggcgacgcaggcgcaagaaagttctgta

SEQ ID NO: 10862 - DNA, 938 bp, Homo sapiens
aaatgaagaaagtaaggaagaaatattgaggatcgagcgggataaacgtacatataatgattcatttggtatgtgggtatatagtggggaggtaattagtggcggtctggggacatatacgaccatgtacgcgtgagtaatgcgaggcgtgctatttcactagctggtagtggtggggtgagtatgtaaatgggagattacggacttgttgggggtcgcgaatagtgtttatagtgatgtactaagagatggagataataaaagctgtaggataacgcgaatgattattaatagttaattagatgatccttggagcggagaagtgtactgagtagatatattattattgtacctaaaataaagatagaaatatatatgaagtaatgagcgtagcgtactcaggtatagagagtatcatggttaataagatctaattgcccatggggtggatggttaatctgtaaatcgaggtataaaggagggaggagaggtcggtcctagaagtgagttgtcgagcggtgtggcggcgtggtcatcgtgttatcaggttctatcgggcgagagtggaagatacataggcagcaggtggtgagagggtggatgcacgactgaggaatgctctcgtctataggatacctctccgtctcgagtgtgtgaacaagctggtaaggccagcggtggtggcaaggtggcataagaaggagagaacacgggtgcctacaagaaacgaggcagagcagagtacagtgccagtccaacagtaaggaaagggtgctattgtatggttccaagctgtccgagagagtatgaaagagctgtcgtagagcatcgtaccagcgcccgagcctacaaccgaccgtgagcgcaaatgtctcctacagatgtctatgggagtataataagagaggtggttgttctctaaaaaaaaaaaaaaaaaa

SEQ ID NO: 10863 - DNA, 1643 bp, Homo sapiens
  misc_feature (1)...(1643): n = A,T,C or G
cccatacatanatatgatcactcngcagtagaagcagctagacgctatagtaagtgacgtgtgtcgctacgtgtgagtactatacaacgtgaagaggagtacgcgagtagtgcncatcgcgcgtcccgacgagtgctctatatcggcgctgttgtgcgcacgacgcctgacgggtcgaggctcatcgtatcagcgngatggtgcgcataatacgtgcaatacagatagagaagcatcgcattgctaatctgtctcggaggtggcgccaggtccgccgtgatcgtaagtcatgcagcntcgacaagtgatggccgagagacgtatgaaagcgccgggtggcggtgtggtgcgcactcatatgnttctcatgtcggagtgcaacgacacgcgnacgcgtacgantagcccagcgacgatccgctgatatcttgattaagtggagaaaatagacgagtgtgagtgtgatgtgatagtgtnttggagagagtagggtgtggagaagtgagttgagtgatggctgtaagaggtgagttagtatagtatganacgntaaatcatagtatcgacgatcgtaagatagtgtcnaacntggtcgngggtacgtagtagacanagagtgtgtgctggcgtanttctgcgatcgggtagagtcacgatagagtagctagatgtggtagcgctgctaatgaagaaaggcacaggcggagaagagggatgcatagagagtgagaagtggtgaagtcagcganacggtgccggagctagacgtgtactcgtgggcgtacttgtgtctctctcacacatcagtatacngttcagnggtgtccactccactcttcctcatacctatcatcagcttgacggcngcaccgctcgcactgcactctnggactgcaaatagtcagcaccacagcagattagcttgaagtgcgcacatctacacgtatctcaacaacgcagcganatcacacttcacgcgcgcggcgaagcatgcagcagcgacacgagaaccacagacttagcgctacacacgtacgagctgtcnanctcacacgatgctaatcgcggcaccgacaagtgcgtaattgatatctcatcgattggacatcatgtgtgaacgcacatgtcatagcngcgcacgtgcgggcacacgccatcagttgatagaataatgtatngagcatgtattntntacgctcatctactcgctaacactcgcggacgcactgcaccnggattgctgctcgacggatgacgcnacatatgagntacatcatagactattatgctaatgggatgaggataaagtattactgcgagatagagagagaganggctcagcaagagtagactctatcactagtgtacnaagcacgtgtcttcggcggcacgccagagtgtgctcacagttcgtcgcgctaatngagctactatagacgtcgatacncactctctcacggcgctatgttatcgcagtgtctctccagccactatagacaatgantgantaaaacgacagcagcacagcgtcggtcactcgtgtacgcatgagcgacngacacagcgaacactctnctctactcttcatcgtccacacgttactgtaatcactcactgtnagcctctactagtcgtttacacac

SEQ ID NO: 10864 - DNA, 299 bp, Homo sapiens
gcgcccccatggatagacccatgtaacaagaagctgatacctctggcaaacagccagccagagcctgaggcgcttcctgccaacagccatgtgagtgagcttggaagtggatcttctgacgctgccaacagccacatgagtgagcttggaagcaaatcctctacttgttgagccttgagaagactgtagccccagccaacaccttgattgcagacttactaggggggcctggaccagaggacccagcaaagccacatcccaagaggtaataaatgtttgttgttttaaaaaaaaaaaaa

SEQ ID NO: 10865 - DNA, 1961 bp, Homo sapiens
  misc_feature (1)...(1961): n = A,T,C or G
gctgtatcagtgantanagtgattagtagtactcgatgnagttcntccgtagaggatgnatgctntacgacgantgtanctccatcgcgttcatgatgctctcagctcgatgagactncgcgntgatcatcaatccagnatngtncngtgactaccgttgacgtagtagtgcattgagntatantgncggattcnctcagcacggttncacgactcgcgacnctctacctcatcactgtgntgatagtacgacctatcngatgcntcngtcctactaccagtacnatactatccataggcgaccgtcagctgtcctctcagantacttatcgatcatctctgnagactaccatcgtacgtcantatcgacatctctgcctcgtacnctcatgtctcantccncgcgtgctaatctctactactcacgctcccttctctacgacncagnttgtacacgcatcatatactnattgacgtgtgtgcgtnctgcnatcgncgtacganctgcgtatggtctgttgtgcttagcgtcnctattcgtcatgcttacatntctcaatcctctgcangtgcgtcgatctgtcgtacctacccgcanagcgacgactgcacgctcctgtccgtcgncgactcttacatcatacatatttactatatacatactcacgtgaccgcncnagtgcagtcaacatacgntacgcaaggttatgaagacgcggcacggagagagagtagangcgtgctacgangnggacgggagataggtttgtgcgagagtcgcactgtagatcttcgtgtgcgntncgatgctgtgttacgtctacgagagctctgactctcngtgacgctcnatcgtagctagttactacacggtagctgtctcgtgtgcttgtcacgctgactcatactnctgacgactagctcacgtgtnagctactcacacgctcgcagtagctcttactcgatcntgtctctagtctaaatacttgttcatgcgagtatacatatcggacatgtacgatgcgcgtcatcttgcgtcgcgcgtctcgangatctgcgtcggcngctagtcgatcgatgatcgtcacgcagcgtcgacgtgcatgcgcgctcgnctgcactgcagcggtgcgcgactgctcttcaacntgccggctgtcgcgccgatagagngtgcgatgacacgatctctctatctactcgangatccatcatatgtggatgactctagcattgtactatcgtgcacacacatattgtatctagtaatgtngcgccaagctngntgntgtgagagactactgacacgttacacacacgacatatctcgatatctgccttctcagacgtangcgacaactgtcgggctcatngagtgtctctagcgagngtctgtgtncgcttctgactagtaatcactcggctatgatcagctgtctcatntnttcgtgtgagcatgatgcatgcgctcgcgcacgtgggaccgcggctcgtcgcgcagatattatctagcactctgctatcgacngtctcagtcatagacacaccacagagttgacgcgctgcgtagtactgctacacgagtgagcgacgtgacggtncgancgcgcagctcgagagnagggtaggcntnagtcgtagtctgtgaggcgtcagatacagtcgattacggctcttaccactcgtgcacactccctgngaccgccggacagtacttagatatctgtcgagcgtgaccgtgtgtgctttggacatatgaataccgaggttatcacgtatgtgcgtgttgtggtcgctcatctgaggtgatgttgcctcgtcctgttaggtttcatgctcagtcactatatcgcatcgcacttgtggacacccgtctgcttgtcantactgtcttatacgcttttctcgtctgtgttgttcgttatgtgatctgctgttagcctgtcttatctatatgcttg

SEQ ID NO: 10866 - DNA, 1525 bp, Homo sapiens
  misc_feature (1)...(1525): n = A,T,C or G
gcggcgggggggcaaagtataatatactagaagagaacagcgaaacgaaggncctccgttatggcnaaaaccaangtgacaanagcgccaacggtcgcanaacgagagaaatagacacacagataagacnacacacnnacccaagtcgcctcaatgaggatgtcatccgatgcataaattgnatagtgtgtagattactgcataatgtatgttattgttnttattacataggtcnaaccaacactactaaccacgacaacggccacacgttatcaccggcttctccgcgaatctatgactgctcaagtatccaatcacagagcngagagcacgtgtacgagtatgagacatccnattgaagatagtttcctgttgcgattaatctgctctgatcgctcacttcatcgactaacgaggagtaatagaaagcaccatgtacatcacaacagagagcgggatggacgaggcacgcancntacacgatggtacctcgtcatcgtcctacctgtctaccttagcattagagccacatgcgcgaagtgtcacttcatcacatagtattgtaccgagcctccacgaggataccgatntcgtaaccaagagctccgagcagccgtagagcacacggatcgctcttagtctaactctcaccgtctgagcttgttgtttctgtaccgttgtgcgtattgttccacgatctcgtagtttcaacagcccacacatccagtacacaggagcgaatccttaagattaatgaaagctgtgtatgtagctacttaggcagcgattgctncggtgataccaatagcgacctagagatcattctcaagactgacacatctacggtcagtctctccgntatcactcacgctgcgngtcattcgcgacaccttcatatacacgacaacgnacgcagtggataataaaataacaagtcgcncncagaccgccgtgtcacgaatngcatatcgtgtnacattcgtaagtgtgccnagcagctgtgactataggaatangataatagtgcagtgtgtacgatatctacncaatgatgatgtgtactgcacacgtgctgtgagtgtgtcgatctgatcatctacgcgtctccctactntacactgtctctngtcgtcgagcgcgcagagatggacgatagtgtgcactcancactgacgcgttcgcncacgcgtagcgacgagatagttagagaaaggcattccaccatgaantatccgnatcatctcactcagctacacaagcggtagctatcgactanccgtacctgaatgaagagggagaggtntacatgtagtgagcagctcgtgcactcnnctnatcatattcactctcatcatccacgatactgtgtctagtcncncncacacatactcatatgancgtgttgtatcgcacgagagtctnatgactagacatactcncnnccactctcggatatctatacgacacgccacacgatctgacctatactcgcaatagcagaacncatagaagtcatatgtgactt

SEQ ID NO: 10867 - DNA, 1056 bp, Homo sapiens
  misc_feature (1)...(1056): n = A,T,C or G
ccgctcggcagatagcatcacgtgcgcgtgcccgcggtagctccgactgagcagactcatgcgccaacatgtgtacacccttgcataaggacgatcttataacttgatactattatccgttatataggaggtgtccggctggatggggaggagcgtagagtaagtagtagaatgagtgaatagagataatggcttgttccggatatgccgacttgcgcgcggtaatgcatgttagcccagcgagggagtatctattccatcattaanggtactcgccacgtagcttgctgaagatgagataagatgcggaagtagcgtcctcccgcggtccatcgtttgtgcattaggcgacgagctcggtcgcgcgaggggagcaagcgagcagcggcacgagcggacctgttgtccacgactgctccactcgcggtgatagatactactacgacagaggcaccagagcattaccgagcgtgaacgtaactaatctcataatataagctcagaatgctctacactcagtatccacactcaactatattatatcctgtcctttcgcacatgattgggcgtcaatgtgtagtctatggaggaaggaagtcggaactactcaacacatactcatactacagctcctgcgactcatatacgctcacaacaccagaaacccacatataaccactctgacaggcacacatcagatcacgaaccaccagctatctccacatcttctacaacccccgcgtcagtctatgcccgctgatctatacggtggggttgtgggtcctcttctgcgcgatcatatggatatgttcggacatcagtctcgatgcctacacttgtcgtgatgaacaagcgtggtgcaaagaagtcctctttatgctataggtgaagggcctggtgagataaaagagatgaaatttgatgggacggtagaatacattgtactcccactcccataccaactatcccgccccccctcacgtcgccacaggaacatataattatatattaagattatctttagtataatatatattatatcgctatcactatcaa

SEQ ID NO: 10868 - DNA, 1921 bp, Homo sapiens
  misc_feature (1)...(1921): n = A,T,C or G
agtngtctagttngcttgacacgtatntctgcggtagantatagtgactctctgaagnggtactgcatatatgagtgganngntagacatggtcggtagtctgtgttagctacttgtcattaatttaagttgactgnacatgatgatcacgtacgtttctcagtattctcgtgctcgcagactagacgacgctactaagcngagatcgatgtcatcgacgtgtagagngactaganagtagcatgcgannttatatcgatcgtcgtgtgctatatacaactntnanacacgctacaacagtctncatgcgagtaccgncatacgcgtacgagacacctgcatctctactctcatgactaatanttagtaatatactctgatagatgtgcgcgcgaaatagcaagcgcaggngtnagtggcgcgtcgcgctgtctgtatgctctctcgcgngttcangatactgacatgagatgtaaagtgcaganaatcacacacagacgataantacgactatcgnacaccagccanacacgacaaacatancatganaatctacntcgtctcaacgtcannacacaantgactacgagtgccatnagacgctgacancgtactantctgatatagtatatcgtcgtctatgatgatgngtgtagtgagtntatgatgcgtgtgcgctctaacagacgagtgaaggcgattgaggngtcagtcgcgacagcgcngcagcgcacggtgattacacgacgtantattcgtcataancntatgtgtctangacgtgctaacgtctacctgctctaactccnatctctccacgcgcgctgctacagttctnctactcacagtctagatcaaaactcatccatatgacacatncacactacgcagagagatcttgtagtatcagcacgcattangtctttcgaacgagttgtntagagatagcacacatatatatcttatactgtagtgatcgtcacagcacactcatcatatacatatgcgcgtcgcgctcgctactcgtcagtncccagttcgangactctncgcgacgcgcgatgagatgagacangtctactgcgtctctcactatctcattgcgtgctacgctctactctctcgcgtagctgcncgacctctctcgtangnatgatgtgcgaactcgncgatcgcgcgtctnctcgctgctactcatcgcattcattcactagatactacagtacacaatatacgcactcgttagaatatactgtctgagtntgtgcgtgacatacatcgtgatcgtagatccacgaantcgtctaaggtgtagaggaattatatagtgtcagttgngagcncgaacacttatacantactacgactattcgctcatatagacancattataactagctatccttcactctacaccaccactacacgattgtatctatgatgttctctagcgacatcaacgagcacacatcgacaatatatatatgaacttcactcgacacaccacactanacgtctcgatgatgagactacctcagttccgcgcaagctcggcgcngaagagtgccncacagctctagacatcagacagacgcagacatatctcttgaccgctgtctctcgtacgctatcttgactgtgacgttatctgcttctgcntgtagacgcgtacatactactcacctgtcttcaacaatggacgcaaccgcacgcgtataaatactatgtcaacatgacaacctacgtaatatctaatacatatcacatatcattatctaccaccacgcgcgccgctatagaaaatagtagtttattttcagtatttctatagtatatcacgtctctctntctgcttatctatacatcatcataatgctgncgcacggtactcttccagcgacatacattcttatatagaact

SEQ ID NO: 10869 - DNA, 1388 bp, Homo sapiens
  misc_feature (1)...(1388): n = A,T,C or G
agtgtgagtgtgcttctctatccanactgctagcggactcttacgncnccgtgtgcgtcgagcgtgttgtgctactactntattcgctctacacgtatatagtgctncgttgttgtngagtgtgctaacatgcgcgagcgctggtctgctgtcacgtantgtgagtcactgatctggagctgatcgtctgattattcatcgctgcgtgcgtgtgtcttgtcagtgtgatgactcgcgagtcgtgtacgctacttatgagtactgcgctatcgtgtgtagtctgctctcncgtgtgcactatcgtagtctcgcgctgtgataattntatatctgtcgtctccntgtgcgcattccttcagtactgtgctactgtgntctgatcgcgcgctcgtcggctctcgctagctgtacgtcgggcgacgccgtagtaagcgcgcctctcagcgtgcgtcganctgntcgctacgcgatgctgtcgtgtntgagatagctcatcactcacagtangatgtangtactactcagtgccgcgcgacgaggagtcgcgtagcgcgtgctcctgtacgattcgatatgagttgtgtagtgtagctgtggtgtagatagatgctcactagttgtgtttctctcgattctgctcttgctgcgatagaccgtctgtcattggaattcntacgcacgtagatacntgtatgctcagcattacgcgaatctcgtgcgtgctccttctggtggagctgcttgtctgttgtattctctgttgtctgggtatctggttggttcgggtggcgtgctcccgtgcgtatagacacggctcgcagggcactntgtgcatagtctgtcgctcactgcttctgtagaccctacggtccgtccggccgtgcgcgagcctcgtagtgccggttcattggagtttgctctgtggcttgtgtagtgtctgctacctgcgccgccttgcgcgcgtgttatttgcacaagggaagcgcatgtccatcatcgagtgggcgtgcttgtgcaacctaatatggcggtcgttttataagaaggaggtgtccttctgttgtgcgctcgctgctggcgcctcgtatcgggcactttgtgatgagaatgttaggaggcccgcggccacgacgtaagggcgtttgtgcctcctctgcgccgctccggcaggggtcctcgcctgtttgggtagtaagttgtttacttctcgtctcacccggggtaggcgaaatctcaatgtgtttcaattgatagcgagaaaatgggatgccaaaaataatgaaaaagaaaaaatatggcctcgtggctaaaatcggtgtgctgttccgcccaacctcgtgttctcttgtttgctttcgtgtttcgtcgtgaccgtaccggtcgcgcgc

SEQ ID NO: 10870 - DNA, 1137 bp, Homo sapiens
  misc_feature (1)...(1137): n = A,T,C or G
atatctagaaagggaagccgataggaaacaggagaagagagagaagcagacactgagacaaaaagatcaccgactcatcaggaggggttaaagttataggctggatcaagaacaacataaaactaatgaattacctagatacattttngnagctgttgagatcaacgaggtcacagcaaggtaggtatggctgagtagtctaggtggagacgcggaggcatgagggagagcggttgggcatgtggggtagtaggtacagtaaactaatggacgccttgggtgtgggtggtgcaaggtgggaaatactcatataacctacagatagtttatgtttattttttgttaggaccagcacgcagaagaacacttaagtttgtttagtttattctatttgtggtgagaagtagaagcgcagtcggcagtgcacagcagtccaagatgaagggtatcgagggngnnggcgacaaaagatacgctcgcgagcaacaacacagccaacaagcatatagtaaatatctccctcactcgntccacaacaccaccacttatgacgtcacacgagagactgatcaggagtcacgagtgggtgacggaggcccacgcaggttgacatctgagacgtagttggggatatgatgggctacaaatggtgctcgcacggaagacacgatgtcaaagtcgggcactactaagaaacggcaggaacttgacagtcgtgccacaaaccacccggagtacgaaacaataaaaattatgaaaaataaaaaataacaaacgcactaataacaatttgaagagacacataataagagaacgacctcaagaacttaaggaagactgtgtgggcagaaaaggcacaaaaganncattntgtacttgtaanaggttgagaatagcgcaggggggagaggggatgtgtagctaatcttccgcgaatagcgcgcgagaccatagcccgaagaacttcacagagtaggggaggagaggagcgaatgaagaaaatgaagtaaacgcaacgactacgtaagcaaagtgtaaaaataggaagaggggggagggagagggtatataagtatctaccataccaactatgactaatattaatatcataaaatattaaacacttcgacagccaat

SEQ ID NO: 10871 - DNA, 1898 bp, Homo sapiens
  misc_feature (1)...(1898): n = A,T,C or G
catatacatgcgtantcatggtcnctgtccatcctgaactctgtcatacncatcatatactaattcatatgtgcgacttcatcgagttatgagtacacagaccaacgagacacggtgttcgcgaagttgtgtcgtgtgcttatcactacggtgngcctcatagtatgttatattacgatattacaattctcatcgtaagtcgtcgtgtctatatatcagaggtaagaggaagtcatcagtgatgtgtacgtaacatggcgnaccactaaccagcgcagactcagacagaccgagcgcgcgcntacactcgctcttctgtgcggacctatctacancatcaagagcgctggtagcgttatggagagcacatagcggatgcagacgactcatattctcagacgacctagatcgaccacgcacatcacactcactatcctctcttgtcgttcatctatcngccgngatctccatatatctcttcgatctggacgtgcgtcctctctctgtgtctgctatngtcgcgcgcgtctcgcgcccagccttcgcntganctactgactctattacgattcgcgctcacaacgctgtcatgagannangtgtctcgaactcgtggtgtggctgtcntggacgttngtcatcatatcatcatcgatctcgactctcctgaatgngcnngcgaccccgctgtacgagatngnacgtatgtcgtcncttcacgtgtcactgacancatacgcatatgtctgcgctcgtgcgnatcgggctatggacncacacngagtgctgcgngtcganancnagaggatgantccgcgctctggaggacatgcaacacgcgagtgcgtgcatactcagaggtcgacgcgtatcgacgtgtgagatgatgatggcgagacgcactacactcncgccgcagcgtacgctctctctctatgcgacatcattcgtcagattcttcagtncacaagtcgctgatatgtgtcatgagacgtcganaggttcntcgcgtaagtacgttagtcgtcgaagctgacacgagtgtgcgtcgttcgagaagtgatcacgtagaggactcgtgcgtacgtgcacgctcggcagacagtctaagcacagcacgcgcggcgtcgacgntacgcancgagcgcgataggaggtgaacgggacttgacgtgacggtgtatagagtcaacacgcgtgagcagcactctnagatgcgtattatactagcatagcgctgacatcagattgtatctacacatcacatntctacatatacacgacacggtagcgcgtgcgtgcaacgtatgtctagaagcgncgcaggcagactcgactctntcgctactactccgtatcacgccgtcactntgtatattagctcttgcatatagcccgcttactgtgngngatantcttcagtaagaccacacacagtatcaactggatcgatagcgcgtactacacgctgtctgctgctccantcgacgngagagtacgctgagatgcantagaagtatgacggangtgngagatcatgtcaatagtcttcacacttattcatatgncgagatcttggtgttcgatgcactacgacganacagacacantgtgatagngggtacttctatnatgagcgtgcttatacttactgagtaatgtgtatgttaatgtanaattgtntcattgtcntgtanaagcatatatactacacacacttcagacaataaccaccatcgntattnaactcnatcgttaacgtcacataagtcgctccagcaccgcataccacctaccacgcgactccacatctcacttaccaacacactatatacaacacatactcacacttaactcntgaccctctccatcctacaccgcacactcctgctttctct

SEQ ID NO: 10872 - DNA, 1158 bp, Homo sapiens
  misc_feature (1)...(1158): n = A,T,C or G
ggcgcgccgctcggcgttccgcgctcgtcgtcgtgcgccgcggtgagttcgttgtcgcggtcgttctgcgctgcgtcgcgcctggcgtcgtcgcgtctcggtctgccgccgcggctcgttgctcctttcgtcctctctcttactctactcgtgtgcgctcctgcacagcgtcgcccctgtctccgcttcgctcccccctcgtcggtgccgggctggtggttcctcctccttcgccgtgccccttcctctgtgggtgcgtctgtgcggctcttgctcctgtctgggggcgtgctgtttccgcttctcgcggcgggaagtcgcgctctggcgcgcggtgcggggcgtgcgccgctcggcggccttcggcgccgctgcctgccgccgccatctcctcgtgtgtggtgctgttccggtccttccctgtcccctcgcctgcttccgggccgcgctgtggggtctcccgcgctgtcttgcgctcctcgctctcgccgcgtctgcgccggggcggcttcccgttgcggtctctcgtcggcgtggggccggctcttggactcgcgcgtgcggcggcgccgcccgggcgcctttcgtgttcttttcttcgccgcgtcccgtctccgcgcctgtctgctcgtgtgcgggcgttcttgccgtctttctccggtcgtgagctgcttcttcttggggtgttcgttcgcgtttcctcccgcgcgctgctccctgggtttgcggtgccttgctcttcctgctctcgtggtccaacagtctcttttcgtctccttctcccctctgtcgcgcgtcttgcgctcttcctttcctcggcttccgtggctgncgtcgcctgctctctgtcccgttctcgcgcgccgctttgctccctcgtcctcgcgcctgcgtcccttgcctcctcggcgtccctgtgtggtgccctctctgcgtccgcttcgcgttctgtcttcggtctgtgttgcccttcgcctgtctacatttccgtgcgcgttgcctggcgcgcgcgtcgctcccgtcgctgtgtgggtctctcgtctgcgtcctacagtcggtggtntgttggtttcttctgccaaagggncttcttcctccttcgtcttctctcttgtgtgttctcgtgtgctcggtctggtgtgcatgctgctgcgcttg

SEQ ID NO: 10873 - DNA, 1561 bp, Homo sapiens
  misc_feature (1)...(1561): n = A,T,C or G
cccccccccaccaccaatgaagacgctattcacagagtgcagcgcaaccctgaaagnttacgtggnagggtacaacgcatncccnctcacaaaaaaagcaacgtctcactgtccaccctctgacaggtaatgcagaaaacctgcttgcggccttaacgaacatcgtactgcccacgggaagctcggcggacgaccgtgactcacgtttaccatcgccgttataaactcaccaactacacaattctactacctcgcagcagcagccgagtgtacctagcaggcgctcgcgtcnccnncctactacttcggcgacgaggtaccatcctcgcatctaacgatcacgccacccgactcgcgatccgttcactacctcctaaagccgcctccagtgcgatctccataaggagtgcgacagcagtacttcttcaagactatcgcccacnntcgatcntctctttccancncccatcgcgcacgacccntcctcctctcctccaccctcctcctctcccctccnnncncgcgnctccctctctactnnngctgnctcatggtcccctctgacacacaatgtcagactcgattaagtcggagtgtggtagcacaatccaccctcntccacgcacccgacctcaccgccagcgcgccgcaggccgcacggagacgttgtgtggtctactgcaccccactcacgccttttnttctcccgccncnnctccccacaataattcaatccccaatctccctcacacacacgtccacactaagaacgcccctcacccacccacgctaccttcttatatatcctctctaagttcgagnacacgcgcgacacagacgactcgctagctgaacactagcnaccacgcaccttctgcgctctctccgcccgcgcgctcctccgcatgcgtatgcgcatgacgtgtgatagacaagtcgccctcctcgctctcntnctcacatttanncgaccgtactanatcagtcatcactcgagtgacgacagatctatctgatccccnnnctacacactatgctcttntctcagcatcgccggcccgtacgtgtatactncnanctgtatatagtatccactncnncatcngttatctcacctacactatgatctgatgcgtcgcatacacgtgcacatagtanctnnnnnnnnnnnnttntcnnnnnnnnnnctnnnacnnnnncacccacactacnnnnntctcnntntacntcgcactaactgatcgtctatcagtagtctagacgatctccagtagtcantantanntctgcaccatactcncnttcgatacanncatacnagnactntcccccntccatnctctctacncnccnccncacttgnngtactcnncnacctcctctctcnnnncnctcgtctctgtgctcncccgcctgtcacnntattnnancctaatacntnatncacgcatgcactncncttactgacactcgnctctcnctcacgcgtgtccttcgagtcgcagtcgctcgtgcgtannnnnatagtgcgagnatgcacnacacnacactgctgacgctc

SEQ ID NO: 10874 - DNA, 1429 bp, Homo sapiens
  misc_feature (1)...(1429): n = A,T,C or G
gagttcggcggacgtcgtgcgtgcgtctatgatctaggtcagcgtacagacacgtactcgagacgatgatgtgtcagagacatacagatattagagatgataaatgatgtagtatgtgtgtcgatatacatcgatggcgtatcaactcaggataagngactgtatcgtatggtgatagagagatatagattttaatttataaactttaattgttatttgtcctttgagttcatcgtttgtcgcaantataatacgaacaacacgacatggcaatatacacatcataagatcgaaatgagcttnctcttatcatctcatttacaaatctgtcgctcgcatacatcttcattgttacgagcatactgtatattcgcgtctcgcttgcaacacatgccacaagcttcgtctacnctattcagcaacacgttgtccttgtgcngttcgtgcgtgggagccacgcggcggtcgagtgctccggcgacggatgagcatgcatatntagagcgtctaacgtgtgtagtagcggcgcacgctaggagtcttcttaagaatcgaaacagcgagggtgacgacggctacgcgtggttggagtgcatgcacgatgactctcggtcgattgctgtccttttaggatgttctgcaccccgccagccagccccattagacgcacaggtgtgtnacgcgtggtgcgcgatagcgatatggcgtaatcaacgtcccggactcagctaccagtcgctgtaccataactatcagcgtagacgaatactattaacacgtaatatgtatacatatcattacgtgcagcgcgtcgcggtcgagtgcgaggcgctcgtactctgtgcattcgacagactatccttaactatcgccagacgatcagtacgtcacgctctcgtccacacataactacagacagactcgttatgatatnagagacatatgtaacatagatacacgaatagtatgtcgtagttgtgtagtttgtgcgttgcaacttcagttgtgtgtgtacactcacagcgtcaaggactcttgtgatgtatcttagtcgcacgacgggatatcgtgctaccattctctgcgtcancagactgtacctacgcctccgactttcaattattncgtgcaggatagtcgtgtcggtaggcacatgtcagtatacataacggtcngacganttcgcgagacacgcatgactctacgctagttgatgtgcgtgatagcgattgcgngcgacatatacggtacaatatatcacgcttcnctgatcactcctgtcacctcaatctccacacgctgtctgatgagcatacagactgatagatcgaaataatatagagntgtaggcgctgtctcgctgctgtacgtttatcgtattatacngtctgtattctactctatctctctctcaacaatctggtacact

SEQ ID NO: 10875 - DNA, 301 bp, Homo sapiens
ccccccccgcccccatattctatagaggtattattgaacttaagcgcggacagacctggtaaaacctaccattctactatcgtgcttctatgagtctattaacacgatgaactggatatacgaaaatacgcgtgtacctatgcaatggaatattattcaggcataaaaaaagaaggaaaccctgccatttgcagcaagatggatgaacctgcacgacattgcgctaagtgaaataagccaaacactggaggccttcctctcagattcgatcgctccctacccacctgttgtttcaccctga

SEQ ID NO: 10876 - DNA, 1084 bp, Homo sapiens
  misc_feature (1)...(1084): n = A,T,C or G
ctattgtgattactcgcccactacggatcctgtatttcgtcggttgtcctcggtcggcctctcccggaaccagctctaagctcaggccgtctcctacgtacgagtgtcgctcgttagctcgtcccgtgttgtctttgggtgcgggtgtggatgcgcataacaggtcgagctcgttgtgggtccgtgtctgatagttgcgccggtgtgctagctggaggctgggccgcgctgagccgccggcgcggtgacccgggccccggtgcgcccgtgcgaacggcgggcgcgggggtgtgagcaaagctatgcggacggtctagtgggtcgcggcacactcgtgtagagccctcctcggtcagagtcgcgagacgccagccggcgcaacacacggtcatgatacacgagtcacacgcacccacaacaggagcgcctgttctctacgatgngagctggactatcatcattccatcgggatactgcgttcgctgcgcgatgagttcctgtgcccttccaggccgcctctcgcctggtgcggcggctcgtggggcggctgggcccgaacatgcctcctgctaggtcatatcctacgtccttcgctcggctagtacgagctaaggtgccgtttcgctgtggcgtaacctgggtcggtgtaatcggttgaggcgacgatgggactcgagactgcaccacagcggctctatagacccctccgatcagggcaactgagcgtcctaagtggtgccaattgtcttagatcactctgagacagatcgcgggtactacatcactctcgggcgccgtgtgcgctctcttntctcccattcgctctatgggatcgttgatgnnatatgtcgaacaaacggacgccgggaggagtgttgtagtttatacttgctctcattcattcaaaacccggcgcggagcctcctggtaccgcaattccccgcccggcccgaggccgacggcggtccgggtcgatggtaaccaccactcccataacctgacgccgatggagtgatagggaagcgagccagactaaaaatatagacaacacactcacactattcattctagaccctcgtgaaaa

SEQ ID NO: 10877 - DNA, 1009 bp, Homo sapiens
gtgttagttatgattgtttccatgttcgcggagagtgtgtatgatattaagtggatgggattttgattttattgtaattaatctattgtatctaaactgagctgtggaaatgatgattgtatgatagcaagtgtggcgttatcgaagtgtgcgttcgtatagtgtagtgggtgatgaacaaaatacagcgaattagcaagtacatgagcgagaggaaagtagattgggaatgaatcggagtatatgaggagttgacagtgattgggacgcagtctgggtggctaattacgcttagtgttgaacaaatcagatcctgtaagcgggagggagttaattttgtctaaagtatgggtgattagcccccgatggacccgtgggatgggggccggtaatcgatgtggagtgtgcggctggggtatcatcaacatgttaggcagggcaattcggataagagtcggtagtacatattctggtgtgatagaagtggatcaagacatgaatgaaagggagaggagggcagtttctattttccagataacatggtcaggtactgtacagctgtcattggcattggatatgggataactccagttcagtataaaacattatgttattatatcgtgtactcccgccgagtaatgttgaatcgtggcggttaacatccttgtcgctgccgataaataaagagtcagagctatgcactttcatcgttatagtatagcctgaatacgatgagtttctggccggagtaccgacatatttactcctcgagtgtgtagttggaacgcgttcgggactagatagcgatttattagaatcaactatttaacgacttttgtccacattacctatagggtgcagtgagagattattaatgtggattgttttttaaaaataaaaaaaataataatggttcctcgtcggccaaaaaggcggtgtgtgctgtttccccctcaaccttcgttcttgttttctgcttattatttgaaagatttgactcggtggactc

SEQ ID NO: 10878 - DNA, 1115 bp, Homo sapiens
  misc_feature (1)...(1115): n = A,T,C or G
acaaaacgnatagattaagaagagcaccgagagataacattgaccactttaagacacgcgccagcgccatctagtatcttaacgactaggctataaaacaggctctactaataagtccttacagaagagggggtagggacgttgccctctctctgggataccttacatgcgtagcaactatgtactaaggcctcaaaagataccatagaaccagtcggacaactttaaaagtgaaacatgaacatacgatatgtgcacaatttcttgggtctgtttgggggctattcacatcaacctcgggccagcactaaaggggtttgggggagcgcgtggtggtgtcctcgccacagccacattacatatagccgcggacggacgccatgcgctgactcaattgttcagataggacagcgtaacagcagctgggcgcactacgagacggtagtatatacnagcgaaccagccagcgcagtgtgcttctgtgggttggcgttggagggcgccacaggtggtggtgcggtgatgggggctgtcggcgtacgagaaggccaagccggaccctcacactctcattaatcacaatggtggactatgggtcaggctacacgcacacggaatgtagaaccgccctattatgactcaaccggtacatgcgtacattctattcacctactaagagtcagggcaagtgccgccggcagggcgagctcaagcgccaccacacagtggctctgctcaaacaagacagcgcatgatcggtaggagttcactggcacttagcctctattatatcacgacgcacacgccttcacatcgcacacgtgacccagtgtggcacatgggggctgtagannaacaaccgcgnaacacagaagtctaaacggnggcacactggtagatcgagcagacgccgtacagaaacgcggggcaccgtggaattatggtaatagactctagggcacaaccaagacaagatgaaactttctcatcgattacagtcccaaactctagtagactgtaatgacagtcggggaggatcgtnnttgcggaacagagacaccacactatgactaacacaaatgtatacctcgtcacccaaccacctccccctcgcc

SEQ ID NO: 10879 - DNA, 1457 bp, Homo sapiens
  misc_feature (1)...(1457): n = A,T,C or G
cgtcagcgcctggtagcgacgtagagtgcgcgtacgatacctggngacacacgcgcggcagancgctgagtgaacagnagcgtcatcagtcgntatgcaanaacgatctcgctagganctcatgactcattcgtntgtctattatgctcctcgttctacggctggagcgtgngacgcgagagctggagtggttgagatacaggagagagacgcgaagtgtgggngatggatagagagatgctcgataggttgcgcggcaatcagaaggatgcgacaagtaacactagcaacacgggactctcctgacactccgatgtgctcctctctcgcactctggagtgtcgtgactgatagnacacactcagtggcgcatcgtcgagagagtacgttgaatataggtcatatgagcgaacacactctggcctctccgacgccagnacgtgtctcacttgtncgccgagtcgcgccacggtgngagctatgtatataaacgtagacgctgagaagaggcgtgtgtgtgacgtggtctggtgggcgttgtcgaggcatagtgtgagcgatgaacttaacgttcggcgtgntttcgtatntcggtgcatctcgcggaacgcgtggcgcatcgtagtgatgatgtgtgtgttcatctgtgcgacgcgcgtgcggcgttgatagcgcgcgcgtgangttgcctacgtactcagtgcaattaaggatgagtgaagtctgaagttgtatagcgagagagctcatcgttggacgccggatggtggcctcattacgtatcgcgggctctgttattgaacgcgtggtgtctgctatctgangcacgcgggtggagcagccaacgagggctcgcgttggtacacttgtattatcgcttggccctattccgngcgcgacggtgccgcacgccacctcctgcgtcactctaccgagcccggtcgcaaatatacgccgcgccctaccagtgctagccacacacgcccctcgtgaccctgcgccgcatcggatattcagggcttccgtagagtttggaatcttatctgattacagcatcgggggcagccgaccgngcggagcagagggccgagtagtgagactcatgagcgatcacgaagggacggtaagggacgctcacaacgcgcgagcaagttacgcgctccgtgccgcattgcacaataattagtgtggtataaactataatactccatcatgaaagtacacggttgtgtcctnacgcactctctctatgtaccgagaagcgagaaagggatgcaagcgaataacggtaggagtgacgaaactgcagtcgagtccgggcggacttgatagggtgtaataagtgcgtgcgagtgggnggtagtgtaacgtgtggtngcgaccactnacactcctaaactaattatatattacttaccacttagtaatcagcttgattagcatcactgcggtaccat

SEQ ID NO: 10880 - DNA, 1690 bp, Homo sapiens
  misc_feature (1)...(1690): n = A,T,C or G
cctcaccctcaccacctgatttgtcctcgcacacgaataacccccagctcaaacacgcagacctttnactacggtcgcgtccttgtagcacgcatcacacagcatgatnnctccctcctcctcgctcgccaccacgcgcacatcgcacaccagcacatcctcccactcattgcgttgcgacggcgtctcagctcacgcnacttcgcatcgccgcccaactatcgtcacaccnacatcgtacatcgggcacttntacccctactcctcgcgcnttattaatcgctcttatnatccgccgtccaaacacgacacgcatatccgtacnctactccaccgngcgcactgtgatcactcgtatcnacacagtcactgctgcncncnncgcctcatcctagtgacagggccactcacatcngtagagtaatcatcttgtccgcactncccaggtcgatctctctctattgcctagtngctcactgaacgacnctgtaactcgccacacgtcttggttcncnggactgcgcacccntctacgtttcttcacctcanacgtnnnncgcaccaccctctnttaattataattcccgtcgttcccttccactctatctnccatcgctatcccncnncncacnccncttcccttcatantcactccggctnctcgcnctgtctcgcgccttcctacagacgacgtcacgncagtctctcatgtgtncgccgcgcgactgctgatacgtgttntaannntgcgagnnngcnacgcagagtccgcgatccacaggctactcaccatgtgtagatcgntcgagatctatcctcccncctccactctcntctgtctccnntccccccncnncnctccncctctcctctcttatatatttntcacattcctcctctcattgcgaagccaaccattataatgacgacgaccaccgccgcacacgacgtccacatcatcctcactcgatcgactcaacagtgccacctgtgtcgacaggtaggcaagatctgcatacgtcgcacactcagacactcatcgctctcatccnacaaatttccagatgntcgcatcacacgtagttagtcctagtacacgngctcacacccacgccccagcgtctctgcnnncnctctncnactcttcgcgncgctcggcatctcttcgaccgagactcgcaccatccgctccgnccccncnnacaagcncgccnaccntcctcacccctcactctacagtgactatatctnacatatgaagtntactcctaccncccgaccaccccccagcgctctctcgatctatccaccgatgnttccntgtgtctatnnncncncnnacagccnnnnnnnnnnntnnctnnccnnntcngntnattccctctatnaccactcaccngccacgccgcgcaacacgcgcacgctgcttctctcgtatcctctcatctagtcatacgcgccnccctagcgcncntatcgctcctccnccncatcccctncatcgcccccntcaacacncttcncccccctcactctnccncnctctgtcgtgctctcgccgcgctccnncctccctcgcactcantcactcgctccnttcctatactctacatcactcctanagcgagaggaatgcgtatctcgctcacgctcnaccatacgactcactgttctcatcgcgcgtacctct

SEQ ID NO: 10881 - DNA, 1652 bp, Homo sapiens
  misc_feature (1)...(1652): n = A,T,C or G
cctcaatctgtgtgagtggtgtgtcagtcnttantctatcagagtgacanacacgatgtcncncnacgacaccagggcactacgagtacgcacgcgcgacatccaccgtgtgancacgtatcgcgtatgttcggactgatgctatgatacatctagatcgcggangtgtctgcatcgccgtgagtactacgcgccatagcagcgtattcggcactggnagcgtggaggcagacacacgttcgcgnntggagctgctactcgtctnagnacctatgcgtctctgatgcgtatcgtcgtgtcgtccgtcagtcagccacactgcttctcgtctctctcccgtcntatgcagttactcgttgcaatcagtctcacattancacgctgcgcgttgttacctattgaggagccatcatgatcacgcgctgagatantcctacgcgcgcggagtcgcgatctgtgcctagcggacgtgcggcacgctcgnttgtgttgatatcacactcctatcatgacgcatgactacggcngggtaggagcgtcgatgcatngagatttgnggcgttcacgtagtagcgcnnagtcactatctatgctcgtcggcgacatgggcatgtggagcggtgcacaggtgcgcctagtctatcatttactatcatatcacgtagataaacgcgctactcctcttatacnagtagactcgctatcnacaactgagcgcacaccacatcataacatcagaccgtcgtagtctcgacgcacgtctgtgcgcgatcgtggctacgccgtgtggaagatcaaganacgattcatactanngtacatatcttagtcacgcgcaagacanacgccgcantcgggagcgctttgtgtgtggctcgtgcctgtagnggtgctagtcttaaggatgtctcagatgggaagacagtcgntggtgaggattgtgtggttcgtagatggcagtgctctatatgcgagcgactgcgntcgcgcctgcctcgtaggcgcgacctttgatggatgagtgtggctgtgtatgacctgttatagagcgctagatgngagtgggccgtagtctgtatgacagcacgatagagtagcggtgtgatcggaagtgcagataatatngcacatganagagnaacatgacgtgantcactatggttgatgactgagnatcgctatatagaanccgctacgtgtggganncgcacactcggantgcgtgcttcttcnaccctcctcatggcgacgctacatagngttacgactgcggngcngcgctnggngactatattcggagatcgaccttggggnggactgcgtgcgcngacgcacgcgtcgagagaggagaactgcagagagaggtgactacagagagatgatggcgctatgtaggttagctanacatcaactcgctgctctgtcgtcgttttgaccgggagcgcacagaatcaagacattaccagttgnattatatagagtgccacacctactcctagtagggagcggtcttgatgagagatgcgagcacacggtgacgtagtgggngagtgtacggaccgccgtgggacagtttaactattatgnaactctcgataaaagagtgagacttaaacatacatctctatgcgacactgactaatattaagata

SEQ ID NO: 10882 - DNA, 1160 bp, Homo sapiens
  misc_feature (1)...(1160): n = A,T,C or G
ccgacccactccaaccgccctcacccgacacaataaaacggaagttanacggctnaactagcctngcactagcnttttggtgagctgtacacccttcgccaatcgtnccacccattcgcctcacacagcagcgacccactctngacgagatggtgagatagaatctctattcgcgcagcacgttttggctacgtccctaaaaccaaagcgcattctggtaggacttttgttccctgatcgacgccatcagccaccgatgcttccatcatacacaagtgaacaaccattcgccatatnggncactacttttgtcagtcgcacaatcgactcgtccgcagcatcccttgatttgttgtatttgtacggagactatattaagagagacatataacaattagtttntttgcatcttatngtcccccctgcccngtcntcgccactggacacaccaaccctacaccaataaatggcnctccctttcggcccttcaccgcccccgaccctcttgcgcgccgcgtcccgcttctcaaggacggcgatagattcattcgatttctggagtagatagactccactcggcgctgcgggggtttaggttgcacgcatnnnnncctccgccctcccttcaangatttncactcaacaaagtacgaacaaattgtgcgccgccccccgccggtcgtgaatcgtgtcgagcgtaattggtcggagaagggggccgggatccngcantaagagcctccattccaagcgctcttttaccactaagggagcggcagcccccccacgccactcacaaactacaccgcccctcgagtccaagaggggggcgagggcgcgtcccctgtttcgccgccactcaccccccacgctctcccccgctagctcttccccctccctcccctcccccccctgccgtacgcccgccccnccnnncnnnnnncnnnntnnncnnanantatcccctcccgacagcacaccacgcggcgcgccaccattgcccaaacagccacactccataccgattttcaanaccaacctcgccccccgagccaccactctccctcccggaataaccacgctcntccctcccttcaccacccctacccgctccctacatctctgaggaggatcgacccaggactccgcctcccggcact

SEQ ID NO: 10883 - DNA, 1853 bp, Homo sapiens
  misc_feature (1)...(1853): n = A,T,C or G
cgtgtggacntcagncngtgangtagcgntgtagngcaccagcgtagtcagtgacgtcgtcangantgcangtcactggctcctgagttagnacgacactgtgactgcatngngncaccgtcgctcatntacacacgcttgtctcctgtagactacaacaatcgtactcttacatgctcgcanctntcactgctactctctctcgttcgtntctctncgtctctctgtcctcgtagtgagcgtctgcttgtgcgtggtagatgagganangaacgtcgtggtgaattttccggtcatcgtcttacacacagcgttatactatgactgcttagaagcgccggtagtacggtgcatagatantcncagacgctgctcgtanagtatatagtagatggagtcattagtgatgttgtagcggtagttgagttgatggtcgacggctgtcacatcacgcggtcgctctcgacgcttgcgtactctgtagtgtagatctgatgtacagangtatgagacatatgctctctgctatagtatgtaatgatattgcagtgaanannacgcgacgncgagatcactgttctctggtttgtaatagaatatatcantagcgagactggtgnngngtgagtagagctcatcgtgtagtgatagntgagatgtagatnttnntctcatctgtcgtgcgnagagtcgtgctagantcgctgcgtcatacgacgttagaggcattacgacatgtgccgtgtcgctcacacatcgtaaggcngtgtgcgcgcatgcgtggcgcagtcactaagcgctggagtggngtgngtntaggacatgagtactctgtcantntaccgacgactgtgactatacgcatgcatgnctgtctcttagctctnctaatagtatntatcatagtcggtagtgctcattngctgtntatatactgcatgagtgatngacgtacgtatacgatgcgtcgtgatctgacaccatgacatcgttcactacatctactcgtctgtatctatgntgtgcgacagtatgntaaganantatcaacatgacggagtacgctgagcagcgcggagtgactacgcgctgtatgtgcctacttcangtcatcctgtatacgcgttggntaccgatacggatggggtactctcgtatacgtagattccagcatgtgntagatgatgggaagtgnatgccgntantgagcatacgcggagaaacataataggccctcactgtaacaagcggcacggcagagtattatcgacgttccaagaggtagcgccatagtgagcctcttgcgacatcgntgacagacaacactacggacatgagacgcaatagtcgtcatgctgcacgagttgtattgtatagcttagctctcgtgcgagggntcgcgcaggtgnacctactctgcgtgaccgctcgctcgtgnatctcgatatggaactatgtaattgtaggctgtgttgtgtgtctgaagtagaatcggcgatgtagaactggtcagtaggtaggattattcgtaatgttgaggatgatattatcagagtatgctcaggggcagagnatatactgtgtttgtatcatancttacattctataatctttgtagtgtgatgagatgtagaagggtggttagtacttgtaatcattgccagtgtgaanctatatccgcctctagctagcacgtcacactatctgaattnacaatacaatgtgagataagactatataaaaaatagatgagacaacgagaggggcaactcngacgttctgcttatctacttaaacgcttatanggactgtatgctaatgttctatgagatgcgcgtcctctgttgcgcgct

SEQ ID NO: 10884 - DNA, 1636 bp, Homo sapiens
  misc_feature (1)...(1636): n = A,T,C or G
ctcgtccacgcgatagcggtcctgcgctcgcgctcgtcggtctactgtgttctggttcgcttccccgncgcatgcacgacgcctncntacgcttagctcgcctgtctcgtgcacgttgcgatacgctctatcgcatccacgtgcacgtcacccgccgctctgcaccgcttgcagaccatgatctccgctgacgcctccgccagcatccataccgctagcacgccgagtggtcgctctcgctagaacantcgacgtactgancgatcgccactcgaagctatacccggaacacgctcgcgactcactcctcgctctattctacacatctacagcatatatgcgcgggtagtcatacatgttcgtcaatttaagcacgcacggacacacatgtgcgctcacaatatcgctagactatgcagcgctcgtcgcgctcgtcaccgcgcgcctagcgtcgtacatacagtagtattacatacatactctcgtatcanctgcctatcanatacgatcatactatgccatcaccgcacagacgagaacacacttcatacgtcgcgcactaatacatagcgtatcttatatatcagcatcgttgaggtaatagtgaggaggactgtcagccagtcacgtaatctcacctangcgcgaactggccgagacgtctcantcgatgcatggtatcagctctacacagcatnagacatagcgacgagagttcgagngagagacgtatgcgagcgcgtgtgcgctctgcgctctgccgcgcngaggacgcncagtgtctcgatcgacctacgtacagtacgtctgttctgtctggcacgtctgctgcatcaattatatcgcttactcagcnccgcatctangacaatggcgagcgctcgctacatcatcacatgcacagaagtcntgcgtatatagacgagacatgcgtgcgatagttctgctattgtatacacagtactcgcgtcanactatcttgttatcgtgcgataccatacgctgcgagtgnagcgtgatagagacgcagagagatagtagatcganatgcgtcgagaatnacgtaaagtancgacgacatagctgagcgangctgtgtcgctctcgtntgattgctacgccagaatcagcgtgtgagagtagagtggagtgctcgngatacgacgtatgcgagngcactgcgagtgacgcgcaagatatacgtacatacatatacacaaatctagcgccagcacgctctgctcagagantcgattactgcccactaagaggtctatatcaatctctaccatgtctacaccttatgnagtctgtctccgtcctggctttggtgcgctgctcaagggtctgataactgtatattaacagatgatgctacagcaagtcgcgcggaggattctttctggcgccgacagatctctccaccatccgtcacacgcactgccccacgtcactccgtatccttgctctgaccagccccccactccatcgtgatctctttaatatcacgactataagtctatcctggtctcgcacacatcgcccctctcaccaacctgctcgtcgtcacatctccacttctcctgcactacgactgatctaccatcctcttcgcctctaccctcgtcgactactc

SEQ ID NO: 10885 - DNA, 1675 bp, Homo sapiens
  misc_feature (1)...(1675): n = A,T,C or G
gcagctcagcggggcnaagacgaccaagcagagcacacagagaccaacagcnaagagccgctcagaagagggnaagacagananngaagaagagnncacgcctgccacaggacgaagacaaaccagaacaaaganacaaaacancaccaagcgcacaacgcgcacaataggccacagagccnaaggagtnacaagagggnanantcgnacacgggagcgcacatacgtagtgctcaatagaaacacagagaggcnccctcatctacagtccggccacgcagacagcgagctccacgacacgctcgcgtacaccnccagccagcggccaccaaggcaccgctgcgtgcacgcgagcggacancatagccgctcncgaggaggacacnccnnctaataanagcactccccgcgaccagcatactcacacctcagccantccactccaccgagacgagcggaggagcgcgcgccccatcacgaagacacaagacacggacgggggcgatacaatntacacaagagncaacgccaccagcgttncagtcgcaacggcctacagagctgcccatacgagcgcggtaccggcgcacgcgacgcggagccgagcggcgcaacgtgagggtgcannnnnnacgacacacgagacgaaagtaaccacaccgcacgacagagcntacacatagatcactagacagagacacctcacacacacacagagagcagacacagagcgcncacaccgccctcaagcgccgcacgagacacaccacacacagcgcgagaccgcggncnataggtgcatgcccnaacacagcgcacgtcnatcatgcaggacggcgcgatccgcgacctgntctgacgcgcgtactgccacatccagcagcggcgccncgagccgtcgaccgcgggcnncccatcgagagcgccncatctagacgnctcaccgcgcgagacgccagncnnnnnctaagagagtccgcgacggcacagacgcgacagcgtnccntacaccngagcagacgcgaacgcagtacagatgagtcncgnactcntacacgcacactcacagctncntgatgagagatanagatagatcatatatctctcctatcanaacacccacagccantcagatagtgtacacagatcagagtcncnatacgataaacgtcacacgggagcgagcagaggacagacgcnatacncnnnccaagcgagtcgcccacactcgcgatgcngaaatntaaagaggcacagcacgaccgcgaccgacgcagacgcggccacagccagacactggggnacgaggagtacnncagaggtacgcgcgcnacacgcgagcgccgtctcatcgccgagacaaccncnctacaaagggaggagtcatcancgcctacactcnccggcgcacngnactcggtccacaacaaagtaggcgacggctgcagctccatacgaggagagaggatataantccnntctatacaggtgaagacctcagtgccgcgagggaacgaacagannnccactagcaagcacacacgcgcgcacacacaccgacgcgcgcgcnacgcgcgacgctacccnccnnccacgccgacacactagcgccaggcaccagagagaccccagcacgcgcgccgcgaggcgtaccacngtggcgccacgctgatcg

SEQ ID NO: 10886 - DNA, 1407 bp, Homo sapiens
  misc_feature (1)...(1407): n = A,T,C or G
gagaggggcggagcgcaaggagatgagagcgagaacgagagaaaagcaagtttcgtttgtctggtnaatcccacacaccncnggagaggcgctgganggagcggaacngaaccncanaanangggggnaggngagagggaagaganagnagaacgagcaaaagagagtattnaggagagagaagcgagaggagacggcgagaagacgccgcacagaccaacacacagacagcgcaccaaacacacaagacacaanacagaaggaccagcagacggcaggcacggaanacagaacggagagcagaagaacgaacggaggaacgccagcgcacggacaggcaggacaacaatctctcgacagagggacaagagacacaagacacgtcggaggcactgcgctaacacagcgatctcagtcttcttttgttcgcacaagcagacgtgggagcgagatcggagcgacaccagaaacggcgagtggtgacgacgcgcctcgacgacaccncacgagccacagagccgtcagtgcctggacacggcagagagcgatcgtggcgcgaggaggagcgtggcgacgcgcggcgagaccgacgtcgagcgagggtcgggagagtggggcgcacagaggatcgcgggcggactgctacgctcagcaacgccgacagggaagacagcgatgaggagggagccggacggacggacgcacgagcggactggatagcgcggcgcacggacgaagcgcacgcagaacgtagcnagacggcaacgcgacgtcgcgacgaggacgtaaggaagggtagcgagaggcgcgcactagcacgacgccgtctccacacacatacacgtccgtgcggnggcacccgagtcagacaactgcgcggcacacggacattggctgacacgcctaccgcgtaggacggagtaggagatatgtatcagggagcagcatacacaggcgtgccggcaggtgcgcgtgcgtgggagtcgcggtgggccccaccgctctcatctccggtnacacgacaccgcgagataagtggcgcgccagtccccacgacgcgaccgcgcaaagagccgacgacagggagaganaggagaagtacacgcaggcgnacagagacgtaaagtcagagatacgtgggcgatacgaccgcgcgccgtgcaacggacggcgctggcgaaagagacgagagaacgatacatacagcancgctcacacaacactcaaactcggtgcgaggagcaacgagacacgagagacgacgnagtccgatccacacgcgcgccgcgacggcgccgacgcgcgccgcggtagtggcgagcgagtgtggcggcgctgcggaaggagacaggacagagcacgccgccggacactcgcccgaccctccggacgaaccgagacaccgcg

SEQ ID NO: 10887 - DNA, 1253 bp, Homo sapiens
  misc_feature (1)...(1253): n = A,T,C or G
ctcccatctatctagatgtactgtgcaccatgtctaggnatgatagcaaatgcatatgtagtggancgcactgaagtatgtgcgtcaaccgcgacacaccagcgaccgaacaacatagcgcgctcgctccgcggtgagncatgtattgatggagttagataggtacgccacgtcgctagagtcgagtgtggtgagaggagtgttgatccattctatggtcacacacgtcgccctcacattaggacttacagagcacgatcatctactcctatcagaacctaaaaatcatgaactcggattctgcagtgtcgtcagagtcgatgagtgcctctgtagagatagtgaaaggtatgtatttgtagacaaatgtggagcgtaggnataccttctggtgtgatcatagatgtgggagcgaagaggagaaccgtcgcggtacctacttgtgtgngtccgtaccttgggggaagctgttgagccgatagtggaggcgatagttgtgttagtagggtagacagtgtgagtagcggaggcaacggagcgtaataccctctcacggtccgtgcaggggtgcagattgaatgtgtcgagcgagtgtaccgtagtagggagcgaccagagaagtaggtgagcgcgagagtaatcgtgagcgtcaggcgccacccgtagaaaccactggaccgatgtgaggtctttagncataactaggaacgcctagggacttcggttccgtcatcactgtgactcgtggcccttcgagancaagagcgcacaatagggggatcgtaggaagctagcactcagaacgcaagcacctcaggcgactgcggccactcccatgaggccatcactcacccgtccgacgaggggggcatgggggcatcaacagttgccagttgttgacctagtgctataatgagaacattaagcctattggcaagttagaactacatggccgctggactatatttggcccagtgaagatctcgcggcctgccgtggggaggggcgactctgaaacatggttagggataaggggtggaatggcgtggtgatggcggaaggtatgacgagcgtggggagaacattattctggccgttcgccaccacccactccacgagatacacgcacgactagaccgcatcatgaatcaagaatcgataaatgtgtggggactccgggaaccaaaggctagatcgcaaggtgaatcttgtgtgtattatatgagcccgtgtggccctaacaaatttacact

SEQ ID NO: 10888 - DNA, 784 bp, Homo sapiens
cttggtgcctgactgggtaggatagatggatgtaaacaataatataagctgaataattttcaaatctacctgcttaattacaagtatttgcccatggaactccaaacaaggttttctgtggataatgcattttatgtttttgaagaggagttgcatctttatctgctaaagatatggccactttcataggaagcctatatgtccagattaccaggaaggcttgggatgagtgcattggagaccaggaagacaccggtctcagctcacatctcatgttcccagacatgtataagattctcatctgaccacaaatttcttctgctggcatacttcagttttaagtaattgaatttctttatggaccatgtcaaaggattattttcttcatattagtttttatctgtcttgtctctctagtttctgaaacttcatctagctctcttcctctttgttatttccttcagacttttctaaaaacagtttgtacccaagaggatttcattacccccagaatacacttcgtaagggaatcttctagtctatgatcagctgtaaattgcactccaattgtttcgtgtgtaatctagtttttccttcagctaaactgtaagcccttgaaggcaggaattgaagcatctttttgtatttaccataaaatagcactgaacacatagtaagattcaatacatactggctaggttgttcactcttgcactgtatgaccaataatacaatatctggaggtcctttaagttaattgagaattaaactaggaatcgccctt

SEQ ID NO: 10889 - DNA, 1061 bp, Homo sapiens
  misc_feature (1)...(1061): n = A,T,C or G
tgagattaacaacacaaaaaagagaactaaggctaacctgactgatgcagtggtaacttcaacctgccaatgtacacccgttgctcacaagaggaccagctgagagtgggagggaatttattgccaaccttttcctactgctaaaacaaagcaattctgtagatttgtgactgatgacgaactagcaccatgctccatatcccaatcaataacatgtacatatagggactatgttacacatgcagccgataacgagacaataatcagcgcgaataggacacaacctcctcgcggccgtgtgagcaaataagatagcaccgcaagagaacaacactcgagagtccgacccacccccagcattccagacctctcggaaaatcacagaaggcacgaagccaaattgagcagcaccgcgccncgtgccgagcatccggtcaaatataataccgcagacggccaggactctcgtacacgccccaaaccaaaacggaccgcgccaagcgccgcgcacgctaaactccagtggttaaggccggcaacgcgtcttgggcgataatgaaggcacgcccgacccagtagacgagcgggggtggtggacagggaagatgtcaggccacaccaatgtcgcagccgatatgtgcggtacatcaataaccgttgctaaggaaaaggtctcgcggcgcgagatccacgtagagaggcatatatacgatacgatgctcatacgagcgcagagacaggaagagaaagggaacgcccaggaaccaccgcgatactcgcaatgcaccctgtgcaccacagaccggaacgggcgccaccacgacgcatgcactacaccagcaagatggattgtacgcataatgacgccacccagcatcatagtaactgacataacccaagaaagcagcacacattggcataggccgacgggacgcacgcgaacacggcgacagatagaaccctgcgcagggatgaatatctgaaatgtaggattaagataagagcacgaaccagagcggaggcgaagcgcgataagagaagctggagaagaaaatgtcgcg

SEQ ID NO: 10890 - DNA, 941 bp, Homo sapiens
  misc_feature (1)...(941): n = A,T,C or G
tagtgatgccgcgcacacaggagcgcgcggattcagtagccccaggctgatcatgagggtacatcagacagattccaactcaaggacattctacaaaatacctgactggcactgcgtatgagcgtggcagggtcttcaaagacaaggaaagactaacaagctgccatagccaagaggagcctcagaagacgtgatgacaaaacgtaatgtgggactgtgggacagataaaagacattatagaaaagctaaggaaggccgaaagaatgtggaaggggggtgctaataacgcgtcgacactggctcctgagtatggctggccggactggacactgcggtggccatcacgggaaactgggcccggcttgtgtgggaactctgaatgaccctttagaatttttttttcgtgtaagctagcagtatcgtaagcgaaagcatttggtgaatttaaggaagagcgcacagactggccttgtgtggctacaagggggagcctgtatgaggggtcgcctagagggaggggtaagtgtcgagcctggataccggactagatagactcgggacgatggagtcgaggcggaccgctaagtatacgctaaggctcgagagagggagccccgtattcaagtggacgccctatgcacgacacgctagaagctgtcctactgagggagagaaccggagagggccggcgggctgtcggatgacgtaccgtcccgcggaggatcggcaccggcatgtggcgagttaccgagggacgctnttcgctagagtggtgtggtcctcgccgtgactcttaaatcattagacgcgcggggtggggcagtcgaggggttaagtccgacgcgaggtcggcgagacgcacgtgtacgcgtggacagagacgttatgatcgtgggcagcggcctgcattcgcaccgcgcggtttcgtgttcgccgggcg

SEQ ID NO: 10891 - DNA, 821 bp, Homo sapiens
  misc_feature (1)...(821): n = A,T,C or G
attagtataagtcatggaacacggctgtcggggatggcggagaggaaggcgaagggtgagggccccgtgggctcgctgaatgaccgctctggggcgagaaagtgggacgggcatcggagagagacggtcgggcgaagcgaggcgaataaggcccggaggagccatcgcggtccaatgattcgcggacgaatgatagcatagtggtcaagcgcgaacgttccgcgcaacatggggagcaggggtgccgacgaggggtggaaagtggggggcgcggggagntgagtaagaggggaggggaggggagggaggcggcgggaggggtggggggtacaagatataaaggggggcggcgaagggcggggggcttacagggcgggcgggcgggggaggctagaggggcgcgagcaccggagggggcggacgggtaggacggtggatcgacgcacaacgggaggcggcgcggcatgttgacggatggcacacgggtggtcatgataaggggagcggacaccaacaagaaagcaagcgccacacaccctctaaaatccttgtggtcccctctataccgaatcctccccacctctaagagacaacaatttcattcaggtacaatctggtcataatcagtactatacatctgggagcgcccaaatgcttctttgttttgcggttcaggataaactgtgcctgtcttttcttggtatgcatctttcacaatcttttctgcaattttcagacgaaacatctaaaaatggtattcaaaggaggataaagccgaccctcttgccaaggcttagagacactgctgaagtacaaccaag

SEQ ID NO: 10892 - DNA, 184 bp, Homo sapiens
  misc_feature (1)...(184): n = A,T,C or G
tgtgtngttgngcgccccccccgggtcttnggggggnggagggggggggggagaagaaaaaagaaaaaanaaaaaaaagaaagggctgggggggggttacagagggggggggggggggggggtggggagggtgngtngnngnnnnntnnaaaannnnnnnnnngggggnggggggcgaaggaga

SEQ ID NO: 10893 - DNA, 2033 bp, Homo sapiens
  misc_feature (1)...(2033): n = A,T,C or G
actcactaagtagagaaagttacacgtcgttgcgcctctctagagatagctcgtncgcgcggacgttcgaccggtgtgagtctatcgcatagtactcggtactgatcactnactctatcgaaagtcagtcgaagttagagctatnatgtacgcgtgatcgacatagcanctgtctngcacgctatgtattgntagtngagcactacaactngnttctcgccgtggacgagncgacgatatcancgcgacagcgtcgtgagtactgncntcgtactcacatacganacatttacccactcgnanggtcacagatacagagtnagtacctgcaggagtagagctgtgcgctacagcactgctcgactactcgtatanaaatancntcactacancnagaacganacagacactagtnacaagtagcactgncntngcgatatcatcgacngagctgcagactagcanacgccgacgcgatncnggcgtatcgtctcgctctcgtgtgcnttatgtcgcttctntcgcacgtgactgctanagcgcgagcatacatgatgatcacatctgtgagctcacgcgttacngtatgtgctcgacgtgtngcgacacggacgagtgttgcgatactnacgacacgcgagcancacgtnagnagnngnaattctctattactaggcgctctcaggacgtngttaatgatctgatacngcgtactctcagcgctgtacacgtnacgcgnagatccttcacgtgccctgtagagtgcacgcanctngtctatcgtgcatcacgcaggaccacgtgacgacctgnaccgtcgcgctcacctcgcgtctgtagtctgcgcacatcgcagcatcncgaccgagagagctgcctgcncgcctctctgcagcggtcgtcaagtggctatagtatgtaggngacagtnacgtctgtgctatagcgancatcacgaacgacgagacgctncacanacacactactcagtggcgacgatctctatatatgcgagctgcagtagactgtgcganacgcgatactgantcgatgacagctgtgctcatgcggcntccgtactcgcangcgtngnatctgtgtcgctcgtgttgcatcacgacgtcgcaccgatcgccaactagctgncctatccaacgcagcgacacttgtcgcangccgactcatccatatgagcactgcgcagacgtcgagcactcgagagcagtgcgctctgcgtcggctcatgagtgcgcactagtgtgcttcactactcgcgacagcgtgggacctgcacgacgcggtgcgctcgctgcggcgtgctgcacgaagatcaggagcgccgcgtatgcgngagatctaacatggtcctctatcgcagatacataagtnacatcacatgatatagtaagagtacgacgacgtacgctagatcacgagtgcagcgtgtcnccgngtgagtacgactcgacagtgacgangtgagtagcacagcatgatnagtnggccgtagagtagngnacgcctnctgacagtgnngtactcactcctaggtgtactgcgtacnaacagctacgcgnnacaggtaagtacnaagtggcagaatngatgcgtgagngtcagtactatcatgcgatgcatgacgatcgcgtactgngtcggcgacacgtctnctgagatactcgtcctcgcgtcatcanttctcntnacaatcgctactgttatagtatntactnctagagtcagnctgtgccgacngctnccgcacgagtcgagcgagngacactgtatggatcacnctcagacatactcgcagcgctacgagagngncagnacgcgtggccgctggtcgacggtcgagcgtnctagcgatgntcgcagcgctgtgtgganctncgctctangacngctgctcgatgcactctgacactgcacctcaccgtcncgatatcgctacgtcatgtatcgctganacatacatatntgatnatctctcagcatagttactactctcaccacatctgtgtatcatacat

SEQ ID NO: 10894 - DNA, 1335 bp, Homo sapiens
  misc_feature (1)...(1335): n = A,T,C or G
aatattagtgaatgagcgacgagagacgctattggtanactatagtgataggattgctctgagtcactacatcacatcctaaaataacagtgaacatacaacacaagtgtcgacagaggtcctcgatgctctggacgtaacgatatcagtcgatagacactgaggaatcagagacgcanatcgccgacaacggaatatgagggacaacacacaatgaaacaaaacatatacagtattgagaacaataagacacagtagcaaacatactataaatactacacataaacaatcatcgtgagagagtgcatatgaggcgcgtgtgagcagactatgactagcacgagctgtangtcgaaggtgcgggtcctcgtgtggcgcgtggcggacgccacggtggtgcatcgttgttgcgacagtgcagtcggcgatgcncatggtactagtncgtggtantattaggcgtgaggagtagntcgcgatgccatttgtgactgtgtcggtnttcgtgtatgacagtatgcgcgaatcatgagtgtatgcggcactcaccagaaacactgagagcagttccgtaggtcacgactgagaggagcagacgcgaagacagccatcacactcatgagcgatgcacaagcggcgtggagtgtaagaccgtgagacgatgctagagagatgcagcagagtagcgngctcagggacgatcgcagagataaacantaatacgcnacgtctcgtactaancccgtcaagtattcacacgataattcatcctcacancagacgttggtgtgagcgaacgacaggaccgcgtatctgatntatatgcacaggtcgactacagaccggacgtgaagtaaacgagcagaagaacatagagaagtgacatcaagaaaggtactgttggccgatacagccagatcaccgaatcgcgcttcataaccgcgaacgcagaggaccacactgcatacgagagctagcgtggcgatcggctgtacggatggcgcatcgtgccatcactggaaacagactagacgttatttgccgcatttattgtccttctatagactatagacgactcctgggcgcgcaatgtagtcacggagagggaagtggttgttgcagtcacacccatgaggacggtgtgcgggtagcttggattatctagtaacggatagaagaaagagaagagagagtacgcagataatggagtgaactaacgtctgaacagtcactcgacgcacgatagatgaaatganngaggcgggcagcgaagatttgatgtcatcattatctcagtatgtaactcaaggacatatatagcccaccacaagacca

SEQ ID NO: 10895 - DNA, 1831 bp, Homo sapiens
  misc_feature (1)...(1831): n = A,T,C or G
ccatnctnacgactgcagtgnacgtacgcatcatagcancacgctgctgcagctgcgacgctnntcatcancagcnangagcacgtcgcgacagtgcgtngcagngtctngcatctnagatgcagcagcataggacgatgacgtctcagcgtgctacgncnccagtgctagcgagctgctgcgctcgtatagtcgctcgtanagttcantatgacatcatntctcnctcancagcacgagctagtangtatatgcggcatgtancagtaccgnntcgacactgggcctcaggncagacagcacgtccgtctnagctantaacccanctgcncnntncgcncgctagattcgtgatgacgaaantctgacgtagctagtagtacgtagacgaanacgtcgatgacacgacagcatgcaagangangcgcagncgtgagcacgacgcagtctacaccatcgactanagtagttagtagttaatacgacccgtnncgctgcttgctgcgctgctccangctgtagctgacccgtctccgctgtantctactnacgatcgcntgctgatatnatnacgcacnactctccgcacgatanacgatnagccagcgtcgctcagcgncgacgntacanctctgagctgatcgcgtgacaccgacatctcgactagatcatacgagtagatntcagcacaacngtgcgtatcatagctcactagacgcgctgcagctcatgtgtcgcancgctcgcgactctgcnagcagcgnnacacagtcgcacctcactcacgtcatgcgnagtgtnntgtcgtcttatcgcgactacagtcgtacgtgctgtcgtatagncgcgacgacggcgcgcgaccgtgacgtcnctntactgcgtgtatgtcagancgtnttacgcgacacactccgtagagccagtccactcaccgtctcatcacgcncgtacacacgtcttccgtgcaatcgtcggtccgctcgtgagtacgcgcctgacgttagcactcggctcactcactcactctcttactctgaatactcatccattatctccntctatactctaatcacctctcctcacctaatgtctatactcgccacgcgattcgcgtggcacgcgtgggtgagcaggtgtgtgcgcgcagtacagtacacggagagtatcgtgacngggggagacgtcgttgtacgcctacttgtgcttcagtcatctatgagtctcactctagaacgcatccactctatctagttctctccaagcgtcaacaaccaacatgctagtagataagaaagncaataatgtatcacacttgacncgtatatcaagcttagaacgtcattantatcttgttagccgatcactgtncttaaagactacactgagcgtgtggactactcatctcgacggtctcattaggtaaattattagaagtactggtaagtacgtagactagcgcccttacaagccgcgcctcgagctcactcctcggcgacccaaggtanacaggattacgtatggcggatagctatcgtgtagaatgacgagacgcagataagancgctgacgggtctgttcgttgcagtgcgtttgctggtatatgtcttatatggctttgtgcttcgtcgtacactcacaattgttcattaaaaaagtcacaatcattgcacatacacacactanttcgctcaatcaaacatcaaagaatcataagccacgcgcgccagcgccctcggcgcttccctacactcagtgattcgcacttctcactccacatatcacatctcataccatactcacatctaaccacataatcctactctacctc

SEQ ID NO: 10896 - DNA, 734 bp, Homo sapiens
ttttttgctcataggtccccctccatattggcttgagcgcacctcaccgtttctcccaaagaggcggtgagggaatatgtaaacagttcttgcgaatggttccggagtgaggcaaaacccggggtggggaaaacgtccccccatagggggcacaggggttttttttttcctatggataaaaaacaagagggaaggccttcggcggtgtatttgccaaacgggggccacctttggaacaaccccccccaatttccttggagcccttccttttttttttatttgagattacggaataaaaaatttcccccccaagccaaatttattaaagccataataggaaccctttttttatgatagagggccttttattttttatatttaaccgtaaaatggggaaccaaactaaaaagtggaggtgggaaaatagttgaaataatataggaatttcccctttaaaggaaatggtccaaaaaagggcacccaagaatttttttttaaatggtttttgggggtttttccctcctgggggaattggggcccccgggaaaaattttttttcggttatgttttcccagaccattaatttttcttttatttccggggggaaggtttcccttttttggttaaaaaaagggaacttttcttttttgtttttttaaaaaaaaaaaaaaaaaaaaaaaaaaaaaagaaaaaaaaaaaaaaaaaaaaaaaaaaaaagaaaaaaaaaaaaaaaa

SEQ ID NO: 10897 - DNA, 1259 bp, Homo sapiens
  misc_feature (1)...(1259): n = A,T,C or G
attggtgtgtcctgccacagggtgtagtaggcacgcgtactcccgggtcggcggctgtcggtcagccatcgccggtgagctgtaggatcctgttggacgcgtgtgatctcggtaggtcgttggtatacggtacggccgtctcgctgtgcgctggtacgtatcgttgcgctgccattttccctccggccgtgcatttccgcgggatgtgtcacctgctcacctggggggggcgcgcgccgggcgtggtggtgcctttcctcgcctcggggcgcgtcgtcttcctcggggcgcggcggcgcgacgctctgtgtgctctcgtggtcgcggggcgtgcctgccctggccgccgcgcttcgtgccgttaggctcggtggtcttcccgggtggtgtgcggtgtgcggatagctgtaactctgcggtgcgtgtctgggttcgtgctatgtggggtgtgctcaggatcgccgctggtgctgcattgggtttcgtgtctcgccgtccggcgcccgcattgtcctcgtgctgtngtttcgcgacggccgtgttgtaattgtcgtcgcaacgtgggtctacgtccgtgcgttgagggccttgttctctctagtgtcatttgtggggcgtnggtgtgcgtggtccttgtcgcgtttgattgtcgctctgtctcacgcgtgcttcgcctgtggctccagtgcgcgaccccgtgtgttactctcgggctctcggttggcgattgctcctggtggtactgtccgtcttctgttgtttggtggcgggtgcttcgctcgttgttctacaccatagctttacgttgctcgctgctgtgatcccctctcgcatgcgtgtgtgtacgtgtccttctgcttttgtttcgtgcagttcttcgctcgtctgcacttctcgcgtggcgtggatcgtgttggggtcgcttgcgactctctcgtctgctgttcgtattcgtttcgtttctttgtgctttctttctgcgtctctgagccgcgccggtgtccattgggctcgctctgtgatctgcggtgccggcgcgcgctcaccttcgtcggctggcgtggtgggagggtgcgcggcctgtgtggtcgtatcctgcgttgggtgtgttcgtgttgtgtgggtcttgccttttctgtgttaaaggcggtgtggtcgttcggggttctctcctctataagggtggtttgtttatctgtcgcggtgtcgtctccggtgcgcggtgtgcgtgtgcggtatcggtctgtttcgtcttcgct

SEQ ID NO: 10898 - DNA, 1570 bp, Homo sapiens
  misc_feature (1)...(1570): n = A,T,C or G
ctgtagtctcgtcagtcgcgcacgcgacgcgctcgtngacctgcgaggaacacgtcacagcgacacactagagcagggtcgacgangtgncggagtcgagagctggatagtgaggtgattgtgtatgagtgatagtgtggatggaggtgctgaggagngngagaggcgngagtgcgtcncgcgtatcatcaccgcgcgtcgccgngtgngacttcgagggacttcgtacgttgangacgtcaagtcctatcagtctaccatatggtcgactcgcggcagtgagcncgctcgacgcngacgcggcagcgctcctggtgacgtgtcgctccacaccggactagtgcagtggatcgttgtctctctgatcgtggcttntntgtgcatctagagcacgcaagacgtctgagctatgatggcgttgcgcggcgcgtgcgatggacgaggtgcggctgtctgtgcactaatactgcgtcacgataacgncgacgcgcgaggtgtcgatgatatagatgaaggagcccaacaagagaagtgagcgacagtatgatggcgancacagtactcngagngtcatcacactacaacttgtgagtaancatagagcgaagagccgatcaacacggcacgacacacgaagtaacncngactacgcgccgatatcaccgcgcgngacgnctatntcacgcttccgtgcncaccgccactccgtgagcccgatccgacacggtacctgtattccggtgagattagcctgcgncacgtctgctactcatgtgaacgtgccgcgccacataacgcgccagtcacatgccgccgcctgcgtcagagcctcccagcgtcaggcgcctcctcgcacgccactctagcagtgngctcaacatgtagacgagctactatgagttccgcactagactacagcatgatcagagcacgcaatgagacgagcgtacagagacgcggcatagaggagcgcgctggctcgacgcgcaacccatggcacgtggtccacgtgtagcactcacgtgacgtgacagcgctacagagaggcgcacgtgcgcgctcagatcatacgangcagcgacacgccgagctaagagtagcgaggagagaaggccgagggtagacatgaagagcgagcgtgtgggcgcgcgtcagacgtctgcttcacttgtatctctgtatcgatactcagagcagngaccaatctactcgtgtgagtgaanagagcgagacgnacatagcatcgactgatcgagctcgtcatggctgtcacatcgtanctgagcgacgatgatcactcacattagtaactacgtgctnggctgtacgcgacgagaggctcgcaaactttcagacaggagtagantagacagcgagccgcgacaggccttacagtctgtgcagcgataacgatactaccgcctgccgacgaatcacgctcttcaggtgtcgcggcgcgcacagcaccagagcagangaggaagagatccattatcacagataacacatatgtatcattcattattatgtactataattctactcatcctncacctctactgtcagacca

SEQ ID NO: 10899 - DNA, 1305 bp, Homo sapiens
  misc_feature (1)...(1305): n = A,T,C or G
atcttcctgtacacgttcttaacttccctttccacgctcattcntctcattgactaaccacaatggcncacaattttaccccatccacatcaatccnaccatannnactatctatattccctcccaatcttaaacatnnaatcatntctncatactattcttatcttntttacctcttttncacctttcctccttctcttcagcttcccttctcccgcttctctaatctccaacaataactatgtcctatcaactttcatatatcctgtatcctctcnnttttcctcctttcctatctatatacattctctctccttttctcctcatatatgtatcttnntcaataatatttaatatatataactgctttatantnnaaacctacaccacccactccncctcactcttttctctttttctcatttattatgcccttcnnccctatgtattcttcttcccattctcctcccnccnacgctcctctgcaactcaaccacgctaactctcccaaagcccatatcctatattctactctctcttcatgctctatctactttgcgttaataattattattatattncctactatcgccatgttnnaatattcatctataccaccccatctcctcctgctctatnacgacttgtctacatatataganaccacacatccccacctgcccacacagcccacactctcgcctcttccctccacccacattactccnccatcttgtatagtacctccactgcnctccctctcctcttcttccctacatctctcctctcctcccactcccctctcttattatttattaatcaccncacaacccctctcatgcctcatattttcttattctnnccttttgtcacactatatatatactaattaaacctacccaactgctccctccgcacttatattgtacttgcncctatctcctnctcgcccgtcccacactatatctcacactcattatatcatgnncctatatctattgcctcctaccatctcatcgttataatacgtccnacacccttatcactcgatacttctctnnccgacctcttcattctcnccacaccaaccctcacgatctcacncgattactcataatcgccncacnnnnncactccactctcactctcccccatcactaccacggcgcnccacacctccatcctagtagcttccctcctccattcntccctctcctcgctaccncnctactttcatacctacgctcttcacatatctgttctacacatctagtatagatcanntactactacttacacactacg

SEQ ID NO: 10900 - DNA, 1728 bp, Homo sapiens
  misc_feature (1)...(1728): n = A,T,C or G
ccgagacgtgatgagctgaagcacgcatgacgtcatgcgccactgtgtnctactactctcggagagnactcncaagagtatggttcgacacggagtagcgtgtcattgtgagacgaggatgcgcagtgagaccgcgtcgcgcgaggtgtgttgttcgacctctgcaccttagagcgcatctatctcggtcgagcgataaggaaagtactatggtgngtagcagctcgtcngtgtcgtctgatcagtgatcctgactatgcatgatcgatgtcggangagcgagactacgcttagagtagactgtgtaagacatatgatcgagttatcagtcgactgctattatctacgtctgcgcagtngtcgaggaattgtaccgctcgctcgntgatgtcttatgagtgnttagcgaaggtngcgngctgattgtntatatgtcgtgacgttcatantcatctgccgcagntnctatattgtacactcatgtaacacataatcatataccacagaaactctcatactcacaagtatttntgacagctcacactcattaggttcgagtgaacacnacaaggtcatcagtcgactgataattcctctgacctgtatactatattgtaatgtcgactcatnacaacctcactggtagcatactngaatacactatcanaataaccacctgagatacgactgactgtanngatacnatctatctcatcacgtanaatatatctacagagacactgtgattgtgttgcactatcgcgtatgatcgtcacgtcgtcgactcacgcgcnacgttatctaattgctcattctcgtcaaccacctccacactcggtnnactcgtcgtgcanatgcatnatacataaaacactctatctaacnatgactagtcttatactatgtatctactacantgacgtcatctcacgacatatctcgtaattacnatatatcatgtgcgangcacacttactaatngtatacacaatctaatcagcactctaatgtacagtcagtgacatanaccagcaaatgagaacagagttatacttattataataagacgcnccatngacaccactatgcacacaacacaacagtcacgatcacagtcctacnactcacacatacgaccagaaaaccaagcaatnngngctgttgttcctacattantctancgctcgtggtcgatgacgntcaacagcacgtctcgctgcggacacttcagtgagacgctctatacgangacacacgtnaganagaatatgatgtgagaacacgatctgagggnagatagatangaggaacgacagatgatgagagtagctgncgcaggatacctcactcatcgtaagcagagcaatcactanatctcacggctgacgcactcngacgagtgcatccacacatactcacgtgacggcgatccactaggctcttcggctgtgacttgatgtagatggagtgtnattgttataggtcagtgaatgtctagtcaggttcggtgtctcgctcgtgcttgtggacgcagtcactcacacgacgctggcacggtacgcgcgcgtgtgatgtncgctgcgtanggcgtcgtcantttgctggagatgtgctagnntnnngactatcatgtgacacttatntgatactaatntaatgtgtctccatctacattatccctatcaatctctccactctactctacacctacatacactttgacatatc

SEQ ID NO: 10901 - DNA, 1590 bp, Homo sapiens
  misc_feature (1)...(1590): n = A,T,C or G
ctaaatgagatacagacaatatctacaataggtagaagacaccgcctattgtttgtctctgtctttactcttccgttgtagcgcatagagggactggtgttgtgcgagttgagtccagtatacagagtgattgtgtgtgctgtgcaccacctcgctcttagctatcgtttgcganctacgcttatgtctgcctatcatcttgctttctctgctttctcctcatctctttcatccctcgctctagcttccatccgtgcgctcttctctcacctattcgcatactacctgacntcgcgcgtacgcacatacagagtacatacatactggcagacgcggaggatatcgcgttgtgtctcttagttatgactctactcttcgatagtgatgttcgccttgcattaccgctgtttatatctatcacttctcgtactgtanaggtcgacacactcactctgtcacgctacctctcacacacgccggtcgagagagtatatagatacggcgctgcatgtgtgtccggcttaggccacgtcatatcanacagcagtaacttagagacaagactcaattcgagaatgtcatacatagtacctaaagagtatatatgatatatagtagctcgcncttatcaagccgactgactatctactgtacgctgatatggccttgtatatgcatgttcntgtcacacacaggattacgcgttctagctattgcctgacttctcacccaccgcgtcctacctattctccttctaatggagtagtgtaatccgacgctctgatgcataactactacagacacaagcacaatgaaagtacgtcacgatagaagcatagcatgccgacagaattctcgtactaatcatataactgtcgagttgtgacgaactcgtacaggacgcgacggatccggcgcgtgtgtagacggcgataacagtgtgcggcacaagcgtgacgcagtcgcagtcgtgagacatactcgtatgcaagtaggctgtaaagaccgacacggaataacgcatgcacttataaatcatgccacatatgacatactngaacgatacanttgtccggcgtctctaatcgagtctatatttctagtacagtctagaatggagatctcatctcgancgtatagtctgatcgcantctgatctgcgctctcgagcacatgatgacgaccangntgctgtgatacactcgtagtgagggtgcgcgactgcgaaggaggatagacatcggtgtatgtgttatatctacgggctgtacgtgganttgtttcgntagtgatcagtttgtagnttcagtttgtgctcatntnttagattagtgcgcgcggagcagtactacgcacanactattatacttcgcatttactntngttaactaancccatcacactttctcactatacataactctctctctnttctcatctatctactagacttacatatcccgtccngcgcgctgtgcgctcttctctcgataaaagcactcaccatcattncacatctantacttcagactcatagtcacnccataatatacttcaactatatccatcagtatgattaatataacaaca

SEQ ID NO: 10902 - DNA, 1115 bp, Homo sapiens
  misc_feature (1)...(1115): n = A,T,C or G
ctccgtcttcgcgggcggccggctcgggctcgtggtggcggcgttgctgttcattggcctcctgctcctggtgtgctgggttgctctctattagggttatctcgctgcaggtgggctagccgggtcgtcgtcgcattcggctcctctgtggtctgctgtttctctacttgcccttctctcccttttgtggcgcgcgcccggtgctctctgtcgccgttgcggtgcgcgttcgttggtgtggcgtccgcctcttgggtggcttgccgcttgtgcgcgcgcgtgcggccgcggccgcggccggcggctcgtgtctcggtgtcgctggcgcggtgcaccgtcgcctgtggacgcccctgttgcgttgtctttgttggtcgttgtcggtctncggctcgggcgctctcggtccgtgacgcgtgtcgtgtcttgtgcccgcggggcgccggcgctgcttgtgtgcgcgctgcggggcgcgcggcgcccccccgcggtctcgctccgggagtccgctctctccgtctctctgccgttgctatttttgttgggtgtgtggcgctgctcctattgtggtgtggcggggcgcgccgggggtgcgtgtgtgtcgtttttgtcttttgtcgtctcgttgcgcctcgttcttttgtctcgttcgtcgggcgcggttgcttctgtccggcgcgcggtcggcgccgcggcgtaggggtgggtgtctcctccgcccgcgtcggctctgttcggttctgtgtgtggttcggggctgtggttcgtgccgcctgcggcgccgccgggcgccgcgtgcgctctgcccttcgtcgccccctctgtctccccgccggcggacgctcggctngcgctctgcgggggccgtgtgcttttctgtttcttgctgtttcgtgtgtgcttgttgttcgtctgggggtgtgcgtgtggtggttggttcgttctggttttcggggcgcgtgtttgggtcctcctctgtccttttgttcctcctttccgccgtgctcgttctctcgtgtcttgtttggcgtggcttcgccggctaacgcggtgggtggtgcccgccgagctttttggtgcgccttctctcgcgtccgcgcctgtgggtggcgggt

SEQ ID NO: 10903 - DNA, 1675 bp, Homo sapiens
  misc_feature (1)...(1675): n = A,T,C or G
ctgtgcacttagagtcttcacctacggcgtctcgcggccgctgtgtgctctctccttgttcactcttcgcgcagtggtgcctgactgtctcctgatccgcgtgtttgtgatactttcactatcaccgggagcatgaactgtagagtctgngccggaacatcgtgcagccgcgatgctgtgtagtggcaaggttgtattatactcataggatgatacattccgttcacgactcgctgattaagtattatgtgctgttgtttggtngctgttgcnctgtattctttccgctcagcgctatggtcgcgtgtctcgtgtgtacgcgtcgcgcgtgcggtagctggccacccgtgacacacgtcgatcggatcgttgcgcgggccgcaggctgcgacgcgatgatccgtgtcttcacttgattttgacatgattacatctctcagntgcgactatcgattatttgttgatgtaatagcacatactagtagtatcgnacgngcgagtgantcaacgacagggagatggcgtatctatacgattcgcacgtatggccatctgacatatgtcgttatatcgcgctgaccactaacganctcataactatctcagctcgcttgcatgcagngntcgagtggcatcgctcagtctactctgaattcgataagttgttgtatgtgtcngatttacgtacgatgtacctgactgagtcatcgtcatgttattatctgagtgtatataatctcttagctcgtgtgcacatgctgatcggtggtgtncatgtnctgtgtctgaggtctcgtgtaccgtcgttgtgtattatgtgcatggtgtgagcgtgtatcgtgctgcgtctgtcatgactcgtcgcgcgtgncgctctgtgactgtgtgatgtatgttcgcggtgacatagatnatagagatgtcagcgctgcgagacgcgctctgcgncgacgcggcaccgctcagcgtgtcgtagacgagatcnggcgttgctactcgaggtgctgcgttttcacgatcgcgccgcgggagcatcgcgctgcgtctctgcgcgcctccgtggatctcgatcgtgcgcatcgcagtgtgatcagcgtgagcagcgcgctggagtgcanttgataagatctctatggtatagctcatacatagctctacgtgaggacgcacactcgattggcgagtcgtcatccgtcgtcgtgcgtctcgtgtggtgttgtgtgtgtgtcatactacgactctcggtancagctcagcgcggacgtccgcncgtgttgactgtacgcactgttatctcacgctctatgtgttgttcagttacatnttagtataattgtgatagcgagatgtggagtgaanttacgtcgtgtggttgcttcgatgtgtgacaccacgaatgctagtcgntgtgattatgagtggatcagatgcgtgtggtctctgatgatcgattgcgattatgaggtactcgatgtgcatagtatggcgacctacttcgtcactctgtctcatctctagttacaattcancaccttctacctcactcctctgatncttcatattcaatcagtcacaccgcaactctcaacactatatatacaatctttatctatatatatctttcatatatcgtactgtatatntactatatgctcctgcacctctccttccatcc

SEQ ID NO: 10904 - DNA, 815 bp, Homo sapiens
aggtcttgttgccagcgctcttatcccggttgtctagctctcgttgactctacaccggtcgctgtgctgaactcggttgtgctgagtgttgcggccggggtgcgcgatctctgctgcttactggatcgagttgtatacaataccgtgtggggaagcactctccgagaggtaggaatgtggaggggcgcctcgtggcctctcgctggtaactattgtgtgctgcgcgagggggcctcgcccctcgggcgtcggcttccttgtttcgtctgcggtaggtatcgctgatacatacttgcttttggttgttcaccctctataggtaggtttgtccgcgtgttcttttcttgcggtccttacgcgtttgagcgtggcccgcaagcctgtctcgtctctcacgaggacccagcgtgcagacaagtcgacgatcaggtttgcttcgtgttggccttaaacgtactcccttcgtcgtttatattttctgggtctatacgaacttgtctttcatatattatctatgtatggcggctttgggcggtgttaccgcggagagcatggttttatcagttggttaaaagtttgtgttttggtggttggtccccccatgatcttataacaagggtgggggtgttgtgtcttgctcgtgtctagcggcaagactttgtctactctgttttgcttctcgcgcgtggcgccagccgtccgtgcgctttctgccgtcggtgctctccttctcccgtttcttctcgtcgttttcgcagaaaggggtgttgttccctagagcttttttttttttcgtggctctgttgggcggcccc

SEQ ID NO: 10905 - DNA, 983 bp, Homo sapiens
  misc_feature (1)...(983): n = A,T,C or G
ccgcaccaggcaggaaggcganacaacctttagcggcgaccacctcggaaacctcattctactctctgcttctatgagtctattaacagatgaatggatatagaaaatacgcggtacatatgcaatggaatattattcacgcataaaaaaagaaggaaaccctgccatttgcagcaagatggatgaacctgcaggacattgcgctaagtcgaaataagccaaacactgaagcttctctagattgatggtcctcccactgggttttgctgaccgggcggtcaccttgcgtcctgagagggaacacaacttcgcataggctgcgcctcgatcgccgcgtgtgcctacaccacatcatgagccctaccgcgttactgaccaccacgaacgtatagaggcattacgacaattggaaggatcaggggacgccgcctcgtggcccctcaagacgctcgaggacgcccgcgcctcgaacaagcaagcatgagatcagcttgcagcggcgcaaggtacgccaaccagctggggggccgcccacgcgcgcctcgagctgccgcccggcgcgtggcgcgggctcggcgcgtcgcctgggccgtgtccggggcggccgcctctgnccttctcttgacgcccagtgactgtccctgtttcgcggcgcgcgagacgcgaccaccccgtagcccgcgagtggtgtgctcagctgcccgtgcgccagacagccctcgagatcggcgaagggaaagatagaaggaagcggagagcgcgcgacgaacaccgcatcgcccagacaccacgcacagccacgcgccgcggccggacacccaggcgtgagatgctagcgctcagggacgcaggaaccgtgttgggagggtggcatacgacgcccggccgagcagcagcctgccggcgcgcggaggtggcgagaccgagcgcgaccggcagcaacgccgcccaatcgctgcgaccgtggagcggaggagcggggg

SEQ ID NO: 10906 - DNA, 1611 bp, Homo sapiens
  misc_feature (1)...(1611): n = A,T,C or G
ctgacgggtcgatatacaggagcgcgagcgcgtactgtgactacanggactacgctcgcagancttatactgcagatacgntttgatagtttgtcatgtagacagcaccatatacacagagcgcatcgactcatngantcgngtcatnactcttatgctactctgtcacatagtntcactcatctattatttnctagagtctatccatcacatacacactgcactcncnatgcagagtcgtcntttngctagccggatagtattangcacgtactatgtcttctcgccttactctacacacgtacccagccactgtctatataggtgcatgngtgtagcgtcagtctctttgcgtgtcttgcgtgtacgcgtagcacaacgatcntcaagcagtgcgtacgtgactaattcantatatattgaatccacggttgtctctcacgctctcacgntacgtctancgacggagctnctcgcgtgtnagcgtctgcctcatcgtgtgtcgctctgctcctgtatagacgactgtatcgctaagagacgctaattgagagttntagatgagtcgtaagactgaggtgagtgagtgactgggtgaacgtgatcgtgggagtactgtgagtgtacgtgtgttccagctctctcagtgaatgtgtctgctaattggngtgtgtatcgtcatacgtgtggtgcgagtgtcgtgtgntgagagccgagtacttcgtctagcatagatgcgacaggagtgtatagacgatcggtcgcggcaacgcgaagctagctatggcgtgctagcgagacataccaggacacagcactatgntaagcactcgagtagaggaagtgaacactgacatgcgcctgagatgatgtctcatcggcacagggtgcgaccggcgacgcngctctcggtgtcaacactacgagagaaacacattctaagcaacgcaactagcacatgtccacccggtcagactgacantacacgacgatgtcgattgagtgaataatacagtcggccgacgtccgcacataggagctaatgaagcactgtataggcgtcatattgatccgttgtgangatcgtcntcgcactgctgtctgctccgacccaaccgatcgcccgtacggagcgcgagaacnggggcgatgccagtagtctaaacgtntcggcgagacaatatagctacacctgacacgtgccgctgcataccacataacaataacgactacatcatcgtaagacaataataacaataaagcacgnacacgacaagtatactctatgatatcattatcatattatnacaatctgagcntgaagtagtcgttctgcgatcggcgtggactctgcgaatgaaaaatgggaggagtggatgaacggngatagaaggactcacgactaactaggttgcgtgagaaacgcgagtgtggcgatagcaacgatctgtggaataatcagacgcactcatccaaggagcagccgtaaacgctacgtatccgtaccatcgatgtcgtagactcatgctatcgacgttgccgggaatagtagaactaggaactctgtatgcgtattggtaccgcacctatgcgtaggcatacacccacagc

SEQ ID NO: 10907 - DNA, 1082 bp, Homo sapiens
  misc_feature (1)...(1082): n = A,T,C or G
tccggccgngtgttcggtgtcgcgccgtgccgctgtcgtcgtgttgtttgtgcccgctggcgtgtcgttgcctncccgtcgtggtgggtggttgcgcggcgctgcggttgcggggcggctttgtctcggcgcggctgcgttggtggcgtcgtgtgccggttcgggtcggtcgctgttgtgcggccctctctgcctctctttctcgctcgcctctggtatgggttcgtccttctcgcgtcgcgccgctccctctctccttgggtgacgccgcccgctgctgccgcgggtcggcgttcctccctcggggcgtcttcgcgcgcgttgtgtcggcggcggggtggggttgggtcgtgctgcgcttggttgtgctcgctcccccgccggtgcggcgcggttgttcgcgggctgggtgtggcttttggtcggttcttctgtgggcgcctgcgcgccgttttccttttctctggtggccgttctccgccgtgcgggggtgtcgtgggtgcccgtgtcggcggctctgtttttttctgttccgtggcgcgcccctcgcgcggtcgcggtgtggggggcgcctggcgcgctggccgttctttgctgcggtgtggcggtgcgctcccctctgtggtttgtcgctgtgggttgggtgtctcccgcttgcctcctgctgtgggtggcgccccgccgttcccgctccgcgtttcgcgcgtgtttgtgggttttttcgcgtctaccaagagcggttctccccctggcttgttgtggtcccccctcgggccgtggcgcgtttttgctggttcccgtgtgggccctcttttgtccccgcttctctctgtggtgcgtttcgcggtctcgggcttggggtgtgtttttgggggcgtngtccggcctggccgcgcgcgggtggcggccggttcggtgggagaggcgctggcgnggcggcggccncttnttnnnnnntnnttatgggctttcgtctggcctncaggcggtggnnngntnattgngcttctgaggttttttcccttnnctcttgtgtcttggtttgtggttgcttcggtctgtgctgctgcggtctgcgccgc

SEQ ID NO: 10908 - DNA, 1355 bp, Homo sapiens
  misc_feature (1)...(1355): n = A,T,C or G
ccgtgctcctagtcacctctcctacgcacccacgcagaacatgatctagatgncacatctgttgactatagtttgcggcntcatctctccatagaacgataatacataagtgagtatcagcgctatgatctactcacacgctcccagtacacacgatttanacatacagagagcgtatagtgtgtgaggcgagtcatatagacgaaacagagagatgttatctgtgtgcgactggcgccgtgcgagagtagtaggtagtgtgtaccagtcactcgtgtgcgatattccgctctgatcacgatctcattcacacttcttatcgtcgacggtgcgctctgcggcgcgtgtgcggagcacgtggtcacacatttcataccgccgcaactgtagacgatgacccgagtacgtcctcgaccgccgctctctagtcagcattacacgcgcacggactctcgtcatatgcttatctagccctcgaagtggagagcatcacgacgatgcactactattttctatattattgacgaaggtggcaggtagcgtaggggacctggctcgcagctagtcgtgatataacatacagtccctaatatagcggtcagtcagtacttatctataccacctatgagtagtactcgtggagcgatttcactctacttctgccgcgtgaatctaatcagccgtctactcttccttacaatcttcttctggtaaagtgccgggtagggtcggatacttctaattggttatcgattatatgcacgaagtgcatgatcgtacgtaggtggagagatgacacactccaattgcgcttctcagtggtgatataagagaaatacgatagcaccacgccataaacgattctaacacagtctacaccgtctgaacccgcgttctccctctctccgtctcgcctcacaagtctctgacgcggtcgcccatgtcaacctagcgaggtagacgacttacacgaacacagcacgacaccgcacggcagattgctatcaggagtatgctaaggcgtctgtcctaacaccttcgtgtgacctgctatgagtggcgtcagtacgagacgggcagttacagcgtcgcgtcgtaacacaataggagcatctcacacaacgcagtcgtggaggcacgagtgcgggtgggtggcgtcgtcttcttttggtgtatagatcaacgtacccggcaccatcatctctttctatctttgccctccgcttagcgctattactcactacattgtatgatttctcattcatgaccacagactgaggcacaagttagtaaggcggaaggtcacgtatcctaattattgcctcgtattctcgtgctccagcgcgtctacactc

SEQ ID NO: 10909 - DNA, 458 bp, Homo sapiens
atcctgtttttcccgaccccacaagtaaatgcctcaggaccccatctaatctgtttagacatcagacagattccaactcaaggacattctacaaaatacctgactggcacttcttataactgtcagggtcttcaaagacaaggaaagactaagaagctgccacagccaagaggagcctcagaagacgtgatgacaaaacgtaatgtgggactgtgggacagataaaagacattagagaaaagctaaggaaggccgaaagaatgtggaaggcagctactaataacgcgtcaacactggctcctgagttgtgctgtccgtactgcacactgcggttaccatcacgggaaactgggcgcgggttgtgtgggaacctctgctcaccttttagaattttttttccctgaacatctgaagccaattctaagctaaacattagtcgaaattcaaaaaaaaaaaaa

SEQ ID NO: 10910 - DNA, 972 bp, Homo sapiens
  misc_feature (1)...(972): n = A,T,C or G
ttatctatattttaccgtcacaaaaacacacgcctcgaggtaaacaaagaaatggccgttttcaccaacaaacatacccaaaggacctacagcttggacccagtcctctctttaaagtgtgacaaccattcttagcttggaatccttacaaaagcaagtcatgaattggatttgtctcacaggccataatctgctgattcctgctacgtactggttgatacacgtatttgtacataaaagtataagaaaagataaaatatatacagagaagactatatatactgtatacctctatatagagttaatagtacttacctctgaggagacacggaagacaacaggaatgggatgtaggacatacagccacatttatttcatttattaaagatctaaagcagatatgaagaaaaaccattaccaattaagttttacataatgggtgcaagatactttgtttttattattcttcatgatattatgctcaaaaatatcttccatataaaagattgcatacgaaaacaacatacaaccaatggccacgtatggtctaatngggtggagctactgaggaccattccattttaaggaaggtgcaatcatatgaccctccactcacttgactcgctagaactccgaccctaccgctggcgaaaaccgatattaactaccttaagggcggtcattctgtcatccacataatctggggataacccacgaataaacatgcgatcacagggctaccatatggcccccatctccaaaaggccgttttgtatgcattattaataggctcccctccttcttaagctatataaattcgccgtcatcatttaggtggataactccaccagaatatcagaatctttactattctcccaagaaatacctattgcggatgatgaaagacctcacataactcgaaactaataacttctctttcggaactgtgccgtatctatactacacacctct

SEQ ID NO: 10911 - DNA, 1643 bp, Homo sapiens
  misc_feature (1)...(1643): n = A,T,C or G
cctcacaacacactgtatctatactagagctagtcntctgtcagtgccgcatcacacagactgcatccgtctccacgtgcacgtgtctctcacacgaacactncgtagagaccgataatatgntcaacacgtgtntagctatncaatagctaatngtgtntgtgctattatatctgtatagacgcatntgcatcatatcgtacgaacgntgaaagtcgcanccgcgtgaagaacngtgcgatgtgacgngatacgcgtaccgtgcgtgcgncgtctccatgtgtaggtanacatnnattcgctccanctagatcggtaaactgagtgntcatacatncnaagnantcgtagctacactcgtactgcatgctgtaggagatcacgcgcgacggagatcgnatcacggcgagnctcgcgtgatcatctntcaggttgtatcatgtatacacgagatggacatcaagtacacgtaatggtctaaangcagcaactaactcacgaggtggtcgaatgtcggcagtagacatggactctactatatatatcgtggagaccatcaatggtgtgggacgcgtatcgtgcgtcgtcggtctgagcttacgtcatgcgctcacacgntactatgtctttctctactactgtgtatagctnactacatctcgtacctcagcgagcgacgtagcgcaggagcggattgagatagacgcantcatctgcacatctctcantacgcaaatcactgtagactatgtagaagcgagcgaacatctgcgtgcgcatagaacgtatgagagagcgagcaaaggtacgacaagcgccgagtgtagtattcatagtaatgtcttatcatcanattctatatatctncaatcttctattaatcgattgtatatagtaagtaaagacaatgatgatacaatagcgcgcccgtcggtggcataggcgagcctaccgatcgcaggccgacaacacccagctgttaccttcatcattcaacctacagacacacaggtgccactcaacataagcgatccctacagagcggagtgatgagcgtgttgcgtgtcgctgtccgctgtcgtccgagcgagcgtctcggggggacagctggtaatgcgagggtcgctctnagacaaacatcggtcatcctcttactgctatcctctatgtgcgaatattaccctcctcactgcggagccacgaaacgattatgctggccgctntcttacataatccacaatatactgcgccatctaccacacatccatcacgtcgtcgatggggttcgcgctccgtacatacgacaggagatgagtgccaataaagcggtagctatagaattgtatgtattagtgggggtattctgtgttgtagtggtatgtnttattgntgtggtctgcgtgcatgtcgtcgctcagctgtatcganaccttctgctcatgatcgatanaacctttacccactagctgtaatcctcatatttaccataggtagagcggctaggcgagcatagcatagtacgcgagcacagctggagagagctgagcagaagcagcatctgctcataagtggtcacttacgatagatgaacaggcagnagctagcgcgcgcagatgcactggtgtagtagaacgatatatcat

SEQ ID NO: 10912 - DNA, 1251 bp, Homo sapiens
  misc_feature (1)...(1251): n = A,T,C or G
gttgtcgcgtcgcttctcgtgcggtctcttgtgtgggtctgcgtttctttctggtcctctttccgcttggtcttcactggctcccctggtgctcttgtgcgtcgatgtgctccggcgctcgggtgtgcgtctctcttcgttccgctctcctctgtctctcggtcgctgttgtgtgtctgcgtcctcggtcccttcgtgcgccggtcggtggtcgtgtcgctctgtccncctggtcgttcgcggtctgtgtgtgccgttcgtcgtcgtcttcgttctgcgtcttcctccggtccgttgttggtgcgtcggtgtgggctgtgcttccgcgtcccgcctggttcgttggcggcttgcgggtggtgccttggttctcggtgtggtgtcgtgcgtcggtgcttcgcttcngcgcgcgcgggtcgtcgtgtcgggctatcgtgctgntcgccgttcgtgtcggttcgcgctcgcgctctgctcgcgcgcgctccgttgttgcgtctctgtggtgtcctgtgttgtctgtcgactggtgcgtcgtctcccattgctgctggtacgtgctgtgtgcgtgctcggcgcctgcttgtgtttgtnttgtgtgtctctcctttcctgcctgccgcgcntgtcggtcggttggccacttnctgcgcgtgctcgtgccgtgccgtgtggtgctttcgttggggttgtttgttgtgttgctttctggcggtcggctgcgttgttttttggtttttgtccgcttctggtccggttcgtgttttcgtcgtgtgggtccccttcgtgtctttgtcccttctgtccgtggggtttcctcttgttgggtgttccttgtccctttctcgcccgcgtggggttttcggggtgctgctgcttgtgtccgtcgtgtctggtcgcctgtgcttcgcttgcttctcttgtggtcggggtctctgggtgtgttggtgtcgcgctcttccttccgcgctgccgtncgttgccgccgcgtggttgtggtcgtggcgtgggcggttcgttgtcgtgtttgctggttgtggtgcgctgcgcggcttgttgtcgctgccgtgggtggggcggtgtcgttccgtttctgcgtgcgcggtgtctgtctgtgtcgtctgcgttggctgtggggctcggtgggctctttgttcgcgtcttcacacccgtggtgccgtttgtttccccctccgagcgttttctgctgctgttgggtccgttgtgtgtctgggtgtgtctcgccggccg

SEQ ID NO: 10913 - DNA, 1002 bp, Homo sapiens
  misc_feature (1)...(1002): n = A,T,C or G
ccaacagtctcccgccccccatcatatccacattccctcggnggctagacccgcctcaatccaatctgtcattataagaagaggaaatttggacacaaaaagagacaccaggggcgtatgtacacagagaaaagatcacgtgaggacacagagaggtctgcaaaccaagaagagaagcctcagaagaaacaaaaccagtcaaccccttgatcttggacttgtagcttccagacttgcgaggaaataaatttctgtcttaacgccttacatattaaattacattggcctccccggatcttaacggcgtagccttcgccgacaattgcctttcctgtagggtcgattcctgatcgcttagttatagcaaacctagtctcggccagcattctgtctccctccctcatatgttcgctcaatgccaataatttcgatcccaccttccgtaattgttatactgtatccccgatctcgtgatttcagtatgtttcctattacgacttcgaccctagtaattatctctaatttgtaccgtaccttcacacagcattctatctatatataaagtaccctcccttcgttccatctcccacacacttaagtttaaacagttcagttcctcccgtttattctctcctagacatacttccctcgacatcacccctacctctttccgcgcacaccaactaatggcatagtgattacccatagtgcatcatccatagtccgaaccgtgtcatcccctaatctactcgatctatacatctactgccctccatttgatcgatcatttatagtatatctgcgcgccgatgtttcactgagtattcgtcgtcgtacgttcgacgaactggtagttactcaataacatagattatcacccaccatatgatctctacgatttccagtatttacccctgctaaacccctcctgatccaataccagcccccctgaagactactgtgggaatcatgcaatatcagcatacccctggagcgccgagc

SEQ ID NO: 10914 - DNA, 1686 bp, Homo sapiens
  misc_feature (1)...(1686): n = A,T,C or G
ctatggtcgctccattaagatcctctaacgccgagtacacgccgtcgtgtagtcgcgtgtggtatatcgttatagtggagcgatgtctctgcccgtcacgcatcaggcgttacaaacacagatacagaaagcgctcgacatgcaccgcgccgcncgcgcattgatctcgtacgcgcgtgataataagtggagtctgatgtagctgacgagcgggtcagcgcggcgacacgacacgaccgtacgcaggctcatagacatcgacagtatgatgttagtacgtccgcacgcgacnatactttccgcantgtgtaccatcgtccggtatcgcatcgttccatccgtccagtatcacacagcgtgctctgctacatatacaaggtagactgatcgangctgtcatgtagagactctacgcggtcgtcgagcatatggattagacgcacagtgatatctgtcattgaatcgagtcgccaccgactcaccctcgntctcnctccgacatcgtaccagcgctcgagtgcggcgcgccgctacgattacncatcaccgcagtgcacgtctccgcagacgccccatcacatactactactctctctcactctgagtatatcgtagagcagcctgctcgcgtgctatangctatatgcaaatgatgagagacgatacgcacgtgtcagccgctgctcgctgcactacgacagtgatgacatccgcagagantatagtcacgtggacttgactacgtcacgtagagcgacacacgcgtcgcgacnccncgnctacgttganttgtgtgtaagttgactcatcctggtactgtagagctgagcgtgtctgcgcgaggatctactcacagaccgctcgttccctactacgcagtgtcgtaactgtatctgtgcagagtgtacgatacattatgagacgtgactgacagttcgcatacccgtcagaaccggcggctagcctgccancgagaaacgaggtacatgatccgatgatcagtctcgatcgctcgnactatcactcactcgactagcgctcatagcacgcgattgatgatgtgatggaaggcgacgagactacaggacaagtagaactctgcacgtgngacattccganagaanancagcacacgtgatatcagtctgatactgtgtctgtcctgctctactactcctacacgtgtcgatctngagtcttcatctagactctaacgtagtatggatgctntngtnagtatgatangatgtgcgttgcagctgtcagtagnagtacgagcgcgatccgcngtctntatacgngctncagctctncgtattgacangtcagactagtgatccggtcgcgctcagcaccagcagcactacatatactgtgctactgacatacgcacatcactgtatctgctcactgtcgacgctcctgagtntcaagngcgtcgtagtacctagactcgtntatcgttcganantctgagacgtgcgtgatctgagacgtgtaatgctcaacacacntgaganngtcgtcgtgcacacgtgacnttagacagatgatcacgacnagtactagcgtacgtcgcatcggcaccgcagcatgcttanagcagacactncnanctgcctacactncgacagancgagcgtactatcgcgcgcacgcgcatcatctntctgctactgactgctg

SEQ ID NO: 10915 - DNA, 1035 bp, Homo sapiens
ctaccctccctcatacaaaaacgtcttaggggaacagcttaaaagcctggtactcaaggccgctcatttaaagaactacacctcgacgaacttcgtccagatctcaccatgatttaaatgatcgacactcacgatttcaactcaatatctgagatcgatggccgctttcgcgaccttctctagggatgaaagcctccttactcgcgggaaacacgtatctgctatatagttcactaatgaacaacagtgtccgtctaaaacaagttcctatctacctccctgatattcctccccctcaaaatgtcgcaaacaattctcaattcttcctcctctgttatctgactttcttaactaatcaagacatttcactgactctccttgctaaccacaccctattatcgacatactaatttccacacatcaaataatcctcatcccatatccacccatcacaccctatctccccccaatgtcaatccgaaaactccacctcattactctcttcttctacactcttctatttcaacgtaattgtctctatatccctcttctccccatacaatatcgtatttataactccaccagtattgcgatcaccccggcccactactagatctctctatgtctgcaaccccgtaccgttccctcttacacttcaaccacacgcccaattagctcaacccccccctgaccccgctccattgacttccatcatatgctcttagtttaatccgccattctacttcccctcacgacgatatcgccatccatacccccgtcccacgttatctcacccgaaactactcacacaccatacgtctcgtattcctccacaccccaccacatctctccctccattatcctaactaaacatactccctctcgcagattaagaacaaatccacccctcatcatagaccacctaaccgctattgtattccgatccttctatcctcacatgctcgtcccctatccaccctccgcccgaactgtacgccatgtatactatactcactccctcactataagtgacct

SEQ ID NO: 10916 - DNA, 1003 bp, Homo sapiens
  misc_feature (1)...(1003): n = A,T,C or G
ccttttcccgtctcggtgctcggtctcctaattctgtctcatcttagagcgcttgcttactgttcatactcagcttcaccttctatctttcttcctcagtcctcgtcttgtgcgttatatttctgcgctatttctgctctcttctcctacgtccgtccctggatgttgttcatcatctgtttctatccggggcaatacgatactccttctttcagcgcgtctggcagcgggccacggtgccgaaagtcacagccgcccaacaacccaaaagggcgtcacgcccccccgcaccggatgaggtgtgtatggtgctgccgtgcgccatctgcctgctcgaagtctcctcgtcggcgtgcgcggtgtgggtgatctgtgcgggtctcttcactcgtgtcatctctatttcctgtgcgcctgtcgttctcgcgtccccgcggcccgccgtcgccccccgcgccgctcttgggggggtctctctcagctgtccgcccggccgtggagacgagtggcacgcgcgggctacgctaggttctgtgctcacgcttttgtgtccgcccttttgcctgggggagctcgtgtgggtggcggcgaatatgttgttcgtcagtgatgctcccgtttttttgttgtttgttttctgctttgttgcctctcttcgctactccttctttgtttctgtttgcttgccgtggaaatggttttttttctgtctttctcttctttcttttcttttttctggttccttttttttttctcctcttcactccctctcctctcctcgttctctcctcccttttttttttgttctgccgttttttgttctgctccacctcctcccctccttttccttcnctttttttttccttnttccttcatntnnngcgncgcccctttttctctttttctttttggtttcccctcttaacttttttttttttttttctttaaattttttttncnctttatcctacccctccctccnnatttcttttctccccctctt

SEQ ID NO: 10917 - DNA, 528 bp, Homo sapiens
gatcattaaccaatcaaaagacctaatgggactttactctctttcccaggctgaactgcaatggtgcaatctcggctcaccgcaagctccacttcccaggtgaatggataaacaaacggtggtatatccatacagtggaatactattcatcaataaaaggaaatgaggcatgaagacacagaaaacacggggaaacttaaatgcatattgttaagtgaaagaagctagtctgaaaaggctgcatactatattattccaactatatgacattttggaaaatgctaaactataaggatagtggaaagatcagtggttgccaggatctaggatggcgggaagaagagaaggatgaacaggtagaacacagaggacttctagggttataaaactattcagtatgatcctgtaatgatcatttgaatatttgtcaagacctctataatggtcaacacataaagtgaacactaatggaactatgaacttttaattattaaaatgcatcaattctggctcataaaaaaaaaaaaa

SEQ ID NO: 10918 - DNA, 949 bp, Homo sapiens
  misc_feature (1)...(949): n = A,T,C or G
ccaccagatacataatantattgtgggcgtcgggcgtacagcgggcagttcttccggtctactgactcacatgcatctttcagaacacctacagacacacctggagaagctacgcattctattaaaatgaaaaccacctggaattctctttaagcataagaggagtgggttccattcccatgcgagagttgggatatggaaccgtgtactaggtgtaccgacaaaataggggacaagtcaagtaacaggatgagacttgaagcctatacgctctactcagcgatatatcgaggacgcacgatgtcggaactacctcaccaaaggcaagcgagagatgcgagtgtggggccccccaaccagattaggatccaatcttttcgactataaacacgctcccgacgtgatccgcggaactggcttggaatgtaaacaccccctgtccaccgccctggagataggcacacagacgaaacacacatcactacacggcggcacgcgctgcgtcttgcccgttattcgatttacccattgtacgtagccaaacgtcacttcgcagaatctaactagagtacgtcccggaggcattgcgagttgcacgtttcgacactatcgtccgcactcagtgaggagattcaacagagacttaactcgggagtgcaacgtagagtggctactggcagcgacagccgagcggcgctcattgaatcatgacataagatagcgcgcccttgagatggtccgcgcacttcatagaggaaacgcccgtaatctagagcccgccgcaatcatacttcattccacgccccgtattcggatatacctcttcaacacgaaaaaatatatcccgctcttgtggtaaggcgtggacgacgatacgagcgggagcgcgttgcaggaagcgtattggatacgggatttttaggcgcgtgcggagtgggtatgggtaatg

SEQ ID NO: 10919 - DNA, 973 bp, Homo sapiens
  misc_feature (1)...(973): n = A,T,C or G
cccctactatatatgaaatggatgctcctcgcttcccctttgatcgagttaaaaacagcaggaccaatctacctgcagaataagcttcagtcccacgatacttggcctgattcctcacacaaactgcagccagaatcattgcccatactcggctctcctaaattgcctttgttggaacctataccacaactattccaccccaagctctccgagaataaggagcccttccaactgcgctctggtataaaagaacacatatacatccttgaattatgcacaccacctccttgcttctgcataaagaatattcagtgtaggaatctccaacaccaactcaagtataccgatccctactcttcaccaacctcctccatcttctactcctttcccatcggtcataacaccccgccaccatctccagtcgctcccgggtcttctttctccgcacatcctacccaccccccatattgtcaccacggatatcccacctacgtatcccactatatcacactatcgccgccgtcgctccatcccttccgaactcctaagcccacttcttcaccatcacttgcatcaggattacaccgccccccgcctccgcttgcctccccctccgcccttctcgacgtgacgctcatcttttataaaacacccatatgggccacacatcgtccgattcactctcacagctctctaacaacaacactacccacgttaacgtcacaatatctatataactaaagtattcctcttttccgcgctcgacgcgcgacgatcacgccccgcacgtttcgtgcccgccaccagattataataaacgcgcgccctgattctacatttccttcaccccccccgtgtttaatccaccctcctcatctaatcccatcccatcccctacctgtccgtctatcatctgcgagatctaatcgataccatcccnaaccgtcgcctccaggcagcccccaccctacct

SEQ ID NO: 10920 - DNA, 1347 bp, Homo sapiens
  misc_feature (1)...(1347): n = A,T,C or G
ctatagagtaatagagagagcgaggcatgatcaagaggaagtagagaatatagaagcatagtgacgaacatcgacaacatcggagtcaccaagncgacggagccacacgatatatgccaaacacgcgcggacgtatcgcgcgtggatagtgaacggagctaaacgcaatacganagacaggagcgagaaggagtagcagagaatacagcaacgacagacagccggcataaggacgacacgtccacacactacgccatnactgatcnaagtgagagacggataacacaagcgcaggaccgcacggacactaagcacaagcagactgcgtcacgcgcgctacgcagcgcaacttacttgcgcagtcatcagaggaagcgcgagatggcgccgacggcagcagaggaccgtgtcagcaaaacatacagaacgagcgcgcgacacgcgtccgagaaagacaagagcaacgagtagacaccgagcacaagcagagcgcgcaagttatagactaagaactacacaacgagatagagagacatctatatagatgggaccgagtatgctaactgatgatgagatgcgtagaggatatgggcgatacacatccacacaagtagacagaacagaacaagaaacaaggacatagagcgagaganagatagacgaagcccgcggtagttacggacgactgcctctcccgacgcgtcgaccantcgattctccgtgcatgacactctcggtagtcggatcgtctcaggctgcaaatacgatagcactgacgaagtattaccgcggatacggagacgtagaagtagtaccgtatgatgcatacgatgatagagtaccagangcgaggacaaggcggacctcaggccagacgcagggtacaacaaagatgaggaagagaatgaagcttacgggaacgatgcatccccacacgatcggaaaccgccacggccgagaccagaaatcgaatgaacgcacatccagtaaccgcatggcatccgcaacacatttgacagcggcacgccgcacggcgacccccaaccggtacagacataacgcatgcacgaccaggcggctagtngaagaataataaaatagtagcgcataacacgaggtaagtagtgtggcggaaatggttgccgacagtgtaaggagaagggagacgtggccgaagagaccaaaaggagacancccttctctatcctcatccatagctcgtaagacagtacaatangacgctatgttgttcgatgtgaggcggagacgaggagagagagagaaatagagcatatagcagaaacagagagagagaaaacacgaagagggcagggcgcggagaacaat

SEQ ID NO: 10921 - DNA, 1526 bp, Homo sapiens
  misc_feature (1)...(1526): n = A,T,C or G
agcgcacgagggtacatggaggaagacaggcatgaaggtacgtgtgngagtaaggtttatgaacggacacacgctcgtcatcgtggttgagaggcgaccacctgggcgtacttgagtcaatagtgtgacacagcaatatgntcctgtatgtgatgtcgaatgtacactggactganacgtgagagtgatctgtgtggatctgtgcgcacacgcatcgatcgaccgtcacgcgagtggagcgcgcgcgcagcgtcggtggcatatccgcgacgacgcgctggctcgtgcgtctacctangtgatgagcacgagtattgtgattatctgcggtcactactgagccancgagtggtgtaacctggtgtgagatgtcgatgtgcgagagtcaacgcgatgtcgcgctcgacgnggtgctagcgtcgacatagacctgcgtcgcgtgaatctcggctgactcgatcctcgcgagtgccggctgggcgcgtaggtgtcgcgcagaagtanttgctcantgtctgcgcgagagtacacggatgctcgtctcgcnggtacgacacgagctcgcgatgagcgacgtcgcgcggcgctgcagcggttaccgctcctagtgctatattcggcgtgagaacatcntggtatcatcagactactctcacgcagagtagatgcgtgtcgtgacgcgacgcgagcgnatgactagtgnggtcacgcgtcttaantctcgctgcatgcgntgcgcgagggacgtgtacgtggcggacacctgctgtggtcgatgccgctgcgcgtacgaccgccggagcgcgtcgatgttgtacgaagttctgagacgagagattggtgttgaggcggcgaggatcggagaggtcaaggtatgttgatatcacggcggcgngtgtgcgagcgtccgcgggtcgacgtcgcgagagagcagagcgctcaagagcgtgtgcgtctaagcttcgatggctgagtaatagcgggngtacgnggtgtctttctcgatgtgcctcgggtggcacataacgcaggtatactactgtgcagagataagttgtgngaggtcgtgcacgacggacgcacgtatctatatgtctcatgaagcaagcatgtagttactactatgcttcttcctagaagttgtgtcgtgagggcgtgttagtgtaccanatatatgtgatagagagtatcatatcaggtagcactcgacggacgtatgcaaagcaagaagatgtctacgtggtggggatgtgccgtgtaggacatacgatgagacggacgaagaggagatgcgcacgtgacagtgtgtgctcgacatcaagacgacgcttcgcgattatagactganacacaagaacaagataatagaatatagatgcggctctcctgttgtgncttaaaaagcttgngtgtgnagtctgtgttgtctcctcttntgacgcctatcttctctatctgttgtgtgtgcttctttgcnctgatcgtctctagatagtagcacgcgcgggtcgtggtccagaggcagc

SEQ ID NO: 10922 - DNA, 288 bp, Homo sapiens
gaaattttatcgtacactacgggatggcggctttaggcgcaccagcattagcatctcagacacacagagggaagaaggccatagaaagacaaaggcaaagattggagttgtactgccacaagcccaagaatgaggaaaccaccaggagctagaagaaacaagcaaggattcgtccctggattggtctttcaaagggagcatggccctgctgacactttaatttcagacttctaggctgcagaaccattaaagaataaatttcctttggttcaagcaaaaaaaaaaaaa

SEQ ID NO: 10923 - DNA, 1255 bp, Homo sapiens
  misc_feature (1)...(1255): n = A,T,C or G
gcaggctgccgcccccacgaccagacagagggcacagacacggcaacatcctgcnagagaacaaccaccagncagcctccgctcagcaaggagcgaaacagagnaacacnccagagcagacatgtgcgttgnctacctgcctctatctagctacacctcacacagagtcgcttcagtccaccagtatgtcacgcatatcgcagcgatgctcagcactccaagcaccgtccagatcgcgcaaggacacacaagcacgcaaccaacaaccatcgacctcgcgccacgctatcggcgacacagcaccgacctcggcgctaccaccccagacaccggcacacaccacacattcttctatcgaccactacatcgcggtgcgcacaccacccgaccccgctacctcgtcccgcccccactctatccctcagcgaccgctaaacgagctaaaccacttacaagacgagtgagctcccaccacgaccatcatcgccgcaccatacggccaacagcacatcgccaccaaccacaactcacaaatatctcacactccacagcgacaccacctatgacatccagacgaccacggacacccagccacagcgcgaacgcacacccagcgccagaagcgccaggcgaccgtcaagggcgaatgtataacgcacgcgccacatcatagtatcaccaccacccccctatgcaatcacgcacntaacgcatcggaacggcacagcactcctagcgaggctcggccgcgagttccagtcaacgcgcacacacatctccgcctcntcaccgccgccaccccgcagcctcacggtacaaattcaactagtacaaactcctacacgtcnacaccgggtgtctgtatagaccaacaggtcgcgcgccgcggacgccccctcgccatgccgaatatactacatcaccgcgccaccaccggancagatacagaaccctcaccacacacgcgcgactctactgcaccaccacacgcccgaccgcgcaccacgcccctagcgcacctcacatatcgcacganntaccgcaggcagacccgcaccgccgctcgacccacgaacagaaacacacattgcgaacttacaccgtgtagtagcgtgccgcgcgagacgangatctggtcgtactggatacacagccccgcgcctccattagtctaaactcctccgngcagcacgcagcgcgcgggacactagtacgactacaccccgctacagcggaaacacccacacgaccaaca

SEQ ID NO: 10924 - DNA, 1617 bp, Homo sapiens
  misc_feature (1)...(1617): n = A,T,C or G
tgagctatgaggatgtaatagagagaggagatgtcatagaggangatatggacataaaaatataatagtatgtactagagacgacngtagagcgaataggagagcngatgatatagatagtatacagacgtgtgagagagtgatagtagcacatggcataatgtttatttgctatatcgtattaatgtantgaatacgtatagtnagtngtaggagattactcatgatantataagcgaatgatagcatgtgaacggaagtggcgaggtgacntagatgatgntgaagcaagaatgtggagagttggaggtatacgagaagatctagaggttgtaggagatgtattgagagagtgtangatcgcgcgagagatgagtngtngatgtgcagtatgagatctagtatagattgtagctgtganagtgtgtgctagagatacatgtcgagatacgaacatgantagagtgtatgntactgacgagtagtatatagtgagtatgangaatataaatgagaactgagctgagagagcgtgtaggatgttggagaagtgtgtgtgtgaaggcgagaggcgtgagagtgagngnggaggnngcgttggtggttgcgtgaggtatcatgagtnattactagtcagtagacatgtgagttatggagtgacgtgagagggtaggagtaagaaggatggtagagagtagaagtagnaattaantngttgtgagtaagagtcgatgtnctntcagntatgtagtnatagatntntcatgagtgtgctgnatatgatcgtatgtagtgngatgagtgagtgagagtacgcgtatatgtgtcgactgtgagctatgatagacatgtcgtgaggaggtcgtagtgagtagtatgatgctgcgtatgtcgtgagtgttgctatagtcgtgacatagcgtgatgacgagcatgatgtatagtgctgagatgtgacgagagatatagagtgttagagngttcactggatcgtatatgttattagtgacgangtggaatgtacggagttgcgagagagtgtggtgtgtggtaggggagtggagaggaggtgaggggagctgagtgagactaaggaagagcgtagagtgtgggttgaagagtgtcaggtagtggcttaggatgtgtcgtgtggatgagatggatagacgatgtagtaggagagatgagatagnggggtggttacatatgaaggttcgtaggactggatgggagagaagtgtggaagataagtaggagaatatagtagaatgtgatagagttgttgtagaattgtgatataaataagtattactatgataaattaggttatgtaatactaacttgaagaaggaagagatgaatagtatataggatgagtagtaacgatacggagcgttgtgttaggacgcagagtaaaaggataganagtggtgttgttgtnaagaaatagataaatgttgtctatagttgagtaatatatataagtagaagtactattgtaatgaagcgggaaggtaaagaagaaaaagtgtagggagagagagaatgtgagtgagatgtatatagtaattatatgatttatatagtgaaagataatagtgatagaaaaatataaat

SEQ ID NO: 10925 - DNA, 755 bp, Homo sapiens
acgatgtgctgcagaagcaaatcattgtgatcagaagaagttttttgtgtttgatgatgcagtggtgcggattttagtgtgctttgtggtggcgtcattattatctacggtggttcaggggtggtttgcttggggggcgtctgtgggtgcgtggtctaaccaatcagtgctgaaattgcttttgattagagttgtggtttggtccttctttgtctttgggggcggggggcggggagggcggggtcgccttctggggggaagggtgggtcttgttgttttttgttattctattacgaagctcttgtgacgtcatatttgtgtgtgggggaggcatttggcttggttggaggagcgcggatgtagtcttgggtgggtgttaatgaaattctagatagttcgtgggggagcgttgcggttggttcagggtgtgggggtagtgtggaattttattgggtggatcgttaatggtcaaaaatgacagtttgttcctcgctgtgttgaaggggtagcctaggttgttatgttactttgcgacactgatctggcgtgtgtaatagtggattgacaaaggacgttgtagcttcccttgtccgggggatattataaggctagggtgaggtttagccatctgacttggcttttgcgtatgagcatgatgtgctgaagtagagcccttttagaattcaacgtattatgtatacaatgtgtcgctgatgataggttaataaagatgtttgatccaaaaaaaaaaaaaa

SEQ ID NO: 10926 - DNA, 1059 bp, Homo sapiens
  misc_feature (1)...(1059): n = A,T,C or G
ttgttgtgtgtgtggttgggttggtgccagtggatgcttgcgattcttatgggcgcggcnttgcgtgcgcgtcgagggtaggttggtgtttgacgtgctattgcattggtaccgctgcgagcctggtgtcggggcgtgcgggagatcagtgcggtctgccgtgggtgttggggtggtagtagtggctgtagcctgcgcgcagtgccctgtagtcagcgggggcgcgggcggccggcgcggcgtcgttacttgagtgctgtcacgtttagctggcgtgtccggtcgttaggtagtctcgcggatgttgtggtcgctctcgtcctgggggggcggcgggcgggtacgccgctcgtgtttgcatcggcttatcattcgtagtgcgcgctagcgtggctggtgtgtgctcgtgacggcgaccgggcggcgtcggggcgtgaccgtgcgtgcagcgcgtccttattgtcgacgggcgtgggggggggggtgggtggtgggggtgcgcgcgtgttgtgagttggtctggtgtgggcgctggtttaggtttgtgtatggatgggggtgtgttagtggggagggtgtaggtgggctgcttttgtcggtcgggagttttttctttttgtcgtgttgctgttcgtggggctggctcggttgagtgatctgctgaagacggcgtgatagattttatactgaaaatatgtgattattttttcgttttctatagatagattctaatatatattctctattttctattcatatattctttagttccctcttctctgcttgcattcgcatttcgcacttcatcctattttatcgatctgtgtagggataagagcatttatggtacatacgttcgcantagtactaagcctcattcttctcaatgttttgaataaaatattttttgtatgttagttaattccttgctctctnttgtgtgttgcttgttccggtncgtagcgctattattctttgtgtttgcccccaaggttcttttttttattattctcttcttctttatctcgcttttnnncttntncnttcttcttctccttt

SEQ ID NO: 10927 - DNA, 1571 bp, Homo sapiens
  misc_feature (1)...(1571): n = A,T,C or G
cgtattacggagcagcgaagacagtcacgatagataggtcttatagnagcgatatcgacancatccactngatgtgtagaatggcgatactactatcgtgatggtgcaagctngcggacagtgtggacgacgggacgctgcggtgtggtgactgagagacgagagcgagcgagagctagcagcgtgcatgtcgatagagagtcgacagcagtgcgagacagacggcgcagagtacatagagcanangaatagtgagcatcntcgtcacgacacatacactgtaagagtncatcgctcgacagctgcgaggcgtagagcgggagaaggcgagtgcgtcgaagatgcattagtgctacagtcgcatgcctagacagctgaagttatgcgagcgtagtctatacgctaacactgagcatagagcaacactgttaatnanatgatactttcagatgcgatgcgtgaactgatccgtcacatgagcatgacagctgcggtgtattanacgnagctgaatcacagagagtgagagtgaaacatagatgtaggtgagtgcgtcnacgagagacgcgactaggcngagatgtcggcgacgagacacacacagtcagtggagcacgcgacgtctcgaccntaggtcctctctgtcctgcgtctagtagaggtgtgacgtcgcgaaggatgtagtgagtgacgaacgtgtgatgtgtacgtnagtgtctgcggtcgtacggtagatcctatacgctnagcagacgtatgcgctcatgcctgcgtcgcgaggaacgagagcactcctactaacaaaggcgagagataangtaaggcagcgacctgatagacgatcatgccactacagtagcgccgacgcattgacgagtagcatatacagacgaagtaatatacattatagtgctgaggtgtgcgctgtcgtgtagagacgatatagaagtgggcgcgataatacgtgtaatgagctagctgttcgtgtgcacgtgtgtgtcagcgtcgatgagaggaaagagcgctcgctgacggtacaagcgagacgcgtcactactgcagtatcacgcgaacctcactacagagggtagaccacgacaagagatacagaatcagactatatcacacatatagatcaggacagaaataaatacaactaaagagtcgagagcgctcgatatatgcgctaaagcgaccactgcgcaatacgactngaatcgttgcgtgtctgatataggacgcagagagcgttaccagtaaggcttgatggataacttatgagcagtagagagggcagagaggtgcgggcaaggcgaagtagggatggaggagattactatattagaacaaacacgacaatacgttcatccgcgcgcgtgggggggagtacgaatgcgctgacgtgggtcgtggcggagaatagggacacactcagaactcacacacgaagacactttgtgctcactatcacgtattatatcatatggtagccaataaagctttacagaactagagcaatgaataatataaatatataaagatgatccacctgcgcctggaagcacgaacat

SEQ ID NO: 10928 - DNA, 1309 bp, Homo sapiens
  misc_feature (1)...(1309): n = A,T,C or G
aatctctatcgcatcgctcaccgcgcatatcgactcgagctgtacccgtcgcncgtctcgtcanttctngcatcgctaccctactctctcaatcacgtgcaataggncactacacagagagtcgatacgcgccgcagtaatgatatatctatatctcntcttgtcgtcatgtatgcggctgctctcacagctatgtcngcgcggtcgcgcgtctgtgcgcacagagataccgaccnagtgactcgagaggtctgtcatcgtatcacgtactagcgacgatcagctgccatatacgacatacgcgagccatgtngggcgacacggngcanagganagtgatcagtaggagtgcagantntgcgcgtgtgtcgtacatatacgacatgctgtgcgcgtgatcgacatcgacgacgantgatacgtacaganacgatgcgcgtatgancgacagatgcagacgacaactgtcatcacgcgccgttcctgatagtctactcctgcgatgacgatcagcactagcgncgcgtacacagtcagtcaacacngatcagantcgtgtagagcagcacgagcagcanggcanctacatagtctcgcatgcnctntactgtatacatcatcatcatcgacgctgtgagtgtctcgtagtngtgtacgcgncgtgacttcaccgtgcttacttatgttgtatntgtngtcgatactacagcatgtctcgttccaagcacctatcgactcacganagctgtcgtgtagacctcgaacatataacgcgtgccttagcacactgtgcgctancgctagggactgtactaccatctcttattctttatttcttgttgtccacgtcctcctctctctatcctacagataccgcagatcgtagacaccatcaacaccctccaccatcagtgccacacatctcacacgcctctgcacatcgccatacagcctctacatcaaataatcaacatagttactacagacataaatcatatcactgcaaagctaacagagacgagacgagaggtcgtgaggaagagaaaagcagagggatggcaacatatgccccgaaggcgaggataaccttggacatactcttactactcagctgtaaaagcgattgtggtttgcgttgtggatgtagcggcgttcaggccgggcggtcctgttgctacgggggactggtgattacgtggcgtagtgcgggatgggcgtgggtggacttacgatatgaacgcagatcacaaacacacctctcccaccggtgtatctgtctaaaaatccaccccaaccaccctaccttaaa

SEQ ID NO: 10929 - DNA, 1835 bp, Homo sapiens
  misc_feature (1)...(1835): n = A,T,C or G
cctctctctctgactctntcgccgctagcgcgtgtcgctatctgctcaggccacgcacttgcgctgactcgtcgctnctgttgcacagcacncngcacacagtatgtgnagaatcgagatagcaccgcactgcgactaagtcagtccnatgtagtagcagttatgtacgacagcacncacacgacgcaacacagtctgtctgtgcgcgactctcgatactcagtgatagtacgctagtagcacaactcgtaggagtccagatcacgcagacatnctagtctacacgctctactacgctcgatacgcatacataggtcgataatatgcatatgttgtgagctgtcccgcgntctatcacaacgaacacgcgcagaccacgaccagagactactctagcatccgcacgccacagctatgcgacgtatactacactatgctgcatcatcgtgtgtcgtgcgaancctcgccgctctttcacatctcacgcgccgccatctatcttgtcctctgcactactctgacttgagtgcatgtaacgcantctcacactcagacacagacaacgctgatgctccactactgtccgtagcagcgcnatcgtacgagtcatatcatcatccgcgtcgtctgttacgtcgtgtgactgtgtngntgtgagcggcgcgcgtgctcatntcctgtagctcagtgcgntcatctntcacctacnctgcgccctcggatgtacgtgcgcagcgtgacntgtagtcatctgtagagtaccggtcgtgcatgcatacaggagtgagttctcgtctactatcatcgtagtcgnctcgcgagcgctcggagacgagacgagcgcgagcatcgatgcatacgccacgtcacagttgtctagacgcgatgncgctgtctatttctcgtctgctacgcttgtcactcatgtantcacgccagtacangtctgtgcctatccacaatagttagggtgaccgtgacgattgcgagtggagcgctacgtggctaagatgcgtgtcgcacacagatacttcgagacgtgtcgcgtgngtgtattaggctcgatgtaacgcgcacgcgcantgctgacacgcacggacacgtacagctagtgtatagtcgctccntccgtcgagcgtggcactgagcatatacagtataatagtcgctagcgcganagagcntgtcgctacatctcatctctgcagtgttagcgatggcgactgcgtggatntcgctggagtgcgtgntgatactgcgtgatgtgcntccttgtgtagttgtagtgtctgagacgncacggacgtacaggtaactctcagctacncncngatagtatcagcagtagcttagctgaggagcgtgactcgcacgccgtgagtatcgcagctgcgtctgcgtngtcgccgttgacngagtgagatcagcgctggagtgcntccgtgactgncgcgcgactgtcgctcagcgcgcgtgcggtttgtgacagtctgacgcgtagcgagcgctcgngcgactctgcgcacagtgacnggattactgtcgatgcatactataacgctagctcncgatatagagctcagtatcagtgttgctactcgntcatcgctctgctactcagcgcagtctaaccgnactacaggcagcagtcgacgttngtatacttagagatagagatagactctangcagcattcgagctgatgcgtgacgtagtngagtagattgatcatgttgctgtcncnctgatctgcagtgcatgtcagcatctaatgactacatctgcgtcagtttnagtcactntgcgatgcgtngtcgtatacgtcatgtcacatg

SEQ ID NO: 10930 - DNA, 1284 bp, Homo sapiens
  misc_feature (1)...(1284): n = A,T,C or G
tcaacggcatgtagcatacgcgtgctcagatctatgtctctcgcgcgtcgcgtttcatagtatctaaatatcgtcgacagatatatatgacatgatgtgtgcgattatgcatcgtctgtgcgcagcaagtaagggcaggaggtgaggtgagatatctcacaatcgtgaggatacgctacgtctttacgctgttatctcagaacgtctattatatattcataagtgagtgtgagcgcactgtgaacagacagtaacagtcgagtcgggattcactatatactatgcgtggtagcgtacgaatagagatgggaatcgaaacgaatgcatcacgggctcatcgatgtagatcatgattggcgagatagtgagtgatgagagacagtcgttgactgctcttgataacagagcacgtatgctacggacccgagacctcatgtcacagcgctacatctctcgtgtatacactgacaatgagtgatcagtcatgtcgcatatacatatgcnngttgatgtacactctgttctatcgcctactacactatatagtgtctgtagatactctctgncgtgataactctatatacaantngacagtgatgatgtgatgtganatatgtaccgacatgntgctcccagcgncacggtcgtacgctcgtgtgaacgctcttcgatagagtaactaactntatatgatgctgctcggcgtgtcgggtgtaacgtgccgtccaccgcgagctctgtgagcgtgcgtgtgaccgcgcggaggcgagtgtggatatgcaatagaatcgtcaatgagcgcgggacagcatgggtcattgattacacattatattattcncgtcaggtgtatctagaatataggcgcgctatctgcatctgatattgatagtactctagcatgttgtagtggcgcggcaatgagagacgtctcagcatcgagagaccttatggataggatctgaggtgtccagtcatcgccctcttccaagttctacatcagattaattcgcttgatgaattatctacgctgaatgatcgtggaggacactgtggatttccacaactaaactctatgcgattgtgattaatcagtgatggttactagataatttgtcgtgttatgttatatgtgctatagaaaaataacctcctctaataagtagtcaataaaatgtgtcttttaagaaaaaaaagaaaatggcatcgtggcttaagcggtgtagttgctcttctgactatcttcttattttatcattattgtcgtgattcgctcgtctctct

SEQ ID NO: 10931 - DNA, 1481 bp, Homo sapiens
  misc_feature (1)...(1481): n = A,T,C or G
cagtagacataatgagnagcatggtgcggactgacgaagcgngtgcgttataaagcagatgagcatgtcactggactcgatctagcaccacactatacgaggatagacatgatatgtagcgagtaggctgctgtcatatcgcttcataacgtctcgatagacagtagacttgtatttagattagagtacgagtaaagcgtccaatangcgatacgacgacttgctagcactaccgatcatatatcacgacgtanagtctactcactgtnaactacgcacagtgtgatacagatggtgttgctgaggagatatcgcgactcgcgtgaatagtctgctagttgtgatttcgtgnagtatgaagcgtaggtagagtggctgggtcggctgatatgcgtaccatntgctccgtatcgcggcgccctcgagtctagcatcgcgctcagtcacctcttggtatagtattacacattcatattcgcgtcgtcagngcagtagtctctcgtcgtgtcanggcgtgcacacgagaatnaagatggaagttagttgtaagcacacgtgggcgacttgnttgttattcagagggtctatgtacacgtatgaacgccgcagcgtggtgagcgtgtggttggctatgagtcgagtcgaggtgagacgaacgcgagttgcggctcgggatccagtcacggtaagcgggtgacgtgtcattgtctatangttgagagtgaagataaaaacatttaggaagagttaattattctagagcagagaggacgagttggccccacgtgggcggcctcgacgcaggacgggtgctgggtgtcgataatcgtagacgtgaatcatagttatctgcacacgcgcccgtctcttccataccacaatctgacggcgtgatgcgagcgatagccttcgtgacggtcctgagtggtagagtagtggggcgagagactgtttactattaatagcactggtatacttatatgtatatatgaagaaatctcgtcatcncaggcactgataatcgtatcatgtcatgacaatttctttgacgagcttgacgataactaatagtgatctatacacaatattagacatatacatggtatgatgcattcgtggtgtattatgtgatagatagatccatatagtggtgaagtagatgtggtatttcgacgcgcgcgtctctctgttaagtatgagaagttatatgtgatactcattttgtctagggttatatacttcatgatgtagatggagtgtangtgtgagtangctgtgattagagttgatgtgtgttactgagtcacattgtctgcctcttagtttctatcagcgacaaggctcaaagaagcataacatcgtgatctgactaacacagacgtaccacaagtcacagtatgagtgttaggctatcaagatgtcaaacacgtgttaattactcaatgtacttcaatacctgattattatagacgcataaagta

SEQ ID NO: 10932 - DNA, 1725 bp, Homo sapiens
  misc_feature (1)...(1725): n = A,T,C or G
acaacagaggagcnacagaatgcgcgcgcgcactgtatagcggagacagatgagctcgtacgcgtgcgcggagcggtaagcactagcgtacgactccgacangcgatgtgaantcgatgtangntctgtagtngtngatgactcagagtgcagangagncgacgcactctctgtgngngcgaagtcacgngcggtcgcgaacgcggtgctatgtgagtcacatagcaganngctgtgctatgtgtgagggatgtcgcgntgtgcgcgagtgtatagtgaagtgtgcgagacgtcgtcgagatcgcacgagcgataggtggggagctgccaggtagaggtcntcggatgtgtgcgcgcgtttgatctccatcgtatctggtgtacgtcggcgacgcgagcagcgtnatgtatacgnagagatagagactgagtgtgngagcggtgcgtgtgccgtgggtnttgtggtcgtctgtcactnatcgtatgcacganatcgantannggagatatacgataagcgagtctgnaattataagtntatagtngcgctagatgagnncggtantacatgacatagannatacnantnatgatatgagtagatgtacganacacatcatnagangagtgcgattatatgatagtnagagttaagtagcatcatttctcacagcaatangagtcacntgatggagaggcgtctagatcttagcggagatgatctcctacttctcgactcancctcgtcttagagaggatagacngcgctgtagacactgaagtagcgacaagagangttgtatcgggagtgcgcatatcgtctgcacgcnagnagtcgctcctcctctctcgagnacctgtcgcgtaccatacactcgtgtacacancccgtctngcgntnctctctctgtgcgacactgtgctgcagnatgnancttactacaaggtancgaccgtgttagactctctgatcgtgtgtactcntgcgcgtgnangccactcagtgcagnatcctgatactccgnacacgcccctctgacagccgacctcgactacgactcgnatcatcatccacgnacgctcgccataacaattgctagctacatgcgtgcagtatacngaagtgcacttacanagactacgatcagcacaatgatcaactacctgcanatctatcgtatancgctcagtntagtctcatagtggcatactgtttgctccgtggcgcgnggtcgctgtacgagtaactgncagtgtatgatacactgtatgtcgctctgcatatgtaggccgtcgtgcgagangaccgaantangtgtatactgacagtgagtgtaggaggtcgggatggcgtgctgtcgagatgngcttaaagttggtgaggaggngtagacacgctgcatgattagtatgactatgaatgtgatgcagtatattcactatgngctctgacgntattgatacatattactatagatatgcgatgcgacgggatgcgcngagngcacgagngctcagtgagagtatagtggtatagtcgnacagaagncgcgcgcgctatacgcgactgcgcgctggaggctgtgnatgtgtgtagaggagtatagggatatgtgganagtaatggggtgagtatgaanatactatcatcatattacatcatactgnctctcattgagtacatctctcattacaccttgttctnacactcatcactcgacacag

SEQ ID NO: 10933 - DNA, 1132 bp, Homo sapiens
  misc_feature (1)...(1132): n = A,T,C or G
cgtacggtaagtgtagaagcagacccgtaaccaataattcacctcaatgcatatatgaataactaacggcgcctgtgtttgtgaggtggagggctcttctacgatagtttaaattattataacatatcccacctctcgtccgactgacggaattagtaagacacacggaattaatgatcgttcacaaacaattatgttaacgatgacggtcgactgctgctcgaacgaagattagttgagatcgctgttccgtgtcgctgttctaagttatgtgactgggtcacatatcgatatataggtgagagtagttaccgagacggatactgtcgtagctcatttactccatatcgtttttactatcgatactttagatcttgtaccatgcggacgcgccgacggatgcatatcttgtgaatgtagtcagtgtgaccacctttgtcgacgctcgatcatatgttacggtagtttcatcgttacgagtaggtataaagatgcctccgctaatatattgtatattctaatgatagtggtggcgcatcgtacagccccgcacttcacaatggatcattgctcactgtcactttctatactatggctgaagatcctcaacactcccagctatgttgcatgcacgtctcgcctctaatggcgtcgttcgctcctctgatgaattatagaataatatcagaagtcatcttcatcgcagcaaccaacagtctgtcggttgtttatgtagcgctnttgatatgagttattaacatcacgaagacaagcgatggcacagagcgacataaccttatgacagacaaaatcgtagaatgcgacgcgaagacatctgatagtgcaattattatacagcaaagtactgaaagtaaaatatacggatcgtatggaacacacatggatattaagtggtagtatatatcgaacagtcgttcggatgtagtggggtggtgagcatgagtatggctagtattgagcgtcacggatagttaacgtcagtctactacaaagtcgataacaagtctgacatccgcgacccacgtgttgacgtgtgacgctacgtcctcaacataacagttctatttacatgtacagagaactagacgtacatccacgaatatcacacagc

SEQ ID NO: 10934 - DNA, 1179 bp, Homo sapiens
  misc_feature (1)...(1179): n = A,T,C or G
catccttcgcagtctccctctatgagtgcacttaacccgtatcgtcgctttcattccgcagtgtctatataatgttttggttctggatgaatgtatagcctattatggaatgtgttataggaatataatgatagaaggtaataaaactatccattattatacttgatatattagatacttctctagggtaaatttaataccgtctaatcaatcctcttatataggtgatgtatacaggtcggatgaaaatttacttattaaaaatatactatccttcttacaatacttccatgcccattaggggaagaggaatgaggttntgagtgtgtagggtgtctctttatccttacattattctctactttctttacatagagtctacaatatcattacatctttactgttttatattataaaagtatatacttcgttctatcgatgacttgtcatacgattaaattgcactagaggagtgttgttctgccatttgttgatggattagttgtcggtgtgctgtgttgtcatagtagtgtcaatataacgtttctactagtttgtttcatctctatgttacatcttgctagtgagtttatatattatagttgttatctattcctntcatagtgcacaccagccatacttctttactgtctgttcagtgtctcgagtccgcgtagtgttgtagatgacntctattctgtgttacaggattgaagaaatgccacgtgcgtgggtctgcctaataatacttaccacaagctgacgctggagtatctcaatgctgacccccccatcatcgtctgctcatattacattaatgctgtaagtcataggattgagcacttttcatatatggtctccttacgatggaaacgccgtacacgtcggatctataggcctgcatccacaatactatacgtctataactttgtatcattattatttgaatgccgttgtttattgctctaacgatttaatgtgataatccatcccgcctcaacccaaaagatataataaaaaatatataaataaatagaagaaataaataataaagaatagaatggtctctctgttgcgcataacactcgtgtggtagcttgtatgctgtgcctgagaattttttctcttattactcttttgagatatctacttattatatagttgtcttattattattgt

SEQ ID NO: 10935 - DNA, 1601 bp, Homo sapiens
  misc_feature (1)...(1601): n = A,T,C or G
cctagatgcgcactgcgtcgtgcgtcgtattgtgtgagcttagcgtctatgatgatcgtatgtgatgttgtgtccagcgcgggagtacgatgtagcngtagagtatatcgagaatatagcgcgtgtggcgtgtagtcgacgtggtcatatgactcaantagctgatacatatactctcgctcttatgttgcagtcggtactaaaacggctgtctctcccgccgtagctcatgatcagtactgaacttatctagacgagtatcatatctgcgcaaatacattatgttgtagtaangcagcagcatcgtactgacatcatacgtntcgtcgtgatacagtccacggccatggtancgtacttccgatcgacgttatgtctcgaccagccgcacagcncctcgtgcatgtctagatgttgctgtaggtaacgatcacttagtattcgaatctagtaattactttgtctcgtctcgcgagcgactagtgtagcgagcgagtgtagacagagcagagcatgtgtgttgtggaagcgttgatcatgtggaccagtgactatattaaatatatatcagtaaagagagtatagcgtactcacagatgttgtaagtgagcgcgggcanttctctgcgcgttcatactgtggcctcgcgtgctcatatccggagatgattagttgtctattgcgctcacgtcgcgacgagtctgcgaggttccgtgaatacaccgcgcggcactaggtgagtttctactgtggtccgtccctacttagctcgcgagtgtatcgtgtaagataacgttcggaacgccgcaggagtgggcggttagtattgtgatatagagagagtcgcgtcttgcgtcgagtggtcgatgtcgctgtgcgcgacatatacttagtgagagatatgacaaagntcatcagcgagtcatgatcggcgacgtcacctccatactagcccgagctacgcatgaagctgcagagcatgctactcaggtatagcaccgtcgtgcgacacgacgctcagtacatgagtagctgttagtctgncttcttgtgtcgantnttgtgtgctctccntgtaacgacgcgagtggagcagttgacagtgcatcggtgatagagaggagtgcgatanagagtacttgatgctgtgcgtggtctatatcgcacactgtatctctctgagtgantcagacactcagtgctacaagcactgagagcgnggacgtactcanacgatgcgttatggtgagttatatagtgcgagtacgtaccgcancctatacattcgcgtntattcttcggcgcgcggggcgtgcgcgtgctcgtggtgacgtcgtggtgtgtgcggtgtgagtgttgntatcgccgagtgagatctgcgcgancacgtctctactcacgcctctcgtccgctgccttatancactagcgtcnccacaactctctaataatcacgatcacatatatgcagcattgtgagaacgcatgcggggcggccgtagaacgctctctcgtactgtatctcttatctgctctctatcatctggcactctctagatacacctcgattcttngttcagtttgttgcggagagtgataat

SEQ ID NO: 10936 - DNA, 1861 bp, Homo sapiens
  misc_feature (1)...(1861): n = A,T,C or G
cctncgacagctggtcgcagcgtgacagctcatacgtactctatctgcntnantacgtcacntgaacnatgntgctccttcactacngcagcgtagcgacgtacgctgtctagcctatacagtcganananctgccgatctatcgactgtctgtatcgtntngcggctgcttcacgcgcctctcgcgnctgtgtntctnatgcatntcggtcacgagcctcgcggtcnccccgtctgaagagaatagcacgacaactatagagagtngaacagacactcgacatanattctcacangntgagttnccgtcgctactngncgtcgttgctgacctctctctgcgcacagcacgcgcgcgtccgagtcagcacttcatctatcgccgcatctgactggcgtcacgcaccagatagacactctactgatanctcataggacgactcgacacntgtantaccatgatgtgatgtctcaggttcgcgtcgtgcgacncgtanctcagtagcgctagcttattggtcgtctgntcgtcagtctcctatagacagcgctgcagacgangatctaagacatgatatngtntagtgagagggtgtngtggcagtagngngngtgtattctagaaagatgtacatcgcgaggagtgtgngntgantctgatcacaccggtctcctagctgtctacgntctanangtagttngtacacgcgagagctgtcgactcgatatgtcggtantgcgtacgtgcagtgcggtgaggaattgatctagagaanggnactagctagcatactacgctaactaactacttccnatacacgtctgatagacgtatgctcacattagantcactgtacacatcgtaaacgagtgggaacacgtccgtaagccatcttatcagatggnactgcgatattatagagtgtaacatacgtngntcaactcgcagcgtatngcactcatacgcatagcagcgtcagacagcgatacacatcaacgcgacggcgcgcgcacagnttgcgcgcgacggagagtaccgacacgcatacgtctgctacgttcnctatngatatacactaacatctgagcatacntgcnctatgtgtgctacatncgagcncctcatcatacatatagtcattctgnattgatgtgggtgattgcgtgatcgtctcgctacgctcggttgtgctgatatcgctgcgtgntcgnctgagtgcgnagacgtagcgacgcagacagaggtatatagagcgangcgtgtcgcatcagtgattgctagttagatgtacangcctactacatacataagcaatgcgcncgaggccgatgcgacgcactacgacgaagcagngcgacgcagtatgagtgatcgtatggangagacactgtagcgtnangntgcgtntngcggtgatatagctgcangcgcagcatacnagtgtgngtgcgacacgctggacgcggactgcacgagactgaggagagcgcagtatctgagtgtaatatggaggacgngcgcangagagagaatcaacagactgtatagnantacnatcgancgagtaggtatatgtgnagagtgatagctcgcgcacgcgtagcgagagatagtgtacantgtattatgtgtgttgtgnaggagtacctcactgcgcgcatacaggagagcgcgcagctggagcagagcagtatgagagnagngcaaagcgngnactctgatggaggagaggagagagcagcngttgtntgtatctgcgcgctgcgcagctcgatgancctccgtncnactcagtactgcgacgcatntgtaagattcnacgctagtctagcacgcgctacataccagtctnaccactag

SEQ ID NO: 10937 - DNA, 1543 bp, Homo sapiens
  misc_feature (1)...(1543): n = A,T,C or G
caatctactganncgagcactactgcggtgctcntgacggcgtgtcgaacgctagtcgcagatcgccggtgagcgacnccacacgccgtgaacacacacgaactccgangatcgtgtatgccgtctgtcctcatatntacgtgatagtctacgacgngtanatgctgcgaatgctctatgangacattaggagagatcgagtacagaacggagnacatcactacggtacagtacatattgntcaatcacatatctaggatcgagacgctacagcagagatgcgcgantcgatgtangtcagtcagagtagcggagactaggatcgcgagcnccatatantcagaacgacagcgtacggagagcacgcgaatggagagcaacagtatagtctggcatgcgaagcncgaatgagcaggcatcgagtgtgtacatgctacgttgcagcgctggcgcgcgcgagggcgcgtcgcgagcgccgcggaagcgtatgatacgagctgtaggcaacaganggaagagctacacaactgagcggcggtgtgatagatntaactaacgcgtagatgagagagtcgagtcattgtgggatcgatgcataagtatgactttgcatatnatgtgctattagatgtgagacagtgctctaaatagcgcagtcgcgctcntccatatgtacgaancaagaggtgagcgtcttgtgtnaggacactgttgctcggcgacgtcacagcgtagctcncacgcagcagacgaagccagtcgaggaccgtgcacaagcgagcgggcacgtagtcgaagtagatgaagaaacggcgtcgtgacgagggcgactgcgcgcagtcgcgacacgaatcacgggacacgaagtagaagctcgctggtgngcaccatcaccacacgagatctcgctgatnctatcagatangatcatctctctagcctangccactaaccggaagaatctgaccgatagactcacaagtatgacgtccacctccatgatcaacacatctactcacatcacaccggcgaggaagcaagatggtataaagaagatcngaaacatgtatactagatagtatactcagnccattgtgtcgaagagatcctgacggattcgccaaacgagttgatctattgcgaagataatatcgaataagcattacgtagtacccactgcgcgatgcgatanatgacagacggagagtaaattaactagaaaagataggagtagtaagaacgagagtagaacggtggccgagtgaggagttgtggtgatacgtctccgaaatgacttacaattatagaggagggtggaggaagcgataaagcagcgatgataattaagattgaaatgagtatggtgacacgcgtccgcccgtaaccactaatccgagccatgatccaactcaaatctgacaaagcacccgaacgttcgcacgtacctagcctcgccgactacgctcaacgcgtgcaccaaaccacctctatactcatacaactcgctcataactcaactatcactaaacgaccaattatacat

SEQ ID NO: 10938 - DNA, 1024 bp, Homo sapiens
ccctccaccggaaaagcagaaaatcaaaatctaagggcaacaactttttggtgatggctacagaggcctaggatctgattatcctggtctcattaaactttacaactccatgggggatggcgagaaagtgcccgaatatcacaatgttcctgtctaactggaaccgggtgcgagatcggcaatattcacagacaaatgctattgaagatgccaggaccagcccccgagaccactgaagaagtggtccacgccttcctgatctctcacaatggcgaggggccgagctgatgaaggacgaccttatataaccgcattcgcttttccccgagcgccaaaggagttagccctgccgaaaacaaaactcgtgtcgcttacgggggctcggactttccgttcaattactcggtccagtacctcccacgcacgcgtcctctcgggcaggccccaccctaccggactcgcgcgcagcgcagctcgcctcttgcctgtttacgaacgccgctgcccatccgccgttcgcctagcccctctgtgtgtaaactcagtgggaggcccaccgcagcgcgccctctctctcatgcgggagaaaccgagcgcgtgtccggagaccactactcgctctactacaagcgtgcgggcggtatctgcgataccggagcgctcacgatcgccaactgatgcctaggttggcatttatcaaaagcaccacataggccacatcgccgagatgatggcgcgtattgagcatctctgagttagcggaggcgcgctgcggtggcgcctcccaccttcatggtagcacacgagcccgtgcagacgagctacatcagcaacccacgtgcaggatgagacttccgtcgacgcacatagtcgatgaaagaatgactgggtcgacagtcgcgcgctccagtcctcgtacacactctgtgtcagagaactgaatgcgctcatagacgcgtgcagtaccgagccggcgcagcatcgcaccccacagcctacgcataacgacgtcactaaccggccg

SEQ ID NO: 10939 - DNA, 1421 bp, Homo sapiens
  misc_feature (1)...(1421): n = A,T,C or G
cgcctctcgaggtgcgcgatgtgagacggcgcgctcatctggagtcagctacgctaatctctcntctgtactctngcagtccaatcgacatcgctgtganactgtancttgagttagtcaggagcgtagtacgaagagatggtagtctgcgaagtnatctncatatagtgtggctctcgctcttacgctcgcgatgcctctcgcactcatgcaccctgctcgagtaacagtataacatagatgcgatatctattctacgtagagagtatcagcgctagcctgttacgagcgagtcagantatagcatggaataggaccnccgacgatacangcagatatcaaatacatgtataatacgtcactatatacgatcatcatgattaacacctgtacaccgccgtgatgttagtagtaattagcttggaantacacagtcgcagccgcgcgcgtcgccgatcgacaaacgatcctccattctaatcatatgagttcatcattagatagatcgtgcaatctgctacagtgtgatcttgagagcagcagcagacaatgaangnttgccatttacgctagacgcgacatattactacattactatctgaatatcgatcgaagtatgagagtctgcagggaggtgatgcgctgatccgccgtggtgaggtaaggagagatgagagacacaaaagacgttggctagtatcgtncgagtcactctatcgacgacagacgtcgtcggctgcatcgattacttcacgctcctagtcgctcctctatctatctgatcttatatactgtgagatgtatagtatcgcacgtcactacaaacacacaataaactcagtagtcaaatccatactacttggacgttacgaacggcagtgtaaaggaacggattagattttagtcagatgagtgaatagaatggtacagatgcagatgcggcgaagttgagctacgtaaagctgcatgcgttttatggtgtcagatatttataacgatcattgtttcattgtacggacgtcagacgctcccgatgtcgaaacggcgagtctcatcgctgatcctgagtcgtttgtatatgcgtatctgcgttgtgcggcaaagggagctggtatgtaggagtgcgacctcactgctaacccgtcaccccgcccaacgtcaacttatataaataagcgccggcggcctatcaatacacgggttcaaggaaaagactccgcgggtacgcgttaaggtgattgagaacccctacgtcgcgcctctgcgcatacctctgcagctcacgtacccttatccatgctctcccgtctacattatgatttaaggcatagtagtggctcacacgactacgctggtgcactaggccaagccatctcccttcacatagtgattgagtgctctttgaggctcgaacgaggcta

SEQ ID NO: 10940 - DNA, 726 bp, Homo sapiens
gtcggtgttatgactgcattaagtggcggaggtaaatacatgtgtgatgagggcttcgggcgtacgatggtgtgatttggtgatggattgttacaatatggtatataggggagatcttttatatttaggagcgaagggtctaaattttaattgtggatgatgtaatgtggtatgatatagcgtgtggggggtacgatagagggtattatggtcacgaatgttgtgtcgtctaggaacgggtggtgggattgccaatatgcaggtgaggagggttttgtgatatttcagcactgggcctctagtccgttggagaggtggtgcattctttcgttatgtatgaaaatgtggagggtcgcagctgataaggcaggacctcggtgagcgcaattaccttttccaggattccaggggattcacactgtggaaatctaatccatgttgttttggtgggttgggattagcattgaaacactggtccagtccattgaaaaccatattttgggtgatccctatcgtgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaatagaactatttaagagttaaaaaaaaaaaaaaaaaa

SEQ ID NO: 10941 - DNA, 1728 bp, Homo sapiens
  misc_feature (1)...(1728): n = A,T,C or G
actgtccatgtgggcgctgagtgacgagtgtggtgaggtgcgcgcggcatgcgtgcagtagtgtgtgaccgntgtgatctnctctcnctgtcgctcgcgcgtcatccgtcgtgactgtcatcgtacatcgntgcacgtgtngcagagtacatcgcgagcgtagcgtgcggcatagaacaatcantntctacgccagactctctnaaccactacacgtcgtcgtacagtcatcgcgcgtatgagatactcgtgntatcgtgcgttcacatgaggcggagatagtgcgcacgctgcgccgtgcgtcgctacagtctcactcatgctctcgcagtcgcgtgctctgtcgcacgtcactgacgacgnatgcggagctgacacaactaggcgctcgctctgcgctcgcgcgcaggggcgaagatcgcgtcgcgtggctgtgtgtcgntctgtgtngcgatatgtgcgatgacgcgcgataggacgtctgcgcgactgctagactacgaatctgtcgtgcagagaccgtcgagatgagactanagagcgagtacgtcgtgcgacttgcacgcccgtccgcgcgcgtgattcgatcnggcgcagnggtagtatccgtagcagtcggagcgcgatcgcacgagaagagtaccgtgtgcagagcgtagctcgtgcgcgacgcagcngcggcgatggaggcgacagtgaactcacgtcgcgcgtgctgttgtgatgcacgtggtgcatcaccgtctgcacagcatactcaccgcatcagtggagcgagcgtggcggagcaagagntngttacggcggattgcggtggataggancgtgcgagatagatgantacatggtgcgatcngcgcgcgtccgagtagcgccctacgcntgtgtctgcgctgtcttctccgtcggagataggccgcgtggttgccgagtctgcgagttgtggtgaatgtgggtaagctagcgcgcctcgtcttcgacggcgtctcgagctggactgtcgtctgagganctcgtctcggaggtngcgattgctagagtttctcgcgcgcgctctgtctctcggctcccgtcgtcactgtcgcttctacgtcgtgccgtgtccactctcgtttcatcttaaaatacaacgaccgcgccgattgatnattctaatcatcgttcgtaatactgcctactacaccaatananataccctaatatccttgtcacgaacaaacactatatctgccactnctacatacccatctctcgcatcacatgatggccatatatccgacttatacagtgatatcanatattatacaacggatancacaccacatttctatcctancgctctcctccgagtgcnatattgtactnnctcgtgatacagnctctttctcgtcttcttatctacaatcancttntntgttntctctntcttatctctcttntttctctntntcaaacacnttntttttnctnnnnaattctctttnnntctatnctncnncnnnttctctttcttttnntnnntntgtgtgttttnnttnntttcgtctnngttnaaaaggtttnnntnttttnnnttnntttgggttttatccncncntantcgaggggnancanntattattattttnnantcttatatttataccttcacncttctctcttctatctctcatctttttnnntccntnttcttcttcnntcctctttctcttttccctttttttttat

SEQ ID NO: 10942 - DNA, 2055 bp, Homo sapiens
  misc_feature (1)...(2055): n = A,T,C or G
cactcaccgtcgnggtgctgtatgcgtacgcgcatcgatgtcgactatgtactnttatgatganagangtgacttgccngtatcgtcagtcgctagtcgtcggtgtancatantcacancgtgagacgtcactatgctagtcgcatctntgtcttcgtcacgcacgcgtatacgtcgcatcatacatatgntagcgtcngctgttgatctgcgctgatcatgactgctnctatatcacattatacganctagaggactctgtctagagcananctctactaccagtcgtgcatgnacagatgcacaacgtcgactgcgcgagcgcgtaagtcnangctacgaganacagtctgctgatncgagnancacagaaatctgngaataactacactcttgcgtcatatatcatgatgatatcgatagatgtcntgatcctgatagctactcactntagatgtgagtacatatactagtatctatcacanattctgctgcatcacttgcctcacgtctagtctgctcgcagatcggctgagtgagtgatgctcgtantgtcgctagcgncacntatgtacagctctgcacacgacgtaagcangagtgcatgacacacgactacaaacganacatcgatctactcaacagacgangacgagaaacgtgagaactagtcatgacactaggggcgagcgcangagcncgtctnacgtacgngactctcacgcgtcgtcacanacgacatagcagcagacagcanagtgncgcgatgcnatctgnacgatcgacatagatgctgcggtcgcgagttcgcgcgatgcnaagtcnatgagtcagtatcgcatgcatatctcatgtacgtatcgantgcatggacatgactgagagtagntagctcgcatagagatcaaacatagtactatgagtactataganagtcgtagtatgnactanctntgcttcgtaatatctatcacgtcagnctncgcgtgacatcatgcatcgactgctactgagcgatggtcacntctctatgctacagtatcgcatcaacatactgatctnactgcagtagacttatcangagtactgctatctacgcaagtacgagacatatagtgatnacagagtagagtcacggatagaacngctagcataacacgtacgtctacgcnatacangcatcacatagagatagagagctgctgatattgctgtgtgagcanactgagagagctagacatnaactnatattgacgtagtatagangtgctatagcgtctatagtaggcgtcagagactatgatcacggacagaacgagcaatggtgatgtagcgtngcgaatgtgtcgtnatagananagcgatatagatgagcacatatactcatatgacatcatcatgattgctgctntgttctcacatctcacttacttagctcancngcgnctatcatagacgcggtatctgtacgcacttacttaactcatactgagtcacgatacataacgataagcgcatcgcacgccgntgcngatcacgatctcgcgncgtgcccagcgcgttcgagncgtacagcagcacatctatagtgtcaccatgcgatgatnanatgatgctatgngtcacannacatgatctgngatctgagncatactagtctgcatgcgtcgttcgtgcgaccgtcgtcgctgttcgtgatcgcntgtatgtcgtnatacgatcgttactgtncgacnctgagagtngancgtcatatgtagcgtagctcgtcgctgcctacnanagtatactcgtctgagctacactcgtacgatcatcngtctctcagccttcntccgagacnagcacactatcacngtataatanactatatatgacgtatatactcactatacgnatcgctgtacagtacaacgacatcctggacncgacagacagncgcagnctcgctcagcaacacataatagtactgatnactgactcagagactcacacatcttgtatcatacnacaactactacttgatcgaactatactattcatagatatacacca

SEQ ID NO: 10943 - DNA, 1449 bp, Homo sapiens
  misc_feature (1)...(1449): n = A,T,C or G
ccttatacctgttatattagattgtggttcgntgtatttgtcatatctatgttgatgagtgttgatgtgncacatcgctctatgtgagctatcgtcaatctctatacgtatctatcgattatatttctcgcgtctatctcatctcaactctanagttaatactttgatctttcctgcgcagcgtgtntngtgagcgtgagactagagttgtngtagatagtcagtgagagtgtagtgatatcggagctcacggagagtagtaagcataagtatnagagagcgagacgatgtggtctgctataagcgngacgcgtggttggcagatgtatgcgagttctgtcggtcaggcggtgagagtgctgtatttgggcgacggnatngacagacggttaggcatgtgatatgtcgtacgatgtatatcgatacncgcttaaactcgagtntcctcttttgttcttcgttatatgtcatataggctgcgggtacactcgacatagatgaagatcatgagaagtacatacagcgggagagatatcatgaacagtgctagtgtggatagtcatacttgactgcatagtataganggaactgttggatctacttgcagntctctgaggtgatatgtttagaaggtcgtttctcggagtgcgtactgttagccctactcacgaggtataatattcgatattgtttatatgtagtgcatcagctgaaatacaggtacgaacactaacgcgcctcactctatttcatgttaacgtgtgtgatgtcgttgtgnttatgcttagatggctgagtggcgatccttataaatatgacacatgattctactcggacatataaccatggttcatatatgtctagtcaaccagacttagtgagtatactaatatcgtgtcgcatgcttcagcatcttacatagtcatataaanggtacatattatatattgtatccaatacatacgataatacggtacgcacatgatcccgtcatcttcgctgaccaacagggtgaaagatgttctttcgtcagcttgatgcttcgttatgttatgtcgatatgagtattattgtgatgtttgcatgcgtcgcatgcatgatattatcgggtctgttgcgttattaaacatctctacttgctattcgctcgctaattctataattagctgaggttataggatgtagtccaattcgctgctgtaggaaaagagctagagtaagggggtgatattgagtggggtgagcagtgnggaaatacggtgaggtgggaggttgtgtgtgcagatgcgttcagtcgatttatatctaattaaccccgagtttataaccttataatagaatgctggtcgtcttacaatgctaaacatagtaccatacttactactttcaatatgtacttatttaaatttctatctcttctatcatattaatgctgacacacagattata

SEQ ID NO: 10944 - DNA, 1016 bp, Homo sapiens
  misc_feature (1)...(1016): n = A,T,C or G
cttcatgtatcttggaatagtcgtactgttggcgcgagtcgtgggcagcgttgtgagtcatgaacgagtgagnacgttatgagtagtagtgtctattcattatctaaatgatttactcataagtgaatgaaagtgaagcaaaactcgatagcagcgcatgttcgatagaattaatcagcagtaacatgtacgatctagatatttataaccttatcgacacggtacgatacgtaagtctccgttagactgtaccatcaatcaccccagtccatatagtttgaccgccagtgttataacggatagggtgagattctatgttcgtcaatttattagatcatacgtgagtaacanataattatagagagaagcgactgattgcgatgttaggagatagtaagtatagatagaaagaagataagattagatacgtgaagaaatgtgatcagctgtgcctcgtagacgactctcaaaagaatgccctcgataggtggcatgtaacgtgggaacgcgccgcgtcggcgcatgcgaacatcgtctccaccatcagtagcgagcacgcgcctggaaatataatatatcgagagagagaggagataggacatcgttataatcactaaactgaacgttacaatctcaacacaaaatgagacaatatcaaagaccgagtcaaagcaaaatccaacagcgcggaatagacgtgtggttatagagagcaggtcgaggccaaaccggtaccggcaacaatacagcaagcctgtaggataaaactcactcgccgcagctccactccgcgactagaactcggcctcgggatagtgagcataggagagttaagtgacatgtaaatatgtaagccaatcagaacattatcgctgatgggtacgaaacgggcagtactactttttagttcaaccagataacatattgataatggtgatatatagatatcggatctaacggaacacaacagacagcgactactcagatcacacatatgatatactatagagtgatag

SEQ ID NO: 10945 - DNA, 1030 bp, Homo sapiens
  misc_feature (1)...(1030): n = A,T,C or G
gcgcgaaagtagagagtaggaccaggccttgaggttgcaaccttgggccaagtagaacaaaggtcatatccccaggaagacaaaagaataaagcatgtgaataatttttgggaggtgaatcctttattccaagcaaacctttcattggattacattgagggttgaacaagaccttgcatgaaaatgggttataaagaccccgcatcgctccgacgccccacagcacgaagactaatcatcatcaaaatcgacagaaacatatgttcataccgtgggggggcgcgagcgcatcgctccatcccgtttcccctctccgtcccggcccattcgcctacggggccgcaacactatcagacgataaacctaggccgagcacgacgatactcgctagacgcatagagaacaggtacgcaccggcgccagtgcgcgcaccaaaagcaatgccaccgactcctatcaacgtagtacactgcaccgccacctagccgcgccctctacttattttgacaccctcgacgcggccagccgccgataataacacccttcgtgcacggcgcatgctcggacttggggcagtactcccgtggtcccttctggctgcccgcgtgagccgctcatcgtcacgcacacacgctcacgacgtacagctacgtaggacctaccgcgttatcacagacgccccacgccgtcgagggatgattagcttccgggatcgtccatcgcgcgaccgactagcgtcaccacgcacgtgaagccatgctctgcagcgtcggaagctatacgaccaccccgggggccgagactccgcacacactgcagagccaatacccantgcagtcatctccacgacagtgtcgtgctattgtcacgcgtcccgcacgacgcttatcgaacctacttcttcgtaccatatgtcgctcacgatgatacatcgaagcacatagcgccatcgagcgcatccacaccgcacacgctagcacacttgctacgcgcccttacgcgctctctgttctctgagccggtccgcccg

SEQ ID NO: 10946 - DNA, 1594 bp, Homo sapiens
  misc_feature (1)...(1594): n = A,T,C or G
cacancancagcgaagcacgagcatgcgacgagtaangcagagagtacgcactaggtangagcagactcacgcagcagcatgcacactgatcgcanagagtgacgagcagagataacgactgaaggatacatgagacaagatattacagtatctgatgcnactngtngagagcgcgctgtntctcnactaggcgccgcgactctatcagcngctgcacactcacaccgacgaganacancgcgcgcagagagagcacatgtacaggagcaagagtgagnacgcagagccaactcanagtaggtagatcggacgagcgcgctcgcatagagctataggactcgacgccgtcgcgacgagcgcgtgacgcacgtagacactcatagcagtagcacgtgtacgtgtgtcgccgcgcgagtcgtagatcactgtctanagtcatgccagacattacagacagatgagtaagcggtgcaggagtgatgatactgcgatacatgagcgagtaagctactagaactagaacatgtacgaatatgtaagactccatcggcgtctaccgtcactacgacgacggcgcagaccgtcagtacacgcgacggagcgagctgaacacttgactagtagagacacggagatagcgctctacgcngtgtgcacgcagnccactggtcgaatgtgtagatngatgcgagcataagtacgcntgtgtcgcaagacataactagcgagtgtgtcacgagacaagagctnagggtcgatacagggcgacggcagtgacatctgatatatctacaacnacagtctgcacggactgcgactacagcgtacgtgctcgcgacatgagcgaatcgcgtaagtaggcgtcgatgtgccagacagcgtagtatatactcgctcatgcgtacatcgtagacggtacgcgatgatggtgtngnagttcatgagcgctgacggcgtacatgtagtgctacggactgcgatagctacgtgtggcaggatgctaaggtagagtaaggagcgtacgacgcagctgaggtgctagtgtgtcgcagcgatngncagagtgtatgagctgcgcatcaagccaacggcgctcgagagagacagacactcagagaagacgtacgacgtggcgcgtgaggcgtagcgncangaagtgttatcgagatgagagtctggtggtagaggaccgagagcgtcagacgnattacatattgtctactcatcaagacatacatctagacaacgctattcgtgtgagtcatctcaccaccgtagcggaagcgtaacaatgagcacggaatcgtantcgtatggntaagcgcgggagtatgtatacagaattaggtngcgcaacgacacgctgcggtcagcgagaanaggacgcagagacgagtngagcggtcgtggtagcgacgctcagcagaacgacgcagtctcgtactcacatacatcgtctatgactcaccagatccaacnccgaacgcataacactgcacanagcagacggacaacgcaaccagtatgatcgaagaagtaatgatattcatcgtcgtagccacacagcctctatttgcatgcaaacaaacgcat

SEQ ID NO: 10947 - DNA, 1696 bp, Homo sapiens
  misc_feature (1)...(1696): n = A,T,C or G
cctcacgacgatctcaacactgntctcgtgcngntacatactctccgacacgtgccccagtgtagttgatntnactgactctatatcganaacattgcatatgcatacgctganatctgctggcagtcgctcgtcgtctacgaccgatgtcgcttcgtgtctctgtcgctctgtnntgctcctgctcacatacatctgcacnatactcaagagtatcgcactgctcacgactacagctatactacgtagtgcaagctatctagagcatacgtgacacgtgtcgcggtgcatatatgacgtcactactcatctagcgcgcacagncctgactagctaccgactcgcagttgtctacactacganctagagagactcgctantatcgtcgatagtgccttacacnctactatctagtcgaccacactctacgagctccgagtgacgtcgtctacgcgtcgcggagccgtgngcgctgctctcgcgaancctacgtcacnttgcgatgactgatggtcnagtcgagtgctgatggcacatgatggatcgcatgagtagctgatgcgtcgccttatgcctctgngcgtgtctcgtacgcgcactgtcgtttcatctgtacttcgatgtgcagtgtcggcgtctccgcgcgcgcgcactantctcactgntacagtagcagangngtagagctagcaagcgtgtatagngtgatgcacgggcgaccacgtgtgacggatttgatcgtgcacagactgtaatacgacggatagatacatcatcaagcgcaacgcggcgcggcgccacacattattactctaactctnctagcacttgacgcagagggtacggcagagcgcgcggatgctcgatatactactattctctattanaatcagtgtggctatctcgagagcatctctattgatgtcgtgcgtagagtgcggtgcgtcgcgaacatcgtcgatcgtacgctcgatccgccaccactcaccgtgataaatcaaggntacanatcatagacggactgtaactgttcggcgagtcgtcggcgacgcttatncatgctcgagtacgccatgagtcgctacgcggcacgagagtgcgcgtcgtcatcctgactacctgctgctcgtccacatgctacgcatgtctgtatactacgtcattcgctcattcctaccgcacgcgnaatgatatcacanactactcagatagatactgacgctatagatcggcgagcgacatgtgtgagatgtcagactcacttgtcagctcgctacatatcgtcactgacgctgtactcgtcgccgtcctcggtcagtgtacntanatactaatagactcatgttggtgactgatggatcgtacacactcgcctccgtgtcgcttctgctcgcgattacntatgcagtgtcgncgtcgaggtactggcgagcatcagagtactgtatattctgtggacgtgncntgtgtggtacggtctgtctctgtgcctgtgngcgtgccagcatccgacgcgcgcctgccgtccactgcattatatcactcgtcatggtantgtgtgtagcatattcttacctgccgcacacacaacagccatccactagcagctagccgctgtcctcgatctgatnctctctccacttataacttatctcgtagagtacaagtgcacgaggcgatngcagctagcacccga

SEQ ID NO: 10948 - DNA, 1165 bp, Homo sapiens
  misc_feature (1)...(1165): n = A,T,C or G
gaaaccaacgacacaaacacccaaacaaaacctaaaagaaaactacaagatatcccttaagggtgaagaacatggatagtgcctccacttcggctactctcagcagttgcgaccatcatctaaatgaatataagaattcgaatcaactgtgcaccagagccggccacacgtgtcactgaactacatcccaaaaagcacgtatcgatgacgctccgctgcacaaacaaacaaaacagataaccggccttcgtgcggccataaaatgacgacacgacccgccgaaccgttttttttcctcctcgcgggcgcagatcgcgcgcctcgtccctcacccgaccaccccagtaccaacacgccccacaccaccccccgcctccccaaataaccagccccacacaccagagtgaagatactggtacacccgcccacacccgaggaccacggagcggacaggacatcagcacccccactgcctatgtccacaaatacacgcgcagtcacagcccaaggcaccacacaatatagcanagaccgggttaagtccagagcatcacctctacaaacgcattactacctaacctaccaggtgaaccactcacaacagttagcaccgaacataagccagaagacaaccgacacaagagtgctgctctcctgacaactgaatataatacataatgtcagcataggatcatgcgctaggccgctagtgattaaagactctcacaccggcgcgaaacagacacccacgcatacacaaataangcaactaccgatcactcgtcgacatgcacagtcaatgacgaagcaccacccacctgcagaaagcacatacatatacgagacccaccgccccgtcccatgatccataccacatcgntcccataagtcctaccctaagagaagatcatcacaacgccacaaccacggacgctcgatagaatcacacccagccgacgccacacgaaacaccacagacatggaatagatgcaccgatgacaacgatacccactacaaccgcagttacaacagacaaataaggatcagatataggaacatcgggacgaacgacaccagantaacacgtgcagcgccgcgcatcgtagcaggagtgcacatcgaaaatcgatacgcggacacgtaacgacagagacttcaagaaat

SEQ ID NO: 10949 - DNA, 1327 bp, Homo sapiens
  misc_feature (1)...(1327): n = A,T,C or G
gcgtttctgcttcgcttccgtgccgcgtggccgtcgtttcgctgtggttgggcgggtgcgctgctacggtggggcggggctgcggtgtggtgctcgtgcggtggcgtggtttgcacgttcgttgcgtgtgtgnggtcgggtggggtgtgtctgttgttggtgtggagggtcggtgcgtgggggtggtccggccctgtccgcggcggctgcgctgcggtgtcgcgtgggtcttctgcgcgtggggggcccggtggtggttgtggctctatgtgtctcggcgtggcggagtggcgtgctgtccgggggtggcggcccgctctgtgtggtgtgggctggtggtgtgggcgggggtggggtggggctgtcctctctggtgcgggccgtggctcgcgaggcgcgcgcgccgtcggtgtgcggccgcgcgtgcgtggtgcggcgcgcggccggcgtcggcgcggtgttngcgccgcgctcgtcgcggcgtgcgtggttggtggcgtgtcgggcgcgctcgcgtgggggtgtgcgtgagtgggtcgtcttcggtggtgtcgtcctgcgtcgcgcgcgccgcggcgcctgcgcgnggncgtgtcgtccccgtctgtgttccgtcggtttgccgctcgtgcggcggtgcgtcggggcgcggggcggcgcggccgcgtgctcttgcgtcccgccgtctgcgtctgcgtcgtntctcgctgcgtgctgtcgtgcgccgtgtgcgcgccgnccgcccgcgcgtccgcgctctggtcgcgcaccgagcgcnccacttctcgtctgccctcggccccncttctcacaaaaagctctccttcttctcccgctctgtctcgtccttcttcctctcctgcgtccnctcctctctncntnncntgcgctcttctccctctctcntttctccgcctcgtcctttgttgnccgttcctattcncttctcttctgcggcgccctctcgccctntcctctcgtctctccctccgcccctgctncgctcctgctctantgtccgctctctcgtctctcnccttcgtcgctcgccttccttgctcttcctctcctctgtctgttcnccgctccctctcgtcttncntcncnntctctnttccnctntctcncnctncncttcntcnncttctctcaatactttctctctctcttnctngtcnctcnccnccccatctcgctctgctctcnctctctctcncggggtatgcnctctnccccntccngaagagacgntnnctntctncnntnttggtttcttctcctttnctaaggggatatntttcttcttcttctcttntcnttcttctct

SEQ ID NO: 10950 - DNA, 1515 bp, Homo sapiens
  misc_feature (1)...(1515): n = A,T,C or G
ccgtcggtcgaccgcgctgcaacccgcggcgcgccggtcgacacggatgcgtcggctcgtcgtgtgtcgagtgtaggcgcgatgtcaatgtgccatggcgacaanacactagagccagcaatctaggctgtaaccatagatgacggacacgtagtgcacttnatgcaatcacttatatctgctgngntcaatcggatcacgacgattgtgggtgcggatactatgtcatatatgttgctactcgttgtatgtacgatagcgcttgtgacgtcacactcgcgtatgagcgtggatacgctgtcgcgcgttcgctcgtagcgngtagatactcgcgcgcgcctctgccgcgctccgtctacntgctcgctgctcatgcgccatctancgncgatcctgcatcttctcactacatcgccgtcatgcggccaacgctcccaggcgtcagcgtgcatatgacagcgaatagcactagctatctataatttctatccgcgtacacatctctgcgctcctcccacgtatcnccagcagatcgtccacgcgtcatcgccgacgtacgctacgctcttactggctctcgctgcgtctaccgtatccgagacgcactgcgcatggtgcagacgcggcgtaggaggctgcgcgccgtcgcagaggctctgatattctggcggcgggctgcgctcgtgacttatgcacgttgtacggtactcgtactgcctctgagtatcatctgccctatccagtctctaacctcctcagcgcgcgctgagtccgatgtctctgcagacctacggtagactgcgccttcgtcatgcacaggctatcagaggcgttgtgtgtccggcaatgttgtgtcgcgttatgactaagacttgtgtcgtcgggcgacgtgctaacgtggcgcgatccggcggtgcgctgtacctgtctctcgtgtcgctgttcggatcctcagtcgcngcgtcaggtgcttgtgtagagagtggcgtggcggtggctgctcctggatcgagtggtcgacttaagagcacccaacgcgctcgcggatgcgctcctgagcgctatgcgtcacgcgcagacgccgagatcggcgtggccgtgcgtaagcgccgatataatactcatagcactcatcggctagtaccatattcatccattgccttatacgacagtgactcttattgctgctcgctcggtaaagacaaaagattcgtttgtgatggtggccagtcgctgtacgcgtccgtgggcacgcagcttttcggttcattatgcgtagaggcggggtcgtgtgatttcagcgtcgcccatcgccgcacgccttcttcctcctctattgatacctacaactccctactaccacctcgctanacaaacacgccctactacgtgtgccacacccacacatcgcccactctcgctccntctaactaaaatatacttattcgaacatatctagcatagtatcactctatactatattcactacncgtccgtattctactatactcactc

SEQ ID NO: 10951 - DNA, 889 bp, Homo sapiens
agaaggtgaattatgagttagattcgtagtggaggggactacaggcattgtaaggaaagtgcgtggaaggtgttgtttaatagtgcgatagaagttatggaaatgtgagtatataatgtggtgtggatggcggaagaagctcatttagtcggcgactggtggtggggaggaggtgacaaataaggctattaatatatatgggcgttatgtatgagagagaagaggagggagggaagtcgggctatgcaggcagtacgaaggcccagtggtgggagttaatggagttatgagttataggggagacgagaaaggcaggtaagcgaggattcgtgttacgcgagggattgtgtttgtttccttcagcttcgcggcggatgacggctaattcggtgtcgatggggtcctatgagcaggatgaaatgtttgcgtggaggctggtaatggacagtgtagtttacttgaagtgaggagcgagagcatggaaagacaatgtgtgcgctaaggtcgctagataacacgtaagtaaaacgagcggcttttcgatggtttgttggttcagttaatgactggagtgtgagcaacgttgtggaagaaactcactgtgtgtacataatcggattgtcatcgcagattgaatctgtcgaaaggcgcaaacgtctagtgtctatgcgtttggtgaagaaaatgctgttttatgatacttgtgccagaattgtcgtgatgtggtagaaagaaggagatcattggtgcccctcacctcccaccactatagaatcaacatgatggtgagggattacagtgggggcatttctttatatcacctcttaaaaacattgtttccactttaaaagtaaacacttgataaatttttggaaaaaaaaaaaaaaaa

SEQ ID NO: 10952 - DNA, 1663 bp, Homo sapiens
  misc_feature (1)...(1663): n = A,T,C or G
actaacacgtattctgtcgtgtcggctgacggcgccatggcangacccaggcgagtcatntagcgagacgtgctgcgacgcctcgnccactacaatatgagagcctgtcaagtccatatatcgagagtactatagatagctgctagtacgtatagcgtaaccactcncctctcactgtacgtctgcgtctatgcgcatgtgtcgtgcgatngagacgtacgccgctcactnagcctgctcacantccgtctgtgccatgtacccacgntctcgtgncacctcgctcncgtgctgcgtgctcgtcngctatctgctagagcgagtgtcactagttctgtgtgcgatcatgatgatgtcancactacgagcnatatatgctacgcgtgcctctctgtatngngcgacactctgcagcgtggagtactattcatcagnatcatgcacgnacatgagctctagctgacngcgctcacgctncttcccacgcgcanccacataccatcantaacgcctcgacactctatacgtgcgtccgtaattntcgcagctgtntnagttactatgtctaatagctctgcctacgactcgcgcncgaccatacgcctatcgcagngacgctctnccaactgcgactacattcgctacgcgngctgtancactagcgtcgcgagngcacggcagtctcgcgtacgcgatgcgcatgtgcagaagctgacgtgagcgtagtgtagtctgcgacgtacgcgtcttagcacatcgctagatgacacagatactcctgagtctactcgtntactgcgcgagtaccgcgcacgcgcnctgcgctagggcgagtccgcgtcgacacacacttctccgcacgcantcgcctgtctagtctacgagcatcngcgctcatcgatacacgctatagatgagtgctagctcgtgttatgcgattatgtcgcatcgtgtgcttcgtangcgagtgtggtctgctatctgcgcgagtcgtcgcgtagcgagcagcgttactcgactcgttgcgcactatgactaacatactgcgataggttatcaggcataggagtgcgagtatacgcagtcagccgatgacgatgcgccggtgagcgatgcatgaccttccgatgactatattctaatgagtcgcgaggccagtgtctacttgtctcaccttcagacatgctacccaccgcgtcgcatgtagtatgttagctgtactcaggtgtgctgcgccgttcgtatcattcgctgaccncacgcactccgctactcgcactcacccagcacctgtactctnctccgctcgcgcgcgctcgcgcatctgcgtgtgtgtctcaccgttnatctcctcgcgcctactctcgctccgtctatctctgttgcagcggtctgtgatgttcgatggtggtgtagtggttctgcatgaggacgcgtctgcagctctctncgcgcctcggcttgtgtcattcttgcttctgtgtcatctgtaactcatccgactacctccagcntatcaaactaaccagaagatacacgagtagcacaataggacatcgtctcgatatgatcaggtgcactcatacccgatgaattcctgancatctcctctgcntcacctaccactatatatacactattccgtcatcatcattatattctg

SEQ ID NO: 10953 - DNA, 1295 bp, Homo sapiens
  misc_feature (1)...(1295): n = A,T,C or G
gaccgactcatacaacactagcggccgcccgcaaaagcgcttcgaacaagaactcgtnctacctcgtttcctacacgaaggaagcatgactcacaactctcaagactcttcagaggcgaggcctacacctggtattaaactggggtggcgcgcgtttccagccgattcgcctaccagaaacaagggctgctcactcttccgtctcggatcgttaaagtcgcttttaaacctcgccccggccgagcactcaccctcccatcagggccctcttcgcgtcaatgcactcgagtgatgtaaacccggcgacatttagcgcatcccccacttcatcactctgcgtgggcgagagtggtgtgcacgccccccaccccccctatcttctcaccgccgcctcgtcctcctgccactggccgtccacgggcacgacccccgcgcccggtcgcgccgggcctcgatgtgcgaccccgtagcgcgcgcgtggccgcgcgtagccgcgaggcacgcccgggacacgcaccaccgcggcagtcgaccgtcaacagactccggctgccattcaccttcctccgacatcgcgatatcgcctccgctacacaggtgatgagctacgagcgacgcgcagctngtgcgcctaggcatcgtaagcgatctcgccgcgcgcgcctgactactatctctacgcactcaccacgatcgaatccggcgatattcgcactacagtgtcctctcgactagatcccagtcgcagcggccatcaacgctagcgcacgcacaccgactagcaccgcgcgcgcacggtgcgtctcacagtcgtactgactacgttcatcccggcgtcgctgtccgtctcgcgcgcctcgcgatctgcgngacgctcacacagctcctcatcactagtcatccgcacgagcatgagagtancggcgtccgcgccatacacccgacgctgcgctcgccgtgccgtggtatgccgcacgacacgcagcgctctcgccgcnccagcgtagcccatccttgagtgtgctctatcgcgcnagtnanacgttcacgcatgctgcagtcaccgcaagcgcgagtccgacgcngccacgcgtactgacgtgtagccgacgcgagagaagacgtgtgtgtgttcactgctggctcgtcgacgtgagtacggcagcgcgccgagtacgatgtgtatcgatgacagactagtctncacgccgtcgcgtagagcgnaggctcgcgcggaacccggcgncaancgagncgcgattacgactactcgtcactccctcatctctcacaat

SEQ ID NO: 10954 - DNA, 1770 bp, Homo sapiens
  misc_feature (1)...(1770): n = A,T,C or G
cctacgcacganagagacgtaggaaacacgnactgngcacaggagantatacacatactatcgagaccacgaatcttcagtatgtcgtacgtcgatgcgcttanctgatctcgcccctgtacactggcnaggtgagtgtagtgctgcgtctacacatggtactgctaacatactacacagcgactcacacctncacgtngagntntgggancgaatatagcacacgacgctcatgagagttgtctatgtcttgattacttcctncgtacacagtcctatctaantagcactagtcacacgaganagagngcgcgtatacgtcaggagtcgcgcagcgggacagcagagcgaccaagatgagacgtcgctagcggtctcagccagcagtagtcacgcgacgcgagaacggtgagtatcgtganttgtctctctatactctgttacctcagtacacacacacacgtcattatcttataactactactgatgntatnaactacacttagatacataactaatagntatcantgcgtatngacacagatacatgagatacaganntagagagaacgaacagagagagcgagaagtaactacgcagtagatntataatagtctagatntcntgtncacgcttcagatgcatgacacnagtagtctacacantnatgctatctggtacgcgaatgactgacgcgctatagagatctgactagaacggacgctcgagananggagtagcagcagtctgtangactactatgcgatgatagcangnatacgagcgcagagattcagagaacacacagcgagngnagcgtgagnatatatgcagacgatcacgatcctagcgcactatgcagcgtgcgcacggagggacatntcgatgcgtcatcaatcgcgcactgtgagctctgcgtagatcgcaagacactcanctcctgccgtacacatctcgtacagtcatgtagacgtaatggcgcagagcggtgtcgtcgnccgtgatcatcgtcgatgcgctagcgtgctgcaggcgacggacgactcacgacgtacgtccggctncagactacactacctcacactcacactctcaactcactcctgcgctcatcagctcactgctctgactctgtcatgactgtcancngcacgacagtcagagttactctgtatagtgctagcgtcgagcgcangcgacgacttagctgcggtgatagtcttgtcgactgcgtcatcgcgactgatctgtgctgtnccgcagcgacatacgngagatcccagcgnggagcagacacgcacagcagcgaatgatgacncgcgaggtggctaccaacttacacagcaacagccgcgcatacctcacgtccgcctcagcantgcgtctatgantacagatagcatatcgtaattagaatctatgtacgtgaactacgtagttcactatactacatgctcgcggacacgtcgcgcgcctagtacgtcggcgagctgcgaagacggtggtcgcgaggcgtggactgccagtctagccgcgttacctnacacgaacactactatctganctatagtatcacagcacaccatcagcgctcanatctactcgganatgactatancacctatgangcactacnctcactcagctcgcagctactagctctcgctatcgtcgatcngatactaatcanttctacatctcatgattcataagataactatagatcaattacnnactcactatatagatcactacatgacttatatact

SEQ ID NO: 10955 - DNA, 1264 bp, Homo sapiens
  misc_feature (1)...(1264): n = A,T,C or G
atagaacggctgtcgcgctacgcggcacgctcgtcgcgtgcgcgcgttgcgtgtttgtatgtatctctcatgttatctctcgtcccgctgcgcttgcggatcaggcttcgggcgtgcgtaagtaatcacgtgcagtttctacatacgcaacgcttcgtagtgtgttgctgtnttgtctgttgccatcgcgcctacatcgtctttgcactgggtcgctgtggatagtaactatgggtagtgttaacgtaaacgttgggggttggttatgttcgtgtgctcggacagccgataggactcccggtgctccggcgcctcaccatccgtccggctgccgcatagatcaacagagcggagtggacggagagtacgatgcatactccgcgaagcagtcgatgatgacgtgacggtgcactagtcttcgtgcgtgtcgctgcgtcacggcgtctaccgcaggttagtgtggtcggcgtgcgacgctaggctgggtgccgtcattagcatcgtgagtgcgtcgtgtacgcgtcctcctcgcgtgtttcgcgtggctggtagagtgcgacgcgctgtgttgtagtgtgtatcgatacattattcgcagtggcacggtgtgccctgcatcttctatcacatgctatgtgatatcggcagctgcattggttggcgtgcgcggcntattgtgattacttttcagccgtcagcgcggtngagcggtgtctcgttgaatgtggctctattacgtgtggcagttacgttgtgcgctatccagtagttgagaacgtttgtggctcttgatattcctcttcccaatgtagtatgacgccgctgtggtgacgcaatgacgtgtttgagggtgaggggcggtcctcttgtgttgtgagacgcggtcgtatcataataatctgtgtgtataccttgttttgtcgtatactaagctcacctgtttggtcgattgaatacaacttattaagcgtgtggtcatcgcgagcagaaggtgagttattcagctcgatggtgctggctgtgagggcgcggggctgttggcagttgggctacggattgcatggtacgtggtctatgcggccggaagaggaaagtaagaataagaaaagaaaatgaaaagaaaagtgaaaacaataagaagaaataaataaaataaagatggtcctcgtctggcctaacagtcggtgtagctgtctcccgcgccaacccctcttttttttgtatttacttcttntctctctgattaagcgtcggcccgcctcgc

SEQ ID NO: 10956 - DNA, 1010 bp, Homo sapiens
gggttatagtaacattacaacgaaggggaaaaacaaagcttattgtagacagggaaggggggtttgaagcaaagacggtaaaaaagtatatcgaacaaaaggaggtggggcctacaaggggaacatacaaaaaaagggatgggaggatggcaatagtggatgccaataactgtgggggaggcatgacatcaaaaaaaggggggggccaagaaccctctgaagatggtccacaaaccaatatgctgggaccttcatcctacatccgatgattttctgggcgggcgtgggtgtcacaatcagactgggagcgaaaaaggcaaactaaaaactggttgaactgcatatctaggtggtgtttagctgaggtgtggtgatatctggatatgagaaaaagggaaaatcgacaatatagcgggacacaggtggggaccaacaaactgggctcagacgacggcgccacaactcggtggacatgtgtttgagtatatattataaagtgtgcgaatattcaggccatgtgggtgggtgtcatcactccaccgcgatatacagcgacattaactggactctcccgactcctctgcggcgcactcaccggtgcgcctccgtggcgatactcctaaatatacgatttgtgtgtggctgcgggctgtggttctgctactacacactgtttgtgtcattgtccccctttgtgcccttcgccgcgcgcgttcacgtgatcacttatacaaaccaacctctgtgacgccgggttgaatcttgatacaaacattgtgccctgatgtccgggcctcggtcctcccagggaccatgccacttcggtcgtcctttgcatctcttatattcagaccatcgtgcgataccactcaaccctggtggttgggcatacagtagcttttaacggaagcacctctagcacggtcctctgggtcacgtctccctgtgtcgttgttgtactctttttcacagccattgtctctcatttctctagcgcgtatttgataact

SEQ ID NO: 10957 - DNA, 814 bp, Homo sapiens
gcgtgacacatacctccaccccacagaggggagggaaaaaagacctaattagatcgaaaacgctgaattccatctcctatgtgtgatcatctgtgcagataaacactctcaccacatcctagaaggacagtagtgttcattcactctgtggggaggtcttccactctgtgaaaaatttaaagttaaactggaaagttttatatttggggaactacgactaaatataattaactattttctttgaagacctctcccacccaacttctttctagaccacaggaatgaaaataagcccgttgtgtaatctgcaaagtaaaagtaaaaggctgcagtcctgctttgacatggcaaaaaaatattgtttttgaaagcgacggactcccttattgtatgcaaccaataatgggcccatttctccccatggaccgggacctgcgctggggggcgcgctgttgctcacaaagggggttagttctgagaccctctccttatggtgggagggcttgcgaagagccgcgcttgcgtggcggggtaaacgcggccggcactttgtgggaggcgtgctctactcgtgatgcgggggaagtgttgtaacgcccccgaagccgggacgtcccgaaagcaaaaccggcgaacaagggcgagcgactggggcctgtagtccgcggcgcccgcttggcgaacatacgagaaacaccccgccgggggagcgccgagagggagcgggtcttcagagcggcgcgaccccgcgtgatagatgagcccgttgcgcatcaccgagacgcttgtccgatcccccgatattcttagtggg

SEQ ID NO: 10958 - DNA, 880 bp, Homo sapiens
  misc_feature (1)...(880): n = A,T,C or G
accggtaatgtnaaacacaagaagacgagtcatcagtactcgtggtcttgcttcgttaccaggctggtccggaactgcgtggtctcaaacaattctccctcctcacccttgggggagggggggattgttgggtctctctctaatgaccagggctggagtgcactggcacactcatacgctcactacaactttgaactccctggggtcaagagatcctcgccgcttcagcgctcccagacggctagggagtacactgagagaggcatcaccgcgtcggcagggggcgagtgatcgaaacagaagcaacgcgtgacgaaaacagccggccgccggtctcgcgccaccgcccagaaggcgcgccggacaaggaggcggaacggggatagtggacgccggagctcgggggtcagcgagagacggcccgaggacacgcccgcgccggtgagggaactgccacccaagtcaaacgcgccaggcggggtagagccaaggacgctggggcgaacatacgcggcgcagacagcacgggcacggcgcggagaggccgccgggcgcgcggggggcgcgtagcgacggatgagccccacctcgctcggcggtccacggcttgaagggcccatcgggccacgacacggtcgagagcgccgcactgcccgaggcgagcgacgaccggggcgggccgcggggtcagagccggatgagaccgcgcgcagggatgtgagggaagcggatcggcagcggcagcggcgcgagctgggcggggcgacaggccggaacgggcggacgggcggagcggggcggctgcggggaacagcggaggacgctacgccgcggatcgagttcgcgcgcgtgagacccagtaatccggcaagtatccgag

SEQ ID NO: 10959 - DNA, 1666 bp, Homo sapiens
  misc_feature (1)...(1666): n = A,T,C or G
ggtatacgagggtgtaggcacttgagngacacagatatacanagcacgagtgtggacaccagtcatctgtctccatgtctctgtancgaactggtcgcaacactctctacgacgaagtctgcgatccattcgtcgtacctcatcactcatgangcaatatacttctgatctcgagcactcactaaagcatacccacgcgnnagancganacacaagataaatatgatgcganngcaggctatgtgcacgatgcagacgcgcaagatacgcacacacagcgtgtactcgatcacgcgtcgctctccatgtgtacactacgctctatagtcatctgatcacgcgagagcgtcctagatgggcactaccgctcagaggtcagagtagctagatanatcgcctgcacgcacaccgtgcncgtgctctgtcatgtgcacgcctacgccgacgagggngcgggcacctagtcgagtgntacgcgcgcgtactcacgactagaggtgatagtagcgagtgtaagcgagcgagagcgtagtncttgtctgacaaatgttatttctcaacacaaanaagacagaacgagacgnagattacacgtcacgtacacactcgtacgacagcaccgctncattaggtnattggaatgtgtgagtntgggcgcgaggacacacgtggcgtgccgccctaccggcacacaacacacancgntgttatcgatctctactagccantcacgactgcgggagngagcacggcgcatagagacgatgatacgagtacgtaacaacgcacaggaccacaatgaaactctcgactatggtctctcacttacgtgntgacactcatgttcgcttactacaggtncnatatctctcagtnncgctctggcgagaccgtcactctaggattccgcgtttcgtntacanacatagatcagacagtctcacatanacgtcacgtatttgngcttgagtggtgtagcgcccctgcctgctgcttcccttncgctatcgagatcgctttctcacgcacatatngaccacgacgtatanatcatctcgatacgcaactgcaatctcactanagcttatctntaatagcttaacaatcatntgtagctactcgctcactgtgtgcgcgnntccatctgacanttcttgcgatactcttgctctgtacgctcgtccctgnagcactctacatngtaacagtcttgtgtntgcctcgaacatgggcaggacgcactagagacatcgttatctgnngcgcgcggganaacacgacacccgtatgaacaccatcgttgtnggtcgatcgctntggnagcatatgatacagagagacggtacacatcaccatcatacacaacgttctcgaagctcctcaggcgtctgactcgcgctgntctatgacgtcattacattgagcttcttgtggcatagatngcgagaaggagcanatttatgattgttgtgcctagacacgctcactcctcgccaccagtgagtgcgtgtggctgaatgatctctatgtagatactgtaggatatcttaatnncattattnnacatcaacannacanacataaccactcatattcatcatatttccataataacaacacatattaattaacaactattanatacactctatccacacactactac

SEQ ID NO: 10960 - DNA, 1437 bp, Homo sapiens
  misc_feature (1)...(1437): n = A,T,C or G
gtcgcgcgtcccgtgtctccctcgcctcgcggtccgcgccgcggtcgctttcgngngcgctgctgtggctnggagtgtcttnctcgtctcagtctctgctgtagacgtcccgtcgccttcgcgcgcgtaccgcncactgcgngcgcgcggagatggtcgatgtgncgacgctgtgcgctgcagcgtncgcgcgcgcgtagtgntgngttgtctgcgtatctgngctgtgngncgcgagtcactctcgtcgcggtgcgtcgtggatcgtgtgntgctctctgcactgcgtcgtgctgcattccgttcgtcgcttgctccgtcgtgtcgtgtgtggtcgacgtcgtcgtgctagtgntgtgcgctgctttnttctgtctctcctcctgccgtgtcgctgtatggctctgcgtcgccgacactcgtgtcggcttctgcttggcnctcgcgtccctccctggtcggtgcgcgctcgccgtcgagtgcgcggangctcgtcgcngcggtgcgagcgcgcgcctgacgggtgcgggttcccgtgtctgtctcgcctagcctctcgccgccgcgctgttctctgtgcgtgtttgtcagtccttgtctcctccgcgtcttcctcgctctcgcgtcgtcgtgcttgccgtctgttacctttcttggctgtcggctggcgggtcttcatctggttcgtcctgtctcttgcgggcgtctgtggtgtcggtttcccggcggtggtgcgttgcgtggtcgtctccttgttgtggatgtgctgtgctgtgtgggcggtgttccgcctgcgcgcattttctgtcttgttcgtttcggcgtgtatggtgcgtcctccctggtcgtcgtttcctccgtccggcgtctccgtggcgggtccgttcttgctcttctgccggctgccgctctgcctgttcgcttcgttcgccttgctggttttctgccgcgtggtcgttgtcggttgngtgccgcgttgccgggtgctccggcgcggcgggtcgtctgctcctccggcgcgtgtgcgccgtcggctgcgtcttggtccgccttgtgcgcgctgtggccgttttcgttggctgtttcgtgttgtcctgcgctgcctctgcgtggccgtttcctgcctctctcttcttgcctcctgttgcgcgtgcgcggtcctcgtgtcggtggtccgccttcgtctgtttctttgcgtggctgctgtgcgctcgccgcggctgcctgttgtgttgtgttccgtgcgctgggcgtctttggtcttcctcttttctcggtgctgcgcgctgcttccgccgtctgttggtggtgcggctcttcgttgctcgctcacagctggtgtgccgtctgtttccccccctgaaaactactcttcctctcttctttctttttctttggtgtgttcttgtggcttgctctcggctcgcttctccgccc

SEQ ID NO: 10961 - DNA, 1432 bp, Homo sapiens
  misc_feature (1)...(1432): n = A,T,C or G
cgtattctgccgtctgctagcgtcgtcgtctcgtcgtattacgtgcgactactataatcgccgctatgtgctcagacgtgacaccgcgagcgctgcggctgggctgagctcgcgacgcgtacgatagtcgtctcgtccgtngtgctggtctgctgttgagtccgctcgcgtgcatcgtacaacaactgctactcggtatcgcgctatctctccatcctcgtacgcattcgccaagctggtacgttcgtcgtggctccgtttctgtcacccttctctctctccgtcgacaccttcgccgcacgcggcttagcgctggacacgtgacgcgcgctcgcccctgcctcgtcgatcttcaatacacgcgcgggactcaggtgacggtgtggcgtgcgtggcgcgcgcaccatatcgcggcgcgggtcgggtggtgtgtgcgtcanagtgcgtacggccctctcccgcggcaccgttcttacttccttccgcttctacatccctgccgaccgtttccatctccacgcgtggcgagccgggtcgccctcgggtgcggtctacgtgcgcgggcgccccggcgcgccctgccgagcgcgctcgcgtgtgatttatgtgtatactgcacctatgctatctctatcctgtacgcggaggtagcntgagcgatgtgtacggtgcggagcgcgtaggcgtgagcggctgtgtgtttgagtgctcgtccgcgttctgcgcgtcgtctgcacgtcgcccttgacctgctcgtccgcgcgtctatgcgccgccgtttcgntgtgtccggcacgtgtctcgctcttcttgtcctctccgctgtcctctccagtccgcgcgtcgctccgagttcattaacggcctgggctcactcctacgcccctctctcgttttatggttgttttcgctatgcttcgttaatattcactctagtttattcacttctctgntcacacacatatatncactacactcttatcacgacattttcgtatacttcgaatctctctcctccaggtgcgtactctccccttcatctcgcacnatatatccttactatctacttcattctgtgttgtcgaacgtaacacctgcacagctccacacgatgctcctgcgaacatcatactaagatacttatgttgcactctcaacaccatcttttctattctttatntttctatcgtcttntcttctaagccagcnatctacacntntntnnttatctctggnctctccgncctacgctccgccggctacgggtgnnctctcgttcgtcnangaaagtcgttcttgtccgtnttgggtcctttctctnntaaagnttatgtttattttcttcttttantttcctctctcttcttctctcctctctcctcctcccctctnnncnancttncntttttnntnncccggttttttctttttt

SEQ ID NO: 10962 - DNA, 804 bp, Homo sapiens
  misc_feature (1)...(804): n = A,T,C or G
ttcttattctccatttgttttcatctgcaaaaatcctcaagaaatggttctaaacttgggtntgggggaaaaacaaaaatctnnaaattncattccaaaatccatcaangagcaaagaacgggttaatgaagcaaaataaagctgtctgacccacgagaaaaggaactatacaccatagtggagttttgtgtactaaaattgctatctactggggctgtggagttcaactactaaaaacctaaaagctaaaaatcaggcttgaatacctcaaaacttaaactcttaccaaaatctgtatatttttcttaaggagtgggattcctactttatgtaatgggggtcaaaatctttcaaccccttatgtataaaaacctgtttaaaatttctaaaaaaaagaaaaacacctagcctctctcgccctcaccgcggaactctgccaccggtcccctttaacaagggggtattccatagccctcacttcataaactagttcgcttcgggaagccggtgtcgcgacgcggtgtcgactcactcacaagcgagtattgcgcgtttccccaggtcatgggggaaccgaggaaaaaccatcgaacaagaaccccaataagcccgaaccgacaaagccccagcgcgtgacgtgccgccagggcccccgcccccagaaactcacgaagctcgcttacacgggcggtgcgagcccggcggacattgcccaacccgccgtccccccgcgggacctcagaggttggtgtccccgcttaccggtccccgccctcaacaactttcctcttaaacccgcactt

SEQ ID NO: 10963 - DNA, 1265 bp, Homo sapiens
  misc_feature (1)...(1265): n = A,T,C or G
tcgtccaaggnagctcgcacgaagccagtgtgcagggagcatacagcgaccgtccagttggacgcgacctcttgtngtgtatgacactgagtcgataccgtcaatccacggtgcgccacactccgcacangccactcaacaccgccgtgatctactgatgctctagatgcggaatgcgtagtgctgcactcaaaggccgctcacacctgtctgtcgcgctgtgtcatcagtagagagntgatgcggcgagctactcgtactcgtcagggtgctcgttatataggctcgcagtcgtggagcttcgagtgtcaggtacgtgttgtgcgtacgcgctcggtgagggcatcagatgtggatgatgtggtagacgccatgtatatagtagatactataatatgttatcaatacaaatgtgagaactggatgaggagaaaggggagaacgacgcgagaaaactgctatctagtgctgcgggtggtgtagtagacgagcgcttaggtactggtgttgtcgtatggactttacaagcggagatctcatagggttcgcaagcgggcgctgactcactgatacatctgccatctcggggtcccacattaacctaaggccactgggtcgtgtgaagcgtgcaggtcgcggtgtggacgcagtagagaccacgatgaaggctcactctagagaccatacatgctcatcataggaggtgctatagtgtgaacataagcgcgactacagcacgcgctcggaccgcctgaccctcgtgagcattgtacggaccagtagagtactctccacgttagcatcgaggacaagcatttcctctgccccttgatcctcacgcaccatagccacataccttggtgcgctcttagttattcgactgtggttacgttggtcacgtgtgtcgnaccgggtggcctactgcatcgcctggggacgaccattagnccatagtgtgtggttagggagctctcaggcgtgatgtggngcacaccgaggggcanctggctctgcgagcgtcatctcttatcagctgttcgtacgtgtctactgtggcccatctctctactcatctaagtcgctagtagcttgacatctcgttctatctacaatcgcngtcgtncgcgacgcgcgcctccgcgggcnccattgcgaggngagactcganattgaaagaagnggaggggggtatgccggtntccattaacactctgaccactataatagattgccctatatacgatcctctcccccgacccatcact

SEQ ID NO: 10964 - DNA, 1447 bp, Homo sapiens
  misc_feature (1)...(1447): n = A,T,C or G
cagactttattgaacacattgatacgagagaatgtatgtagtgtcagatagacgtgtanagatgatnancgactcgcgagtcgtgtgctcaacgtgtaaggactgacgcgtacggcacaggtgtgacgcatgtcgagcgtactctagtngaactaattgagagcgagnacatatcanaaaggagaaccgcgacgctgatcatctgtatctgtagatgtattatatgagatgtntatgatacgtgatgtgtgagtgtatagagangtgatatgatgtgatatattacgcncacggcggcgtcgtcagctcanctcgcaccaaccgcaccatagtagccgcgttctacgaagcctacaccgatcgatttgacgtatgagacntcgggcgatgcaacatagtaatccgcatagtacagcgtgaggaggtgtatatgatagacggaactgacacgctacgnggtactagaagacgtaacggatgaataaacgctagtgcattgagattcacagtagtgtagagtagacgctagactgngagatcnatcatgatgaatgacggtagcgcgactcggataatcacataatacgttatgcagagcgtgtaacgatagtagcatgcgactccgtcgccatagcgagagcggcgcgctgttgcgtacgtagacgtatactatgcgcacatggcgacagctgtgcgcagggcggccatctcctgtatatcgaaatagcgatgtgccgtagacgcgcagagacgttgctgcagtgatgatctgtagcaatatacancctggcgctgcagtgcacagtgtagactataactgaatcacggcgggcatgaagtgaggcacgatgagtgggtgctgtgctgttgtatgagcgatgagatcgatacaagtgacacagttaatagactatgccatgacacaagcgagcatgtcgctgtgcgcgagcantantcgangtntctgcgtcgttctccangtagagctgcacttctgcagtgaccactgcgctaacgcattagctcacacgcacgtctgttagatgacgttcagtgacgacatcagttcacatgcgcgatctcgccggtggcactcgcagacgcatactactactaatcttattctcatctcctgactgctctgaggatagtagctgtcgatgcttcgacatgcatangtgcgtgagatacggctcgattttcagtgtgagagagagcgcgtcagcataactacttgttctacacagagcatattatgtgtgcggtatcgaanatctcggtggtcgtagtagtctatctttattatgagaaagagagaagaaagagagtggtcgctctgtttgtgcgtaacatgctgtgcgcagtntagttgctcgccccgaccctctttttctcgagtgtggtctctctgtgtgtgatgggctgggtgctggcgggtgcgcgcggt

SEQ ID NO: 10965 - DNA, 995 bp, Homo sapiens
  misc_feature (1)...(995): n = A,T,C or G
attttctattttttaacggttatgtttttgtccaattaatacataatgcaagtgttatacaaaacgggagccacgaccgttacatataaacgagtatatattataaatgtgaggaagtagagtgagacatggtgatgtgagttttctatatacaaagatctggtgacgattcataaaatggatatatcgctaatgcggcacgagacggaaacaatacagacgttgatgtataaatagatatataataatattaagaaaacataatgaagtataaacctgggcgacaggaagaggagagtagggggctgggtctgggttagcgtgccggaggcacaacagcacgagatacacatagaagcggccgatagcgaacaagagcgaggaagagggaaggggagtggggagagatagtgggagaagagaaatcagaaggagtggggagtatgtagcacatgctgagtggccggaccgttagggtttcggtgcgtccgcgcgggggtgccgttgtgttgcgttcgccgggctgcggnggcctcgcgcggctgcggcgcggttggggcctcggggcggctggccccctgcgcgcggtgtccgcgtgtccgccgcccgggcggggccccccaaaaaaaaaatttttttttttcttctttttttctcttttctccctccctccctctcctcctccttcncctccctctgtctttctggtctctcctcccctgcccccnccggcccgctttcttctccgccgcccctctccgcgccctccccccccccnccccgccgccccccccgcncnttncgctcctcctttcccctctccccccnnttcacccccccttctccctgctncccccncnctctttttctntnntctngtggtnncncnccnngaggccttcntctgttnngtcgntctttctagggtttttttttttttttatttttattatttcccccctaacaancccnnaanctncccnncctctccaccc

SEQ ID NO: 10966 - DNA, 1076 bp, Homo sapiens
  misc_feature (1)...(1076): n = A,T,C or G
ggttatgtggtcatcgttggcatgagcgagccttattggcgccgcgggccacgacgcgggcgccgctcgcctcgtctcttggatgcgttgagccgcacctagcggcttntcgctattggacgtggcgtcgccgggggggcgtggggaggcgtgggcgctccctttgatcctgtagcgggtcgtgggccttcggctgcggccctcgtgccatnggcggtcgtggcctttcgtacgtgccctggctctcggacgtgatggccgcggtggcagggtgggacacgcgcttggtgggtcggcgagcgccgacagcggatagtgagggccagagagaggggttgtaatccttaccttnggatcctcattgttcaccgtggctccccggtagggcagggtacaggagcggtggtacgctgctctaggcacgggtcggcgcgcagggggggcgaagattggggacgtgcggtgtggtgggaggtggcggggacgggagggagatggtatctggggggagtcgggtacggtgtgtggccgggcttccttgtggttgttggtctgggacactcggactccgcctagccctcgaggagacagaccctgctgttcgatgtcttggccctcgtgggggttggnacttcgtggttgcctgtaccctgcccgttttgtcctattagctcctggttccctccccgcgcgtctcttgtcctcgtacccgctcctttgtcccattctgttccttgtgtctggtctatgttgcttctgagggcgtgctgggcccttcggagccactatagcacttttgnacattcggggngtggagagctcggtgatgtgatctgngccgcgcggggtggcaacgtgtctacgacatggaatctcgctcagtatgtgacgtttttctctttcgtttgctcatgtgagtcaagccggcggggtgtcgagtatttcttggctgggcgttccgctgcgcatganacgagggtgtgtgtcggtggtgggagtttttattttnnccactnactccatccaacttaccatagtctattaaattttttaccccgtttccttctctctaccat

SEQ ID NO: 10967 - DNA, 1512 bp, Homo sapiens
  misc_feature (1)...(1512): n = A,T,C or G
gtatgtattgtttactacgagctcgtctgctacacatcgatgagacgcgcgcgtcancagcnacncttcacgctgcacgctgcagactgatgctnagtatagtactcgattgtctgcacgcacgcacaatttgangagccactgatcgagtatgtgacgttgatcangnatgaccagcgaatgacgacgatagantacgcatgaccacgaggatcgacgcacacagagcgccggctctgacgatcgacgcagagcgactgttcccgcgtctagactgatgcacactancacagcctacatctatctctaagatattagtaccagatccataantataatcgtgtccacgtatgagacacgcacggcgagtctattactgcattacgtgtgtgtctttgcatctgctanctatgcttctcattcatattgcaaccaataccataccacgtgcgaacagatcgctagacgatcggcgcgccgccgtcggtgcgccacattatactgaaggcatgatgcggcggtccntccctctccactactcagcatgtgatgattagcgtcgtgctnagtnactctagatgccatatactccgtaacaacgtatcacgcaaacgatgactcacgtcacgacattaagcatatatcggtgtagaacgaattcgagaggcgtgtgtaagtatattactttagcagaatatctgcgatcgtgatangatacagcatgaagtgcattgcggcgcttagactgcggtatcttatatcgaataatactacagaagtggaatgctcctgagcaagcatagattatgctagacgcatctccgaggtcttactcatcaccagtcgggtgtgcgtgcgagtgctgaatcgcacattgggtcattgtaagtaggtagtgtgtagctgatatactgatagacacgtctcacctaaacaattcgccaccctatatgtcaagtaagataaatgtcagcctgatcagacagacgatacatgcacacatcatctatgagaagcagtgaaggctagtatatgtgaagagtatagcgtcncagtatagcttgacggatcggccggccgtcttgtcggtctcagtatgtctgttgtagtcactctttagtgctccgtcagtcggtgttgggncttcatcgctaggctgtctctctgggcgcagccttgcgcacacgtagtantctcaatatgttcgtcgtgttcacgcgtacgcagcgtacacataagtgcgcgtcatggtgcgtgaggagcgaagcgatgatggcgagtcgtcgagagggcacctcagacctcttgcgcttatcgaggtacaagtacgctgcagttgtatacacggacctacggtgattctctgacgttacgattcaccgcgcgcgccgcaaaaacgaacangccacgagaaaggctctcatctaggaaagttgaacgcagggctctataagcaccaacgtccgactgtaattcagactgttgtgagcagtcggcgagcagatcgtacta

SEQ ID NO: 10968 - DNA, 1836 bp, Homo sapiens
  misc_feature (1)...(1836): n = A,T,C or G
gagtagcctgactctaggcgcgagcggtccagcagtcccgctacactagatgctaagtcgcgccgcgcgcgcgccgcggtcgttccaacctgcccgcgctaacacatacgtgtagtacgtcagcttcaacaggactacgtgtgtccgacgtctggtcgacggtgtctctcgcactaccgtgcatcgcgtctgcacagcgtctcacacagcacgcgagttcgagcgttagtagtgacaggtatggtgtcgtgtaaatccgtagtcactcgtcggagtgctgcttgtcgtcacagagagactcgtgctatatagtcactatccgctcacgctgagtgcacacactgacgcagcggcgcgcatctntagctctgatcgtcgcgacatgcatgtgcttacagcatacgtcgtcgataagttggtgatcgctcccacgaaggcgctctgagtcagatccacgtggngatagcagatccacgcatcagcgcctatatacganaggactatctaccaatcatctcatatggagtcgacatgcatggtgcgtacgccgcacactgcacagagcgacgcncacgccngagaacctgcctgacgtnagagcaggtgntcggcgcgagtgatagagtgtgagctnccacgacgtcgcgacggaatcgcgagagccgatcagaatcacgcacactatcagacgcgccacgcgaccagtcgtcagcgtactgcgcactgactaatcctctcgttcgtctagacacgttactaggggagttgagtggattacacatacacacgtgtaggatggtgctcacggacgcgtgctccacagtgtcgcttggagtgcctactcgaagcacgcgagtggttatgcggatgaggtcaggnggtgctcgcanctacatactcatctctagatgagagnaatanatcagcctgtgcgacagattcgcgagcagtgcaaggttnagagctatacgtcacgtctcactgactgtgcncacggcaggcgcgcgacgcgcgctcgccancactcgagcgtacagtggncatatagccagatctcatactcgcacgcgcacccgatgaatgantgacacatgtaacntnatagagagtttagttctanatagatgagtcgtactgcgatagattaatacgcccacgcacgatgncncgacttagtatttctactgcatcagctacnacttgatcactcnactatntctcctatagtangatgcgttgtgagtgttgtcgtcgtagcgtgtgatgcgatcactaacgatgtcacacgtaagctacatgantacatgtaactgtgcactatgtgagtgacgnanagaccagtagacacgtgcttgcaggagagtgtgtgtcgatcatacantcactccagtctggcgaccagtcagacgagcagacncgatcacgatagtncnctagatagtcganatagcagtgantaatgancactaccntactgtatgctgaggagtcnacncgcngatgatatagacgagatcgagcttagtagacagtcatcatcacgatcgngcgacagtattaatcagcaagatgacatgnatagattanagngctgntgtatgaactantantactgcngctcgtagacngctgtgcagttgatgtanctgcgtttngatcatcgtcagtaagactgtcgatgcgcatcatccagcacacagcgcactagtcggtcggagcaacgagcagatcgagactcgcgaccccagcagncntatcttgacggttaaatantaaccaataaactcatagatatcaatacagccgcacancagagcggtacagtnagtntatgcg

SEQ ID NO: 10969 - DNA, 545 bp, Homo sapiens
ccctgctctcgccttgtgatgtgcctgctccctcttcaccttttgccacgaataaaagctccctgaggcttgcgcagaggccaagcagatgccagcaccatgcctgtatagcctacggaactacagagtcccgctgcgccacccaggctggagtgtagtggcgcaatctcggctcactgcaagctctgcctccggggttcaagcgattctcctgtcccagattcccaagtggctgggactagaggcgcctgccaccacgcccagctaatctttttatatttttagtagagacagggtttcactatgttggccaggctggtcttgaactcctgacctcatgatccacccgcctcagcctcccaaagtgctgggatacagacgtaagccaccgcgcccagccctaatatctttatataaattttgaatgtctaaaactagtagtgtatttagtgtttttcttgtatcatttaacaataaattaaaatgcaatcaaaatttacatgatacaaaaatgttggtctcacccccccccaaaaaaaaaaaaa

SEQ ID NO: 10970 - DNA, 804 bp, Homo sapiens
  misc_feature (1)...(804): n = A,T,C or G
ttggcaataatgttagacaaaaagcaaattccagtgatgggggtgcaaaatgggtcataaagcancnnaaacaactcagaatagggggcaacnaantttaacccannnaactnctaacnaatgtgcagggcgngggtcattcaagaggttttgcaaaggagacaaaagccttgaagatgaggagcataatagccagccatcggaaggtgacaacgaccaattgagagcaatcatcaagggggggggtcttacaactacgtgggcagttgacaaagaaatcaatggtggccattctacagtgggtcggcatttgaagcaaattggaaaggggaaaaagctcaatgaggggggggccttatgagctgagggagaatccaaaaaagtcttgtgtttgaaggggggtcttgtcttatgctatgcaacaattatgacccttggtcgatgggatggggagctggcctgaggaaggggggttatatgacaaccccgtcaggggtgagacaaagagaagcgtccgaggccttcgggagggcagcttggctcaggaaaaggggacaggactgttggggagctgcggtaggctgagcactgcgggtcggggaggctgggagaacgttgcagggagggaggggggtcgggaatggggggggggcgtgggcggggtggcggaattgggtgaggcaaagaagggcccattggtgggggggcgggcaccggcggcggcgggggtggggggggagaaggggggtggagggtgcggcgtggcggtcggcggggtgtggggtgattcctgtcttaagctgt

SEQ ID NO: 10971 - DNA, 776 bp, Homo sapiens
  misc_feature (1)...(776): n = A,T,C or G
aggcccgtggcatctatgagaactctagattaatcttcctagtagtggtagccgagtagtgtgtgtaaaggtcattttgtttggtcttaattaatggtctgttattattgcaggcgcgtgcaatgtcctcgtagtaaccttgagtgtctttcatctctcagttcgtagcactttgggttcaggcgcgagtagtgagtatataaaataattgatgcggttgggccgcgtggcggtgtactcccgcgagctgagcggtcgtagggatctgaatacgctgatgaggcggtggtgcgtggtacgtattgtcaggttacgtgtatatacacgcgatggagactggctacgttcatgcaactttactgctaggtgtgtcttcatcgttgtaagaaggttctatgagaattgtgtgttgtgcttgggggtgttgttgttgtggcgtgacatgtgctcgctcatcatactcttgtctctgtgactatggcgttattagctgccgccgctgctctttgcgccctcttttctgtcatgtgcttctttactttttcatttattctattgagacgatccttcgaaaaaataattattttttctttttcatcaacaataacaaaagacccaaatcagtattctatacttttcctccttctttgtttgatgatttttttttaactaaattatatatattttcccctcccgtcccctaaccaatcttatattaaacctataacaaaaatcttttttttaaatacaattnttagcnattttttaaaaacgag

SEQ ID NO: 10972 - DNA, 893 bp, Homo sapiens
  misc_feature (1)...(893): n = A,T,C or G
cactcgggggcgacggacgcgccgccgncgccttaaggtgtaccaacctgtggaccagtaanaacaaagatcatatccccaggaagacaaaagaataaagcatgtgaataatttttaagagaggggggctttattccaaacaaacctttcattggattacattgggggggtaaataagagatgggatgagaatgggttagaaaaatacctcatcagtaagtgggcgataacaatggaactattagaaaaaaaaaacaagaggggcctcgattgacctcagggggggggggtctancggccccttccctttagggaggaagaattcatggagccgggctcactggactgcgcggctcggggcctgcggctcagggggagcgggattaacgtgaggcagggcggggatcgccgggatccccgagaggagggggatggcgcagcgaaagacatgtggagcaaagggcacgaagaggccagaaccggaaacagaggccgggggggtgggggtgttcgccgggggtgcaggccccgggcagagatgccaaaggagagggcggaggagacgcgggggagcccccccgagcgatggaggatccggcgagttgccccttggagggcccgcggccccgctgcgagagaaacgctgcccgtagcgggggcgatgacgaggtgcgccctacggaagggggccggttttgtggacctcagctcatggcgattgagaggggtgagcgcattatctgccaggagcggggggggggggcagagccccgggagcgggggcggggagacggctgggagggcggcggggtgggcgcgcgcgggagagaggtgtgagggccggcgagggggtgcgaggcgggaaggcggaaggggaaggtgacggagcggcg

SEQ ID NO: 10973 - DNA, 1284 bp, Homo sapiens
  misc_feature (1)...(1284): n = A,T,C or G
agtttacatgacctgataccatcggcgtgnagtccgtgacggggggcgagcgctcgcgtctttgantataccgtcaatagaaaccctgccttctcactccctagccagtctccccttacgcatgtgtggaaccgtatgataanggaggtatcagatanagacgtggcacgtgnagcagcgatagtcgcgggtatgcattagacgngagggtcgctgagtgagcatatcgcgangcgtntgggagatgctgcgatgagcaacctccacacgtantacctcatcgctgtgggtgctggtggtgcngngtgtctaggcaatcaatattggagggtattgtactaagatgtaagtgggacgagcttgcgctcgcgtgtattgtagactcgttgatgtcagtgggcaccgatgtgagtaggagtttctataggcgttagtacggagttgggaagtgtattaccgatattacgtgtnccttatcgctgtgcgacatannacaggggcgtngtgcggcccttctgtaanatcttcgcactctctcttcacattgtttaatcaagtcgattatatcgtgtttgtcttcgcccgcatatatnnatttcgaaacgcaagagagagagnnacncgtagagnagacgacgttcgacgtganagaatagaggaagtcttgattgtatcctccttaacgggcggtgaggagggaagctgcgtgatgttgccgcgcggagcgccgcgggacgggaacgtaggactgcctccgacatcacacgntacggattgatgtggcacctctatctcgtgcgtacctctccgcgcgtttgctgttctctcttgtgngaactcgcatggtatctgttggtcgagtatctattatgtactttnnntnnncttcgttcgtcttttcttttctcttctctcttnntatcctgttaataatatctattgnnttcttctatntcactttcctctttcctatcnnttatttatnnaacttagttatatcttctacctcctttnttcctacgtgactattttgactcgnaggctgcgnncctgtcatgtctcgaagcctagaaattaatttatttaacaggacataaacatgacttcctattanncttttctcttttcttnnttcttccctttccttttatctttattnnnctttcattttntnctttnatatttttnnttttttttttnnnnnnnnncttncatnncttnnnnnnnnnnnnnnnnccttctcnnnnnctcacactncttnnnncttcttnnnnnnnttttccc

SEQ ID NO: 10974 - DNA, 812 bp, Homo sapiens
  misc_feature (1)...(812): n = A,T,C or G
aagcggtgcattcacaccttaagaatatgcctaangttttggtntgcgggagacatanaactnactgaatcaagaaaaagtctcatcaagcagaagaaatagcaactaatgtgttatttatgtgatacagtgttttttgcattttgtgttttttatttttcatttttatgaaaaaacagtgtggaatgccaaagatggagagggtgggcacatgctccatttaatctctaattgataaaagtcagactgttaaaaaaaaaaagtgctgtttttagtaggaaaatccagagcttctacacacattagctgaaataagtattcggtctctacaaataccttgtaatggatccaagaaggagaaaaaatttctttttatctggcattttcactaatgctttgagcctagatatatagagtacatgtgctccttcatgttattctaggccttacttttctctgggtgcttgggtataaataccaagtgcttacactggaagaataagaaaaaaaaatgggctggttggtccttaacgggagacgtctgtggccgcttgccctttaggagggtgaatccataatcctggctaactaacctcctcagcttcgccgtggcgggtgagggagcggggtgatgtacctgaaggcgggtatcagggtatcacgagagtacggggaaacctaggagtaactcgggtccaaaggccagagaaaggcgtgaaccgaaagaggcgccggggctgatgttttacgtagggccgcccccctgaaacagtcagaggcgcccgcttagtcaacggcggaaacccacaagg

SEQ ID NO: 10975 - DNA, 251 bp, Homo sapiens
aaatattatcacacatacacacaacaataagatttcaggaacaacctggaccattagaacaaagacatatccccaggaagaaaaagataaagcatgtgaataatttttaataagtaaatcccttattccaagcaaacctttcattgcattacattagaggttcgaataagaaactgcttgaaaatggcttacacaaatacctcatcaataagcacgcaataaaatgtaactattaatccttacaccccccc

SEQ ID NO: 10976 - DNA, 1541 bp, Homo sapiens
  misc_feature (1)...(1541): n = A,T,C or G
acgactacggcggtatcgctgtgtgcctacacaaggacgatacctctgtcagatagcactgtncacctcatatctattcgncatctatcggtgntcgcgtcgtgcgtngacgcgttgtcagacgatctctcgctgtgangngcattatgtgcagtaaggtgataggaggagaatgctaagacgtgaacgtctgtcggaagacgctcagnaggacgaatcactgaancacgactacgatcngtactcctgagtggcgagaacgagcgggagagaactgacaccgattcggagcgcatcatcggtgtaactcacgtaacgntgactcgcgctgtgacatgtcttgtgatgcgatattacggtcgtgtcgacngagcgcattcatagagnaggaagaggagatgtagagtgtatagaggatagtatatggacattatgtatatgtgtctgtatcgataatggacaaggtgtgcgacttgtacgtgttgtgtgcngagtgcggtgatatcaggtnagancgactctcttcttctctgcggagtacgtngtgtgtcgatntgaggtggtgtgggaggattgtgtgtgtggctgtggtcgcgtcagttgcagcggtcggggcgtggtgcgtgtggcgatgtcgagtgacgggnnggagtgcagaagggctgtagtgtgtggcgtctagcgtcagcttgtgagagtnntatgagcgancactctgcgatagtgtngacgtgatgcagtacgtgtatgtcgcgtataagantatgacatgagggtntgngtgctggtgttgtgtgcgttgctgtgtatgnngtgtggtgtgttctgtgcgtcggtcttgagtgcnctgcgcggcagtggcgctgctgctttctggtcgtgcgttctggcaggtgcgcgcttggtgcctcctactgtgtggngcctgcggcgttcgggnnctcggtcatcggcgctgtcgcgtggacatcgcttgtgncctactgatgngctcgttcattgtgttgcgtgccggtgctcgnatgtcacgggacgatacgattcactcaangtcattgtgactgcttagtatcattgagatcgttgcggcgtgtctgtgncctattttacattcggtttatctgtgtgtctcattctgggggcgcatcaacgggcctgatgtgatggngccagtctatgngcgttaattttaactacagagatgtggatcaggtnggggttgctggtgggggtgccgactgngacacagggagaaaagatactaaagagtggatggctaataactatacagacaaggagtgagggagatacgtgaaaagagatacagtgacgtcaccgctggccaataccacgcgaggcggagantacggtgtgcctgggtcggtagacgtgcctcgacgcgagagtgcngacagacgggcgtncactgttagagtagtanagtagganaagggtatgaactgcttcantatatacgataaaatgttaaatatctcattattaaaaatatcgagaactatttcgacgtcgtactcgaccct

SEQ ID NO: 10977 - DNA, 2080 bp, Homo sapiens
  misc_feature (1)...(2080): n = A,T,C or G
aggatggagtagatagtcactctgtgtgcgatggcgncgtcgctctctatgnntgtgctaatctactatatatagcgcttctgtttgntgnaggangnagggtgtgggacgctgtatccttatgctatcanacttattctcttagacctcgtcgcttcgcagtggtactctcacgtgtagtgngnnanacattagtgacangntgaggagtgtcgaacatgagctgtacgtacgtcgatagntatntcccaccgtctctnntacgtagangctagtcgacggctgctgtgtgtganngngcgagcagaacgcngtgtnttcgttcttgtatcactctgtgatatcgagtatgtcacgatatacatcttctcgcttcggtatnnggacacactatgtagantgtagtngtgtactntcgacnatgcatgagtcatctgacagatcttcatgntgangcgcagngaaagtatgctacactcntgtncgtgtcntactcgacgtagtgtngtagtagganatgagatancgtcgatgtgangatgncgtcntcgcatcgctacggtagagacgcacgtgtcangcgcgaacgatgactcgatctcatatgtngatagtcgcgtcatgctatctgcatatcaactgancctcgatgnangacgtactactgtgatgcatgcacgcactgangcagtctctcgtagtgatggcngctgacgccgctatagtgtgnatacgtactgacagattactgtgtgtcatgctgcantacgagctaggactgactttcgctagggcagtctgtcagtggctgatgntngcatatgtgctgctctcgcgagtgtctgcntcntngttnctatnntancattagatcactcatattntngttactacgatggangatgaatcagtgtacagntgatgactcgtataattagatgagcttgagntactctgatcggtcgcagtactcatgtatgtcgtgtgactgtgtcgctcgtcattcatcnganngatctcgtgntccatcanacggtngnntgctgtgttntcgcgatgagacntcgcatntnactaatagtnctagtaaaactnggangtngtngcgtatgcagtacgcntcgatttcagantgaggantcgttgctcgctatgtcgcgagcgnacgactctcatcgtcgctgantactcgtgtctctncncactattgtcngtgatngctntgctgcgttgctgactctttcatccgggncggngangtntgctggctgtcatctgtgtacgtgcgcatcctcctctacgatganacagtganacgacgtcntgtanntctcatacgttgtcgcgctctcacagtngcntcagttactcanactatcantaagtatcnccncctatatgtnnnangacgtgccgctgtctacngcgcactattcgcactcgncgagcgctactcgntgagantcagtactatgtctgattgagcactgtcgtgtnatgcattgcatcgacngcatnacatcgctacntcagatcatcacatcattgtngactancgcactacactctnctgacattgtagacgatccggtntaacgagcacggcagcgatcgaatncgccagntttcactccantggagnacngnactcgtcgcaagcacactcacntcgagcacgcattgacatactcaagtgnagagtatgtgatcnatagtngactgtcatatngcgtagatcatcgcacgcgacctgtcgcatgaagtcgcagcactgagatganacatgttgagagtnattacaggtgcaggnatactagctacactcgatacatcgtactgtgcgactatanngtatnccaaatctatantacacgtatnagctgtctgtcagcntgntcgatctcggttncacatatcagatntacacgtngtatgccgatgtaatgtgattgtccctggtgatnangcgagcaccattctnatgatctgtagagcagtcatatattctcactaccgtactgtgcaatgncactgtacgtgtgcactacagtcgtagatagatactactgtgctgttttgc

SEQ ID NO: 10978 - DNA, 1017 bp, Homo sapiens
  misc_feature (1)...(1017): n = A,T,C or G
atctcgtcatacgtcaccgtgtggggagcgcgtgcggtcgtgggtccatgacattaaccgggcgatcgagacaacctcgggtctatagtactctgatgctgacgaaggaacacagagtagagggagctagagagaaagtggtgcgtaagggagctcgtagtggggaccgtagtgcccgtnctctctgcgctcggagtaagcagcagtgcgtaacgaaggncgcgagacggggcacgctgcccgagagtgataaccgatgtagtgagtagggctcagcgacgggagactccagttaatgcctttcctccgggaactgcataaaaataactatgtctataagacatctccgcgggagcggagaggacagtatcgtgagtgctataagagcgacgactagaatcgcgaccgggtgactggcgggctcttcgtctggcccgtcgcgttctcttctggtgctactatattgttggcattggctggtgaacngcgactcctggtgtagtgtggcgtgagtgcgacgggcggagggacgacaanaaaggaaaagaatccacacgcgggggaaggagagggtggggggtcggggcgtggagcgaacgtgggggggctacgtccattgcagcacggcgcgccccatgaccgaacacatcggccaggtccgtatagtgnggngctgcgtcccgccgtgcgaccccagcatccnnncctctccgtataacacactccgaccactgancactcaantaaccataaacactccaaacctaacaatanaacactcatataccataatgcgctcggaccataaatcgactgaacgttagatgtacttgctgcctcgattgccccccttacttgccctactctatacttactcctaacttccaccaccatcccctttaataaaaaactaactatnnaaatcctttannncacatacccnnnnnnnnaatncaancctnnnnnnnnnntnncaaatctcactcacaactncacncnccccaaancntcacctaa

SEQ ID NO: 10979 - DNA, 959 bp, Homo sapiens
  misc_feature (1)...(959): n = A,T,C or G
cttctcgcatacgtgtctctgtctcgaccgacngagcaccgcttgtaagtgagcgtgttgcacgttccatatgtgtagaaggagtgagtgtcataatnagtcacttaagtgatactagtatangacttatctacaatctgttgaattcacatgancacacactnctctagatgcgngncggatgaatgagtgatgtatagatgactatgcgtcgctgannggcgcttgacgantnntccttctatngctaactatgactctaatattctacgagcgtctctcttgtgngagatctactaataccttctgtgtggtcgtggaatctgacgtctgacggcgtaacgctgtgtttgggcgcgccgagncgcgtactggtgatagactctatcattctgtacaactangggatctatactatcctttgtttctcatgggcgtgcgtaggtattactgtgtgtttggcttcacgccgngctttggctggaatcgcacgtggattcgcatattttctatcggnattctacatgtaatcgcaatgtggaattgccggaggcatggaagcggcgctggaatgtcctgttgtaactatttggtgggagttttggttgttaaatagtggtgatgtaagtcttaactcgatattatagttatttttctctccctcgcctcactgccattgtcttttccttaactaacctttcaaattttctcccacccaataacttctacttttcaaaattccattttttattaatttaaataactcaccaagataaataaatgctanacatattttttctttctattctacaatacaatcattttnnttttccttttccttctttcctttttctccactctncctttcttctntcttctatctnntaccctctnnnnnnnncctccaacttnncnctnnnnnctttcttnccttcactccttctacttcnnnccttctc

SEQ ID NO: 10980 - DNA, 382 bp, Homo sapiens
ttagatggagtcttgctctgtttcccaggctggagtgcagtggcacaatcttggctcactgcaagctccgcctcccaggttgatgtcattctcctgcctcagcctcccaagtagcggggactacaagcacccgccaccacgcccggctaatttttatacttttagtagagacagggtttcactgcgttaaccagatggtctcgatctcctgaacttgtgattcgcccacctcagcctcccggagtgctgggattacaggcgtgagccactgcatccggcccagtaatcttttaaaccaccctcattgtctaattttgctagcaattcaatataaactttatgcttgaaaattaaattgattccattttgaaaaaaaaaaaaa

SEQ ID NO: 10981 - DNA, 1633 bp, Homo sapiens
  misc_feature (1)...(1633): n = A,T,C or G
ctgtcacagaaggagaacaagcanantcctgatgataggcgntctctgttataccacatacactagtcntcatcgagcgtacgaanggcgcatacaagatgatagcatttcgatagngagtgtngcgtgcgtagtatgagtggtcaatggctagctctgtagatgatctttactcgtaaatatatacgtcacaccgcggcacatcgtcgaagacacaacagagatgcnacaatagagacgacncactactcgcactacgtccaccgataacagtctctctgancgagagtcgcgtccggtcgtgctgactctgacgtcgcgtccaacatatgagagagatgtcagataggtatgcatgaatatganagtctactgatgagactgtagaagagtgcgcgactctcnttancgtctcatcgagtntcgcttacgtatatgttgacgtcacgccgtctcacgtgtgataagagtattantatgtattctatgtggaaatgtgacgtcctatcgagtggtatcgatgngtgatgtagtgcatgatgaccggagangaggagtggcctaatgtagaagcagagtatgnatgagtgagtcttntgtgtatatgttcgaaggcngtcactgctgcgatggatcgtgcgagtcatgtcagcgaccatgantcaacgtccagctgtgcatggggacggngngcgcgnggctgacatcgctcgtcgtgtagcaggagaagacagtcgcgtgngagcagcgctcggtagatgcgcgagcgagtcagagtagtgcgaagcaccgtcacactngacgctctaatagtngacatatctacgtcgaggctcctatatcgcgcatcggctcgcagntggtattgtgacatgngctaacactattatgtgctcttcgangagatgcgtgctgagcgcaggcaggttgagaagcgaccgacgagtggatgncatactatagagcgatgactacgggtctcagtgaagancgcgagagtaagacgagcaagtacacactggagcgacagatgacatctagtcaacgagaggctgagcacagaggcaagcgagangcaaccgtgccctgctcaccgagcctcgccggggtcctatctggcactatctggttgtggtgtagatttataataccatgcttggactactcgcaggcacgtacttgttgatacattttgagtgtgcttatgtggagagatatttatggaatctttngaagagatgcatggtggatcttcgcgtggagacagtatgacgggggagctgtctgaagacgcagcagcggcgtcacacacagctcgcagttcgtaggcggcgcgtctgcgttcctngtatggtactaggtcgagagatcaaggcagaggtgacggatatgncgcacngctgcgtacgtgtagcactgatncgtctagagagtcnatagctatacgcattctgtcgtcatcgtacgcaatctctgctgtgtgtgcctagacatcgctacactgcacgagaganttagactcgtcggnngcgtgccgtggcgcagtagacacgtcgtgagcatcatatgcaattacttattangctacacgcaagctgacattctgtgtcacactctacatatgcgatctgca

SEQ ID NO: 10982 - DNA, 938 bp, Homo sapiens
ccacaaccataccaaccctccaccaaccaatccatcactcaaggctactcattctgaggcactatgcaagaataatacactgcgtttgaaaagagcccctatcatagcaacatgaattctacaaaaattgaagcaggaacaaacatcaactttatggtgatgagtgagtggaagaatggtgaaatcattgacgctctacaaaaagcttccagggacaatattccaaagacgtcagcagtttaaaaatggataactcattttaagaagggatagggtcatgttaaatataaagcccacagcagcaaacaatccgtatcaacctgcgaggaaaaaactaaccttgattttgacctaattgaaaagaactgaccacagcccagacaatagccaccaccatagactttctaattgattcaccttacccaattcctattgaaaacgtacacacgaccacactttccacctcatgaccgccaaaactgcgccccctcactcagctacacaaacacgcgagatatctctgggaactgcgaacaactgacatccacactatgaatacttttctccaagaattcacccggcgatgagacacggtcccaccacacaacccccaacaaaccgcatacctcacgcaacggctcccagcacggcggcactcatccaccccagaacgggccctgcccacacacccgattacaccaccattttgcgaatctcacggccttctcgtcgccacctcttggcacaccataccacaaccttctccccttatatcaccagtcctcacacctccccaccctcacctcacacacgcactacacctcctccccccttccactccctccccatatctgctccgcaccatggtgcccttcctaacacccactcacacaacactccacacaaaccgcccgccccacctaatcgtggcccacgcg

SEQ ID NO: 10983 - DNA, 1208 bp, Homo sapiens
  misc_feature (1)...(1208): n = A,T,C or G
cattatggagttatggggaaccgggaagagatatacgaaatgaggaggtcctgcggaggcatcactgggccccctccctggcatacacctactacacgcgaaatattatagtaaagtacaaggactcacggtgaccacgagagaaagtgataactcgcgcggtacacacaggccacccaatacctccagccaaacacatacccacacgaccaatccacatagaacaatacgtgcaatctcacaggctctagatacccaacactaatgactcggcgcgcagtcgtcgccggcgcgggggcccgaggcctgtgaatcgttgaagagttatgcgtgagattgttcatgaagatggagacactgtggggagggtacgctcttgatcccacgtcgtgtgttttgtgttcgcangaaccgcggcggcctcatgtgccgaacaatatatgaagaccttgtcctgtgtcgggacattcaactcaactatgagtggttaggggatgtacgcgggtctgtgtggtgtgttcgagatagagattagcacaagctatcgcagtctaagacaagacagcaatacacactccacctatacctctgcatactacactgaaaacctctagaacgcatccgagaaaccaggccctcattctgcacaaacagaaagctcctccatccctcctcagcgctcacatcgtacgacgacganacgatcagcactcctctgtctctcgtgagttatactcgcgcgaggacctatacatggacacatgtacatagcgaactaagagcgcgtcaataactacaagaagtctcgantataggttctccattcgaacatcacacccccactccagactctttgtgtangcgtttattggcatattgtagatacttactacagcatcactatattcttatctacataatgcacttgnatctatacagcagccgaatgactcgcgtaggatctcctgctcctaacatgaacgtgcatacttatgaataattcatatgtgacctcgtgtgacgtagactatgattgtgtttattacgatctcgtggtttgccgacctatccaactgctagaagcgacgtcgtgctccgtgtcggtattcgacgtgagacggatggagcatgaggncaatagaactcaatgacatactactctcacatcgacacatatgacacacttttatcccacctcattaaccact

SEQ ID NO: 10984 - DNA, 781 bp, Homo sapiens
atttacggttgtacaaaaaggtttccagggccaatattcccaagacggtcgcacgtttaaaaaaggagaactccttttaaaaaagggataggggtaaatgttaaaaaaaagccctccagcacgaaacaaatccgtatcaaccctgtaaggaaaaaattaaccttgattgttgccctaattgaaaaaaaatgaccacaggcccagacaaaagcccccccccataggcttcctaattgattcagcttaccccattcctattgaaaagttaaagatgagcaaactttccattcaatgagtgccaaactgggggcccgtagataagttcaaaaccaggagagatatctatgggaactgtgaacaacttagatagagactatgaagaattttttaaaaaaatgcaccaggagatgaaacagggctttaccagtacaaccctgaagacaatgcataatcaaagcaatggctaccaagaggtggaagtagtccagtcaaagaaggggactggtcaagagcaaagatgataacagcattttgggaatctgaaggcattttgcttgttgactttctggagggacaccccatgataacatctggttcttataagagtgttctgaaaaagttagctaaagctgtaacagaaaaaatgcccagagagtccttctccaccatcacaatgttcttgctcattcctctctgatcaaacatggcaatcgtgcagaagttttaatagccaattccaatttgaataaaaactaaaagttcctaaaaaaaaaaaaaaaaa

SEQ ID NO: 10985 - DNA, 874 bp, Homo sapiens
cttctgagagcaatctaacttgcccaaggtcatacagccattgagttgaagaaatggagttggagctcagtttggccaatgttaatgcccaagttctgttttccttccctgtcaactaacaattgagagggtattcactctgagcatgattatggagaatgaaagaccttacaatagattatgagtaaaaatatctggatttctcacaactatgacagaagagtaaaagtatattagaaataaactaagactaaatttgacatttattttcttgatataaaaatcctgaaataaaaagagtgtaagtttggtgtttgttttcgtaatctagggctattcctggaaacaacatgaggaggagtatttcaaaataatagtccgtctgaattattaataggaaggtgcattctctgcgaacctctatattactgccattggcaatctatccaaactacctttcctgtgtttttgccaacacaggaaagggtatatcctgacctattgcatattccacggcagcagggactccacaccctgtctccggacaactgtatgaattccacaacactactcaccaattaaaaaacaaaaaaaacggcctccctggcctcccccggggaactctcgcgcccttcctcttctagaagggaatacactgacccccctccctcactcctgccctccgcgtgccgccggcatacccgcctctctccccaaggcggtaaacggcatcccacactcgggattacccccgaaaaacatccaccacggcccgccaacgccgaaccctaaaggcctgctttggcttttcaactagctccccccctgcgacaacaaacactgcatcaggcccagggggaaaccccaggctaac

SEQ ID NO: 10986 - DNA, 1200 bp, Homo sapiens
  misc_feature (1)...(1200): n = A,T,C or G
ctcgtgctcatcgatatcgtgcgcgcacttctattctgctcgctggcctattcggaccgatggacgccgaactctgctgtccgctcggtgtagccgtatccctcgtcgactctgccgtcccaatttggtctcttgtgcgtttccggcctcgctcgcccgtccgcttgacctgcccctgcgtcacgtcgcggcagtgcctctgtgctccgcccactatccgcgccctgtgtctctactgtcctgggaccgtcgctctgcttgcgcttcgccatgcacgccctccggccgcgctcgctcgtcgcgcactctttgcgtacggggctctctgccccgtgctctcgtccgcgtcgcggtggccggccggccgctcgtccgtatctccgactacgcttgatgtgtgctctcgtgccggcggctgtgggggtgcgtgggtggcgtgtggcattaccgctcgcgttgatctgatgctcgtggcgccgtgcgccgctgcgtcgtgtggcgcgctcgtccgtcccggtcgcttcncgcggctgtgctctggttcgatacacgatagttccacgtgtccgtttcatgcactcctctgtcgagtcctnatctatatatacgtattgctaagggtcattggtcttcgctttcgccgcagttcgcatccgttgtgtgggcaggcgcggtgggggttctggtgcgctgttgctgcgtgtgtatgggccgtgtttggcgcccgcgtcacgttctatggatgcctacttctgccctcctgccccctctaacgctcggttgtcaaatataatacttttccctcncacccgctgcgtcccgcacctccacccctccctatccactccacctcgcgcacgtgctcgatacctctcgcgtatattctgatcactggcgaccctgaccctatcgcgtcatcgtcagtgcccctcccgcgcacggtcgctgcccgaccctcctccgtccgtgcggggctgcgtctgggaggngcccttccagctcttgctcacccctttctctcctaacgccgcggcgcgccgcagttgtgccgtccgcgaccgttaacacgcgggggttcgccccgcttctcaccctctctggtttttcttgttcttccttctcaaggttttttttttttttttttctccatantncctcctccttactncannnnnnnnnttttntttttttttttttccc

SEQ ID NO: 10987 - DNA, 970 bp, Homo sapiens
  misc_feature (1)...(970): n = A,T,C or G
tccccgaccgcgaataacgccgaccaacacatctcacaattttccagcaaaccgggacatgcctctttataaagttggccaggactgagctgtttattttcttcacttcccttatgcaaaaatggagcttgaggcccccaacaatgagaagctgagcctgacgcttagaatgggtatcaccatttccccagtcagtcaccgcctatgcacgtggacctaacggtgtaaccattgctaaaaaagaaaggggcaagggaagttagcaacacatcccaccgcgcccctgaagggggtgcacgcaccgctaaaatgaagtccagacaccaacgaacccgatcgttgatgaaagactcacaggaaactccactcagacccaaacgtatataccagtcacgagcgctagcctcacatcatcccaacttatattacgtatatatcccccccccggccaccccctcaacccccccccatcactcaaatccccccgacggataccgtccttcattcatcaacactcgatattctcaccaaccctctcccctcgcctcaccgcccactttgcccggcgactacccgcccacgcgatgatcgccgtcccctaccacactattccacccgatctccccgtccacacccgcgcgcccgccagacgatattaacatatagcgtggggagggtgcgaatacagaaccaccgactgaaaaaatgacagaatcagtacaccncaactctttccgcgcccaccccacactcacccatcatccctccccccactagctacacacaacacacgcccgccccccccacctgctacagatcaatcctctgtcaccgccccaccagtctacctccttaccttcacgcgcttggtcctgttcacctactaatctcccgctcgacattcctgacccgccccgcctacccccatattcaaaagattgacccaactctctcataacgcacatcagac

SEQ ID NO: 10988 - DNA, 2070 bp, Homo sapiens
  misc_feature (1)...(2070): n = A,T,C or G
actgatgtagtgcaggcatgatggcggtgctggtcgtgtgtgagtgtagcgcgagcgnagacgnactctcgcgtcgtgcnccgacttacgcgcncactttgtctccgctctcctcaggcgcacacaacatcgcgcgtgcgactctctcagcgttctactgctatatgtctcgtgngctatgacgtatgtttactatgatcgatactttatctactgngtcagcactcgtgcaccatcgctccgtcgtagagtcgagcgcangtcntncttgagtctgtgttctcgngcagagcagtcgatagatatctctctcatgtcactagcccgcctgnagagcatgtgctatatcagatcgcacgtttacatcatacataatnantagcanaggcacactcgctacgtgtcntcncgatcatgtcatctcgtcacancgtacatcgcnacttnttcancagcacacgtccgacgtagantagtacctacgactagtgtgctgngtnccgatcgatcggcgttctgcgagcgttntacgacctctgcttgcggangcaacgcgcntactcatgtctgcacgtctccactgtntgcantntgatatatcggtggcgtctgtgtatgtggtgtatgtatgngnatgagttgnnagtgaatgagtcagagtgnnngtcgatgatattaggtagntggtgtagtantgtngtgtacggtagngnactagagcatacgtgtgatcgtcgagcgtctgngtatgctgcgtttacntgtcgtccggtacgacgggctcgtntagagtcgcgtcngctcgacngcagcagaggagagtgcacngnccattcacgcagacgngatgangcacgtgacgtcgngacgccgatgtaggtgtgacatantctctactgtgcggtgtgagcgngagatacatgctctcatactacactctgtcacgcgcgtcgtcntttagtgtagcgagtactgctangctcggtntcntnggatctatcgtgtctgtctcactagtantanatctagtatagatatagtatcttactattgtatcatggctctctcacagactcgagttcctatatctatactgttctctagttatatgntnggcgctcgtcatgtgactcgntngtcgtgctcagatgtgatcntgttctgatgcgcgaganntcagagcgtatgtgagtncactcttacatcatcgtgtgttctcagtactcagctgcatcgtacggtcgtagtantgcactcgttacacntccgacagcangactcatcgcgtacgctgagatgactagtacnantactgcatgtgtcncaggctatgagtcaagctancatcagtagcgantactgacccanggaganaacacncctctgtagcagtacangngacgtcnatcagctgatcactgntgagagcgatctgatgcagcagttgagtagtatgtagctactcatgtgatcacgntntatgatgtatattgtnatagattganganacagatcgactctgatgaancttctgtatagttancagcgtatatcatgatgagtgtatctatcacacgtgacgactatcgcactagaggatgactgtagngacagatatcaatcacnaccangcactcgactgtcacacgtacacgtcanactatctacgtcgtctacntctatatattgtgctgtgcggantaatatnatgtggagtatcgntcgtggtgagcgncatatnattatgcaatagggctgtngagtgatagtnatgtaagtagtacagtgtatacatangtgttangctgtatgcgcngctgtcgactgtangtgctcgatncacacgncgctccgatgtgatatgcatgacatacgcgctagtagtactctacgcgcgctcagatcgatcctcatcagatcngagagagcaatacgtgtagcacgtgtatgcgatgtagtggcagacgtcagcacgaagcacgatagagccactgtataactatatacatcattcatatttatcacttgcatctcgtatcagtcgtgtctcgtcgagtccgtctaatctag

SEQ ID NO: 10989 - DNA, 1923 bp, Homo sapiens
  misc_feature (1)...(1923): n = A,T,C or G
cactatcgtctgacacaggctcaccacaatacacactaaacagancgcatctaatagatgtgagacactagactacgattgacanacagatgtagagtatgcgcgcgntgtngattcgtgnggccgncttggtgcgaccagcgngcgcactcacacacctacattgagtcggctgtcaggtatgagtagtgtattctactcatatagngnaacgagtagtaacgcgcatgtccacgcgcaagagnacattacagagcgcgaaagagcatagagancgtagtacatcactcacgtgaangagtacagancnagtctgcgagcgctgagagagtgcgacagacacgctgcgagagcagctgcanantcagtaggacagcacggtgatgacgntgcgcgagcgcgcgctgggtgtcacagtagttcagnggtcagtngatnantaagatagagagatgcattcgacgacgacngngcagtgtgcgtcgcggaagatacgctctcacgcgtgagtgctgcgnttctgcngcgtcgagcggtngctgcctcgtgcgtngngggagctgtcnctccgcnacatganagcgtatacatacgtagtcagtagagagatccgactatnaacatctcgatcactgntcantgaccgagatgtactactatactatcgantatgtcagtgcantngagatagtnaatactatcatctcactctctgcancgntgactcatagcgtcacatggcatgctgtgtcacatgtgntggngtatctcacgaatagatacgntacacatcaacnacacacgatntcagatcaacgatcgagctcacgtcacgctntgtcgtatgatggatattcantacactatattctacgacctctacagcatgntggtctctggctgtggtaatgtctattcttcggagcatgagcatcatcgagcagtatnacaatccgctgcgcttagtgcgacgagtncnttnatgcgangngtcntagcagcacatcagctgtgtacgtcagcactctcgcactaatgtaactcatcgacggatcgcgcgcgngatgngcgtctctacagcnagcagtcacgatacacgctgcatccacgagncatcgagtgatcgnatcacgnctgcatgcagatgtgacgacgacanacgattgacgatacgcaccggacacacgaacggtatagagagagacagacgatcataggtgnngaggatgantgatgtgatatggtttcctgagatatctagtatatagctatctctcaaccgtgtatcgtgactcanacgcgcgcacgtctatgtatgtntaatactagaccgtcagngagacggagtgcaagagcggtggttggatgggcggtgagcgcatagggacngcgcggcggtgtgngtgaggatgtgcgcatgtcgagaggtngacgtgagtgactgatcgtggaaggtatgctagacgtgcntcatcacctatcagcgcgcagtgtnnggacgtggagcgcaagagcgagagtaggcacagagcacagcccgtatgnagcatagtgctctcttaanacgtaccatagatgtctaagtagtagtagcacgtcgtagtgctttgttctgttgtggtatcgtctctgcggtggtcaccagtgaatgatatagntcggtgtatatgtgtgctcgtctcgtgagtgagagtgattgngcactgacgtatanactnataatatcggaagtatactatggcacgttgcgtgtgagctagagtacctttantcgagacttgacgatgtctgaatgcggagtattctggtggcgagcgcagtacaggttgtctctcgatgcgtgatnttgaagctcgcatatagcagtgngagncggacggatactagaganaaggagtnggatcagagtgngcagctgtagtg

SEQ ID NO: 10990 - DNA, 1189 bp, Homo sapiens
  misc_feature (1)...(1189): n = A,T,C or G
ggcgcgtggtgtgatcgttgcgcacggggggtagcgcgaacacggaacctcccagatanggtaggtgtcctgtggcactatctggtnttctagcagaactacgagcgtcctctaagtatgaactgaatatatggattggcgacggtccgtggagggtgtgcatggacgacgacggattgtagatgacgtgggtaggtgtggatgtagggaagctagaagagcagtgttgagacgggacgcgaganacgtcggggggngggagcagctggaccgggagaacagaaccgagggggggagagattactctactccctcggtgattcgcctctgtgtcgattgcacttcatantagtgggttcaggaagacggagtgtgggggggtggggcgtacggtggccgggggggaagatgcggcgggacgcagaagagagaggngacgagcgggtactngagcggaggcgcaccgctctggcgtggngcggttcttttggtggtctcttcgtcgacatgcantagctgtttagcgaggagcagatggtcgggagggcggagcaggaggcgcgtgacagggacacgcgcgggcgggcgggcanaacgtcggccacgcgacagtgaagcgagggcaggcgagggtgccgtctcttccagcctggagttctgtttaatgntcgcatactgatncgtgtctttgctttgccgntcctttggnangaagaaaaaacactgcacgatgatcacgaaaaaaaanaaccaacaacacaataacactctacaaacgtcgttaaatttctttctncccttctctcctccctcgtcatctattcttcttctnnnccttcctcctcaatctctcctctcctgcctgtgngttcgtcgttgttcggtgcgttgntgggttaaatacgtanacaacgaacatttagtcaatgagtatgttanccccagacccttttatcactttctcctcncnatatctctcttccttcctctncctctctnacccatanccctacanctcccacccttnntcactccncttcttctantcccttnaccacacctctnttnatccttccactncatnnnnccnnnccttccctaaaaccttnnnnnnnnnnnnnntnnnnncccatccttnnnnncccattcccttnncctnnnntcccttcccnnnnnnnccccccccccc

SEQ ID NO: 10991 - DNA, 167 bp, Homo sapiens
cttcagttgtctgccagttgccggttgtcggacctgcgaatagaagctcaactgagagtactctccaatcttccacactggctgggtgcctgaagctgataatggatgatgataggaactcagataaagctcccaataaatcttcattatcctcaaaaaaaaaaaaa

SEQ ID NO: 10992 - DNA, 154 bp, Homo sapiens
attcttcgtcctcccaactacatgctcagtaccttctaggagacaaacctacattgtttcctgaaggatgtcttcacttcctcctgctccttcgccttgtatccttcatagatttttctcgcagtaaaactttgcatatctaaaaaaaaaaaaa

SEQ ID NO: 10993 - DNA, 238 bp, Homo sapiens
ataagtattaatttaaaatccaaataaggagacgttcaggaaagccatgtgctcaccttttacaagatcaaccagcaaactgtcatgcagaaaagcagaatctactgatcacttcacacattacaatgaaaataacccacctcaccccaccccattcccctgtgacctcagtttgataaccgtctcccaactctcttctgtgaataaagcttctggtgtctatcgaaaaaaaaaaaaa

SEQ ID NO: 10994 - DNA, 1151 bp, Homo sapiens
  misc_feature (1)...(1151): n = A,T,C or G
acaatatcgacatcactcgcaccgctgacggcgccgcggcattcctctgtaaacatgcatgcccgtactctcacaaacactaccgtcgtcggactctgtgttattcaggacgcgaaatgtatgtagtgtacaatgatacgtacgccgctgcgcctccgcactgcggctgctctctagtcctcgtnggcgtactagtacttacggtacgcgagacacgacgagggagtcgcgcctgagtctttgcaccgcgactccacgattctatacatgcctcttcaaatatcgcagtcaccgtatggtctggtatgtacactatatcatgtgaagaatgtgtatgtcggctntctgtatacccgttcattgaattgtcatctagtatctcgtgtacactaccatcctcccgcacaccaaaccctccacacctgttaccagactacacatcctcatgtcgtcgcgcgttctatgtcgttgtccgaggagtaggaataatgcacagaggaggtcaggggcgagtacttcgcgctctctctgccgcgtgccgacccttggtctgggttctcgtagcataggaagagtaggagtatgacggattatacttacgccattctctacaccactatatcagtggtcgcgttatcctgcatgcgcccctctgcgtcagagcgtacgcgaagcactgtcgtatcgggagaagatccttaccagtaaggagatcaaggattagtcatctcagaatcaacagcgccgcacgcgtccactgtcatgcaaacacataagaaagttccatgagtgctctgaaaaccgaactcgtagtcgactatgcatacatcgtcgtcataatatcatttcctcgccttctgggtagctacgagagtctgaaatcctgacatagccatatatgacgcgctcatcataccctgtgcttcatcttcattgtccttacaatcgtgtaagaatgagcacgcgacgcttgtctattgatgtttcgttctgttgataggggtgttaggcagagcggactgtatggttggtatccacgaccccacacgctaccgctctgacactcgtcccgctcaactcggttgcccccacggatctatgctactaactcatttcttcctcttactagtccttttaccagtgtttataat

SEQ ID NO: 10995 - DNA, 1139 bp, Homo sapiens
  misc_feature (1)...(1139): n = A,T,C or G
ctacatctcctactacaatgctcaananaatttacacatcattctatctatatgtcgagcgtacatacatatgatgaggtgcagtgcagctgtgcggcgtgtgttcgtcacgagccaccacacgaaggtgtcaatcttgatcgactccacactntgcactangtagacaagcacacatcgctcaccgctcagtcaaaccggctaccacaacacaggtacagacaacgagcaccctagggtgacaagncatgcgtcggatcgacaccggttattaacagacgaccactcacacacgatcgtcgaggaccacaaagcgggcggaacagtccacaccggacatnaaaataaaggagtcgacacataaagaccgcgcagagggccgcctaccccccccatccatctccgtcctgctactctccgtccgcgtgctacacacctggggctactaatctgcttcgtataaatctctcgtcgtagcttctggcggccgcggcggagacaccgctgagagcgggcgggctactccacgtatcagcacggagacggatcgacgaacacgacgaggccgtcgagtcgtagcaggtctcaccacgcatgaagcaccggcgcccgagtgtcgaaatcgcgcgtcacgcgccggggcgcgggagcacgaagctgctcgcccggccagaatgcacttcgcggtcccggctcgtgtattgatcgaatccgggacaggtgaaaatgatttcattggttggctgacagtttttctcctgtaatcggtgtcgctgttattttttctttctcccaccccgtgttatctgaagatggtctgcgtacgcgttgtgccggtgtgtcgaggagtaccgagtgggccgcaccgacccccactcctcctcccaacaacggtggaggtagggtggtcgtaattgtcgctctctacaaaacgagtcaatataatataaaccagaaacactttattataaacaaaagcactcacaccacaaaagtgctaagagcttggagagaagtaggtaaaataggaaatatataaaaatatggtcctcgtttggccaaaagctggtggagttgttttccgcaccgaggtctgttctccttggatccaatacatcccttagactcgcttatgcgcc

SEQ ID NO: 10996 - DNA, 1064 bp, Homo sapiens
  misc_feature (1)...(1064): n = A,T,C or G
ctgacctggcttactgccgtgcgcgacnggcatacttcgcctcatctccggtccctgcaggggcgccggcgaaggcactatagcaaccataggaacagcgaaaccttcaagaggggaacaggaagtgtggggaaccccgcatcctcgcaccacgaagacagaaaaggtcgcgatgaagcatggggctcggcagcttcggctgctcgggagtgccactcgattccaactcgagtagtctgtgtgggcgtgccccctgcgccccaggactctcctacaacggcgataccgtaatagtttagatacatcgacccatctctctcaaccacattattttaacccctataggtcaccttcgcgtgcggggctccatgtgcggtgtatttaatcaaataatgaggggagtaactgcgcgagnagcagagccattaacgctcccccctccccccctccgtaangccttattgtcgttgtcgtatttctccgccgtgggccgtgcgtcgcagtaagctcggagcgctgctagccagggcgatgtgggccatgcgaggnaaacacaacaaggaacagactactccccgctcgctcggcgtacgcggaagcaccgtcgagtattacattggcgtttcaaatgtcccacccgnacacctccgagnnacaacactctcttgacgcaccacccanggangacctacaaacgcggggggatcctcaaaatatanannaccccacccacacactacacagacanaccctgtaactcttataattattctcatactctacattaatccctcnatcactcataaaaattcatctcttacacgacactccctcttcgccccgagaatggcccatgacctagatggtcatttgtgagatggaaacttncccacatcttttgnccnctctcccctcccctctcnctnttccctncccgctntcctcctctcccctccccccnnctctccccccnnnnntccccttcnnnnnnnnnctttctnncttnnnntnnnnnnnnnccccccctnnncctccctttctcttntcccctcncccccctctcc

SEQ ID NO: 10997 - DNA, 1078 bp, Homo sapiens
  misc_feature (1)...(1078): n = A,T,C or G
actcatctatgctctcttctcaaacccaaacactttcagtaccttggtctctaactttagctcgagggccttctggcaaggactaagtgaccacccttcaagacttcagtctgtcaatcaaatcttaggaaaacttgtccttaagacagaggagaacttacaaaggaaataaaagaaaacttgaccagataaaagacgaaaggggaaaagtggagcttgaaggacattattgactcagtatacagatcagtaaaaagaactgaaatcgcacactataacatacatcccacactccgcacagtcatccttaatcatccccacccacccaacacccctatccaaccccccctccaccccaacaccttcaccacctcccccccccccctaaccatccccgactttcctccccccacccgtccccctcttccccgctccctcctctctttcctccacgcgttcactcgttacaccgctcccgctcccacccatcttccccaccctctaccctcctccaccccacccactaatcagatcctacccccttagccaccacctccctaacaccacctctccaccacaccccctaccctactcccacccacctcccctctcccacctacaccccgctccaccaccccaacccaccctcccaaccaccgcccccaccctcaccgcacctctccactattagtcctaccctcctcccctgtctcttcttcacatcaccctcaccccacaccgacactcatatttaacattgtacgatcacacataatatcatatcgtcgtactaatcgtctactatatttatcaatcagcatataccaccacccacgaacgcccactctcaccntactctagtacaccacgccctcgctcccacactctttctaacattacaatcagctctccacctcctctcttctgtctgtcttcttctccgtccactacactagtacctcgctccctaccacttccaatctaccctcgcactactcanactacacatctcctccatacataatactcctcctactnacgaccacgacactccactctcactcccccccttcacccg

SEQ ID NO: 10998 - DNA, 1830 bp, Homo sapiens
  misc_feature (1)...(1830): n = A,T,C or G
cgtcgactagagactgatgnccaacgtcgcacgagcgtagtggtagtgtgctcgnaggtgtatggagttagtctatcagagtgtgtatgtaatgtaggagacacttgtacatcgctctgcttctcgtctttgtgatgtgactnactggatgatagtgtgtgtgtantgatggatgtatcgacgtcgtcgcgnggagtcggtgagcatgtgactgtgacacgcattggagagcacatgtaggtcaacgaccatactcaccgcacactcatagatatcgatgagtagantanacgtangtgtagagcgacagtcgncagctagagtgagtagttcaatacagtgtgaanacacgacgactgatagcgactcatagctactgtccatcactctgcacngcgtagcgcagagatgaatacgtggtagtgcaatgtgtgttgcgtcgtgttcgtgtgagagtagtgaatgngcgngcgtgacgacgacgncacgcatatcntatgtatatatctatgtctctctttactatcgtctcgcatacaatacangagtncataacnagaggcagcgcgctgcagtatctgnttgcgagtnattaagatagtcatatatgatantctggacttcntagcgtatatactgagtgtgtcttacnggttgcgttgtagagngattatgtatatgagtgccattganttgcgcatgaatacagctacgctgantatgcagagatacancngtggtgcatcatagatctntntgctctatctctcgacatcacactcacagcggacctacgtncgtncgctgtgtgcgntgtcgctgtgtctacagtgcgctgntatngagctgataacatacnagcgtcgtcactgagaccatgagtagngnaacangactgagntagacgngatagcgancgaaatagantgtngcattctatacataatcgcgactcatccgctatccatacatagtcttggctcgtgtacactatgattactcactgctattatagagtgtngtgacagtgacaggcagangtgatggagctgtagatatctacgagtcattcgtagatagtattatatcaatctcgctanctcgccagcgagtgtttactgatntgttgcactcacactagcagatcctnacncncactatacacgtngacacancgacgtcatagnttgcagagactanacgctgtactattatcagtgaatagtcatatctgcattactgtaagagtcctcaaccacgagatagtatgatgagtgatcatagacgtgagcagcgcacgctgaggcatctantctcgatctcagtccgatcatatagagtacgctgtcctacggtcgcagcaaagcgnatgtctatatattagatgtgcacatcagtcataacggtctcgcgacactcgagcgattanacacgctctctacntgcttatgtgtaggtctcgtggtggtgcgagtgagtatgggtcgcgctctgtttagagagagctgctgtgactacgtacgtataatgaattcgcatggagantgctggttggtgtgngtgggcgtgtgttatattttgggttactgtntgtggctgtgtagcacggtgcgtcagcaatcctgatcatggtgtatagtctccgtctactntacatcgccgctcacacaaagtatatttcttcggtggacttatcatatacgatatgtcacgtagcatacgagggcgcgcntgccgactcgatcagtggactcatatcaatctgaagctcctgatcgttacttatctagtcgtcagactcctgtgcggtgagtactgtatttatatcta

SEQ ID NO: 10999 - DNA, 894 bp, Homo sapiens
tgggtgtctcgtcctcttctccgtcctcgccggcggcgccggtttcgtagctgccggcgcgcaggatgtctcggcgtggccctgttctcctgtcgtgctcgcgtctactcgcttcttggttgacgacgtgcgcgtagaccacgttccggcactctctatcctttcgtcgagcggctcttcgacaggcgcgcccgccgcttgtcccgcgtcgatccctctggcatggtttcgattgggcgcgttctcctgtgcttctgcgtgcgagatccccccggcctgttttcgtgccccggccgccccgttgtgggcgggtgtccccgcggtgggtcgtatcccccccccgatgtttgtgggcccgcgtgggggcccccctccgcgctttttgtttctggcccgcacttcttttcatttgttcccctcctgattgtcatcgcgctctttgttgtgtcctgaccttagtgtcttttttttgccgcggggtccgtggcacgccgcggcgggcgcccgcgtgatggccctgttggttggggcgccaccttgtttggtgggttcggcccccgcggggggcgccccttgccgaggggggagttttccccccccccaagactcccttccgctgccagagcaagagtgaaggtcgttctcttcggacgggggggggtctttaacgggggtatacattccttgtgttcccccctcctttataggagaaaactgtgcgccttgggcgccttttttttccccgggccccgctcccctcttcttctagtgcggcggccggttctctgtttctttcctcttctgggggccccgtaacttcgagccggaagaggagccttaaaaaaacgcgcgccccaaaacaaaaaaaaaaattctaccaaaaaaaaaaaaaaa

SEQ ID NO: 11000 - DNA, 411 bp, Homo sapiens
ctttcaggatacgaaactgatattttcatagaagttctttgacgaaaacggtgcattcacacttcaagaatatgcctaaggtcattacttcttctttttttattctttccatctgtgctcaaatgcttgatgaaaaaaaaaaaagtgctacactgaatttatcaagcccaagcagggcctgaaatggaaacttatttggtagtctgaagtacacagttgtctacataaacccaatggactgtcagttttgtggggagagactgggaacctgaaataagatgcaggatctaaagatctatatagaaatgtccacagcaacattatccataatagccaaaaattggaaacagtgctggtgttcataaatagaatgaataaacaaattttggtataatcataaaaaaaaaaaaa

SEQ ID NO: 11001 - DNA, 141 bp, Homo sapiens
tttccagggatcgactggaaaagccatggaatgtgctcatgatcctatcctggggcaaggaaggattagaccatggagtgatttgaagaggccatggaagaaaaaaaataaggttattttatgcttataaaaaaaaaaaaa

SEQ ID NO: 11002 - DNA, 1066 bp, Homo sapiens
  misc_feature (1)...(1066): n = A,T,C or G
atcgccctacaaaaaaaaaaaaaaactgtacactaacaagctattnggcgtaagagaggtctacacctgagaaaaccatcttggataactgcagcaaggaaaaggaaaagtgcaacacctaggagatttcagtaaacagtagaatcatgccaacctaatctgtgttaaaatgcttggaatgtgggagccgctgatgatgcctcttgtctgtgagtctgactgaatcctttcttttctcatagcagcaaagaaaagttttttttaccacgcgcaaatgacttgccacttaccttaaactcgctcaaagcacttttgaggattaaaactccgttaaaagcgtgaacaacccgagaaaacataggccttccttcatatggaaaggcatagcggtgaacttaataaaaaatacagaaaacatggcccccgacttgcactcaaccaagtaaatttttttagaccaattcccttgtaaacgggggtgcattgatgacactttatctaaatatgatgcattaggcttgagtcctaccgacaagaactacagtagtaaacggataatataacgcgcgtgtaaagcagttatgcacgcacactcagtgtcgttaatacagaaaagtgaactttgtatatttacggtctctataatacgcaataaccatgttaagttgcggttacgaccccatcttatcgttagggctacgattccgaccgaaacaggatagcactgacgagcatcccgcgagcgaaatagaagtaaaagacctactgagtgcatatcacatgtatggaagacataatacacctgtgacaaattatcctatttacaccctcatcgcacacaacatatattaatcgcgaagatgcgtgtatgacgcatgtcgcagctgtcaagaattatgtctcgctctattacacctagtcataaggcagtngatcacgataatagtattacaggcgtcgtgttctagaggtgtatgcgttganattccactattnaggtgcctatcacaccgcgtattttaggtgttatgttatttatcgctcacgcacttctacctgctatccg

SEQ ID NO: 11003 - DNA, 370 bp, Homo sapiens
  misc_feature (1)...(370): n = A,T,C or G
tgtgtggtactatcaaaaggacggtaagtgcgtgatatcagctgcaacatgaatgaaccttgaagacattaagtgaaagaagccagacacaaaagaccacatccttactgtatgataccatttatacaaaatatccatgaaagataaatccatagagatagaaagttgatccgtagttgccatggactgaggtatgcatggtgactgctaatgggtatgggatttcttttgttgtgttattgaaaatgttctgaaatttggtagccttgattgtgcagaacactgtgaatgtacaaaaagccactgaattgtaaaggttatgacatgtcattnttaccataataaaaaaatagaacgaaaaaaaaaaaaa

SEQ ID NO: 11004 - DNA, 816 bp, Homo sapiens
  misc_feature (1)...(816): n = A,T,C or G
ctaatagaaacaagatggatgggcccgaggtagtttaatgataggagagcacggcgggccctgactatttgatcacaaaactaaaaaggaactaataagggcacgagaagaatagactgggagtgaatgttaggagagccgcttgctggagccaggacgtagttttatgataacgactaaagcgattagatgatcagaaataaagtgggcgtaatgaaagggatgcgccgcaagaccatgaaaactatcgtctcgctaacttnatggacgtcgcaccggatggaggtgagcgaaaaggaaaaagangagggagcgagcaacaaatgactngncaacaagcgagaccacggcttctgataacataacctcgaaaacttggactcaccggaataggcccgatagtaataacgagtgtggggcgggtggcaggaacgcggaaggccaaaaaggggagatacgcggtagtagtagcgcgaggatgtgaactcgtaacatggaagcacccngatcccgtagtttttgatcctttttggaccaatatatgacaaatacactccttnnnactccatcccctttctctccgcctaaaatataaatcctccactacctaaaccccataacctccctctcccggtactgactgtcatctgacgtcatcaaaacatgccagtcaaaactcctgctacggtgactcttgtcctacccctgtggtanctcctagagcaaaaccaatcttcggtgtctactcgtttttcagcacntggtctcccacttnnnnnnnctncttctnncctccttcttnnacttattnatccc

SEQ ID NO: 11005 - DNA, 1020 bp, Homo sapiens
  misc_feature (1)...(1020): n = A,T,C or G
ttttnnnnnnnnnnnnnnnnnnnnnggtgggnngnnaaaatttttnnnnnnnnnnntnnaatnnnnnnnnnnntaaattattnnnnttngtnntnnttncntantaagggtggantaanttnttttgnaatgnngnntaagttnnttnnnatatgtgctttattatttatatatgtggtgttgttgtaaatattttgatttttaaaatatttatgattaatttttaataaattattatattatntataatgtttttatttagatatttatattgatagatattngaaatatttgttttgnttagaagaatattaattntgaggtttataaaaaaaataaataaataaatgatatatgatgtgatattgatgagttgggctagagaattacaagaatattttaataaagttatatttataattattatattttttattattaaatgaaaatgagataataaatatatatattatagtaaaagtgaatatgatgagatagatgatgataatattatgaaatttaagaagtaaataaagatatatttattttattattatatcatgtatataattatatacaattttaatataatagggattgttgataagagtatgagggaagatgaaagatagcaataaggtagaagaataaataagtagagtaaaaaagagtaaagaatagagagtaagtatgtaaaatgaataaataaataataatttagatatataataaatttttgtataattggaagtgtaaataatatttattgataagatagatatagatttaattgaatgttaatataatatgttaatgattaaattgtttaataatttattgtatatgagtattctattataattatattgagtatagtttatgtatatttataatatagttattagaaaaaatgaaagtaataagtaaaaagaaataagaatattattaaataaagtgggattaattaaagaattaagagtagagattaaaaaaagatgtatatatataaatgtagaaaat

SEQ ID NO: 11006 - DNA, 235 bp, Homo sapiens
acctaccagcattatcgactatcacactgtgactcctcatcgtgtccaccaccatcccttggttatgtaatttcagtcattgctgaaatgaaagcagaggacctcaagcacagtgaacaagttggctgtgcaggagcaggagcagagttgtctttttcagtattagacttgcaacttgaccctctactttgttcataggatcttagataatggcccgaagccaaaaaaaaaaaaa

SEQ ID NO: 11007 - DNA, 912 bp, Homo sapiens
  misc_feature (1)...(912): n = A,T,C or G
acacaacctccccccagacncaaacccttagggcacaaccgacgcccagtctggagatgcaacggtgcactctccgttaactgcaacctccgcctccctctggttcaagtgattcttgtgcctcgacctcccaagtagctaggattacaggcatgagccaccattaccagctttagatatcttttactgatatggatatcttatttgcctacacattttaaatatcttatgctcaataatgtatttcaaataaaatgtttttaatagagaaatatggaagctgttttatggcacctaaagtcacaaacatcacctttaataaagtgtgattatatgagaacaaacccaccactcccaccgtattcatccaccctccgctcatattctcccacttcctctcctccccccccccattcttaccgacctctcttcttcaattatggcggccacttcatgccactccttctgcccgcacataactcattcctcctaaacccacctcgaagtatgtttctgctccccctgtccaatacccccctacaacccccgccctgccccccgtgacaatcttcctcaccgacccctccattttactcaccgccccctggcccacctcgcgccccccccttcggcggctatcaacccgctgaccgcactccctttccgccgcctcttgacgttatcgagccgcgtaaacccgcactctctcccccacgtcccctgccttgatatctctccccccctctttttcccccccccccagcttacccctcctcgccacgcctttgctcttatttcccttcactaccataccaatcatacaataactccattgaaccctgcctcccactacgctccccctctctcaccaccgcctagttatcatttcccactcaccagccctcctccccg

SEQ ID NO: 11008 - DNA, 911 bp, Homo sapiens
ttactagtccgaataccgcggcccttaggtcacggacaactgggtttcgaagagcccacgagttcatgaacaaaagcaagggtcctccagtcaagatggccatcaaggcagctactctaatgactccctggaagaatgacaagaagagtttattgttgagtaaaggtcacccacgcaaaagtattactgtgcagggtgcttaggtagccatcacagaggatccaagggctacttcttttcttcccaggcgtttttctctgggtgctgaatgctgtcattttagtttatgtagccaccacccccatccactgccttaggttttttcctttgttggaaataaacaaaaccatttcttggtaatcaatgatatttgtttggtcttactccaaccttttgcattagatctctaaacattccttaatctgagttaatagaagcccgcatttataccaagggaccgaattagaattattggtagggcgctcccaaatacgcttgcacaagagttttagtgagaatatggtattgtgtgcacatattaccccagttccatatctgtaaaattggatgtctggaaacggaccattgtaaatacctaaaggactcatgtcgcattgtatgtggcggctggagtgcccatataattaaataaacaggctttctaatatttcctcttactatcatttacgatacggggaatgcgttaactgtacaacgggaaccctactttccaataggccaccccctccatatttagcaactatttgcttgtcttactcgcagttattttactcagttatcccacttcatcacaactagtgatattaactctccacgtgtattcggttatgaatacatttatagtgtcccagtacgggtattttactacttgcggttgtatcatcctaacc

SEQ ID NO: 11009 - DNA, 1662 bp, Homo sapiens
  misc_feature (1)...(1662): n = A,T,C or G
ataatgtgtcgacagtaatagaagtcgctcagtatcgtgtatctgtgcatagcgcagatggtcgagcgacagcagctcatatacatgcaaccaacatcaatgagaatataatgatcgaacntgcactaaccacgccactacggtggagtagcaacgagaacgcacaagccaganggagatagtgtgtgcgagcgtatatgcagaggcggtcgcgtgctggtgtcacggcccgctgtgctagcacagcccgaagacacagtcagtcctgtgtcgactagttatgnacgcgcgactagagcgcaacgtgggtgagatgagctgaggcacaggagagatgaatatgtgtggagtgataggactaatgagcgtcgcatcgacatagtccgtgtgatatagagtcgatgatacttagttgtatactgctctattaatacgtagagatagagagtcgatacgtgangtatgtgtaggtggtctcgcgaacatagcgacgcatgtatgtataagcgtgtgatataatcattatncctctgtattcantgangacgtnggcngcgtcgtgcgcagtggggatggatcgagangacgtcgatcttngagattgnaagtttggcttggtcgtctgcgagctcacggccgncgagctacatcgctgtgcgcagtgctgtgctctngtgtagcatgatgctcaagcagcgatcttacaccggtcgcgcagttcgtgtcgtnagacaagctatggaaagcacatgatatctatgagttgagatagatctgatgtanatctntagtacntagtactctcctcgcgncgatgacggtctgtgcactgagtcngcgcgacgaacgctcatgattacagtacgagagtatctcacggacgactgcgctctgatgcacgacncgcgcgcgcgacatcgctgcagcgtcgcgctatntncnctgcgatcgacnggcacagcgtgctgagagangnacgccacgctgctgtangtagcacgtcgcgntnacacnctgatatctgcagcgacgcnataccggtgatccggctgcatcacgagcactgcanangcatgcacgacagctgcatacgtacgcactagtagactgagatatgattgattagntgtcatcgatagtgtatgtacgcgagcgtagtcagnggagtgtcgtngtggcgatgtgtgtagtgngnnctcgtgtgttcgagatcgatgtgcacanggtagacgtagagtgactctatgtatnanagatctatgcgcagtacatcacgtctangatgcgagcacacatcgtcgganagtatatatgagttggatatgttagatgatagtcactacatcantnacatctttgcgatggcgggtagtagtatgtgtntgggtgatagagtgcatgatgtaggtgtngtaacaatatttgatgttgtgagtagtcgaactgtctgtctctactcggtctgcnttgtnctctctcnatatatcagtgctctatagttacatatcatagtatntaacgatcagnancgagtcagagatagaagacgacaagaggatggacaataagatatagaactatcgcagccagatagtgactcatcagcgatctcgagacgtgcgtagctgacactggagtggtagagaggataatagtagagag

SEQ ID NO: 11010 - DNA, 763 bp, Homo sapiens
ccgtgtgttccatccagacgggggggcccgcgggggagaccctcatccaagaaccgcagccccgcgctccttctatgcccccgcgagagttcgcgtaaggagcgtttaaatcgggggcggcccactcgataacataagagcgcgggacacaactccggcggccatcttcttttcccgcgcgcttcttcaaagcgcccggtatattccactcttccacccggctgtggtaatagggccccgttggccaatagggccaggaaggcccccccaaaaggtttctttcagaggccccctgcggacaaatcccacgggggggaataccccgagactctttttgggcccaaaagggccttccccccaagtttgtttaagtcacacccaccgtgtttccccgcgccttaaacgagcccgaaggttgattgttcccacggtccaagcgtgggggtcccgggggcaggacaagaaccatgggccgaggttatacgcctcccctataggggggccgggcccccccaagaagggatattaggcccccgggtcatcccccttggggaaagaaagaagaaacccccaccccccagaatgccaggagccggagagggccccctcttttcaggggtcagctacccccggccaaaaacctgtgtggggttttcccccaaacaaaggggcaattttccttgggaaaaaaaagtaaccatatgggacccttttgtttcccatgtcagaaacttgtggaaaataaaatggtgaaaagctttgt

SEQ ID NO: 11011 - DNA, 1001 bp, Homo sapiens
  misc_feature (1)...(1001): n = A,T,C or G
ctatgctgagatcaagatcgcacggagatcccgcgatgtgctgaccgcgtgtcgagtactaaccatatgcaagattcgatacgagagaagatcacagagaaccaggcaacccttcaacatcgtcgagtgggctagcgagcagcgtgaatcttatgcggatgtggtagtggagatccattaggtcgcagatattgntggccctcgcgttccatcagagtacaccgactgtcggccgggtgggtcgcgatatgcagtacgagtaacacttctctttcctggaccctacggncccttacccgtgtatatcctgtccgttcacaaatcatccanancgaatcataaacggtctctcctagtgcggcggtgcctgatctatcgaacgacgatgggtagtgctacggaggacgcgtancacgatcaagtggatnnatcactgaacatagggataggtgcgaattaacttcatatacttggantgnctctgctcgtggcgttcgcgctgcgcactgcgtctttgtgtgcacgctgacgctaaccgtntgcactggcgccgcagggcgaactgtcttggngcgcacgtagtgggctctggaggaggangcaatcggacaaaggagngagggagggaagaacgtgtatacctacagggctcctagtanngcnatantncgccgtgcgctgcgcgcaacaacacacgaattgcatccctcagaactanaccggtanactaggagcactatcacaacaaaganangctcacatctgacacgtcatagaactaaaatacacaacgnnnngagtacacgtgaagatacgaccgtgatggcggtaaatcagantcctcaaacactacaannntanaactgcgggtactactctccctnactaatcatttataattgacaccgctactgttattattactacaattanacactcacnctcaacctactacaacatttctctatnttacactataannaaactctacaaaatcaaca

SEQ ID NO: 11012 - DNA, 965 bp, Homo sapiens
ctcctactctccacactacaccacgccccacctccagactccaatggcacattctacacaggtaacgaggagagatgaggagaggagaggtatatgtttatagagaatacagcccatagtgctgcgatcccattcagtacttattttctgaaaggagagaaatcatatccctgcatacctatgcatttccagtataagaaacaactccctgtacaacacgacctcattctagtaggcccccaaagtagaatcaatatctcgtttcgttacataaacagttccagatcctaaaaaatcaccttgacaaatcttcccacctattcttcgtttttcatccaaactcggcctccctggtctaactgggggaattacctcggcacttttcctttactcgtgggccaatctcacacttccccgctcctctaaacttcatcgagctccgactttccttatcgcacacaccgccaccccctctcctctcagccgctaatcaccgccgtcccacaactacggcgttcctcacccgatacaacacttctcacacacgtcgtctccaccacctcactggcacccgtgaatggccgctcgcgcaaccagctctcacattgtttacagaccactttataatctttaccacatctcccatcttatgacccagcgtgccacccccctacccctctttaaccactcccacccccctccctagaagccccgccatgcgttctcccgatatccacccccacttaccagattcttgacattttcttccttgcgcatagccgccctttattaaatcctcttctccttatctctatttccctctcagacatagcgcagactgcctctccagctcatccctccttccaccttctctcccctattcggaacatgtttctgattctcgcccacaaacctctctctcacctttatgatcaatttactcctgaacacaactcccccactat

SEQ ID NO: 11013 - DNA, 1464 bp, Homo sapiens
  misc_feature (1)...(1464): n = A,T,C or G
ctacgcgctgtcgtcagctagcgacaaggaagagcatgtataatcaatggccgaccgtgatatagtatagtatataatgatgagtcaccacgctctacatgtgagcgccaccacacatgcgccgcaggaccgtgtggtgatgtgatagtgctggggacgcaccgcgncacctagtgtcgtcgcgataacagctatcacggctttctcacgaacagcctactcggtaccgctgtcgncgagccacacattatcgcatgtctcgtgctatctcgatgtgtgagatgcagcggtatcgtctcgcaccagagcacagacaagaccatcagacacgacgatagacaagatagacctgatacgtgacgccacgtcgcggcgagacagagcgcagacgtcctcgcccgcctgcaccacacaggcgacgcaccagcgagcagtaacgatctgcgcngtgtacttgtctcgaccgacacaccggaagaagcgctatcacgagcggctgcgtctgcgatccagcaagtcatacgtatgganacggggagcaggcttcgcaanngcagattagtcgcggcgaacgccgacgctgcgtgaagagacagtgccgcgctactagtgcantcgtgctagacgagggagatacaggatcgaggaacgtgcactcgcgaactgaatctgggcggcacgtttcataattcacagatgggagcatatcggatgtgctcgcgcgaggatgggaccgctggtgccgcgattctggcaacgcccgcgagagccgtacaaaccgactatagcgctgacgtggctggattaaattgcaagcgtgtagcagatagtgtacgcgcantagagacacgaagacgaattcaatgtccacccgctcgtcgcggggcgaggaggtatggagacgatgcgggtggggagctaagngctcgtcgctcaacactgantgagcgctcatcctatgaggtagcacgagatatatccgagtcaatgacagtccactggggcagggcatgccggcgaactatatgtatctgcggcgctccagcacaaccgatcgcacgacctcgacgagctctgatgcgcttcaccgatatgcgctacgcgagcgactagagcacgacgctcgcncgtcgacagaacatataagatcgcagtntcaactaatgacacgatctcagaaagtgtgtggcatatgggctcggttgtcggctggtgccgcgcgcgcgtcgtgngagcggcgaccgcgtccggacacgcgtcgctttagattagcatgtgaggtatatgtctctactatacggtctatcgtgagacagagantataagagaatgaatatcgatatgaaccgacacacgactagccgacacacgactaactcagcccatctcatcgcaccgcctaccgttcacctgtgactcgatcgcactgccctcatcacgtccatcgcaccagaccacatatta

SEQ ID NO: 11014 - DNA, 2077 bp, Homo sapiens
  misc_feature (1)...(2077): n = A,T,C or G
actgagtctatacntgctcnctactatcattacactcacgtgactgtactctaatcttatgtgatagnttgtgtacagtctatagtaatatcatngtagcgatnggtgtgttggnngtgatggagcgtctcgctctcatactatcncgcgccagacatgatctatctagagtngncgctgcantgatgtcgacgntngcgtggtctctaatnngtgtgagctatcttatacacgatgtcattgtcactatcgtacgacgtagagcagagcagcgcnagttctgcgtatatagcattatngtgtagtgatnaccgctacgctatgcgtgcattgtcngcttgtcgtcttgcgtgtcgtactgtactatagactgctgtgtgtctacagctctactcgtctagtgtgatgattctcatctactgactgtatgtgtnacattgcgatgtggtctcctctatactcgncactcgcgcganttcaccatatctancagatacatcgtctactgctcgtantatagtcgcgagagagagatgacgacggcgtgtgatgacgtctagacgactgtatatatctcgcatgtacttcatactatgagtatgcgcgtacngtgtcaactntacgcgcatactcatcagcgtcctncctagagctcactgcgcgtntcncacgtgctgtngtcagagatacgaggtgcgacngtatgcatgcgtgaatggatgctgctagttcggagccttgtgncacgacgcnacgcgtccgcaggcagctactcagctgatgagctgctgncngcactcgctgatgtnctacacctntntntgctnctactantttgatngtcgtactgatganatctactcagtcacgctagacgcngantcggctagtcagtcgatgtgtcgctcacaggtcgtcgcgcgcntgngnntngacnctcgntctcgtcgtgatgctctactcanctangagcgacgncngtaccgctnctncancncttacgagcatacggtcgccatgctgtcgtcccgcncacgatgcactgcgctctgtcacgtgtgcgtcgntagtcatctngtcgtaagttgangtatgggtgtgctacgtagantatgtcatatcgatcanatgttgnacgatcngctgtgantatcgacgtacgccgatacctatcgtcatctacagaccantcagagtcgactactgatgctgatgtgtgctgacntcagctccacgactgctcgagcgatcgttgctntctctgtcacgagcctcncgtnatacantcttgtncantgtacgtgtctntctnctcgttcatctgtntgattcgcagtcacgatcacttgcgatctcntacgcactagntatgtaagtcagatgtattcatgcgtcagtctantgcacanttgctctggttnggacgangcgggagctagcggatngancggtacgtagacatgctgacagctnctancgctaccatcatgtacatcatcgcanctcagcngctccatacaatactggtnactcgcatacacgtacacgactncntcntagctgcgtcagcaagctngctcgngagctgtccgctctcgnatctgacaatctgagngagatgtcgctanttatncatcangctatctacacncacancagtacacntgctactntgcgtactgtctngctactcgagcagctcggcactncgtatcgtcacctnangccggcagngngtctgcnctgtgctagctgctgtgctgtactagtcttactactagtcttcntntntatcgttatntactantcttatctatcnctacnttgatatcannttntatcatnatatcacgatatntnntatccggtctttctctcttactnacctctctnctccgacnccncnnctctctcgcgatctacgtncnttnaggtcagacgatcatcgatactccgaaggggcncgtcgtctgtgtcgtctgtctnctnctctcnacattcgatcactanagtagcagatgcngtctngatctagangactcatcatcncgacagcgatactatacatgttcatgac

SEQ ID NO: 11015 - DNA, 1582 bp, Homo sapiens
  misc_feature (1)...(1582): n = A,T,C or G
gtgaatantagtagngataaaccctagcactcactctcgcatgacggaacgacacatggtgcagacgcgctcgaccatcgttagggtcatgagaacgggcgtagagaactagtgtatgcggaccggcgtcttgagcgtacgcacgcgctcgcacactacatccacacgtactcagcatagacgatgtaggtgcgcgaactatctacagttgactgtcacaccgatatgcgatatgcnactacagtctatctatctgctatcttgtntgtgagatatgacgcacagacgactnggacatggcaagctaggagagagtagcggtatggtgtcatgaggacaacgcgcagcgatcgatangtgatagtgcagataggatcaggtcggtacgtagatagtgttgttgtgcaatatcgttcgttggatgcggtgcngcaccgtgcgaaatacactagagattcntatagtcatgcgatatatgagantgtgtctgacatatcattcgaangatgtgctcacatgagactagagccgagcgcgttcatctctcataccaccgcggacaagacgacgactatgacactgcagatncagcatacgcgagngctcaccgatacacgtctatggtcntctcgtctacaccaccttgcatcgttgtgcagcagaatcggtacgagtatgtggtgcggctgcgctgcgtgtctgtccatatcgtcagttatcactgtggctacgctgagagtgatgctgtaacgaganatactcagggagtagatcatactgcggacactcatgcactccgcatcgcagctggcgcgcgcaccgccngtgaaacatcgtcgtatcgactaatagtatagacacacatcaccgacaagcgcacaaatcgtagttatgtagaagtcaggatggagtantcgagcagactacagcggtgcgtgttcggtgcgcagtgagtcgttgactctcggcgtcggagacgcgtgtggacagcgtcgtatggaagcccgcgcgcgacaagacgcgcactaccactcggacatcgcttggcagtaacgcactggcgcgcgacgcgtgcagccgactcgatgtccgtctgcgcaacagcctgacatcagcaagccagcgcagcgatagtatggtgtangccgtcagcatcgtcatgacagcgtggcccagcgcgcgtcgggcgtcgccgacgcgcactagtgagatgtgctgtagtggagcttcacattaatattatacatcacgtcctagtcccctctaccaatgacctcaccgatctgatcactgtaattgaatgaacatcatattagtctaccatctatcaatagagagagacgacgtgggttgtatggttgcgctggncgcgtgacggtagatttcctcatgtgtctgttgtgtttccctccgcgactggacagaaatccgctatcctgtcaaattactgccgactgaaganaacgcttgcgtaaattaacgttaaagctgcggtcgatgagtggcgtcaagcaatatagatacgcttctcttacctaatcatatcctatcgcttaaacccgtcacctgggcagaggatcca

SEQ ID NO: 11016 - DNA, 566 bp, Homo sapiens
gtttaggggcctgcccttggcctaagcgtgtgactgaaaccttccgcttccgtggtaaacgatgctcctggctcatgcttaagggttattggcattacagggaggagccggcgcaccgtgctcctcctgcatctgtagcagagataggatttcttgctcgtgcccacgatagactcgaactcccgacctcagatgaatcagcctccttggtctaccaagagactgttattcacgcgggagccactgtgcctggcaaaacttatatttttaccgctacactccgtgtgtctaaattagcacatgccaatataaaactcttcattatttgttgataggtgttaagtgaattggggttagtaataaaggaaatgttacttacataaattactatgactgattaagtcactgcttatattttataaaacttatatgccagaagctccattttcttacgaataagggatgacccacaagatgtcatgtgatcttcacatcccatcaatgccaataatctcagaattgtgccttgtgaaaaaaaagacacatatggtctccctcgcctcaca

SEQ ID NO: 11017 - DNA, 2023 bp, Homo sapiens
  misc_feature (1)...(2023): n = A,T,C or G
ccgtgctcgcagtcgnganacagctatcgtgtacncgacgcaggcgcgtctgatanatgtcacacgactcagnancncgntctcagcctcactcgctactgcnttgtantgncgnngngnanntngacgcngnattagncgtagngnacagctcgtctgnaantcnctganatcagtanttcnacnattcganatatagtacacatcagatgntaatntatcctctacgtactcatantacattagatcactgncgacggagcagcatnangcgatagtatcatcagntactangctgcacgattgtcgaatatganacgagtacatatcagcantgacgtacacacgacggacgtcgcacatcgtgangactacgtgtagtgatgttcanctatgnaggnacgaagcngcgtcatgaggangngagacatgacnctacgtcngatactgcttcgtcgttctagagtngtgccgnggtcgtcgctgcagtncttgctgtacgtnagcgngncnacgantcntgcancagcatgataggtggngttgcagcgtgctcgtnttgtntgctatnnnagcgtcactatganatatnacatctctctnctctctcatcgatctanatctatcgtactntnanncgantgcnatactatccgtatgtacgcagntccgancatcagtgtgctgtcgatgnggangtcagcatgcngacgtangtagtacnatgcatctactatncnncgatcgcncgcaatgcgcacncgtcgcgatcgttgatgctacatcagcnaatcagcactgnnnnnnnagctnttaagatattccagtttcntntatatcntntgtacgtccgctggtcgcatccctcgagtcccgatgatgnntanncngatcactatanaccagtatgtcgctgagnatctgnatcnattgnacgcaatgggcgttgtatcngcgtagntgtctcgtacatcgtacttcgtgacctnctntgcgctgcgaagtactangtcntcgcgcagcatcgcgatgcagnggagtgcgtcgatcnatntgcgcngagtcgnggtgctatgatnatngagaacgtatagacgtcncngtgagngntatgcgtagctgaacgatgtcgcgtngtantcatgtgacngctggagtatatgctggaacgaatgtcgcactgnacactcgtgtgangcatggtganatctcacngcagtcgacacctcananagacacacactatatcttatgtnagtcgctactacgacatatatacancctctcactcacgctgctcagtgtngngtctcgacgtagatatagtgaagtanngatagatcatcactctacctaccgcactatatctactcttctcacatattattatannatactatgttgtanttctactattatntacaacatanataaatatataaactatatcactactctctanacacactctcatacttacactacttacacaacancatatcactcantcttatnnttatctttnttcatatactcttcatattacttctgatggnctatgttngcaccttcgctgcttgtttntctgtggtgggcggtgnctatcacgtcgagaacaccactgcacgaggacagtcacacagcgcacgcgacaatntggctatctgacatttttgatcctatctctatatcctctctnncttctgtcatccttccttctcactcttacatnttatcttcgctcantatacccttcttcnntctcttctctcncnctcncgcttctagctctatctntctntnnnntgtgcttactcacacnnctgtnnntaaatacactnctactccttttnnnncnnnntgnttntcnncnttncnncataggaactttttntttnnntnnnntnnntntnnnnnnttnnnnncnctntctcntctttttcnntttcnttcncctttacccattnncntctcctnncnttctctctcttcccctattttccttttctctttccctttttcc

SEQ ID NO: 11018 - DNA, 904 bp, Homo sapiens
  misc_feature (1)...(904): n = A,T,C or G
ctcacccgtactagtgagtcgttttanagaaagaactnacacacgtctttaccgaccgaatatgaaggtttattgagctgagggctcccacactctttcacctgcaaggatttcttacaatctccacctacacacctgcttagcttgcctcccaccacctgaatcacgatcgctcgcacctcacctcacaaggcatgaagaaaaaaaggcatacctgctaatcaccctctttttacccaaccatggttactaatcccacttctatccccatcctcatctaaaccctccacctccttcttaccccccctcacgtctcctcgggcctaccacattacttcgctccccagagcttctcctctcaccaacctgcccccacaactttcctataagtaagtgtgcacccgcacgttcgataagaattctgaacccccactaccccctcatcgagtgccgtaccccagcgaacctctctgacgtcccttctgctcacgccaacgctccgtcgacagactccccaacccacaacactactcccgccctacctagcttcccccccctctacgctaccatcaccttcccactctattccacccaaccctcgctactcttccccaaccactatgccacggctcacgaaatccttcttagtgtctgctacgtccatcaacaaactcttatagctgccttgttctccttaccccgcaccactccgcaacactcccccgcccccccgccactctccaccaccaccctcacgctaaccaccccctcacgctatggactccgcaccccctcccaaccccccccccaacttccattatcacaccgcacctcccccttcaaccccccccaccccttaccaccaccacctctcgacacagcgcacggcgcccaccagcacccc

SEQ ID NO: 11019 - DNA, 1460 bp, Homo sapiens
  misc_feature (1)...(1460): n = A,T,C or G
ccgagaagtgcgaagcgtataaggtagagatacagtcacgatntcacacaggagtcagacataaatgtcncatagctgtctcgccagatatatctacacgtcanaacgatatcaagatagagagtgtggatagtagatgacgcgacgatagtgagntgtgtcacgctcgtcnctgtgcgtgcgtggtcgcacatatatcagctatcatcagcatgcgctgacagcancagcgcgtctgancggccgtatatctgtagcangactcagcgcagtgtattcatcatttggaattaacctgcgagtctggatatanttatattagtctanatgagacnatagtttgtantatacanattaataataatagacaganggagcgttgagtggatactgntcgctgtacgtagcgtgatatcgcatctgtaagcgcgggcatacatgtgggaggtgagtagtactgtgttcgtcgtgcgtgtgagctacgatagtcatatacgtgtacagaagacacgtcacactcatatagctacgtgatgtattgtgagagcgcgggagcgtagtgctgaagactgantatagattangtaaccgcggtgcagtgccatagcaggtatctgacgacctagaattagtcgtgcagagatatagacgcataccataatatagaggagggcggaggcgccgcgcgtcacgctgtgtatgacgcatatgaagactatgtgtctactatgaatgagctatcttcattgctgactacagtcgaatcgaggtagtaggtatattacttcatgagggctacgtataatatagtgtctacattacttcaatgttacatataataaaacaccacacacactaaataatcaaataacagagaacgtgataggacacgaactactctatcaacatcatcaatcatcggaggaacgagtcgagttgatgtgtcggcggtctataccactcgcaataacacagtaccctacttttgactactacaccgtaccattccttctgcaccgtacgcgcgcttagcttagcgcatacatataatctactctacaccccatgccttttgttaagtaccattttgaagtagaagcacggtgaggtcttagcgctctctaatcacattaattatgctacttttatgcgaagatgacgtggcagaatgtcatggaggacatacaaatgcgacgtagggattaggattttagaaattgtttcatgctgggcggtgggttggcgggttttagtcggtgtgtgtcagttttttctgagtgaggagataggtgatattgtaatatttatattccctttcgggtaaaatgttattaacaacttggtcgatgggtgtggggtagggaaagaactggtcgggcgcttaggtgagaagtgaatgaatctgaacatacgatagggtgtaatcgatacacattaagtctgatatataaagaagaact

SEQ ID NO: 11020 - DNA, 879 bp, Homo sapiens
caaacgaactaaacagattcgaataagacatgtaggtatatgatctcccggctgttacgcagttagaatagacggcgctaatccctcaagcgtgtgaggtcatatcatgaccattttcgcgcccctcgagaaggcggcgcgctgcagttatgttgctaagtcgtacggtgtggctgggcggcgattgcattgggcggtgtccgtccctatgaacaaaagcatgtggggcggctgcggacacgttcacataatagcagccacgacgcggtgatcagacgaccacaaatgaggagcagtagagagaggggaggagttcgggtttccgggcgtcggggagaacgcacactgcactaaggtcgcgcagcataaagcccgcgtatcgtggagactgcgggcaagagccgggcgtttgttcaggagtgcagtgtgaaggatgaatgagtatggaccaatcacccctttcatcacgcgcaggggtagtcggacaatcggcaagctaccgcgtggatatgctggttactcagccgctgagtaaggatctaggctacacccctcagaaggcaggaaggagaaaaaggctcagctccctcgtcaagtcgtaagagtccaccttcattaccagagccaactgtccgtaccagggcatctaagcctgtgcctcttcttgccacctctagcatctcctagagccgagatcccagcataatgaatgccggcaagctcggctatcagagatgttccaaagacctttccactaataaaaaactaagtattttttctaaaaaaaacaaaaaaaaaaatggcctcgttggctacagcggggagtgtgcggccgagccctttctctcggtctcgcaacaaccacacagctattcgaaa

SEQ ID NO: 11021 - DNA, 1197 bp, Homo sapiens
  misc_feature (1)...(1197): n = A,T,C or G
ccggttcgaagcgcgagcacggggaagagggctcgagggaccgccctacttgatgtcttatacaagaactccttcttcctcactccccggagaaccatgactgtcatggatggcgaagccgcatgaatgttggctgctgcctgctttgggcctgttcgcttccttatcggtcggtgcgaaacaatggaaagaaatgcgtgcctaggttcctctagaaacaggtaaggaagaaaagacgtttttcctggctttgttggcgcatggagatcctaggggtcgtggcaaacttttgtgataacctccctggtgggggtggagcaatctccactcccagatggactctttcaaaagacaccaagcctcctatgtgccactgcgcgttgccgagcgagcgaagtcctcgtggcctggaataacctggcgccaaacagtgcgtcctggggtcgtctcacaaggagaaaggggaatgcattggcctcccgctcgcgcttccgcgcccgcccatatgaagatgaaaccatattcggcgccggtggattacccgcgtgtgggacctatttcctcttgttcagtcccgccttctgacaaagacagtggtggcgcacaccttctccacaaggccaccgccttaattcaaatcttgtgtggcgacgactacgctcgcaaccatactcaccgccagcactcagccgggcacgacactgcggccnacagcccgcncgcttggcgcctgctctggaggttcacaggagtgggaacttcccgcgccgctccggcccttgtagtgaaagcgggtcacttacagtagcgccggcctccctcggactaggccnacgtacgccgagtggctggcgtgtggcggtatccgcgtcattcacggcagcttgcgacggaggggtcanccggttgntcccgaccgcggctgggtggcgtatccccaatagacgacaatcatatgggcgcatggcgtcgnngagtggcgggtcttgtgtgacggttgagcccgccccgtggtcgtcccatgtgtctccgcggcgcgcacctcgtaggagcgatcctcgcactgcagctcttactctcactcgcccagcgcaccctcccattcttaacagtacgtagcggcggcgccggaacctccagtgggaccttccgtcgcacatatgagaggccgcgagcgcgcccctcctgtttacacag

SEQ ID NO: 11022 - DNA, 992 bp, Homo sapiens
  misc_feature (1)...(992): n = A,T,C or G
ggatgagttgtggagggacgagtttatgttactggataataaagagtgttgtttcaatgtgttaatagtgactagagagttggatagatggatggatatggtataatgtttattgagggatttgagacagagtgaaggtaggaggaggtgtagaagagagaatatatgggagagttgatataagaatatgatggatattatatattatgaaggtagtgtctagatagcgttgtcagatattaattttataatatgatgtaagtatatatagttaaattgagcatgctataagcggagtgagatagtagtgtttgtataatatgtatggggcgaggaaattatatataaataataagagaactaagtttttatgttggttgtatatgaaaagaagagaaataggcattatagtggggaggtgtgtggagaggtcttgcggtgctgttagagagtctctcttggaggtgtggtgcggttgnttggaatgagaggttatagcgagaatgagaacattctacgctgaatctctgtcaatatgtgggtgaaaggagagtcgtagtatgatgtatcttcttgtgttaggtaagagtgagtattgtgatggtatcttagagatagtatgctgatgtaaggagtagaaagagcagaatagatggtagaatatgaaaaaataatctatgtggcaggtttgagagtgaggtaattaaaaaggtatggagtattataaaaaaatagtcatgtagttaaattattatataggatgtgtaggaagtggggtgtggatgagggaggggagtgatagtgggagtagaggatgtttaaaatgtgaatgttgaggttaagtgtaaggtcgatggatgagggttaatagagacttaaaaaatttgtataatataattatcataagataaaatagaagaaaaagatatgacagagaagaggtagataaaaaagagataatattataatatgaagaagggggaagactagga

SEQ ID NO: 11023 - DNA, 715 bp, Homo sapiens
aacaaagcacaaacaaatttattacgagaccctgagaggcataaaaaagctgggaataaccaggaagtcttgtgcccaaaaaggcccttatcaaaacgtgttttatatcacacataaggaattccccccaacttttgcagcggtgattatttgtacaaagctcaagaaaaacgccccgggaacaaacaagcccagggctggagtaaaaggaatccttatacgctgggcggagcccagcttctttgaggcaataacagagagttccttctcccacaactcccccggagaacaccattgctgctacgggtccaaaccacataaatgttgctcgctccggttgggcggctgttttttatgttgttgccgccacgggaaaaaaacgtgcctaggtcctagaaacagtaagaaagaaacgtttttatgcttttggccaggaatcctgggtttgcaactttggaaaactccttttcacataacaatttcatccaatttatttttaaaggacaaccccatttcaagccttctggtattatcttttttgaaactttccacattcccccattttaaaaaaaggaatcattttcccccccctccccccccatagaatcaacatatggtagggattacagtgggggcatttttttatatccccttttaaaaacattgtttcccctttaaaagtaaacccttaataaatttttggaagatctctgcc

SEQ ID NO: 11024 - DNA, 976 bp, Homo sapiens
ccctgcacagcccaccctcccaagtcatcgtttggtgcactacgtaacgagtatgatgcccttttgcgagcaacgtcaggaacacatgcttcccagcgccacacagttaaggagatgtctgacagtcctcttttctgtacagagtccaggttcctgagagtgaagaatgatgttcaaaaaccaagatctgacattcagaccaaggctgaaaagagaaagagagagaaggcattcttatcttctcacagtcttcaagggaaagctctcagcatttcataactgaccacgtttgtggtatacttttttcctgtaaatacttattgccatattataaaagtttctttccattttaagctctactatggagatttcttacgaaactcattaatcactcgtccactcttaatgaaaaaaaacaaaaaatggccccgctgcgcctaaaccggtcggagttttgctgccgctcccctttagtgaggcgtactccacgacccgtcgctccactgactgcttagacgtcgtcggtccggctgggaggagcggcataacgtcactctaaggcgggattaactgctatctccctaactcagggaaacccgccagaaacaccgtcggagccaataggcattccaagggccggaaacggacaaaaggcccgtatacgtgcgtgctttcctaggcttccccaccctgtccatcgtttctactttctacccctcagcctaaaggtgtggacccctgcgcgccatagcggatcgccgctggtgtctcgtgcagctccctgcagatgctctctatgggccccctgccatttcgcgaatcctccgcccctcgttcttcctcccctaggcttacgcgctctccatccttcccgcgcacgcggctcacgcaccgaccagttggcactcacgaccggactggccgataacccctccgcctttcgccgattccttctatgtactgcgattttagtcac

SEQ ID NO: 11025 - DNA, 273 bp, Homo sapiens
  misc_feature (1)...(273): n = A,T,C or G
taaaaaaagaaatataaaaaaaancttcagtgtatcgaaactgacaacatagcagtaagcagtttgtcgaagatcagacaactcctgcatagtgggtccaaaagataaattctattactctgatccagaatcttgctctgagacattctgttatctatttttttgtgtatacctagtataaactatatatatatatagctgctctttatatgacactcttggtttctttaatataaaatatgaataaaatgaataacgaagaaaaaagaataa

SEQ ID NO: 11026 - DNA, 966 bp, Homo sapiens
  misc_feature (1)...(966): n = A,T,C or G
cgcatccgactcacacaccaaaaacaaccttatgggaaacgngcaatggcgcgtacttggctaaaccnacctccgcctccgggattcaagcgattctcctgtctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagcgctgggatttctaggcgtgagccactgtgcctggccaaacttatatttttagcgctacactccttgtgtctagattagcacatgccaatataaaagtcttcattatttgctggtagttgttaagtgaattggggttagtaataaaggaaatgttagttacatacattactatgactgatcaggaactgcttatattctataaaatctattctccagaccccacatctgacttaagaatgagacaagacccataaagggtcatgcactctctacattttataccaatcaatcatctaccactcttcgttcgggaaaaacaacaaaaccggtcttaatggctccgccggccgaagccccagtccttgttcccttctccgaggggaaaatcaatcatcatctcctcctgcgctatctgaccctagtgccatagccgtgcggtcaggcagtttattatagatttgaacgggcgcactacgttttgcaacaagtcgctgctatatatattgtcaaacatgttcggagtggacctagccacagataggcccggcgaagaggcctcttcgttgacttccccattagtgtctccttgtgacggcagtaacggtcgtcatttagtatcgttcgcgaccatgttatgtaggtataatcctcccgtgtccgtccgttctcacacacgcctcgtctcaatttcacatgctgcagccccagattgcc

SEQ ID NO: 11027 - DNA, 958 bp, Homo sapiens
  misc_feature (1)...(958): n = A,T,C or G
atggtggaaccaggcatgcagagnggagtgagaggcgtgtgtgggactaaggaggggtcatagtctccgtagtgcgagacagcacgagcgcgtctcgtctgctcactgtgggttgcatgttaatggttctggggaggtgtactctagagaccatgagtcgtccaacaggggtaggtagcgccgtcgaactctatcatagggggcgtggggtgacaactacactgagaaaaagtccaagggtgggggtgtctcttacacgtaaaccccctcgcatatatcgatgttataagtacaatcggttatggttggggacgcagtatggccttagggaacgcgccggttatacgacctgtctacacagccttaccaaagtattacttacaggcgagacctactaaacgacattgtcgtaagaatagactagcgagatttgctgtctcgggcgcgtgcgcggggcggtggagcggatgatgcaagcagcgtgcgggctgtctatataggggaggatcgttgcgcactaatttgtgaagattactactttagatttacaaaaataaatctattctagtacgcctcaagtatccaggcagattaatactataggtagtcactccctatatacctttaaatcacttcacaatactagtaancacttactacccttacactcaccctactttccttactnattttcttatactaacttantaaagaaaatagagacaagagtgaaacgggcacctaatacatgctggcgtccctcaccgcgctcagctcttaattcttttattccattactctctacttnncctctcactttcctttnttcatttntttcttttactttnnntctncctttttnntnnncaattttnnttnnnnnncttnnnttaattnnnnncnntntnncnctttacctttcacacatactncctttttccctctatttttccttctc

SEQ ID NO: 11028 - DNA, 1233 bp, Homo sapiens
  misc_feature (1)...(1233): n = A,T,C or G
ttacgaaaatcgcaaaaccaaccaaaccaggtgaggtgttactctncatgacttgggttaggacttattagcacatttatctcttacaaagctatgtaccaggacaaacgctgtctcatgtccttgtcgatcaccacgcgccagagcatgcgacggatccacatctgaaatgcgcattgtagattgctgacgatccaccgctcgcagcgtcaagtgtcacacacctagacatcgtactcagtagtactcgcataacgcatgatattggacagtgatgtgttatttaagccgcgctttccataccttcgacaaatacttgattaggtcctcttactgtgccctttatagcagcgagattatatctcctagcacacactcacacttctaatcgacgtggccacgacaccatcacaacactactagcatgcataggattaacctataacataggccacacaaccatacataactgagtaccgtgtgactccgctttctcctacatcccgacgacagatcacgcgacatcacccatacacggacactacctaccacatatttgatactcagcgtgttccaactcgattatgactttatttattacttaatacaacttcctcgccatcacaccgcttctcacgccagccatcatcatacccagacgccgtaacgtcatatggngacctatcgacatagatgtattgactacctagagcagaatcactacaccacccccgcacgctcacaatctcgcaccggagattacttaacctcttaagacccactataatcatctacccgctccctaatgctcactgaaggactgagagtacaccatccatgccccaccgcgcaattcacctaacatgcacaccctcgtcgcgcaccgcgccggagttgaancgtataatcgctatttctcgaccgctcctccccgttactagtagaaccacgaacacgcgacaacaagatcgcgaacaatacagcactacttctgcgcgcgcgtcgcactcgcaccgacatccacccatatgtattcctactctctcactctcatagcgagcactaacncgctcatgcattatcagctacgttatcgcgccccgctcataataccttcgcctncagatactataggcatgtactctgactatccgctctactctaaggctatcatgattgaatctccgtcaataccatatatatgtcatactacgttctaccatgaaatggcag

SEQ ID NO: 11029 - DNA, 1346 bp, Homo sapiens
  misc_feature (1)...(1346): n = A,T,C or G
tctgtcgtgataacgttcgtccgatgtaccacgacaaagaccgcgccctcaagtgttgtataacgacattcactcgctatcgcgcttaagcgnacggatatatcgcacgaatcttcatctactctcaagaaagcctcatctagcgcatgaactaacatgcatcgtttacatctcgtctagtagatcccgcacgcgcctagggctagcgacggcatccacctatcgcaacgtccattagatgtgttcgatgatgcatcgctagagtgctgggccaatcatatgtgaacgacgtagtgtgcgtccacgtccgattaacatggagttcgtcgcttcaacgagcctcacgatgctatgtgtattcgtacatacattttgtgtacctacttttgccgcttttgtcgcgagtgcagagtactctccggtctgcccccactattttaatgcatagccgctccgtcgcatgcaccgctcggactcaacttaacttcaccatcacactcacgacccacgtcgcctgagccgggctccgcctgcactttcacttcacctaggangcggtcctccattttggctacctccggccgacagtagcgctccttctccactngtaccctcactccgtcttctcttctcttctgcgagatacacgcgacagatactcacacgataacatctccgttctccntcgcaaccgtgactaaaccacgtatgcccatcctcattcaagcatgtgatatggctcttaacgtgataacgacaccgcaacgcctcgaccacagccaatgagctaatatagcgcctgtgatatgtgaccgctatgcatatccccttacgcgcgacaccgctcatatatatcacacgctccgtctctcgtcacacagttgactcacctcgttcttcactgtctctcatctcaccccactcgcgcatcaatacttcgcgcgtcgcctccgctatgcgtattgtatgcgcgttattgcccgcaccctacaccgtccgcccttatanctacatgtgtccagcacagacagacgcatgagcacgacacaatcgcatcctaatataacacctcctgctattgcgacacttacagacctctctgtctatctacatatcgactttatacatcctcgtactctcctctatgcttctctctttctatgttgcgctcatctattaccatctatcgncgctctcgttgaccacctctcacgctgtcgagctcgtccaggtaccactgcttcacgctccatcacctaccgatagtctcctctcgtgcgcgtcagtctctacagatgtatcttagtatccgtctcactcagtctcctctctntcatctcgctcgg

SEQ ID NO: 11030 - DNA, 296 bp, Homo sapiens
ctgtatccactcagggttgaatggattaagggcggtgcaagatgtgctttgttaaacagatgcttgaaggcagcatgctctttaagagtcatcaccactcaaaaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgaacaataaaaaaaaaagaaaaaaaaaaaaaaaaa

SEQ ID NO: 11031 - DNA, 1559 bp, Homo sapiens
  misc_feature (1)...(1559): n = A,T,C or G
gtacgcgtatgacatgagaaaggcctgagatgtgnagcacgcgatatgctgtcttgaacatatagcagagagttgatngcatggacgcgacttcactatcgtatgcgtgtgccggcgaagtatgcntcgtaacnggtcgagcgtgtatgttgcgatatagcgtagtgtngtgcagagactcattncgtcatgcttcgctctcgccttatcgtactcacatgntggtantgcacttgtcatggtcgtacactgtncgcgtgcgtataccacttcgtcatacaacactcagcagtggngnangcatagatatagaagaatcatatcgtacgngntgacgtgcagtcactgagagactcgatacannctactatgctacgtcagactgaaagntgtgacntgcgaagagctgcantaacagacgtatatatacactctgatctaatagtatgnaaatctattnattatgactcatcatatctggtccggctgcttgttgagctcgnggggtagcggcgtgactagtgagcaancaacgataggtaatcntatacaagtgcaacagccgtagnaacacaagagcacacgaggaagacagatagatgcgaggtgnncccactcacggtcgtgagtcgtagttatatcacgagctgacgncgctttacccagaagaagagagagtatactgatcctgcgtctagcgttccgctctgtatgcgtgtgtcttgtggcgtgtgtcgtaggcggcggttgtcagtgagtgggtctggagttgtacgnggacgcaggtgacagtagcggtatgatactgatggttacggatcgacgctgcactatactatagtatagagtccgagagtnctagagacggacgactgagtatgtagtctactngtcaaaatactattgactactttaacgcttgtagattgtagaagtataggnatgctatcatcaatactctaacacatacacactcaaccgtctatgatgagatagacgcacttggggcgacgtatcggtaatatatcgtactaacagttatntgtgatactaagaatnaatatctacanacacactggtatcanaacattataacttaataacacttncaacngcataaactctataattantanaactatatatactataatcatatatatacattataatactaatanaattctgtcgtgtcttacacatatcttacgtgtagngacattgcaatctaactgcgtgtatgtgncagctgcatngactgactgacggacgtgangcgctgtcgtgaacacacgactgntatctagacggagngagtgtgnncactctcgactcatcttgtgtaccttactctnnncgttnntngtacgtgtnatacttttctttgtnctttngctctcgtctntatcgtcttntntctgtccttttnnttctctcttcgtntcnnnncaatgtnctgtctacttctcngngncgcgtgttnttacatntcgctntttnncaaaaacctcttctctntantnngnnnntnnnggcnannncntnnncnctaaggancc

SEQ ID NO: 11032 - DNA, 321 bp, Homo sapiens
  misc_feature (1)...(321): n = A,T,C or G
ggttttgtattcactaattcgaaaagaaaganaccttaagggaaacgtggaggctgaggtagngagatggcctgaacccgggaggcggagcttgcagtgagccaagtttgctcactgcaagcttgcagattgcgccactgcgcctccagtctgggcgacagaacgagactcagtctcaaaaaaaaaaatgttgttaccttttataatttagtcttttgaatctttgtcctttggaagccagtggtattagctggattctacaattatttgttttggatatgaagcagacaataaaaacaaatatggcctcgttgccctcac

SEQ ID NO: 11033 - DNA, 714 bp, Homo sapiens
  misc_feature (1)...(714): n = A,T,C or G
cgccccacgtcaccgcgcacaaaggcnccggttccagtggcaaaacaagagttttgcagcgatgactacttgctgcaggggcaacagttatgactgcggattgcaacttcatcgccgtcctggggggtaacatacacnaaaantttcattcaacttatatacattccatatcaaataccaatccaacaanccataaatatttctcattaattcaatttcctaataatccccaattaccataaaacaaatttgttcataatcaaaaaaaaaaatccaaaggggggggggggtcttctccttcacgcgcgccggccctcataaaaaccccgttccactttcggggagggggtcaatctcactggtccctccgctacactggactcgcgtggcggtccgcgcacttccgggtcggcccggagcgcgggttgcaccgtcacccacaagcggcgggaacaccggggcatccgaccgaagtgcagcggcgataccccgcgggacacgaaaccgcggtggcgcgtacggggcgcgcaaagcgcgcgcgcgacgccgcgcgcaaccggccccgctccgctcgtcccgttgtctccgtaaggggtgcggcgctcgctctgagcgagtcgccgccgcgtcgtgcggcggtcggcgtgaagccggccaggcgagcgcgcgagaaggcccgacgcccggccgctgctgccgagatggcgggcgccg

SEQ ID NO: 11034 - DNA, 2062 bp, Homo sapiens
  misc_feature (1)...(2062): n = A,T,C or G
ctcaacacantcgatagcatgtcactagtgaattagtgacatatctcgatacgtattantagctaaactgagtgatcacacantctcaacactactgtctacctagangtgatgncatgatagtaggagtcttcgtactgatcagctctctcgcnttcacgagcgtgctcgagtgtcgctgcgtctgangtatagtancgnacgttgatgcgtnggtagcgacgagtcaggtagagacaacgtgtacggtcgctcgagatgtagtgcacgcagtactganacatcgacntagnagagacncacgatagtagcactcgcngacgtagacgcactacagcaatgcacgcattcaatatgtcatatcagaatactcgatngagatnacagatgagatgatgantatagacactatagatatgcaganngagcgacgctgaagaganagtagatatgagagcgagagagacgatgcatgaagtatagtcgtcagagtantgagtaacagncgcaaatggagtttcacatntgctgtaatataatatgtgtantcattcatcggttcanacatctcantcgncgtcaaagcagtnanacacngatggatagacgatcagtcttgcttgcgtgcgagtgcgcttcgcagntgtgtgaacgcgcgcactcgagactatggngcatcgcacgtgnantcaggatangacgctcactcgacgctcgcnacagaacatacgtcgcagaacagataagtntcatanctatgatggcattcntncactctgccgcgctcggctcgcncgtgctgtgagtgatatagnatacgaacgatataatatcagtagtagcactaagagngagtgagacagtggaaanagananagangtaatagatgntaganagacgacgcggggagtgacgcgtgatagtgccgtgcgatcgtctcgncgacgtgcgtcagncgccgcgtcggcgtgattgctacatcgtacacatgtcctggtgcgtgctgntccttctgtacntgtantatatcatatatcttngtcatatttacatgatgtagagcgntgttcnggtcacatgtgcacnactgattagcaggtacagtagtngtattatatagctatacacagagctntatatctcagaggatnacgtgaatattatgacgtgcatatgnganctcatatataacgccgngnggctgnggcatcantnanagatgcctgcgtggagtcgcgcacgcatgcgacgtcctgtccatctcacgcnacacannactanagagcgacgcgctaactcaananaatactacctacaattaccgacgtcaccgcagatctnnanacactcatccatantcantancatattatcatgatatagaacnaatacctcgacaatataacacatatatanctacttantaaanannantaatnatngtgcnacacnaaatataacgaacgactgcagagnggnanagaagacatgngnanagaaccgagnacgcgctcnatcgagcagcagcagacagatgacaacngcacacgctattctcagtgngntatgatcgataggtatgtgtcngatctatctatccacgacgcagcntnctnctgagcncnaccgagngcgacattgcatatncctcgctttcctcagcnnnncncnnngnnnntcaccgntnnntgcttctctncnnnnnnnncctntnnnngnnnntnnngngnncntcnccgnngnnggcccgtnnggnngggancnntagccgncgnnngcgnnngngcattanngnnnnnccanntnngngnnnnnnnnnaagnnnnnncnacancnnngannnnnnnnnnnnnnnnngaactggnnnnnnnnnnnnnnnnnnnnnnnnnnnnnnnnnnntntnnnnnnnntnnnnnnnncanangnnnnnnnnnnnnnnnnnnnnnnnnnnnnnnnnnnnnncnnnntccnnnnncnnnntnnnnnnnntcccnncnnctnacatnnnnnnnncncnnnnnnnnnnnaactccnnnnnncccnttnnncnnnccccntttt

SEQ ID NO: 11035 - DNA, 774 bp, Homo sapiens
  misc_feature (1)...(774): n = A,T,C or G
cccacgcgtcacccaaactcgccgcgggagaacgagaacagactnccttcgtntgtaggactacgcgcggcctcccaccttttgngagggccaaaaccatggcncgtcgatactgcctagaccgctagagatcccacnccatccttcgcgcactccgcgaggagatgcggtgggtattacacggcagttgatgccacttgctgccgcggcgcccatctagctcttattctcttacaaactcgcatgatggaatgtacagattaccctgagagtcacaacgcatttaaacaattacgcaataaaacccaaactggctctccgtctgggcctccacgtggtgttttttttttttacgccgggttgcccgttcacccgaggtgttaacctccgtgatccctgccctccactgaactccgctccgccttcccgttccggaccatctgtttaattagnccgccccnccccgctgtgtcctatgcgccgtctacaccagccccttcctcctttacccctgcggcttatgactactgcgcgcgccacgccccctcgtgcgctgacgctcccgcttccagcgctcctgcgacccggcgcattttacagtctactccgcgcggtcttggctcgccctagcccggctgtcttatttgcccgtccttacggtcgccatgtctctctgcgagctcaggcgactggtcgcccacgctcccctcccaccccaatgcagttcccgagttcctctgcgtgctacggatcgccgctgccgcacggtatttg

SEQ ID NO: 11036 - DNA, 1476 bp, Homo sapiens
  misc_feature (1)...(1476): n = A,T,C or G
acaggacagcgaggagtgatagagagaggatggacgtgacacgggagtgtgatcgctgactgagtacggtgtgagtggacatgagtaatgagaaagatatgacacacacatgattactatanacacagatagatgagtgaggcgangagctatgtgtgtactactacgctcctgatactagcgcgctaagaaggagctataagcnataggatatagacagancacgaagaactcttcaatgtgagaatacgctctagatatatatgagatanagacgtgacagacgcagagcataacgataggagaagatantgggagagaagaagagcgtaactcgactcctatgcaaacagaagataacagagtacaagttaatagataatggcgcgacaacacagcgcactcgatatagagatcttagtgagaggaacgagatatgggacgcgtgtatcagtctgggtgagcagagaataaataaatatagatgagaagagtagaggagatagattaagatagagtgcgataggcgagagtacgtagggaggtatcggatataagtctattctggtttattnatacatctgataggagtgagttgtcggagtanatatatgagtggagagatatcgagtagagagtgagagtgagcgagcgagtnggatcgtgacgatgcagagattcgtggatacgtcttgagatgcgttgtgtatagacnaantcatatatgatgtggttatgttgaggtaagaaggtaagaagatggcgggatgggagtgattaaaatgagggaacagagaataagtcgcatagacgagaggtatggttacaaaatgaagagcgcgagtgaggagtaggggggagggaatggaagaggtgagtattagttgatagaagtggtgctcttatttacaatatattagangcagatattaagagattggagactataggttagatacataatagttgttgagctagaggactncgtatagtatatctgactggattaatcataccgagctatgagagttagcattgaatgtcagagcagtagaatagtgatagactatttagtatcgacgggtcgagtagtgtttatttagtgtggtgcgaggtgcgtaggtgttggagctgtgggtcgcatgtgttatgtagatcttacctgtgtatgagatggatgatgtgtgatgatgaagtatagagggagggagtagtgtctaggatagactaagacagtgggggagtggtaagtgatgtgtaatgcagtgagaactagccgtgcgagatatgatgtagacgaatgggtgtagctagctgccgtgaggtacgtataaatatttatagtatctaataaatgtaataagacaatagacgagaggatagtatacatgttatgttaagagatagatatatattgagatttgcttagaaccgcagagctagggagtagctgtagacacggtatcgctgtaccaa

SEQ ID NO: 11037 - DNA, 669 bp, Homo sapiens
  misc_feature (1)...(669): n = A,T,C or G
cgggccgcgagaagcggcgcggggcggggggagngggttctttataggtnaccagccgccccaagncctagagnagnangcatcgaaaacgcacacacgcaaccgaaggccagaaggancgccccccgttgaccacggggaggagggggggggggcccaacacccccgccgaagcgcggccggaagcgagcccccaccccacaccacgaccccaccacaagagcggcagcggggccaacgcgcaagagagcacgacgcaggcagcaccgaacagggcggaccagcaccccacaccgcgaggaggaggagactttttttttcaaaggggggggaccccgcccgccagcgccgcaaaacacacccaccccgccggccggagagagaaccaaacggcgccaccnagggccaacgggcgcaccnagccgcgccagccaccacacccccgcgccagccgacaggacccgcgcacaccagccgcacacacccgagcgcgaacacagacaccacagagcccacccccgcacacgcgacgggaacaggccacaccacaccgccgggaccacgcacggaaacccaccccgggcgaggggagcagagggcaagagcccacccgcggacccccaccccccacagccccaccccacccacacccacacccagcaaccagac

SEQ ID NO: 11038 - DNA, 1242 bp, Homo sapiens
  misc_feature (1)...(1242): n = A,T,C or G
atgcatgagctcatgatattgatgtcttcgtgggtggaagaagatgtgaagtgagtatgtggcgtgtgtccantctgtggcggtggcgcggagcgtgtgggataggagagtggngatagngnttancatctccgtgcacacacgggcgnagagcanacgagggagatggtgtctctgtagatcgagtcgatccgtcatgtntgtanggggtcggagtangaggtgagtgtgctgaggaacgattgtgtncagtgactagagtacgaatgtacttcaattatagtggagtacgtaactatcataacacttataagatacgttagtgatatgcgatgacgaatncatacgcgtataagcactacgttatcatagacttgnntcgttagtcatactattataaagatcgataatnatacacgtattgatacgaatnnacaaaaaataaataatacactgttcgaacgctaatgcagagantanacgtncgggcgagagaacagcgatagacaactatngacgacaagagtatgcgcgagagagnaataatgtatcagtanacacatngtcatacgcacttcattcttgctatctatagtagtgatatctatatantntgcttgttntactatctcgttcttcgactgtcgcgtcgtataagagcatcagtaaacacgactaatgctctgaaatcggactcgtatgtgcgcanacgtgtgggcacctgatctgtcgnccacagagtgtgggggcaccgtcgcctatgtcgggtgcgctcgtgtagtgctcatagcttcaattgtgtggcgagtgagataggtgtacattctttgtataataattgcgatcctcttcttttatatatcatcgataacgacgctccaaatgtgtcattcactacatcacgtgagtcgtagtgttatatgtacaataatancactctcagcgtctaatagaaacatcctgttcatgctaccatcactcaataagagctagtnaatattaatggttccagttttccactcacgttcaccagtggtgagtactccttcaggacagtggtgccactctcgcgctgtcatgtggagtgagcgtcatggtgggtacgtgttgcggttcccactccttccccacttacgtgagaattaaaggcgaatagcccttgttcatgatccacatagcgacctctcccatggtaacggctgtgtttcaggcactgacattgtcatcaggggtactcagcag

SEQ ID NO: 11039 - DNA, 711 bp, Homo sapiens
  misc_feature (1)...(711): n = A,T,C or G
gcgcggatgaagccccccccanacacccccctcaggattagaaagagctgaccttcccgtaactagtttaaggtcatctgatcatgcgggtaagcgacattcttcagagacgaagggcctccctctcatctcactattaaggaagggtggaaagaacacgaacagaaagctctaccccttaacacgaagcagtacgctgtgtgaaacccgcgcgggcatcgagaggccccgggccatcacacgcctgtactactccgcctctcgtcacctaagtccctcggcggggggggcgcatctttcacacgacggcgactcgctctcgctagtggctgaggacttctgacctggtgccacacccatccgcgcggccgggaggagcggccctcgcccgcacccactgcgttctgggtgctgagccccacggtcctcggccctccggccgcggccgccgctatccgaacgctcggccgacggaggtggggcgcagggagctggcctcgccgacgcctagctcctcggccacaagaccagcgccacacacaccgccgcccgccgcgccccgccccgctagccctcagnctgttacggtgcagaccaccgctcgaacggccaccggcgggacgctcgcgaccgccgcggccctcgccccnccttacccctgtccgcagcgaccccgctcgccgtaggccgtcggaccaccacgcgcgtanc

SEQ ID NO: 11040 - DNA, 921 bp, Homo sapiens
  misc_feature (1)...(921): n = A,T,C or G
accttgctctccgtgtcccgttttcccttgtcgttcccgcccttaaaggagggcgggggctcgtgttggggtgagtcgagtgggcgtcttgagcgttgtggtaggatgctgtcgctgcgtgggtcgcacgcgtggtcggtgcgatgtgtgtggccgcggtgcgttgtcgttgtgaccggcggtgggggcgtgggggactccggcgcgtttgtggggacgcggtcggctagtcggtgggtttacgctgttaagccgtttgctctctttttaatgctgtgtcttgcgccgggcgggggtggctgtcgatgtgttggtgcgtcgccgggcccctgttggacctcgcggtgctcactcgttcgtggcgttcagttgttgtcggcttctgcgtgcctggggcatcgaggtgtttggtgtggtgtgggggttggggtgggcggggggtggagagtatcttctctttctgtcgcgcgtcctcgccgaggcgcggggggtggggtgggggtgggctccggcgccgccgcggggggggcgggggtggcgttttgtgtgttcgggcagttgggctcctgggggggtgccatcctcnactgcggcttccaaaaaaactgtcgctttctttttcgactcttccgacctctccctcgcacgattttttatagtttctttccggtggttggaccctggtggcgatggggggggggctgttggtcgggggggcggggcgcggcggcctcgctttccgcctagtgacgtgagagggaggtccgtcggtctctgaaaaatgtcgctttcctgcatgatctagatccccttaggtttagttcccgcgaggtgtcaggcctgcatttcactcctagggnnccgccnnccgtttcttctttccctctcccnccncccccnntctttctttttcccctcctt

SEQ ID NO: 11041 - DNA, 626 bp, Homo sapiens
tcccccgataccacccccgggaagaagcggttttctagaaaacacgagagctggcctattcactagcatcaagctaaagaaagtgctatgcataaggaaagcaatattataaacatagatgagggagcttcaaaagactaatcacataatagcaaaacttcaagccaaagttcatgagtcaaataaatgcctggaaaaaacagaagagacaattcaagtacttgaggacaaagttgctttaggagctgagccatataaagaataaattgaagatcggggggcgaaccttgttaaaatacacctacagaaaatgaaaaactgcataggatttccacgaggagcccgtattcgggctcactttaatgctgaatctaataaggttaaattgcgctgcctaagctacatatagctgtggattaagtggctttctcaaaatctaatttaatgagaagctacgtacgactctcgctggaaaacaagagccatcgataaaaccccaatatccctggctcatgacctacactgacgccctcacgactgggcgcgctcgcgcatgcaggccgacgcgccgccactaggttctgatgtgtgccgagggtcgacccccccagccgcgcctggctggt

SEQ ID NO: 11042 - DNA, 1189 bp, Homo sapiens
  misc_feature (1)...(1189): n = A,T,C or G
gaaatacaggagcgatatgttaatcaacttaaagatctcatcagtagatgcatgcgtctgtgtgcatgtctgtcttgttctctgagtatgcgtgctacaaggtgttacgtcatgtggatctgtcgataccggtagtctatactcatagcctgtaggacacggaattgatgaagacgcacacgtactcaactgaccgcctaccgcgttcgcccatacgactccatgtgagtcctcttactcttcacactaactgattcgtgtcattgctaccgtgcggacgccatcgtccaacacggacctcgtataagatcatatcaaccgccgcaacatcgccgggcgagctccactatgactcgcacaccattcattattcatcgccacatccgtttagttcagttacgctaccacacgtacacattactcagaataagattaccgtagttggattcttcgtcacaccctcctcgtcccagagtctctcgtatatccgcgtcgcgtcgtgtatttcgtcgcgctaccgcgtcgacatgctctgcgtcttgtgagacttaggtgctaatcagagcgacctcgctcgcgattgctttgtatancttagctgatctgtctcttatatccatactattcattcctctccgtctcgtgggacagtacgtctattcgctatgcttatcaattgttgcgaaatgctgtatccgtctgctgctgtatctactgatgctgtagtcgacaagccggcatagtaagatactttggatattatcaaggcgatgtcggaggctgtcgctgacaggcgaatgaagtctctccgaccgttgcgcggacggcatctcacctcataataaaacctctccgcctccttgttccactccttcgtttctatgctggaangtaatcgtgtctcttgttgctcctcagttcgtgaggaacgcttgtctgtgtgtcccgagcatgtgagagccgacgaacaataaatatcgccctccaagacttatttatgaattttaatctccattttgtttttttcaaattccggcttaatttatcgagaccaagtacccaaaaccacacaacaactcacaccatcatcactaaaatacatatctcgtcgactcttcgcgtgctctaccgctgcaccactacctacatcgctactactctgatctcgtccggattactatacatacca

SEQ ID NO: 11043 - DNA, 825 bp, Homo sapiens
  misc_feature (1)...(825): n = A,T,C or G
cacatggcagagatcggtttggaagtaatcttcttcggacatacgtatgtgaaaaatagacggccaggatactaaccggcttcttgaactctgcccctaaaaggctctcaacacatgcatctattagtagctacgccaccgtcctgccctcgcctcatttgcgataccccacctggtgtacgaccgcgtgtctcgtctcttcatataatccaccaccccgcgcaacacctgatggagactggtaactaccacactcgccctcccgccatctacacatctatcttctcccttatacttactctctccctgtaccttaanttaagtgctcaccgccagagcgcttgccgttccgcgcatacgccgtcaacgataccacgtaacccattcacctgtttccgcgagtccaacgaacatgctacatcgttgattatgtgtcgtttttacgagcctatatatctatatctaagcacttcaatttaagcttacttttcatactgcttcctcttacccacattggttaggaatcttacagaagcactctcggcgtactacgcgcagagcacacgcccacatgccatccgatctcataccccagaacgcctttctctttattcccccccccctttcatagactaaattttcttcgtagactacgataggccattccttagttacctttttacagatataagttatgaatatattcttccagctctttttttataaatgttcacacccatacattttaaatatactggtctcattacatacccccagttcttacaactaaccacaattctgatcaattaaaaaaaaaaaaaaaaa

SEQ ID NO: 11044 - DNA, 894 bp, Homo sapiens
  misc_feature (1)...(894): n = A,T,C or G
ctgtttttctaccattcattgtcgcgcggttgcgcgcggacccccggcggcgcccgggcggcgcttcccggccggctccgcggctgcgcgcgggcggcgncgggtgcccgccggggccgggccacgccgtcgggcggcgcgtggtctcgtggtgtggtccggctcgcgggcgggcgggggcgtgcgcggcggtcggggcgggggggggccgggcgcggncggcgcggggccgggggggggccncncgccaggcctcgccacgccgnncccncnncttcgccgcggggggggggggggggggtgcgcggccgcggggtggcggcggtgcgggcggtgggggnggcgcgggcggngggcggccggggtgggtggngggngccggccccgggcggggcgggcgcggcccgggcgccgcggngggggccggcgcggcgcggcggcgggggggcgcggccggcccgcggccggcgcccgcccggggcggncgggggccgcgcggggcccggcgggccccgggccgcgggggcgccccgcgccccccgggcgccgccgggggggccgctcggggcgcgccccccgccccccccccccgcgcgaaaaaaaatttttttttttttctcttcccccccccgcccccccccctcctcgcgcccccccccccggtcgcgcgccccgccccgggcccccccccccgtcctccccccncgcccgccggcgccgcgngcgtgtcncgggtcgccgcgggttcggtctgcctcttaaaantcttgctttccttgggcggngcnctttctttngtncnccncgaaagttcgcggtncgtnnccaacaaannctttctttttttttttgtccgccccccccccccccccccctccncccctttcttccccc

SEQ ID NO: 11045 - DNA, 508 bp, Homo sapiens
  misc_feature (1)...(508): n = A,T,C or G
caccgtcaggagcaaatattagcccatagggggcacacgagagctcaatcaacagtagcaacaagaaaggacaacggccgcggaaacctgaaacgacggaaaggggcgacgcaacaccgttagcgaggcataactacaaaggcagcaacgaaaagccgctggcagcagcagctacgcgctcggaaagcggggaccgcgcaatcacagaggggacaacggcaaagcgcagacgaacggcctgcagaaggccacacccctccagcggaccgggaaccaaaggccagacccgggcgaagagaccaccacgccccccgccccccaaaccccgccccccccgccacacaccccacacaccgcccccacccgcacacgaacgacaccccncaggcacccccgccacccgaccgcagaccgcacacacacccacgacccagcacacccccaccaccccccaccccccccacacgggcgccccccccccgcccccacgcgacagaccacgccaaag

SEQ ID NO: 11046 - DNA, 642 bp, Homo sapiens
  misc_feature (1)...(642): n = A,T,C or G
ctccgcgcatactagatgagtcgtcttacaagnatgagcacttgctgcaggtccaacagttatgactggattggaacttcatccggcntgggggtaactacaaaacactttcattcaacttatatagattccatgtgaaatgggaatgcacgaaggcatagatctttctgggctgattcaatttcctgataattgccaatcgcaccacacgaaatggcgttcataagggactcacactgtttcgaaaagggggggtggatatgaacatacagcacctcgacattaaattgcgataatcagaaaattgcttgatcacgccgtaaagcgaaatcgcacgccgtgcgggncttttctttcgtactgaggcggaaggatcctgttgccaaaggcccggcggttggtgaagcagggcggcgctcgcctatgagctccgcatgatcgtgaccatgggcgaacggacgtggcgtccgtagtgggcgcctgcacgttccgcgcggcccgcgcggcccgcgtggaggcaaagcagtgaacgtgaggacgggcgacggcgctggcgagcggcgtgcccccgccccgccgcctcgcggctgggtggtggtagtcgggccgctggcgccgcgatgtggagggcgcgggtggtgg

SEQ ID NO: 11047 - DNA, 1211 bp, Homo sapiens
  misc_feature (1)...(1211): n = A,T,C or G
cttcctcactctattgatatatntcgaaacagtatatgtacgatgtatgtcgagatatacgatgtgangttatgttgcatgtcacgcaagatgtcgcgtaggtgagagtgctctcgttcaatggtcgtgcgctcgttgancgtatagtcttangtatagagtgggatgatataagaagtgtgactgttagtatgactgttacatgaatgtgggtgattcagtagtatgtgagtgntcatgtacaagnaggtgtagttgtaagtgtatgcggacagcttagntgtatatacttacgaactgttgtttgaagtgtaattcgagtaggcagatgtggtaggagggtgtgtgatgtagatcctatangtgactattgtatattattgattatgttgtggcgtgcgtgagataagtttattgtatttgctcgtactcattcttttcagacgttccaacttgacatagtgtctcatgcgcgttggcgatacgagtacgatcatgactactantcgaagttcttgatcggtatcactatgtggtcatatagcttgttgaatagttattcgtgtggcttaataagcctgaataaatgataaacgaaggctgtctataaatgtatgtgttggtccgtagtcgttgctctgcactcggctggggaatatgtaagatggtggtatttatgggggggagatttgtgtgcggtgggtgtgaagtgtatgagtgtgtggggtagtgatgggcacctaaattttttatatttagagttattagtatatattttgtagataaataataaaaatggctagtagagttaacggtctgagtggatgagtatatatataaatgataatgtgatataataaataaagtaaggattgaaacgaaaaatttttttttggtattatattttttatttgtattatttgtttaatatttttcgggagaggaaaaggggcagggataggggaggtggcaggagcataggcgggacatgggaaaggcggcacgggagaatgtgatgtggggtgngggtgtntagttgtngagtggagngggaatgtagagttggngattgaggnggtntaggnggttatannnagtanntaaatangggnnntgggggntanngnnngnnnnngnnnnnnnnagaganttnnnannnnnnnntttatacanntnnaaatttattntttttttnaaattttaaaanaaaa

SEQ ID NO: 11048 - DNA, 610 bp, Homo sapiens
  misc_feature (1)...(610): n = A,T,C or G
tcgcggaatattccccgcaaagagggcggccttcagctgccatgcatggcgcttacttggctcctgcaacctccgcctccgggattcaagcgattctcctgcctcanccttgtgaggggctggggttacagaaaggaccaccccaaagagaacatgggttcaccattgtccccctcagtcaaggttatcttagcatgtcttctcacacaggggagggctgtaagtctcatgctacttgggactgtgttgagtatgtttatctaattattgggggtgagtataagagcattcactcatctatacatttaagtcacatggtattttatccccattttttttgtcttatctggcgatcgagaacttatacaagaaagaaaaaaatgacctcattggccctaacgcgggagctctgtagccgttccctttggggagggtaatccatgaccctcccgtcctgactccctgcactgggtcgtctcgttcccgcacccgcattatgtccctcgaagcggggatacgggcgttgcctggatggcttgggggccgtcggagccagtccgcgggcaacgcgccggctggtgggcgcgacgtgcgaaagcggctggtggtg

SEQ ID NO: 11049 - DNA, 624 bp, Homo sapiens
  misc_feature (1)...(624): n = A,T,C or G
gggcgccgtacggcggccgcgnaccgccccgcttccacacggcgggcatggcagacatacccctttcaacgcacacagagaagtggcgtgaagtcaataaagaaacagaacaccattgtgagtgaggagggatcaaaaagaatacagacatttctaaaaagccatctttaaatatgccattgtacaagctgcgtaggagagatgttgagacaaaagggggtgactacgcatccaccgtaccatgatgatgctgggaaaatgtgtgtccggccatatgtggggggacctcgtgcccccagggtataacatactacctcgtctgagaatgaaactcaatcgctccgcctcgggggctcgccacgcggggnccccgctgatgtcatgggaacggcgctggcgcccaccgccccgcgaggcgacgcccatcctacctcgccgcgggcgtggcgtcgcccacggcgaccgcccggcgccgcccgggggaagcgcacttgcccgcccccccccgtgcgcctgcggctttcacggcttacgacggtcgagtcccccttgtgcgacgtcctccgctccgcgctcggcgtagcgcggagtacgggaccccctcggggttccgggcgcgggcac

SEQ ID NO: 11050 - DNA, 929 bp, Homo sapiens
  misc_feature (1)...(929): n = A,T,C or G
ggggcggccgagggaagcagaaaggcgggccttcaaggagacctattcaattcttctttttttgagcggcctttttgactgaaggcaanctcacanatcaaccacaccactaatgtacggggggctnnaaccatatacccatntaaactcatctctaaaatccttnttaaaattaacacancgtcactctttacacacatcccttcattatatttaaacataaaacctatttcttcttcttccattcacattaantcatnatntaacaatatgggggggtgggtccttcagagaattcttgaaaaaaaaaatatacacaaaactcctatcatggatgttctcaaaaataaaaaataaaaaaatcaacaacaaaatggccgccgggaccccccccccccgtgcgtggagagccgatccagcgagtccccctcggcgccgcggcgccgcgcgcactcgtgggtgtcggcccgcgcggggggccgggcggccgcacgcgcggactcctccctccacaccgcaccccccccaccaccagcgacgaacgcccgagacacctaaagccccgcgccacactcgcccccccccacgagggcagcctgccgccaccaccccatccaccccaccacccggaccacgccgccggaccgcgcgcccccaacttgtcgggcctcacgtcgccgcatggcaggaccgcccggcgcaacacgagaggcatgccgggcttcgagcgaagacggcgcgggttccgagacgcgcatgtccttctgacacgcacgcgcaccctgcagccagagcacgacaccctggccggggccgagcaccttgccaactaccccgcaacaccacgtggtgatccgtaatggccgctgggtactgtagatacactcgaacgacgcccgcgtatgaagtagagagtcgacgaagagatg

SEQ ID NO: 11051 - DNA, 885 bp, Homo sapiens
  misc_feature (1)...(885): n = A,T,C or G
tcagcgtgggctcgcgtgtgtccgtttcgccgcgggtccgctccgcccggtgtgcttcgcctagtcttgttagtccccgctttcctctccctctcttgttcatattttcacgcggctatttgtcggcgaatggtgacggacccgacactgtcgcaccaaggtgcactgcgcttgtcctggcgccgcgatgttcgggtacgcacgtgtgtctgttggcacacctccgatttcgcccgattgtctctgcggtggtgcgcaccagcctcggcgatcccctacctgccgcccattacccgcgcggggcggtccgcgcgttntgtcgcgaccgagcggttcactgtcgcggccggctgcttgtattctgttctggtgttgtctccggtcccggccgccgtatggcctacaccgcgggttcgcccgatggcgtgcgcgggttcctccgctggcgcggtgtggtcgggggtgtgatccgatgtgcctgtcgtctgtttttgtgcgtataacgttgtctgctccggtgcctgggcgggcgggcgcgtggggcttccgtcgggtgcgcggtgtgcgcccgcggggtggctgtccgctacggcttttttgtccgcgcgccggatctctgctcgggttatctgtgtgtttcatacgtgtctgtttgttcggcgttgctgtatgtgtgtgcggcgggcccttcgccctctctgcgtgcgctttgtgtgcgtccccgctgtagaggattatccttgtcttttcgtttgtccccgcccttggttcttctcttacgccgcctgctagcgcccagcctcctctctggctcttttggattatccggtcaatcccacgaacacgcgtccgataactgggtaagagggcggcgcaggtggctat

SEQ ID NO: 11052 - DNA, 724 bp, Homo sapiens
actttgctgatcatatttctattggctcaggatgagttcaggtacttataattcacatctagttttctctcctctctttcttttaacttatcagccacctctttcccttctactatcctggttaaggttgccagctgcgcctgatttgttgacattcttcaacgtcttgatcagactcttgtcgcttttctagccttcgaaaagtatacaaatcaaatgggttcatgacgatttattcagtctgcagcgcacctcagtggtggcgtgtgggaactctatgctacctaacttgtttttcggcgctgaggatcgtcgggggtgacagaagggagcagggtcagatcaagttaaacctcagttacatgttttcttttcgtctaacctacgctggcgtaggaatacacacaaccacgtgattcgtcacgtcggcgtggtccttgggcttatctttttatctcgtaccataacttgtatcgtgttgcccccctcttctcagtatatgaatttcttggcgtacgcacagagctttttttggaaatttcgttttggaccggttctttccttcaccccccccctcataattataaaatcattctttattcctgcctccccttatcttttgttcgttgtaatcgaaccttgttgtaatctctttcctctaccttcctctttctcttagaaaaagaatatgttttataaaaaattaattttattaaaacccccc

SEQ ID NO: 11053 - DNA, 1490 bp, Homo sapiens
  misc_feature (1)...(1490): n = A,T,C or G
cttgtcgctgtgctgtcttgcgncgtcgcgagattgctantcgcggacggacgcgtccgcggatggtccgcacgtcgcagcgttcgtgtgtgctgtgcagagggcgcgtgtagtgcgagctctctcccgcgacatngtngctgcgtgctgttgctgtttttccgtctgtatgtgtggggcggcgattatcggtgtggcgctctgcgagcgtcgtcttatctctcggtcgcgatccgtcgtcgtgcattgttcgcggttgcgtcgtggcgtccttctgtcgcgctcgggcgctgtttcgtgcgtgttgcggggtcgccgctgtggcatgtcgcgcgcgtcgtatgtgtcggcctgcgttttcttttgttcatcttctgttgcgcgtttcggtggtctgttccggtgtccgtgcgcgcgtagtggcgcgcttcgctttgtctcgccgcgcgtgcgtccttcctgtgcgcgcgttcacgttgatctgctggtgcggcgctcgcgccgctggtctcgcatcacatttacgcgttctgcgctccggttattgcctcgctctcctgttctcgcgccgctgctctactggggcgtggccgttcgggtctgctgctcaccgctgtcgctggtcgccgcgggcttcgcgccctctgttgtgtctcggccggggcattgcgtctactgtggtcgtcgcgcggtgccgcgcgctgagtgctttgacggctctcgttgggtcgtcttcgcgagcgtcgacgcgcggtggtgtggttgtacatcatcgttctgctgtcgtctctcgcgtctgcgtcgcgcngtcggtntcgttctngctccgcctgctgcgatgtctccgcgccgcttgtcggtntctcgcgcgggcgcggtgtctactgcgtcagcgactttctttcgcgcgaggcgggtctctgtgctttcggttgtcgggttgtttggcgttctcgtgcgcgcgcttcgtcgatgcgtcgtcttgtgcgcgcctgtctgttgtgttctgtctctggcgcggtgttacgacgtttgttgtcgtcgnctgacagccggacgccgtctctgcgtgtgattcgcctgctcgtcgtcgctctctctngtccgttctaatgtacacgcgtcgtggttgntctgtcttgcgcgggctgcgctgctcatgtctgctgtcttctcgttgcgtctcgcgtgtgtgtagtcctgcctcgtcttattctctgctcgctcgtctttcctctccttcgtcatcttcgtacgtttcgaggctcgtcccctctgccgccgctgcttttgtgtatggtgcggttgcgtgacgtccgctggtgacggtctcataatacagantaannattggtgtctctncngtctgcgccacaacnagccgngtgtgtagttgtttcgcccgtgcgccaccgcgttgttttcatcttccgcgccggcgctcgttgttgtctgtttattgccgtcaggtttgtctcgctattcgcctc

SEQ ID NO: 11054 - DNA, 967 bp, Homo sapiens
  misc_feature (1)...(967): n = A,T,C or G
aggcgagcagccgagggagggggagaggagggggcttcgaggagaacaaaattcaactcagctaaaaatcaaacattctcttcttacccacagggtggagctggacaccacctacaatcaaaagactacgggaaggccaaccaataaccataaattcttcctatttttccatcaacacatcatcacttaatatcaanccaatatcatcgggattaaaccgggcagtgcattctgggcaactaatattaactctggtttcagagatttctatccttaaataggggggggggcaatccacacgggatctgggaaaacaaaacattatataggagctctggctttagaatgcccgaaaaggggcaaagggcactctatgaagtctccaatttcggttgctggcgggggtgaatccattggcacaaagggatttggagagaaatgggggtccttatcacgacacatttcagaatgggtacttgtaatacttgggagggcatgcacccccgcctttagctgccttggattacgggcggtagcttttttcctgccagacaggggacctattggaagtcttctttttttgggggcgcttttgacggggagggcccctaccaggtaaaccgagggacgtggaagctgcgtctcgaacccacttgccatgggagactccggggtaaacgcgggggtgaaattggaagccggggagggggcagcgaccgggcggtcttaaattcaagagaggagctcgcgtccggtcgtgcgtcccactgggcctgaggggagaacacgcccctggcggcccgaagaaccgtgagcgggcgcggcacgagaacggggtcgcggtgcgctcggacggagaggaagacctccgacccaaacggggcaagtgcctgtgcggccccggcggggtcgcggggctgcgcttaggagggaaggccggggggggccggcgccgggcggggggggg

SEQ ID NO: 11055 - DNA, 1835 bp, Homo sapiens
  misc_feature (1)...(1835): n = A,T,C or G
ctgctcgttacatcgcgtaatacacatgtcactcactccatanccacactcncncactcactccacgacgtcgcatcgtntgaatagactcatcttgttatccgccctcgtccccacttctacacacgacgcgcttgcatgttcaccgcacgatncntctacaagaaagagtcgacttagtgaggtagctcgatgtacactagacnctagcgcggcgacgctggcttaatactccgccnccaganaagacactctggagccgatgtcagcgcgcctggccacacgagccatttctctcacctacgacatataacatgaacattgacttacgtttcctctctctccctgtcgctcncacaccgcgcctctctactatacacgcgcgtcggcgtggagagacgntacacgcatatgttgtaacgactccatcgcgatatacttcatnctgccatccctnttacatacanttcactcganacannantngcaaatacgtatcctaatcacactctcactctcgtgcttcgggagagcgtcagatcatatctctgaccgcctcatatacagtaatacagcgaccgcatactctcactcctgtgtccagcgatnacacncgccgctacctgaattctcaccctcgcctcacatacactcatcgcacgtcatattgagancccctctaattcacactgacatctcaagcacgctcacacactcgcggagcatngcagaatagctnagatcactntnctgtggatgtctcacgcgtaggtgctggctgatgcgtcntctcgctgtgctcgcgtgcactangancactatatncacgcancaggtgacgtgaatgtgtntccgagatataatgtgtgacctctagatnttatgagcttaacgttatgatagcttgcantattgcgcgntctgtctcacatcaatcataagaaatattatatcanacaatagatatcacgtatgtncaccatcatganatcgatatntcgacacntctgacacatacgtatgtcacatagatactgtcacgcagncaaacacctatcactacatcgtctgctcagcgcgtactnancccactncctctannccatattantcanatcananttcagatgntgtanaacactcataaacgacatatnaagtgatagatatatgatgtgagatgttaactactcgatctacagattnntacacttatgtattntatcgtcaatttactctatacatntatacactcctgtaaaatatnttaatattntagtaaccatctactatcgtatctagactgagagcgactcactngnagaccatagagatanacaacaccatgncacacgtagtagacagatatagatctctagcacactngcgatacgtctntcgctgcggctgctgcgtnctacgtacagcacagagtatgagncgtgcatanggcgagagatgtganatatcngaatgtgatanttatgnnctgcgatgtgaacactggctacgttnactntgtgnnagaganctcncntcgctgctttgtcatcatacttatncgacatgtgacggtggtnnnnntcatcgtngtctntctgcgctannanntnacttccntnagtctcatatcaggnnncgncgatnntatacaacaggtatnntnnnnnnnnnnnnnnnnannnaacnntnnnnnntnntnnccataattantnacaccgnnnannntnnnntnnntnnnnantctacatccnnnctttncccatanncannatacctctattnntcactttttnnnnnnnaaaaaaantttttttnnnnnnnnnnnnnntttt

SEQ ID NO: 11056 - DNA, 601 bp, Homo sapiens
  misc_feature (1)...(601): n = A,T,C or G
accagtccccccagcccgccgcagagacgcccccctccacgtttacattcccaactctctcaacacactcatctaaaaggattatctcaatctgtcctccttacctactcaacaaccaagatccgtggtccatcacctaaaactcnaancaacaccccccancncaaactcaccactcctaaaaacaaaccaacacacacattaaccttttaacaanatcacaacttctacccctcccccccatacttcttattcctaatcctacaaaccaaaattcataaaaccctacataccctttcctggggggtggtgctccctctttacgcggggggctncttctataaaaaaaaaaactgccccaacactcgccttcgtggtctttcatccttcacaacaccgcttttcctcccctctctccacagaccctaaaacacaagactaactgtaagaaagcgatgaatcactggcgcgcactcttcacaaagagctatgtccggacctctacaccactctcccaccacacgcaactcacccaccccaacgaactcctccttgcaaacaagaaacaccaaaacaccaaaactgcgccctccttcccacc

SEQ ID NO: 11057 - DNA, 1374 bp, Homo sapiens
  misc_feature (1)...(1374): n = A,T,C or G
acgagtattcagttaagtgtatcatgtaatgaggagcagaaccgagccggccaccccttcntgacggatgtgacaataccgcgacacacaatcgcctacngaacnagcgacataaactcgtgcaaacagagcatctatacttagtatcgtcgctccatacatacgacctgcaactggtcacgtacaccgctaccactcgcgtctcntaccgcatctgacatacgtacgacacgncacacactatgaacgcgcacacaccacggactgagcgtacacaaatcgcacgtatgctcgtcacacacaccgcagacactaatatggacnacacgtatagtaccgctgttcataccaggcatagatctaacatctcctcacacatcgccagcgcactggcgtcttatttgcgtaatcccctgcacacgcaacatgccgtacacacgcttgttatcatccactcgagcaactatatacctcttctacacgtcgaaccattcctctgtcgaacacccctgcccncccactactattctagcgtttacttctaacaaagcgctgtgctagtaatccttttgtccggacctaatacgataatctcctccacccccgagtccattatcgctcacctctcacaacatctatcagccacattgaaccaactcccagccanctcactcgccccacttcccacgacttccgcccccaccatacatgaacctctatgacttcccccacctaccacctcagcatcatactcccccaaccgcgaccacggtcgcgtggactacctctgtcacgctctccgtaccacgtttaattagacatctcgctctacgcgtcgcccacccacgcccactcacgtctccctctctcctccgtccaccgnctctcatctcaccacaccaccctccctgctccaccacgcactacactaccccacctgccgctccacgcccgccgctcacgcntataccacggtaatgtctccgcgtcgcaccacgacgtgtgcgcgtatccatcatgatttgaacacggcgaccgccactctctctcatttaccggaccgttatttcattangaatgtcctatgactctaacttctctatcacgttctccataagtacacactcacctgcatacctctcaggtagagatgcgtacgcccacgctccactctcataccactccgcattatctgtcntcacaccgctgcacatactcagacgcacgcgcgtccacgcgtgcactccatccggacatctcaccaagcgcctccagtctcccctcgccgctaagaccaccggttcactccacgcagccatctcccgcccacccaccactgcgctatccctgctctttctcctctcctgttcttcg

SEQ ID NO: 11058 - DNA, 1113 bp, Homo sapiens
  misc_feature (1)...(1113): n = A,T,C or G
cattggatgtggcgtcagttcgggngagtagtactgctatcggtcggatgcgcacgagcataagagtgtcggagagagtagggatggcgcaacgaatatatagtaaggaagaatggtatgaaatagaatatatcatntaggataacagtatagagcgcgagtcttgcgactgtagcgaggcgagtagacataatggtgcgtgacgaagattaaatattgtccaatattgatctgccactagtcctctcttataggagcgtgtatgcgtctttgngagatacgagtatggatatcctcatgtgtttcggcgacacgtggtgtatgatcatagagagagcataatatgtcgacttgctatgatttggtatcgtagctgtgcttggtatactcagatatacgtcacaccgtaccccgtaaggatggcgcggataatcttataaactatgagtgtgtcatcgacctgcctgagggttgtgaattcgggctatttggccgaacagtcgtgtcgttgagtacgtgagcgattagggtggcttcattattaggccttcgcgccgatcgcatttatccgcctcgttagtcggaggtttgacgctcccggtctacacagtcggtacgttcggatattacatgcgtttcggattctagagacgcatatccatatggttttcgcgccaaatctcgcacagcgacgttccctcgggtgattaggggtagcaaaatggtagggatgggatcgggaggaagggagtattcgaggataggacaaattatacggcgatagacggaaccaataatatactcacgcataaatacgattatagtagcacagcacagtagagtgtctattcatgttatggactaagacatgaagcggtggggtatgattccatgtcactcgcgctatatatataacttatacgaggatagtggatcgttaactaatctcggccgtgagcggtagcgctgagttaccgcaagatatccggtcgatggatgctttctagttttatagacagtctactcttatcccaccgcatccgcgtaaggctagcgatcactcgacatccgcctacgtcggtgtcgcgctgtattgtgaagaccgctatgata

SEQ ID NO: 11059 - DNA, 790 bp, Homo sapiens
  misc_feature (1)...(790): n = A,T,C or G
aaatgatggtctatcttatcttgtctngacaggaaacggcgatgtatacagaaataataatgtaccaaggaaatatatggtgtcgtaagagtgtcatcagttagtatctatactataaagtaagagaaggtcgtggcgtgatggtcagccttgagtaatttaaaatgttgtgaaatagactaattgatttgtcgttaactcataaaagcggtggaggtgaggtggttgtactgcatgatgaagaagtgctactcaagtgaagtacaccgctcgcaaaataagaagaagagagagaattgataccgcttcgaatggcgtaagaggatatgagccagcaggaaggcgaaaaaagaagaacaaaattcacagaagcggaggacacaatagatgggaatatgagcacagtaaaaggaggaaagtaaaaaatcagtggaataggaacgcggagaatagttaagtaaaccactgtctttacacctccagtaagtggtcgcatctgaggcaaagaaaaatataataagagaatgcttttattggcgatgcatggaaatgaatagccattccttgtcaattctcacctgtacttcactcaaagactgagtatgttacagcaaagatctcaaagggaaaaaacattatgtgtgatgtcaaggacaaataaatgatcacatcaatcaacacgtaatggtatggagagatgagagatgccagaaggctaaaatgcaactgcaatcatcttttattttgttggaaaataataattgttgtaaatctaaaaaaaaaaaaaaaa

SEQ ID NO: 11060 - DNA, 1737 bp, Homo sapiens
  misc_feature (1)...(1737): n = A,T,C or G
acgcgcggacagcgattatttctagcgccgagtaaaaaaaanntttgtttttggatntaacatgtcgcgacaacnangcctancaacgagngnctacaccagtnnaaaagggatnntattctnngatcgtngtgcacttcatngaacntntatatcggacagaaaaccgcgagtatggcgtgtgcgtgctgattcgaaaactctcgatacgtccaagaacagggacgcgacacaccatgtcaagcgagtatatacatcgcatgaacgcttttgacanacacagtaaatactanacagaacgtacacgtgttagatcctctatctgatacgtatgtatcacatctacagagtctncttgacgacgttgacnccgacaggactaggtctctgtcattgtctcgttacatagcttcgcacagatgcacagactactattaacacacgccgtttttgtttatcgtgtctcgcatgagagacagatcactgcactgcgcgtctatatcacccaacgtcacacgatcactgtacatgtcagtagtggacaactaatgaggatcgacacgtcgtgatcactgtatgtaggtagtgtatcactgaactgacaaaccacagcgaccatctctacgtgccaccgtcgatgctttcggcgacgcaggcttagagcacngatacatactcgcgtcgtcacgnanatgcagtgtgactccatctgagtacctatctatcacacagatactagtcctcggacacctntcaacagtaagatcggcaaggagctgcaactacatatancgtcgcatctgcagttcgtcgacttctcgacanagcgcgaacgttagatngtagatcttncacacatcgcagactganctaccacaagctgtgtcancttcgctacactcttanatagtatgattcagcatngtcttatcaatccgagctcccgttcgctcgcctcgcatataccactaacactattctcttgcaatatgttgagcactcacnacgcacgctaacacgttgcgtatgcattcatcgtcctctagactcttcgactcccggaactcgacccacgcatacgatcaccacggctacatgtcgtgtcgatcacaattacacnantcgtgtcacactangtgtccgtgctcgtctatctcacgcgacntacgatntctcancacgactcgtatgacgactatcagtagaacgtacagcgttatgttcgactctacgtcgactgcactcgtcatatgatgcgacgngctacgattgcgacnaccaactagacgatacnantacangntantaatggagactcgtcnatnctgtgcnacactgtagctacntgcgnaggctgntcgctgctncnatacntgtncncagcacctcgctctngtttatagcgncacgacgggcagtanngagtnatnantgtcgcntgcnacgtntacgnctgtctgcttcatnctctgatcntagtgcaggattgtctgtgtncgtcatgtactncnattctgcctgactgatcacagacagctccnatctacatcgtgcactactctcgctgagntacgcgcccgaccaccgctcgcagatnatgctcacgacagtagcntanagcngcntgctcagtntcacagcancanntacancatgcacacgacacacacgcacgtagtcagatagacaagcgncacgactcgacagacgactaactacagnatacgagcgcgntcg

SEQ ID NO: 11061 - DNA, 1212 bp, Homo sapiens
  misc_feature (1)...(1212): n = A,T,C or G
agccgacgcgaacaagacgcagagcgaccacccaacacgcaagtgcagagaaacgagccgcgcacagaaaggggtttgcggtgcgttgcaangnnatatncgactcagctaatacagaggtcntacacacagcaaagcactgataatccagtagggaagtctcgcgtataatactgtgttgacacaccagtaaagaccagatactacaattatacgctgtcgtgcccgtataactataaagacaagctagaacgcactactacttaaacgccaaccaagtacagcagtagatggcgaactgacgaacagcacagacagtcgaagagtatgcaggtagacacattgccgaacacatcaatgcacataggagaacttgacacaatggcgctacacctcggcagtcacgactcagacaacgccatactaatatcatgcgagtaacgtgcacacctgtgtatgctctctgcactcgcacaaagtcnctcctgcaagaagtgtcgcctnactacacacgcatgggacctatatgtcctcttgtgtgccgttcgtcgacaagtgcacgggcgcatgctgagtcaccagaaacgagtagtgcgtccaatgcttctatcaaatggagtacaccgtctcgagcccatactaccaccccaaccacttaggcactaacggacctcacttagacactaacaccgtcgtcggaccctatgccgcaaaagcgatcccgccacgccgaagttgtcgaagcgacagaggcacctgagcaaccaggtcaggcaccctccaacgcacctacgttcccgagtcccacacccggtagttagacttagaaaaagagacgttgcgacatattaaccggcctagccgcagctgaagcaaggacgcgactcccgcgggaaggggcggagcgggcggagacaaagctcgaagacacgcgagcggagcgcgataaccgaacatccagacctcatacactaaatccagcaaatatctacacgccaagtcacagagggcaagcgacgcaacatcaaatacacaccacactgcttgccgcgatcggaaactgaccagccgacagaatatgcacgcaaagaacaaccccgcccctggatgagggtgaacgccccatagcttaccgcccccaccaaaatacagatagaaacaactaccgccgaaaaagaaacaccaaaagacacaaggcgcgccatcagatgt

SEQ ID NO: 11062 - DNA, 1042 bp, Homo sapiens
  misc_feature (1)...(1042): n = A,T,C or G
aggaaaggagaggggagaagagangnngaggaggngagggngggagaggnaggagnnnnaaaggnnaggaggggaggnnaggggaagaggnnaagaggnnaggtggnnggggagaggnngagaggggagggggaggaagagggaaagggagaganaaagtatagtaaaagaaacaagntgtgtggcgttttttgaggttcggccggagttctagtaggttcgttacggggtaggtgggtcaagtacaaatggcaacagtcccaacatgatgtcagggctgcnnccgggcgtgttcgtgcgttaatgagcttcgtccaggtgtatncacatcgtccaagggcatacggatacggcggcnctcggcgcgagggcccctgtcgtccaaataattatctctggtccttgtagttcagcgcgancccagacgagtataagagagccgttctgcnaatagaggtatagtaaaggtacatgttattgtgtttcccgtcctcccaacgctcctctgcatccacacgtgtctcagacacnaatatgaggncccccggtgggnccctgtgagtgaggtnacgcagcgtcacgccggtccacctcgccgcaacggcccacggcaggccaacacggccctcacgtncatgtgctnnncgttctctgcgagttatctgtntttcaacacgatgtttnattgttttcctacgctacaaggtcctcggcccacggtgctccgcagtgtacgttaattacttncgagtatcgtatttacgccaggtggncccagataagtatacnagccctcctcgccgcaagtcaatagacctcccacagacttaccctaattcacggaagtgcccacaggccgaaacgaggcgtccgagcgatacccttatcgaggcccacccccgctcatattgctagnacacagaggtccaccgagaggcncccgttgtgcncccatcgagtcgacgcgtttgagaggcgnctatagagagtcactagtgcccacagagggccacagagttcagccgaacacaggtggaaaaga

SEQ ID NO: 11063 - DNA, 694 bp, Homo sapiens
cttgacacgatagttcaatagaataacaatttgtttttccctataattaaattacaaaaatgcacctggaaagttttacgctattgtgttattcgtttagaactaaaaggtgtttcataaacatccacgtatttactcagtaaagcaacgccatgataccccgaagacccacttattacttggggtgacttacatgaaatcgtcaaaatcgctttttaatagggatcagaatatttagtcgagtcggtaacttttaaaaccatgatacagggtcaaagagattatatataatagtagtgaggaatcatgctgggggaataaaaaattttcctaaaatcttataaaatccaacttcttttaatggtcacacaagttagcaggatattaacccttaatgaattttgaatctctaactattttagtctctgtgtcatgtaagaccataatatttacagatttccacttatgcccacacttaggtttttagtaaaggccacttatttcttttctgtttttgctttattacttgtgtctttaaaaaaactgtttttggctctcagtttattttcctaggtacttatcatttaattcatttaatcctgttgttttttaatcttatgtcattaatttgttttgtttaattcgttttaagattttatagcctgaagtaatcattaaatgtactatttcgttt

SEQ ID NO: 11064 - DNA, 957 bp, Homo sapiens
cgttgtgccccgaggccgaggcgggggccagcggctcgagggcactctttggaaatctgctttttttggccgcccttttgactgaaggcgagctcacacatcaaccacaccactgaggatcgcgggctcaaaccatatccccatctaaactcatctctaaaatgcttcttacaagtcagacagggggcgtgggttacacacaccccttcattatatgtagagataaaacctatttcttggtcttccattcacattaagtcctgatgcaacaatatggggggtggcgtccttcagagaattcttcaaaaaaacaatttacagaagactggtgtgctggatgggtctgaaatataagagaccagaccctcccgatccaagagcgcccccccgcgccggacacgttcaacctccgcgcgacgcggtggcgccgcgcgcccccgcccgccgacgctccccgccggtaagaagatctcccccggctgcgcaccccgcccgccgccaccacccgaatagcgttcgtggcctcaccgccgtggattggttgggacgagcttgcttttcgcacaccgacaatcccccgccatatcccccccgccccccgaccttgctagtcccttcctcgctcactccctcctccaccttcccccccgcccccccgcgcccctcgccccggtttgcagccattcgcggttgtcgggtcgacggggggcgcgcggccgtgccccgcggcacccgcccaccgccgggtcctcaccgcgccgctctcaacttccattgcgaacgcgctacgccgacggacccgcgccgccccacccgccctctgcggttgaacgcaccacaggcggccgctcagccactcggaccgtgcagagtagcctcggtattccgccctagtgcccactccatccgtgtgacgggcgccgcccgatgcggagaggcgcgcgcccgccgagcgcg

SEQ ID NO: 11065 - DNA, 689 bp, Homo sapiens
aaagtggcccccctcgctcccaagcctggggggcaaaggcgaaattccgtttccaaaaaaaaaaaaaaaaaaatagccaccttctattccctgaaggaaatcacttccataacctgtgtagaccccacatttgccaaatgatcatagatctggtcactggcttgacttggtagttcccagcatacaccagtttggaattcttctgctgatattagaagaaactcaaaaactctccaacagcttatcatatagtctgttcagaataaatgctgttctcattactcctttgggcaaacccttaaattggattgagatgttggtttggggctgctcaagggcattagctatagctggggatagcttgatttttctcctttcataatggacaaatcattatatacagaaatctaaaaaattctgcagatctctttatggcaagaatatgaaatcctgcttgttttgtctcgtcttttatgctactcttctctgacaagcccatcaccataaaaatggctactgaactgggaatattttcaaataaattaacttcagtgtattttgtttatacttatgatttattcaagatattgtactaggaagtgcaaggtgacagtgatatgacatctaaagtagcttaaaacttagcagagaaataaatgtttatacaattaaaaaaaaaaaaaaaaaaa

SEQ ID NO: 11066 - DNA, 229 bp, Homo sapiens
  misc_feature (1)...(229): n = A,T,C or G
caggatagagtcttgctctgtcacccnagggtggagtgccatggcgcggtcttggctcactgcaacctctacctcccgggttcaagcaattctcccgcgccagctactcaggaggctgaggcaggagaatgatgtgaacccaggaggcggagcttgcagtaagctgagatggcgccactgcactccagcctgggcgacaaggcgagactccgtctcaaaaaaaaaaaaa

SEQ ID NO: 11067 - DNA, 1634 bp, Homo sapiens
  misc_feature (1)...(1634): n = A,T,C or G
tctaatacacatatatctacagtgagangngcgnctggtatacaaagtacactantgtntctgacacgatgtagtactatatantacgtgatcttaanatantaacggatgatgtgtgtctcacgtactcaacggtntgacgatacngcatcacttcgcgtangnctacactgtggcgcgcgaatactgattctacgtatatacngcggagtactacggtgtanatcgagctcttactcgatngatgagagncgcagctnaagtanctcacactatcacgtacgtctcgactgtaacatctgactcagcatcacngcangcacatgttcggcgtgtatatgatcgtatcgctgtatctctcgtatcgtcacatgacatactcanatcatgtatcgacaaacatatatggatgatgagcagaatgagtctagcagtgcagacttcagtagacctctcgcacaactgcacactntcnctacggcgnccacactacgcacgaagatgatacgcgcacgtagcgtagccatcaacgccgcgcgtagctaccagcgtcgtatcaagattataatcgtatactaccaagacatagatcatgcgcaggatcagttanctcattatgcacaagtagaaggtcacgacacgacgaactgctgtagaacacgagaactaccgaacaatagcgaaacacagcgcagtgcgagtgctgatcatcgacgcgtacacgcaggtccagcgatgcaataatcacacgcgaagaataaaggagatagaaagagatggagngacgatggagatattgtggagagtagacaagcctcggtggttatctgtatagagtatgtggcgcgtcagcgtgggggaggccgctcattcgtctaccctcgaatctgtccgctcagctacgagtacatcacacttgcgtcccacatcgtatcaatgcctacattttcatacatcatacactcacattctgctcttgaagattcaggagaaaaagctaaatacgagtcgactatcaaagatagaacttaatagtacttaagagagacactaaccaacagccgtagcttattcgaactcacaggtcgctgaacatcacanaggtttcgacataacaaccaaacaaatagcaaaacaatagagaatcaagaatncaaccaatatctctacgaacgtcataatctagatcgccctggcgcgtccacgcagctcgtaacgcgtgcgtcgaggagaaggncatgngagaggagtttgtccaagtgaagtatgtatagatatcgaggagtaggccgcctaacaagacgcagaactaacacgatctatatgatattaagtatntcgattattgcagcttacatagtcatgctgtcttatattatcaccaactacgtcaatatgcgtncactacncgatgacatgtacattgtataggtatctctntnccaacatgctattactggtcactctcgcgcgtattatgncgtttcanncancaanntnggtncnnntgctaatanatnnntttctcnncntntcntcnncntctactactaccacatccactaacattatnntntctcctcctctnttnccttccaatnnnncctttcnnanntctntatactcctcctccc

SEQ ID NO: 11068 - DNA, 928 bp, Homo sapiens
  misc_feature (1)...(928): n = A,T,C or G
ggggcgggccggaggggagaggggggggggggggcttcgaggagaccaatctagcatctcttcctctctacagggaccanggaacacacggagtgccttggcagcctcatcattgcaggcaagggggggcanacaatatctcactncanccacctttctacaggagacaggaacactggccccttcatccttaggtataatgcggacactggcctccttcatcctcagactgtggtgctgggatggacccctctgcgagggccttgggagggggggggagaccatcanggaaggtcctccaccaaatgaatggataccatggatcgggngggatggagctcagggggaggcgtgctggtctccctgccttagctaggatggccctcagaaagggggacacccaggcctgagcacaacggggcaaacgtggggggggcatcataggactggggctgggccaacaattagcccgacgggagcgttttacaaacttgttggcaagtgggaggaatgtggcaccttccctgcccgaggaaaaagagaaccgtcctggcggcatggggcgctcgaatccaacaaacaacacagccacagggggcctcgtggccgcaggcggagacgttcagcgggccctgcctttagggagggggaatgaggacgctggaaccgaagtcggtaaacggaggctggggggtggggcgggcgggcgggcgcgcgcaggggggggacgccggatcgccaagaggggcgggagcccgaggagagactggagcgagagggcccaaaaggcggcgaccggcaaggggggcggggtggggggttggagggtcgcggcccgggaggacgacagaactggcgctagaggggagcgagagcacaaagaatgaggaaggggagggcgcacgtgaacgccgcgccgcccgaggag

SEQ ID NO: 11069 - DNA, 1437 bp, Homo sapiens
  misc_feature (1)...(1437): n = A,T,C or G
gtgatctgcatttgtagacggtatggctgacgggctacctccgcgcagactccggcgcaccttgtccgcggcgcgctgtagtccgcttgtggctccgtctgctgttctgtcgcgcccgcagcctcatagtttgagctccgcgtgactagacgtactgtccgcactaacccttcgtctgccaacaccacgcaccacagggcacgccgcctcctgcgctcctccgtgcgtctcacctgccaccgcgctccccgtgccgcgtgcgtctacgtgcgcggcggctgccgctggcgtgcggcgcccgcggcagcgagcgtcgccgcactcggcgnggtctctcaactcatccctatctcctctcccatatactccatcatcttcctactatntcctcatcgtcnacattaccacaccctcttacgctactctctctccaggtgtgctctctgtcttcctctactactttctatgctcttctcccgtcctacctctgcgcgtcacactacctgaccgcggctacataccnatgctcgctctcgcantcaaccacgctgcatgtgcgcgccgcgccactactgcnacgcacacgcgctctcttcgcgcttcttatcccaccacttcgcgaacatctctccggacacatcgactccanacgtcgcgacgacgcgcgctccgattgcgccgggcagtggcgcgagcgctgggtgaaggcggctcgctgtccggtgccggtgtgtgacggcgcagagagatagtctatatgcggtgagntggttgtgtggtcggtagtgaggtgtatctgctccgtcgcgtcgctcgccactctgctccacgatctgancccgatcgcaccactcttaaccgcagcttctactagctgatgtcgtcagcaactgcttggccgcgtcatntggcttacgtgctcgcgcctctacgttatcatcgtagatcanannnannnatgttgcgcgtncaatactataataatatntaggatatgttgtgtgnttaatcttctntatattctcatttataataccacatcaaattcacaataaaccctcattantcnttctctgtgtctctccctctgcacgccggcgcgacgcgccgcctcaccgtgcntctgattggatctagtgatgcgntcctgtctgtcgtgcgcatcggcagcgcccgtgttcgtgttcgcttggtgcgcggcgggcgcgtccgccctcgctcccgcgcgccgctnnncnnnngngngctngtgtgcgtccttgtgtgtgcgcgcnncgtgcttntgcgcgtattgtctgcttgtntngnggtctctgtntgtgnngncgtncccgcctggttgctgtgttctnctcgtgtgtggctcttnccacgnnacgcagnagaaagggtanntnantgtntnnctngtagggttntntcccncncnctaaggng

SEQ ID NO: 11070 - DNA, 428 bp, Homo sapiens
tggcctcctatcgtgttcagtgggtgaacctaggtttttggtgtgatttttagcattttctacgtataagaccatgtcatctgcaaacaaagccaaaataatccacgtggatggtaatttacctcaaaattgatgcactaattggagataatcccttcttcacactcactgcggaggtgccagttacataatgcctgcaagcaagcttgccttccttttgaaatcacacagcaggaaagattttatagagatcagcatgtatttctgagctacctggaagatctctccaaaattactgagaagcccttcatcatactgtattccacctattgcatgaccaaatttatactccatatcccattcctgcttctagtaacagctagaataaggtaaaattatttatttggcttttgttaaaaaaaaaaaaa

SEQ ID NO: 11071 - DNA, 294 bp, Homo sapiens
caaacactccaacgcacaccacacaaaaccacccctgccaacagacacaaatctcactattttaaccaaactactcttaaactcttgacacccaaaccatccttttctctccaatcccagggttaggatttacaaaaaatatttcattctaattactttttatactttatacatcaacagctctattttaaagacaaaatttatttaatatactttttcaaacaaaatttcatgttctaatcattaactgatttcaccattaaataaaacaccatagagagaaaaaaaaaaaaa

SEQ ID NO: 11072 - DNA, 864 bp, Homo sapiens
  misc_feature (1)...(864): n = A,T,C or G
tggagagggagagagagggggccggtttcagggacctatcgaaatcttttttttttgggcgcctttttgactgaaggcgagctcacatataaaccacacaactaaagatctgcggggggaaaacataaaccnatctaaactcatntctaaaatccttcttaaaattaacacanaggcattgtgtacacacatcccttcattatatttagagataaaacctatttcttgtgcttgcgttcacattaagtcatgatgtaaaaatatcgggggggggtccttcacacaattcttaaaaaaaaaaaatttacaaaagactggtatcatggatggtctgaaaaataaaaaataaaaaaatcaagatcatttaattgggaaaaaaagaaaaaaaagggcctccgtggcctcaaggggggagcttctggggcccgttcctttagtgaggggaatcatgatcctcgtaactaactggtggcttgggggtcgggtgcgggacgggttaggtgatcaaggcgggatgcggtttgccagaatcgggggtaccccggagaagcatgtacgagaggccgcaaaggccggaccggaaaaggccgggtggtgggttttccatagcgtccccgctgggaggtagcaaagggggggtaagaaaggggcagaacgaggggtttaaggacccggcggtgccggagaggcctgggcgttcttggcgacttgctttacggagcggggctttttgctggggagggggttcgtgagcgacgggagggggaggcgggagggggcgcaagtggtgggggaggacccttgagggggggggcctggggactatgtgggcacccggagaagatttgcctcgggggcgtgggg

SEQ ID NO: 11073 - DNA, 954 bp, Homo sapiens
  misc_feature (1)...(954): n = A,T,C or G
tatcggacccagaaagatcggcggggggcggcgcggtttctatgggacggacacaaaaccacttgtggggataactatgcaaagatatgaggcacaaggatgtaaaaaaaacttccacataggccggggtggcngcatacaaattaatttttattccaccacaaaaaacanaagactgggaatttttcttcgaggggaatggggaactgaaaattctgctttattatagatcttatcatcccattcgtaaaatttatcattttttttttaccacttatctggggggggccatccgacatttcttaaaacaaaaaaaaatgcctataacttatctgtctatcctctgtatggaccatattggggaataaataaataccatcagtaactactactacacaacccacccgctacccgcgacccccccggtggcggtcgccgctcggaacgcgtgacccacgcctcgcttatcaaaacatgcctccccggggccgtcctgtgaacacaagggccccatgtccgttaaaaagggagagccttccgcccccgcatccttctaggcggcggccagtgcagaactgcccgcccctactccggtccatcgaccacagtgtcgcgaagagaccgcgagccccctctcaacgtgcacgttccctgtcccgcccgcctgctccagatcacggaagagagactctctcccacagcgcctccacaggtcaccccgcccgaacacgccctcgcctccgcccatgtcgataggcccggcggcctaacagagatacaactcggctctccaggacgggcctctcacccccacactatactcaactgcggggccgcgctatacatgcaccgagcctccaccggaccctccccataacgcgataccgcgcgtctgcctccgcgcagcgcctcgccccccacctcccgaagagtaacagcagatccagtagcaag

SEQ ID NO: 11074 - DNA, 664 bp, Homo sapiens
  misc_feature (1)...(664): n = A,T,C or G
catggtgaggatcagtgagaaggtggccatctacaagccaggaagggagccctcaccaggaaccgaatcttctggcaccttagtcttggacttcccagcctccagaactgaaagaggaatacaaaaatgaataagatctttgtcttcaaagcattcgccatctagagagacacagagatgaggagcccaagagatgaaactggagagcagaacatctccagcagcagctgggatgatgaagcatcttctcttggcaaagaagaacaccaaaatcagagaggccagttaggaggctgccgcaatatttcagctcctaaaacccaggaggctcttaaaactcctctaccaacatctcccctccatgaaaaaaggaagccaaagttcttcactattgtttacaatcagaggtgtcaatcaaaatctttaccaattggctcacctgtgggagaaggcattcaccagttggaacatgaccctctcccaggagaatggatgctggccaggatgcttgccagtaggctatttgcaaacaaagagctnttactgaagatattagatcccactgttctgctcattntaagaataatgatattttcacctacactaagctgtatctataaccatatgctacanataanaaatgatgatgttaaaaaaaaaaaaa

SEQ ID NO: 11075 - DNA, 290 bp, Homo sapiens
tctcaaaattcaaatgttgaaatcctatttttcaatataatggcattaggatgtggggtctttgagaggtgattacgtcatgagtaacaggtttagtgcccttatagaagagaccccagagagaacccttgtcctctttgccatatgggaataaaatgagaagttactagtctacaacccagagaggacccttggcagagcccgaccatgctggcgccctgatctgggacttccagctgcagaactgttgaaaataaatctctgttgtttatattccaaaaaaaaaaaaa

SEQ ID NO: 11076 - DNA, 250 bp, Homo sapiens
cctgagacggcgtttcaccgtgttatccaggatggtctcgatctcctgacttcgtgatccgtctgcctcggacttccaaagtgctgggattacaagcatgagccaccgcgcctggccgatatccaaacttttcagaacagcttctttaagatacaaaacaagcactaaaacagaattacaatttattatgttttgtgttttgggaataaaattttcacatgtaatgataaaagtttgaaaaaaaaaaaaa

SEQ ID NO: 11077 - DNA, 1054 bp, Homo sapiens
  misc_feature (1)...(1054): n = A,T,C or G
ttctacccggctacacaaccccggacttgaacaacacagctggttaagacgctggctcatatcactaagcatatctacctggaaatggggtacctgagcagctggactcatcaatctggaaatacatgcagtcggcaaaaccatcacagtgctaggtggcctagggatacagtctgttcggaggaagccacaccccacgagctactcttaccacccacctcccgcgctcgatctgctccacctcactgctcgccactcaccccacgccatggtcaacctatcatcaccctattctgccccctcgtctactctctacaccaacccttcttccacaactcaccccgctaccgcactataatccctcgctccacttctcccacccctcgttatatatgctgagcgatcgtatatatccctaatcagcgccggatcgacacaacattcgccgttcgctcaccattccgccgggcgtactacagcgcacccgctgcgaccattccctccccctttccatatatcctcccccgctatttctatatcatccccccacgctctatccctactctcgctcacccaatctcacatccctcacgcccgacacccactacgatagtgtgtccacgaccctgcgccccttgctcccccgcactatttacgccaactcatctggtggtcgtacctcccttccatcctctatccaccgcaccgtactcactncatctcccgccacccgctcgaccacaacgccacccactcccttttaccaccctcccccgtcacagtgcgccatgaccccgccatccgaccccgtttctcctttaccactccacattcacctcacccacaagatattcagtaaacgacatacccgattgatatcctctcccctcacctccacggcccgctccacgtgcccacattacgtcccccgacgcccgagtatctatcttctaccgctcccactcaccattttaccgccgccgcccactccgcgtatgcgctcctcgtntataaaccccgctccccgccgcgagcccgttaattctacacatat

SEQ ID NO: 11078 - DNA, 1653 bp, Homo sapiens
  misc_feature (1)...(1653): n = A,T,C or G
ctcactcactacacatacatactattaatagtctatctgctacgcgctacacgctgctgcgtcaacgccgccncgccccgtgnngctcgaagaagcccaacgnagtcanaacactgcgtcacactgngtcaatatnatgtgtcctctacccacacnacagcaacacgnaagcacgctattntcgttcttcaagtctacgcttatatgcatactacaatcgtatctcagtcgaatgtagactaactctgcgtgtacatcacantctacgccatacgcacancacatcgcactcatatcgtggacgcgtggttcaatatctnatgtgtctctctactgcgcatgcgctacccagctgttgcaactcgnacacgacatactcgtgttctcgcatcttatatattaactaggcgcgccgcctcttcacgctctcactntgtaacatggcatcaacacaccgcgccctcgtggcgatttcgtctaatcatactaactcacccctcactcgttgatctaaccccacacacttatgttctaccatccctctcgcacaattcatctgcacataacgctctcgttccaacaggttatcccaactacactctcaacgtcatgtacgtagtgcgacacccnttacgccctcacaatcatanactaataatcttgctagacagancacacagtgatatgagagcaagtgatatcaccgatcatctctgactcctcnatacacttgcactccggctctcacacatcntatgacataccaccgcgagccacatntactaaacgactctatcatacanactatactcacaacanactctcctactcgntcntgtcactaaatacacatatcaactcacacaatacactatctagctgcctcattcttctcataggcgtactctcgacgacctcagccacgacgcgtgtncttcatctaacantctattccgatccttatcatcttatgtatcaatatatgtagcgactctatatagagcataccaccgcacgactatctgtgagcctcancactattaggcggcntcgnctcgtgcactccgcatctcgactctaatcgagttaccgcgctcangagcacactacgcgtgtctcgtcgcttcgctccacatatcgacactctaaccacatcgccactagcagtattcgacaacctcatctctcncattccatcagtatctcgcgcgtgtgtattcatacancatatgctacgagtacatacacatcacgctcacctcgccacgccacactgcntatctgtatcgctacgcgctcaattcctcgctacgcctcacaacactccgtcaattgctacgtatatcttcactcccacctgctctattaccctcattgtcttcctcaactatccgacatatctgtctattcaccgcgcgagacnttcgcaacacctccgacatcccagagtcatatactcctactagctcctgtctctcgcgataaactacgataacttctcactccacgctctctcaccctcatcactccgacattcatcacatctctaactactgctatcctcgcccgcatcctctccctctcctacgactctgttattaactatctctatttccactctctatgtctgatcactctcctcctcctcataac

SEQ ID NO: 11079 - DNA, 235 bp, Homo sapiens; identical to SEQ ID NO: 6664

SEQ ID NO: 11080 - DNA, 956 bp, Homo sapiens
  misc_feature (1)...(956): n = A,T,C or G
catggaacacaaacgatacctcgccaccgcagccggtgcgccggcttgtatgncacatgagactcagacttaagcacaagctcgcctgtgttaagaagcactgaacaaaaatatctaaccttgaatagacagtggacaagaatactgacgacactaccccctaagcgctgatgatactcgacacaattagcctcaccttcgctacaaaaaaaaaccacacactccgcgcccatacccggtcaaagcgggggacccaccgagcaccctaccactccacagaggcggacccacccgagaaccagccccctgacccccatgacccaagaccgcctacccccgcgaggtggagggcataccccccacaacccacgcccgacacgacccgagatcccgaagaacgcaggcgctcgcctctcccctccaaatttgaaacacaccgacaggaaaagcagaagggcccacgaacgccggatccgaggcagagatgccgcggcgcctacaacatcccgagcacccacaccccccgaacagagctgcgccaattttcacggctgcacgccgagacagcggcgacagtagtcgagcaccctgccccacacccagcgtaggtaacccagtgatccgtcaccccccgccctccgcctccgcgcaccgctgcgccccgacccaacagacaggcgcatacacgcactgcgaaaaggacacccccgcccccacacgaacacccgtcccgccttccacgaagacaatgaccctccagcacccccacccgccaggcgtaccgcagccagttcacagacgacgcccgaggctcacgataagcaaggagccgccaccaactaacacccaccgccaccgcaagtaaccgagctccacgtccgccacggatcttccgccgcgccaccgcaccgaaaaacgaatcacggcacccctcagacaccgcctccgccgccaag

SEQ ID NO: 11081 - DNA, 921 bp, Homo sapiens
catacgtgaaacaggtccttgcttctacatcaccttctcccatgactggaagtttcctgaagcctccccagccatttaaaactgcttaatgagaagtccaacaaaagagagagagagggagagaaagagaatggtatggtgtgtgtctccgcccttcatcaactacaggacccctatgcatctatattcctatacctctcccttcccctgtctctcttttatcctctcccccctccccgccttttttcctccgctccccccccctctatcccattcctctcttacgtctacccctccacatctatatcacaccccctcctccccccacccccaatatacatcagtactacttcccactcctactcttcatctactccgggtttacctacaccccatattttactccctacccttccacccctcccctctctatttatgaccctcttcctgtctcttatcgtcacggttttcctccgccccccacactcatacactatccccgttataatatacatgaccccgctccttatatccccttcctcttactcccttctccgcccccccccccccttattaactccgatgagttcactatcccctactcacttataatattatcctatctccctacatatctaatccacctccccccaccccattccctctctcccttccaccctccacttttcctttcgctccccaccccccccctatatccttaagagctccactatctctctatacaactactcctcttttgcaatcatacatccccacttctccctccttctccctccttcaagcccactcaactattccccccactcatcctatttctaccccctcctcacttttctcccctcctggcctcctgctcattaaatagctaatttataaactacaatacttcccaccctaaag

SEQ ID NO: 11082 - DNA, 301 bp, Homo sapiens
ccctaacggcaacgccttgaaccttgctaacaagtgcttccaacataagcgatgtgaaggcatctaaaacatgttgaatggctgtgtgcacaggatatcctacacctgcctgacatctggaatgcaggtgaagcaacctgacctgatggagccacccacacctttagaagaatctcaaatacagccaaccctgatcttcctcagctgaacatcatccatccgccaaactcacaaatcaaacataacgcaaatattattaccctctgcctagcctatgaggcgcaaccccctccccaacctt

SEQ ID NO: 11083 - DNA, 1201 bp, Homo sapiens
  misc_feature (1)...(1201): n = A,T,C or G
tatccccctttctaaatccctttaccatattatagtagaggtgcgtttcggagtcctcgatggtagaagccgcgtctacgcgcgacgcttgcgcgcccgaaccgagacacgctgcaaatcaaaattattcccttggtaaagtaaagcagtagcatctgtctcaggctaagcaacgaacactttgagccgatgcagcaaccaagttgctgtactacatcacnaaagcgcacacatgaacacgttagaggcacatgcgcgacctgcagcgaactattcgtagaagacacacaaggtgtaccacttgaacacagctgcggcgcgtgtgaccgtgatatgttaatgtagaggcgacatcgctaacaatcagctcttacaatgcacacaacacactgcatggcacgccttatgtcaaccgaatcacgctatcctcagtcatacgcgaacacacagnttgagagtgaacctcatggaccacaaagatgggctcgaagtcgcggcatcaggcaacccaataactccaacgcaatacgtgataaacgcgtgagagatgcatgagtggtgcataggacgcaggaaaacaagaacggaactaccacaagacatcggatagccatatggacgacacgtcgatcagaagtgccgtccgaccgggtcccgtgaggtacgcaagcgcgcggcaggcgggangcgacatggacccacatagcacccccnagatgggacagtacggcaacacacgcgccaagcncatgcaccccgctgccacctccaacgactcggacggtgaacactgccgagatctgtgtgcgtatgcgtagagctctaggctccacacaagagcacatctcgagcgagacgacgcacaacacgcccagaggcgctcgatcncacccgccacactaaagggacgccctccagccctgcctacacacatccagcgtacgacgncacccaagacaccaccaccacagtagcgcagacaaatgcacgcggtgtctggcagccaacccactgggacacaggacaggaaacggtcaacaagatacacgccaagacacaaccagccaaccgaatagataggcctaaagccagcattccaccaatgaccacgcaatggacccaccagaccctctgtgccttactcacacgcaagatctctggatccatcacagcggagatgctcatagcccataaactgctg

SEQ ID NO: 11084 - DNA, 904 bp, Homo sapiens
  misc_feature (1)...(904): n = A,T,C or G
cagtttcacttaccccgtaaacttctaattaaagaaaatataataaaagaactagcgacccagggcttcctcgcctcctttcagtctgggctgaaatggcagcttctcagaggagccttccctgaccccaccacttgacacttttaacctcccctattcccagcatcccttcctgctccgtcaccatccaaaatactataggtacgggcacagtggctcaggtttgtaatcccagcactttgggaggccgatgtgggaggatcacttgagcccaggagtttgggctcagcctgcgcaacagagtgagacctcatctctacaaaacttaaaaacttagccgggtgtggtagtgcatgtctgtggtcccagctactgtggaggctgatatgggagaatcacctgagcccggggaattgaggctgcagtgagctctgattgtgccactgtactccaaccagggtgaaagagcccgaccctgtctctaataattatatcaataataatcaataaactatatatttatgcgccacaaggaataaaaaaaaaaacatggcccagttggcctgaccggtggactctctgcgccctttttctttaatgaggagttatacaagatcctcgcttactgacttcgttgccctcgacccttcgattcagtacaaccgtatctctctcatctcaaggcggatattacagttatccacagaatccctggcataactctcgnaaagaaccgtgaagcaaatggccaccgaataggcccgaacccaaaaaggtcctttatgtctcacactctctaaacccatcccccgctgtaaagtgaacagtgtcgactctcaagcacagtggtgaaacctcctgatactagtaataccactatcagccctgtagccacataagcgct

SEQ ID NO: 11085 - DNA, 846 bp, Homo sapiens
  misc_feature (1)...(846): n = A,T,C or G
ttttagggaacannggaccaggccttttgttctcccttcttgtctttgtcctcctcttcacgtcactctggcccttctctgttttttacttggtgtggctctatgtggactgggacacacccaaccaagtgggccgccccatccccgtcccccagcgcctgcaccccaccgaggaggaagtcaatcactatcacgccctctacatgacggccctggagcagctcttcgaggatctcaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcatgcctgtaatcccagcactttgggaggccaaggtgggaggatcgtttgagcccaggagttgaagaccagcctggngcaacccagtgagacttcatttctacaaaaattaaaaaataatgctgttaattagcccggccttggnggcatgggcctgtaatcccagctttttgggaggctgaggcctgaaaattggtaaacccaggaggggggcggtgcaccgaccttagatcccccccagtctctcaccctgggcaacacagcgagaactaaatcccaaaaacaaaacatatgggcctgttggccccaagggtggaattctgcggccgcttcctttaatagagggtatatacatgaacctcgctcacagcttcttgagccgggtcgtcacgttgcgcagacgtcctctctatctctaagccggtctacggtttcaccaatacagagatacgt

SEQ ID NO: 11086 - DNA, 1043 bp, Homo sapiens
  misc_feature (1)...(1043): n = A,T,C or G
gtatagatttttatattttaatgttaaaagagtgacaaaaatagaagagcgctaattggaaaaacagagtccacacgtgactgcgtcctacattattcacacagcagcgagtgagccgatgccattagagagctaagtgtaagtatccactgctagacatcagaaatggcaccgctgtcacatgaggccgaccctcgaggcacacagaatgaacgttccgaaatgatacatgattttcatgtatgcgataacaccccttcgagttttctcatatagagacgatatatttttttttattagaggagagatgagcgaatacccaaaataccaacaacgggagctaactaggactatgaaaatccatccttgagaagactgagaaacatcaaaggacgtccaatatttcggccctctatttgcgcactataccggcggcacactaataggtagaactgcttggcatatgcagaagaaggagttaattttgctcgcaaccnatcactccaccaaatcttacgctcgtactccaaccctccacactcttgtactgcgaagctgtacctactcttcccctctgaacggcaaggcactcacgcgtctttcccacagaaacccacgggatatattccacatataagagaatcctctactcccccatcagaggccatcacaatatcgccgcgataactcgcgataacccgccacccacctgatcgtacgttctctcccatagggctttcgctgcccttgtaagtgagctagaacaaaaaattataaccgttcctccctacacgttggtagatattccccatagcacctctataagagaatcaccgcgctcccccgagcacaaacacttcttatgccccaccacatccctctcacaagacacaaactcgatacaccgaaaatacgagtcagcatttgtgtacattcgcgaaaagaagcatacctcatgctaaaatcttatcacctcactagtaatatcacttccccactcagcaccatacatacgctcccatagagaagtccacactacacag

SEQ ID NO: 11087 - DNA, 206 bp, Homo sapiens
  misc_feature (1)...(206): n = A,T,C or G
gtcaaaggcctcgcagagccnctcaaacacaacagcnnggcttcgcggcaaaaaaggcaacacagttaaaaaaatatcactatcaaattaaatgagcttcccctaggcaagctaagattgcttttgcctgaaggctggctcaaaaatgaatcatgagggagacaagtcatataaataagacaaattttaaattaaaaaaaaaaaaa

SEQ ID NO: 11088 - DNA, 164 bp, Homo sapiens
aaaaacgtaatctacacttcaaacaacacacaaaaaccacgctgaagagaaaaaaggcaccatcattgcagcactctttttcagtgcctctgtcattaatgctatgttgcaattcatacgtttgttgaaaattagaatgctgcattcgttgaaaaaaaaaaaaa

SEQ ID NO: 11089 - DNA, 104 bp, Homo sapiens
taagaatacactgatttgatgaaaactgtgaactaacaaataaaagaaattcagtaaacccaatgagaataaatataatgaaaagcgtcataaaaaaaaaaaaa

SEQ ID NO: 11090 - DNA, 1187 bp, Homo sapiens
  misc_feature (1)...(1187): n = A,T,C or G
tgggacatagaaatcacggggggcaaaaagcgcttttggtaaacagaaaacggggttgcaaccatgaccgtgatcaaaacgactaacatcaaccgcggtgcgtcggcgggggggacacaacaaaaaaccggcgccgggggggggcgcaaaccggggccggcccaaacacggggggggggggggatggaagaaaaataaacaaagggggaggagggggaacgggcaccaagagcaacagatggaacccacacaaccaaccatgaggggcaatccttcccacaacccccacggattatttctcccggcacgcgcatggggaggggataatacaaggaggaatgggaaacaagggcacaaaaccaactggaggactgcgtgcacaccgcgtgtggtacccgcgctggcgacgactcaggtgtttggtgacaacgggcgatcacacgcctatctggggcgcgccgggtgggctatacatccggggcgccgggggggggggcgacgattcgggttggaaacgggtcggcgacacaaacggacaacacggcggtgaacacaaaacacgcaagtggcgacgggctcgactagggtgcgagaataaatgggacgacaacataatgtgagaaaagagcaaagacataggctgggcataagactaaggtgcgcacacactgcgtgtgcgccggctccaacacctggctgagcgtgtgagggtgcggggcggaatgcgagggtggttatacaaacaacaggtgccacacatttggcggggcaatagcggcgcggggggcgcgggcgcgtgactactgttgttctcataaacacacatacctcaacacaattgtgggcgcggggtggacatcacaacacacgaataatatgaggcggaaccatagtcggcgtgatggcgccgccgctctcgcaatntaacactgtagtcggcgtgtggagctcctatcgactaatatcatgacggcattatctcggagatcggcgcgtcctcaccgggtggtcttgcaccatcactcatcggctgcggcacccaacgaccgcgtggcggacacagagtgcgtccacttggatacctgttgtggtgggcgtacgccgtgcgggcgacacgcgggagcacgacaacatagtgctggcgcacaaacatccgtcctcaacacactggtaggtcgcgtgcacgg

SEQ ID NO: 11091 - DNA, 856 bp, Homo sapiens
cccatatttgaatctttaatgtagggctactgcagtgacgctgccaacaaatgacttaagcgtcccagaggcactttaaccaaaccctggagagagaagaaataaggagtttttgtcatttatttgggattttctacatggacaagcatgtcatctataaacaaagagtcctctctccacacacacagttctttttaactaagtacattcacattgttatgcaactatcaccgccatccgtgtccagaaccttttcatcttctgaagcagaaacttcctaccgtgtgaggatacagcaagactgtggacatctcaatccagggagacaggcattactagaagcaactgttcaggcatcttgattttggacttcaagcctccagaactgtgagaaaataaacatctcttctttaagccatttaagctgtagtatatttttactgcagcccagtcagactaatataatatctaacaacgttgaaccatttaaccatgaacactcaactttttcattccattacttgtccttaccttctataaatggtttattagtgcccatgcatgtcttttggctctcattaattggatccattttggaaaaatttcatttttggggcttcctggaaaagccttttaaatattcaactattttggccctttcctagtacccaataacttgaaccctaatttttaaaattgggctttgcttaaatcttcacaaccttgctcaatttgccttatttagattctaaaattcttgctaaaatatttcctccgcatatttctgcgcaaacacttctatcgccctaggcaataaagaatatttgttttctcgctttgcaatgagaagccttag

SEQ ID NO: 11092 - DNA, 825 bp, Homo sapiens
  misc_feature (1)...(825): n = A,T,C or G
ggatccacagattttttttttaaacaacaaaaaaaattagcctgggaaaatacgtagcctttttcacgtgaaaagccatgtcaatgaaatacataactccaccctcacgcacatatcacctgtgattgcagaagcatttctccttctctggcctcctctagctcttgatgatcttggatcccttacctgcctgcatgctcagtcttgaactcggttctagaacagcccaggcttgatgtaagatgtgctcctgttactttcgtcacacccaagcactccttctgcactgatcccactcagtaccttacattctgagccagtgaccagtgtcccacctgtgtccttacctatcccgctccaataatctggaatactggtacatgttgaggtcctgccccttgtgtgcagacccagaatctgtgtgatcaggcttctggctattgacaccctgggtccctgtnacttgcttctgtcaagacaccctttcccttgattttaggatcccgaggtggttaatcggtgctcccatggtgtgatgccaactatttagaggtgtgtcccatgatagcgacctaattataactgacgcattgtgctcagggccctaccaaacttaataattatttcagagacgaattaaaggcaagaaatcaaaacaaaaaaacctggcgctctcagcgcccaccggtggaactattcagccgcacctctctagcgagcgcacatccttgaccccgcttccggcccgagcgcttcgagtcgcagtggaaagagcgttccgaactaataagtcagaacgggcgcgcacaaacacggcacagcccc

SEQ ID NO: 11093 - DNA, 148 bp, Homo sapiens
ggatccacagcgatacctgaggcagccctgcagactaccaccagcaaggccacaggatttcatggcaggtgcttcacaaaccaccttctcacctcagctccattctattttacaaaatatattccttctgccttcaaaaaaaaaaaaa

SEQ ID NO: 11094 - DNA, 948 bp, Homo sapiens
ctatctctataatataaacaatcactcgaggaaaaggagcttgatgggaaagaggcaccacagttttcttactggctcttttaaggatgcctgagttgcgaacggagctactgagatgggtaatgacaaattgctttattaccaggccctggatgacgcaatgggagtgagcaaatgacgccagtggcagcctccctgggctgccatgtggtgggctaggctaatgaagaaacgctctgttcgtactatagctgtcactacattaactctgtttttttttttcaattaaatttgtactaggtccatatatataaataaaatggcactttttaaccataatgaaggccctctgtgaccgaattattttaaaagagtgtacccacccatccctggttgacaaaatcaaatttacctgggtcaaaacgtaaggatcacattgattttttccctttatagatctcaattatatgtcttcctatataatttactcgagatcagtattgataccccttgtgaacgctgagggttcggcactggactatgctgtacttatcttacagagattcctattttcctgttgtgattattttgagcacgtgctctgctattgtctgtttaacaggatgctgcatgttcttatgtttactattacttgttatcggacttaatcgcatccgctatcaatcataattgagatatttgcatacgattaggactatacacgcgcccaatatgttgtaaggtcatagatagtatagagaaatgaatgaatatacactaatacatattcgctatgatgtaataaagcctcgctatgtgccagctgagatatagtaatatattgtcgatcgtttggctagttctccgattgtcgtacacggcctgccagtttttactaattagaatatatttgagtagcgatgtacttctatatacgcctccgacccc

SEQ ID NO: 11095 - DNA, 372 bp, Homo sapiens
atcgtgacgtacacagaaacgaagacatggaaggtgatcctggaggctggagagctacgtctaggtgacagacccaccgttatccgccctctatggaccacgcgtctctactgaacatacggacgcatatgacaactgcgccctaggatagtttgaggagaggcactaggatgcagttgtgcacccacaagaccttgcgaccctgtgcttaaagaggacgtcaacctgtgtcctgagacgaccaacggcttggggctcgcatactttttctttatgttgaagcatgcacaataaatgagtggactcctaggctctcaggggtggagctctgcagccgtgaaccttatgtgagggagaaagcaggaaccccag

SEQ ID NO: 11096 - DNA, 1938 bp, Homo sapiens
  misc_feature (1)...(1938): n = A,T,C or G
attttttttaatattgttattatattaatntatnnntttngnntntnnttnanttnttgtgtgtcagagtgttagtgtcatggntnntatgatntctctcannagttgnnagganttgnntatgtggtntntcgttgtttgntgtnngtgtgtgtagtctgtttctgngggtgtgaggataccccgtcngacgtgnngngtgactgtnggttnctgtgagtgctgtgngacgcgngtgcgtgncccccactacatnncnancagtggcagacgagggtcgtgctacattgagggtgtctctncatnatagtnctttcactctcactnatcatctatctatntccctngctgttgttncgcantaagttgcatgtnncgctcgcagtatgtatgtntgtagtgagcattgacncgntnctacnncgctgtcatgtgtcgatcaatcgcgtgcantgcgtgttctactagcnctccccaccnctctactganatagtagtgnatgtgatgtgatgcnntntaatcatgactatatagattatgagtgttgtntagcgtatntgctttcatgtagttgtanctagatctattcntcntctacactgtctatcgctgtcgcgcatcgtttcgtaagatctcgntctattattatacatcgcttgcacggancacacgagcgacggcacactcacatcacgcgtagaggcacacgtccgcgacaccacgacacanaccagcagtgatgcgatcgcatnagtatgtaagaatctagtgtgatgttgttgtgtatagtgatgtctgtgattattgttntnttcttgtgtgcgntattggtgtngtgttgtgtcgtctgatnttgctcgctttgcatgagngtcgttgttgtatgttttttgtngtgtgtgaacacgagtatagtacgtaatttganttgtggntgtgatagtaggtgggtagaggtatcgtgtgtgtttaatgctcgcgtcactctcccgcgattagtgctgctgttcagggcgcgntgacactcatgcgggatgatgaggtgacgctcgtgtcggcgcacgcgtgcacgaggagcatagaactatatggttctgtatctgtctctatacaatataactaatatgcgtctaacatactatgcagagatcttatcacataaattgagntgatcatgtctctcaanagacactacgcacagacatacacacacactagactcgaacttaagtacacagtcgacccagggcgagcgtcatcagtacatcgcgcgctncncttcgtctantgataagatncttgtacctnaacactgcaatacgtatgtactcacaagcgatgnaactgcaagagtgcgatgtgatatgtatgtgtntggccacgatgtgcacgcagtagtacgctcgactatgcgaacggtgatctgatgttgcgtggatgtcgtgagttctacgtntgntctatctaacgtngcngaatgtagatggctagcatagataagtaaattgatgagacgcgagagttgtcgtgctgctacgcgtgtgagtgangagngatatattcgagtncatatggtatntctatacacgtgantgatatgactgcagngctgtgtcgctcagcagtntaactgtgtagtggtagcacgtgtcgttagtagcgagtgtatagtgtagtgtgtaggatgttgtagtgtananantacgngtnatgatgtacgtcaaggattacgcgctcgctgttacgactcgcnagtngttnatgtgtgctatgngtatctgtgtnacttgtgtgtgtgtgtagtcgatgnctactagtatgatagatgggtgtcgacgaatgtagagcnggacgagtagtgtcgtagtgtatatcgttngagacgcgatggnagcgtgtacatgtgtggtcgtcgaagatcngcatcgcgatgtgng

SEQ ID NO: 11097 - DNA, 492 bp, Homo sapiens
catagtagcatgcaaatgtgaagctgtgatggacatctatactcagatcaccacaaccactctgaatctaatcatgtaaatggatatgtttgtctaaatggattgaagccacagcatttccaaattccaaatggcaacccaccctgaaggggcaagagtgtcaacatatcatagtgagaactgacaagtgtcatttttgccgcaaaaaccaaacactatgattgcacctcgtgatattatatattatatgcattaatatgcctaagacatttcctttttattaaaagtaacattttcagtctaaatttcttaaattagtggtaacaatttaaaaacaaaaagctctgtaaaccaaataattttccaggacagttaatatacgttgattacctgcatttcaaggaaatggaaagttggtaaaagaaattaaggccaacattataatcttctctaaggcaaaaaataaaaaaaaaaatggccttgttgggctca

SEQ ID NO: 11098 - DNA, 801 bp, Homo sapiens
  misc_feature (1)...(801): n = A,T,C or G
cgcgcatgcggcgcgcactcccagcccctcgcgcccacgcacgccccggccgaccgcaccagcgagcaagccgcccgcggagaggacgtcgcacgccctgggggcacgcagggagttaagggtggcgagcgcaggtcagtgcgacggacacagtccgaggggtcggacccaaacaacgcagacccagaccgggaggccccccgcgcgccgctgacccgccttgccgcggggactcagccccctggattagtgctcgagccccgcagcctgcgcagaagtgtacgccgatactcggcgccccgagaggtcctggcggccggctccaggggccgagcgggcggcgccccggaggcgcctgcccgatccccgcgggcgcgccagtacccgcgcacccgaccaccagaagccgcgggtgcgccgtggcgcggcgccgcacgagcccgggcggcacaaggtgcgcgggagcgcgcggcgagggacaccccgcccacgcgcgctcccatgcgccgcgtgcagcggcacaggatcacacaaacgagggacgacgccacgcggcagcgggcgcccgcccaaggacgctcttgatgtcttttttttggccggccagccgtagcgggtgccccccccccctacagaaggggaggcgcggggaccgggatgttgattgtgtgctggtcccacccctccgggtctcgtgtcgcgttgccccctcgcgggcgcggctcggtggtggcccgccttgcggtggtcggtggtggntggggggggggtttttttttgcccccccgtggctctgggggg

SEQ ID NO: 11099 - DNA, 739 bp, Homo sapiens
gctgtcgttccctggttgccccttgagcccgtccgggtcactcgccccttgtgcgtgcgccggtgccgctccccgctccgtcgcctcggggggtggctctgggcgccgcgccccctggggcgcgggctcgcgggggcgccttccgccttcttcccgtgcgccccctccgctcgccggggcctcgcctcggtgccggctccccgtcgctgcgcgtcgccgctgccgtctcccccccgtgtcccccgctccttcgcgcggcgtgggttgtgtggttctctctgtcctgctcgcggtgctctctcggctggtgctccgccgcgtggcggcgggtcccccctcccctctcttgccgccgcgggcgtcctggttctgggttctttttctttccctgcccccgcggtcccgcgtggtgcgctctccgctttctggcatcttctcgctccgctggttcttctctccgtggtcgtcctgggcctgcgggcgggcgggggcggcgcctcgtgccggcgctgccccttgtgttcggggggctgggcgtcctggcgcgtctttcgtccctgtgctaccttgccgtgcggggcccgttggtgtttcctccttaaacagaagtttttcggtggttcttttttctttttttctttccctgccggctgtctcgctgtggtgctgcgcgcggcgggggtctctccgtttggctgttttctcctctctcctccggcccgagcaccgagaatcgtcg

SEQ ID NO: 11100 - DNA, 195 bp, Homo sapiens
ttttttatcactgttttattcatattttatgaagcgacaagcttgtactgatccgggctgtgaggttggctgctcccctttcgccttacggcatgattggaattttactgaggcctctccagaagcagatgctgctatgtttactgaacagctacagaaatgtgagccaataaaaccatgggctcgctggcctta

SEQ ID NO: 11101 - DNA, 1133 bp, Homo sapiens
  misc_feature (1)...(1133): n = A,T,C or G
cggtggagtttaatttattttatagttgtataatattatattatttatctatatctttttttcattttatttttatctttttatttttgatatatcctagtggnggnnggaccanngggggggggaggggttgtgtgctttttctgaatccacccggatgtccnattatggtnatcgattttatctaagtagttgactttgttacgtttctatgatgtgtgtgtgggagaaaagaaatttgtaagtgcgcagtgtatgcatatgttacaacgttaccgtgtgcccgaacaccacataacaaaacggtgtttaacgccgagagaggtttaaatacaaaatagatggaacgtctctcggtggtcctcgtcacacagtgcgcttgacgcctatttgttttggtctgcttttttttgtttttatttcccctcgcacaaatttcgtaataactagttttggttttagataggcgtttatttttctttgctatttgattaatattttctattccccccgcacacttcctcttatcttcaccttatcgcctcctatttagagagctagcggaaaggggggatcgatcatccgatccattacccttttattcatctttttttcgtttttgttatcggtcaagtatttaattagattaaaaatcaaacatacacaaagtcactaaagtttttgtcactcgcacccagctaccacctgatctctatcgaatatatattacagtttgtgcatgttgtcaaacgtatttgaggttagntattagaatttatatttaatgttatgtcggtggttccgttatgatccgtagttatatttaatatactattacgttcatacttttttccacttatcctaattagatattacacggcgcggcttgacgacatcgctacaacaaactctcagtacctgcttttctcggtgagcctttttatatattatttacgtgtctctttccgattagatggtcgtgggcctagtgtgagcgattaattatcacatgcatagaaagaaccgatatagattatttatgtgtcttagtattgtgtttaatcaataattattagtttatctttttaattgtttactttttaattctatcttcgatattaagttctattacc

SEQ ID NO: 11102 - DNA, 1828 bp, Homo sapiens
  misc_feature (1)...(1828): n = A,T,C or G
gtcttgtgctagttgtttgctnggtgcacgngntgattagtcgtgtgtcaggtcgtcagaatatgtcaacgcgatcacgnagctcgctgttacccctancgcatagtgnacngatacactctaagntnactacagtgatgatgagttatttaatgtgagactcgaagttagtaataacgcncggagtaatgtgaccatngtgtcacatacgacttgtatgtatcatcagacgatacnatctangacatctctctatcnagtgatactgtcttctctagcttcacacacttatagaggatgatacactagacagctatgtcatgtatgatccgttgtgagacgagttattntgtggacgaggagaacgtcgcgcantcactacaagccctcatctactattcatgtacatatgtatgcagacaggtgcccattacgagttattgtagatacatcttcatctcactctcatattacactacttcctngagagctcattgntatgactacgaataaggattgtattcnctgtatgatgtctcatgcgtttgagtagtaagtacngatagtcagataagacagatgcaatcagtgtagtacttgtcgatacatcttatatattgtctacttatatgactgtcggcaagctaggtatcgattatantagtacatagtatacatgggtgtctcttctcgtatatcgagtgtcttgagagcgcgcgtaggaggagatgattaatgatagcgagagacatagagcatgacctcgagtatactgcgggagggcggagtcacacggtcgtagacgtaatatcncgatgtgaaccttgcatacagcgtatgattgacgntcgtcgacattctatagtacgtgttatcgtactantgcgtgagcatgtagcgtcatcatcacnagcgcgagntganatatgacgtcgcgntnagaccgtcgtatgtcatgcgatatcntcataatcttgatactactcncttgagtatancctgacatgtgantagtactnatcggaactatnattgcnctcgtatntgattgatatatagataatganctatttntgtgcgtgtgtgtcatgantgattcgagtcacgaacgantatagtatgcacgatgactcgatgacatatcagataataattcagtacgcatnaccgatgatgttctccgccgcgacgactgtctatcatcnctnancatcgncagtgtctcgtactatgatcacgtacgtatgagatgctgtctcatctgacatgatatatacgtgctatcagttagatatctagtactaacgagcaggtgccgtcgntgagacgctcgctgcgtcactgatggattttagactcgaacgnattagctagatcatcgtcaacattccgacacatctacgtcgacatgtcgacatagacagaggtgtgtatgtgcgaatacgatntctgnccagatgtactcctcatgcaacattcgtagttcacactacttatctctgtacatagtatggtctcanagcatgcntagttgtatgtacgtcgatacatgatacgtgnatgtgcntnatagtagtanagtcgcaaagtccgtgcgntagcttncgatcgtatcgatatangtagcatgtctaatggacagtatatctgtgtcttctgctgcgnctgagtgacgaggctgtgtcagcgangatatgagctctactagtacagattcaagatactatcgaacgcatntngaggccatactggctgagtgagtcgtactcctacagttaatagngagtgtantaganatcatacatatttgaagatgacgacgcactnt

SEQ ID NO: 11103 - DNA, 1016 bp, Homo sapiens
  misc_feature (1)...(1016): n = A,T,C or G
gggaatagaaagnntagggatgggggaaaggagtgggagggggtggaagagaagagagaggagggagctaggaaagaaacagaaaaaaaaaaatttaaagcgggggggcccgcgncgcgcacaggaccggcacccacgcgaggagacaaccgggaagaggccggggcgngggaaggggaaaaacatcccgaaactggcccggcggatggtccgtgtagggtcgctcgtctttatttattttcttctatgtaacgataccccttcgaaccactggcctgtgttgattttcgcaacttctctagaccgctgacactacttcgctgcacgaacattacttgtgtgggcggaggtggccccgcgtagtgagaggggtgatgtagggaaatctatgctcggcttcagcgcgccccttctttattttatacagcgctacccattctgatagcgcccactactctcattagcgtggccgaccagagggagtgagggcccgtgcgcggctgctatctaccgccatttcctttattttctctttttctgtagtgtatagtgatatttttacgtctccatatatatttttctaacatctatctctttatagctgatttgtgttctggattgttgtctcggtccatggatactggcgcggaatttaatattcgtctttatttacttctagtaatatgcacgttgttgtttgtatatatatggtgttcgtattgatgtgtgaggtggtgtggaatgaaggagatagactttataatattcgtcgttactcgtgcgtctgacgacagtggtgatattttcttgtgcccgcaaatcagtccgcgtcgcgcgatgtcctactacgttcttcttatctgtgtttctcaacttcgtcggccgtgtgcggcgtgttaataatattttagtacaggctcatattggtcttatatttcggctttgatttgacgcgctgactcaagctttacaacgcgacggtctgtcgcggagccgggctagatgtggaggtaaag

SEQ ID NO: 11104 - DNA, 154 bp, Homo sapiens
cagggttctgaattgaacgaagctcaagaattatctggcacagtttccatccacaatctgtcactggcacagcccagagagatctccggctggaagccataaatttgggtggctgaacctgctgggaaataaaaacctggcctcgttggcctca

SEQ ID NO: 11105 - DNA, 843 bp, Homo sapiens
caggatccgtcttgcatatctcctgatctacctcatcttcaccccgggactacagctctaatccagaaagcagtatggcctgttttaagtgagattcaaagaaacagaaccatgagaactctcctgactttgaggggggctccttttgcacaaactactagttgtgcaaggatttcacaattttcctaagagccctgggaagccactgaatgttataagtagaaatgacataacctgatttactttttaagaagattacttgggctgctgcatggaacatatgtctaggcagtggcaatggaagaactgaaagaccagctaggaagctactgcaggaatgcaggaatgcagagtcttgcacatctcctgggctacctcatctctaccctgggactacagctctaatccagaaagcagcatagcttgtgttaagtgagattcaaggagcagaagctcttatcatgaaaccatgagaactctcccgactttgaggggggctccttttgcacaaactactagttgtgatccgttggccaaataaaaggaactggtacgtgacaaggaagaatgagtatctagagataaggttactgacaaactctttttcttctatcttcaaaagcaaacaacctaaaaactcccaaaccctctggattttgatgggtttttatcctgaataggaactgctgtctccccggggttgatttttgggtgatcatcacaagaaaagactctctgaggcagccaagctttatagacagacagatttaaggaagttgaaaggtatcggaatgtaaggggattaaatttcttatgaactttcacggtaaaagtttgacaggt

SEQ ID NO: 11106 - DNA, 103 bp, Homo sapiens
gcctatacactctcttttattaagatgtttttatatttgaaagctatgtcatctcggtattgtctaagaaatacagttcacgatttatggaaaaaaaaaaaaa

SEQ ID NO: 11107 - DNA, 1558 bp, Homo sapiens
  misc_feature (1)...(1558): n = A,T,C or G
ccttcacagcatataacgataagagatacgaagtgttttaaaaaaaagaagtgnacgcctgnggttntgattngtgtntagttctttgtttttaattgttatagatataatntgagtnattgttgtattcgtcctcgtctntctgttggtgcngtgggncgagnaggtgagtgtnnanaacgcgatgagccctggccggaganagctagtactcaaacgaatcggcgagagcagagcggagagacgacgcgggaggaacnagtgagagttcttgtatgcgctgtaagtgcggagccgcatgcggcagcgactccactggcgcgtgtcctgtgcgcgcctcgcgctntncgcgccactgcgacgccgttgctttcttatatggtatgctaggatgaatgacgacgagtcgacagcctctatctaatctttatatatgcgtgactttgtgtgttcagtcgagagtgagtgttgacatgatcgtaatgagtctctctgactctctcatcctctcgctctctactataccgagctaggttgtataattagatgagaatcagcacgtgccgacccgctggcgactttacttgtagtantagagagtcatttttcgacatgttntatatggcgtgaatgatagagtttttaggcacattnttattgtgtgtgtattcgagtaggtgtacccgccgtttgtgtctacgattgagaggtgtatatatatagagggcgagatacgtgtagaggatgcctagagagtgcatagaacgaatacaagagcaccngagacgatacagatactacgcaggacgagagttgcagatatgtagcgatgtatgtctnatgtagntgacgtcgccgtgtcgacgcgcacacgagtacggttatgtancgatatatntgcgatatcgtgtgtatactgatagagtcgtcgacatattctttcatgtgtgtcattagatgaaagcgtttgtagttagacgcatgtagcgacgtatcatactagtagtgnnangtcnacatatngtgtgctagggctgacgagttgtaagtatgtcgantagcaatagnggtagtancgtantcagtgcttatcntatgtacacttagtgtgtagtgatagcgtatgtagntnactactgtacgtaactgtacaggtgtgtgactacgagngatatgcgcggtcacactgagacgacncgcgagntagcgcagcgcgtagttcgcacgatgtacgtnactgtactgcgatgcagcgtacntgagtcagtctananttcgtagtcacatggcgcagcgctgatcgtgtgtaacgacgcacgtnagtcgcagtcacgcaactcantcatgagatatagcagtgactacatactctacgtatntgcncgcactcatatattatagcacgctgatcgcatacatantngttcctcgtncggacgtcacataggcancttagctgtgtgtcactcatatatacatatctatcgactcgatactcgtcgtgacgacacgcgctgggntctgacacacgcacgtacgcgtnctgtggtcgtatata

SEQ ID NO: 11108 - DNA, 927 bp, Homo sapiens
  misc_feature (1)...(927): n = A,T,C or G
tattttatttcgcgatatttgcagttttatgctccggcgcgcctcacctctcaggnaacagaaacataaaaaactcctggaatccttctccatttcagtgcctcagtcaccccatgcccttgtctagctcttacgttccctacagaactgcatcctggcttcctagtccactggagaggacgtgccatgtttgaattcttcctgatggacataacaactgaaaatgtgccagtcttaaggcagatttcaaaagccttttctcacatgattaaacaaatatattgattgaaaaataaaaacaattcaataaaaataatgtaaattgcacattaaaaaatgtgattgaaaaacacagttcacttgttcacttctccattttcgaataattacatcacgaaatgggtttcgtgcctatttaaagaccggagaatgcaacctcccacttacactcatatatgagggagtgttttacgtttactgtttcgtcaatattcctgtccaaattgttattattggtagtgagcacgctatcgcatacttatagcgcgtataaattttttgtactatcaatatcatttgtttgcttctggaaactacgttgacccaccaatctaccctactgttgcaagcttagttaaatagcttctttggttgttcatcttcctttgatcgtactatattcacataaagtaataactaaactcacctatcgatccagtagtggcttatattacccgataccagagaagagtacatatctacggccacttcgaaataatatttgcactcattctcgtaccttacagtcattataaataatgaatacgaacaattaaatctacgagacagcagcaacggtctattatgatgtcgatggcctagtaatcgtacgatccaataatgataatcccacgacctgagtggatc

SEQ ID NO: 11109 - DNA, 1030 bp, Homo sapiens
  misc_feature (1)...(1030): n = A,T,C or G
atatttgaacaatggctaaatactaccttccagccacaatcgacttcattagtaaagaaaactaggacagaaagctagcntccactactattggccatttcccatcggcatccaccacttggttgtcattagccattcaccagcccactccccatcactgaccttaataagaattctcattccctgtctatgctctctatcatacctagtatgctcgctcgtagatatttatacaataaacagcgctctatacagctaggactgtataatgctgattacttatatagcgctgcttcagggatttatattagtgctagaaccaagtgctttctaacgtctcagcaattctatctatgcatcctattatcactagctgcactattatagatgactacttgttgcagattattcattatgcgtctctctatacacaacgtaatgccacatagatcgatacattcttgtgcatcctttactaccacatgtgtcaagcactgcttctccctccacatcatatgcgaggtatgttctacctaggcgctcctgccgcgataacctctcgccgttgcatctcctggtgtatatacaatatgatggtcccagggggtggggggnggggggannnnggcgnnggnttnttggccggggggacacccccagttgcattattagtgatgacagctaatagtatcattncccanatctactctcctacgtctcttattaaacngngcntcggggggggcccnnnnnnnngngggggnnggcggggggnnggggcccggnnggcgtcgacccccaatatagattagtctttattacttctaaatctgctccaatcttatctaccaccaatgcaggacctctttactcctatcgtttagatgtgtactggagaacaatccctcagtgttacatccanttttcaantacacacttagatctcaatccgtagccccaccacccttcaatgttccctctaccttcattacatagacatcatgttagtagtatcgaacgagatcgtatg

SEQ ID NO: 11110 - DNA, 934 bp, Homo sapiens; identical to SEQ ID NO: 6872
  misc_feature (1)...(934): n = A,T,C or G

SEQ ID NO: 11111 - DNA, 349 bp, Homo sapiens
  misc_feature (1)...(349): n = A,T,C or G
atgatggaaagtgttccttgtgccagttgccacttgcaaaaaagaaaaaggattcttagatcaaaagctattgatcacaattccaaagtcaatgtcacatttctcatcccctgcaccaaagaacacaggctaatttgcaagcaagtaaaccggactccaaggccaagctattatcacaatcaaaaactgtgtttagcatcaacaataattcacaaaagatttcttagtactgatgataaatcagctcattttgggcaaacactgttaatgccttaaggaacacaacttaactgacaattgtagtttatgataataaattccattatagccnngtnnaaaaaaaaaaaaa

SEQ ID NO: 11112 - DNA, 906 bp, Homo sapiens
aaaggaggaagaggaggcggagggtgcagcggggcctattcttgcctccacttgatgcgagagattattgatgcaataggaaacaggaggatgagaagtagtaacatgcaccctcaagacttcaaacacttttttgaaactatagagcgtccaagatgtgctataaatggctgatgatgaaacccctggacgataggtagcaactagactgtcgtttttggtggagcggttcatttatttggaactatgacatgaaaaccaaatgggaggactcacatcctttcagcagaaaggtacctgttctttgtcttggcacaagccaggcagatcattttctccctaaagctgatatccttgggcttattggatgaaacaggtctgctatttattcacatttgattagatgaaaacttcattaattgtggattttatcagattgagattccgtgtttgtttcagaattcctatgtaaaatattttcactttgtacctggttgcttgaatttttgcaatttttctttgaaagacccacgaatcgtgttccattattaaagcttaagaaagtgagccaaacctgatttacctagttgtgccctttcagttctgttgaaatggtattggcgcagctcttgacacatgagagttggtgtaaattgtgaagtcgatttaaggctttttacaaattcaaatgtttgtcaatagaaaacaagaaaaaaaatatggccctctttggcccaaggggtgaaactcttggggcgcgttccttttaagagagggaaatttatggagcccgcctctcttgactcgcctgggctcagaggggtcgcggtgaggtaaagcgtgttgagggtgccttaaacgctgggcttcggggttcgccgaatcaggggattgccccggaataag

SEQ ID NO: 11113 - DNA, 1217 bp, Homo sapiens
  misc_feature (1)...(1217): n = A,T,C or G
gggtggagagggnnggcnnntggtgttnngnncatgganagtgtatcgtgttagnggagtcgctgtggtgttagatgagacgacaaaaaaaaaagctttaggaaaagaggaccaagaaaggaagcggggtttcgggcgggggcggcggccccccccccgcggccgccggacggcgacgcggccnccnancgaacagcccccccgcacgcgaaacaggggcccagacgggcgcggcggccacaagtccacggccgcgcgcgccgggcggcccgcgcggcccggctggcgcgcggcgcgcgggcggcggggacnnaaagcgcggaggagccccgggagccccaccaccccgccccccacggcncgcggccgggcgcgcgcccccagacacgagcccaccgccacgggaaccagaccgcccgcgcccccggcgcacccccgccaccgcgcggcacgccgcggncncaccggggcaggcggcggagagagacggacggacgccaggcgggagggcgggggtcagggcgagcggcgaccggncggacgtcgtttgtttttgttttatgtgtntgccatcntgcacctgcggtaagttgctgttgtggtgcgtctacacttccctgttcgcacgctcaatgcggtgcggcacgacgcggggactgggccgcgccggctgaccctcctctctccgcttgccgtcgtcttctctcacaaccatgatggcggtgttgcggcgtttgccggtatgatgtggtcagtattgttgatcgtgttgattccactggttcgtggctcgtgctatgacgcccggcgctgtcgtccctctccctgtctatggtttgtattctcatcctatgcccgtcgtatcgcagctggggattcttattatagttgtgtgtttggtctgtgggtcgagcacattttatgttcgattacctgtcagttggtgatccttgtgtgcggtgagtgtcatgtatccatcctcgtctccttcgtcctgtctttcctctccgtccatttccgccgctggtgcagccctctctccctccacttgtccctctcgtttggtactgtcgatctctcacgcccgtgtcgtggatgttttcgcgtctcgcattattgtagattcggtttattgtgggttggttcctgactgttgatagtatttggctgtgtgatatctctgttcctcgctttacgggtgtttttcgatgtgggtg

SEQ ID NO: 11114 - DNA, 278 bp, Homo sapiens
  misc_feature (1)...(278): n = A,T,C or G
tttgtatttatgtggggggaagggggagggggggggcggcccccccccaaaagggggaaaagggggaggggggggtgggaggaaaaaaattgaaaaggagagggggggggtcatctttttaagagagcaagaagggtaaaaggggggggggtggggggtttgtagagggggaaaaaagggtgtttgggggattaagaagagggggaaggggggnngttttttggtggaggggccccccggaaacaaaaaaaaggggaggggggtgtgggggttgggag

SEQ ID NO: 11115 - DNA, 164 bp, Homo sapiens
catgaaaaacatcagaagccctacttgatactgaaagtgtcccaccttccaattacgatgccaacctagaatgagaattcccacattatgtactacactggaaacagaccaagacttgacacttaataaattttatgaagacattctcactaaaaaaaaaaaaa

SEQ ID NO: 11116 - DNA, 306 bp, Homo sapiens
atgcgacacaaatataggagcacaggtacgtgagccgagagtgctggagagcttgacaaggtcacagacccacagtgttccgtccgctagggaccaagctctttcctggacatctgcaggcgatgactacacacccttcagtggctgaggcagccaaagagatgtgtctccacccccaaaccttacgatcctgagctgaaagtgtccctcacgctgtttactgataagcccacaggcttgagggttgtgactcattctttctcttgaaggaaacagaataagacagtggcctcgttggcctcaacc

SEQ ID NO: 11117 - DNA, 940 bp, Homo sapiens
  misc_feature (1)...(940): n = A,T,C or G
aagggaagaaaaggnaaaaaataaggnagaggaaaaaaaaatnnaatagataagaattaaataataaganaaaaaaaagatagtcatttggggtaaacaggtaacatatacagaccaggtggattgatgaatttattgatgaaaacgnaatatgctttagacaggactgtcatctagtctaatattctaagaggttgggtgttgaagaacagccattattaggaggaaaaagttacttgtaacatgagnaatagtaataattgttgaataagaaagataataaatgagaaaattatgaaataaataggaaagaactaaagacaaaacaaccacaaaaaaaancacgaccagctagaaaccaaaatgagagaacgtccatcaacaataaattagatgaaaacatagataccaacactaacacgcgacccacacactaaccacctcccactatactcaccatcccatccctaagcagcataacgtaacaccgtcacccacaacgnaaaccaaagatngatccgtctttcatgtttctgtttgtcctcatacataagacaatactccataaacnaaccaaccgtgccaccataaaacnaaagcntacagagagtatagtagaataataatcacaataattagtagattagtactctagtatgnccccataacctgcatacaattgttncctacaaacccccacaccccaccctaagtcacccgtccccccctccccaacacatcactccctagtcccccccctcccaccaaccccccatcccccatatagactctgacgctacattcccctatactcaaagacgacaaaaagtcaagcgcgaccgcccccctggtagacctgaacgcgtgccgcggtcccatacttgtccacaatctcnccaacgcctccctataactctcaccatatagatcaacagccncc

SEQ ID NO: 11118 - DNA, 359 bp, Homo sapiens
  misc_feature (1)...(359): n = A,T,C or G
agatggccactgatttctagataagtnnaaaaaaaaaaaagtattcgaagtaaacaaaaatatctncttcggattacttcgtacaaaaaanaacgtggagaactgtcagagaatcaaccaaagacctgatttaaaaaatatgagaaattatagtggccctaaatcactatgctcgaatggtcttcatctaaaacttctcccagacttaaagaaggatgtagctaagctaccaccanaaatgtatcaacaccttccatcaaaaaggagggtgatgaatgcccatcaatctccaagaacagtacagccttacttgtaatgttatgttttaataaaaacatggcctcctagcccttagcgag

SEQ ID NO: 11119 - DNA, 1777 bp, Homo sapiens
  misc_feature (1)...(1777): n = A,T,C or G
catactacagctagtacgnaccatctactacgctcctcaccgcacncgcactcagcntcgngggactcgagtaccgtgacagagagangagacctcgtgtgntncgctctganatcgtgtatgtaacgcgggtaggcgcgtgtacagtagagctgagngagtngncgtgagcggagagtgcgatacgcgagtgnangagagcgtcctacgcgcngacgcnatactgcttgacgntgagcgtggtctacttcttcgnangtgcngctatgcatntatgtgnggcntgctggctcgcgttngtagantctcgtcntntnactcactctcgcgtngngnatcaccagtctacgttgncatctgtagtagntgcttgtatgatgtnnatatatacgtatactggtaganggagaacgatntngtgnngnatacgtataagatgatatcagcgtgatagncttgtgtcgtgcgantatgagtgctacagngcgcngcagtcacgtcgcgancaaatcggaccatgcatcacttagtactctantcttangncaactcagcagaccgtgggagacgacgtgtgtggacatctctcagctcgtcgctcgacctacgannagnatgtgtngnanagactgagtatagcttctcgggatactgagatgtgactcgatgnaaatnnaatatagatacatctacgtatttcgacccgctgtgtanntatcatctcactcgtcggccatcatgttgantcatctctgaagcgcantcctgcgntcgctctctgtngngcgtgcttactttgaggnggntcaccgtgcgngctactcatacaatcacaaannagctcnagaatacacatcgtanatcatcatagacacatcatnancnctgtgagannngacagctctacatgnagtatgngatagtctttntataagatacgtatgatctatatatatntacgttacatatncttagtagngnntgntgcgcatgtgatagatagtctctagtgtgtggcgtcgttcgtaaggaacgccgtctagcatgtggaatgtgtnggtgcgtgattatntnagtagnncacgtatagttggtngtgctcggtganagcatgtgtggagggtgcgtagtgagacgnaagtgtngnngatcgcagatgagcctcagtgaatacgcggatanaactatataccatagcagcattgtaactacaggtagactgatagnagtgtagacacgtatgagacaataacgtcgtaggacgtgcatgcgtgggcgtgtgtgtacttgaccatatgcgcgcggacggggtgttgnnctcgtaaaacgatgagacctatctctggngactcctatttaanacttcgatcatcgtcatgcgtattnccacttattgtcgctanttcccactcantcgattgatatnncctatcgactaaaaactactaaatataatccatgactcataacctaacatnncctnttctctgccctctccatnnntctcacttctttctctgttctctctttctttctcttttctcctnnccttcttctctttctcttttctcccnnnncctctcccnncccttttctcttcnncccgtgtcntaaaaatctgttcgattcncttttntnctgttcctntaaaanntcatttantntnnnnnacatataatatatatatnttttttnnttttttttnnnnnnnttacgagnanttcgattatatannnnnnnnngccctagctactgtatgngacttgtgctagcacca

SEQ ID NO: 11120 - DNA, 1423 bp, Homo sapiens
  misc_feature (1)...(1423): n = A,T,C or G
agcactactatcggtagcctctctgacgagcgagggcagtgccccggtgcgacgtcatgccacgacacgagnnngcgacctcgcgtcgcgcgcgagtgcacctctgccacgtgccgtctgtcccacactgagaagcacaggntggcactccgaccacgaantcgnnnccacgcgcgggtcgtcgctagcgcctcttnggacaccgcctcntcctaccaactgtggnaccatcgcctccgcccactggcanccgctcgtcgnnactccgtcgggnacaccattactccgcgngcaccctgccacccgcttcnctccgnancctccacctcccctactcgtcattaatatacactctctgcgccgcccagggtgaggcgccatgcggcccccgccgcacggnnccacacgccgggccaacggactccgctctcaccccgccgttgancctcgagnccacgcccacctcgcccacacatccgcccgaggagcggcggacaccactcgtctggggnggctctcgcctcatctgagtctcctctantactcagatcccctattnccgcgcaacaggcnncactctcggctccctactcccnncaccggncccggtgggggcgcggccggggctcgctatggagacgactcgtgcgtgngatcgtggatgtccgcggccccctcaccccactcgaagcgtggacaccctccgggccccgctcgctgcgcccgtgtgcctagcgggcgctctcgtcgcgccangagaccgcgccacagcggggtaccccgcggcctgctgggctcccgcgcggcacaggtgccccggcgcgcccggccgcgtctgnaacagtgactccaacggggcacacaagnncagatnntggcctcctcacttgccttatcccccatagtcactanaccatcgnggcggaccggccatcctcttgtgggacgagcggaatgcagcntgngcgtgtgtggatctgggtgctacgcgaggggccctctcgatgtngnngactctaccacaactatgcctannnccctactnaccactagacatacttgtcngctatgtgatnncccctcgttctccaccacgtnacanacccacacacgccccatgccctctactntcctcntccacctgtcctcttcctctttntctcctntcctttctcctnccctcccncncctccctctctctccnnnnccttccnccttctctcactctcctncnnnncctctcntnnncctcnncccttcnnnncnnctntctaccctcttnncctctnnttttntnnnntctcctnntnnnannnnattttntntnnnnnntnannnaattattttnnnnnaatatttnnnnntttnngttntntggtgtntattnataatanatgtgttcttgctgtcctctcttgccacc

SEQ ID NO: 11121 - DNA, 896 bp, Homo sapiens
  misc_feature (1)...(896): n = A,T,C or G
gttatattatttcacgattccagagacaganagaagggcgccttgtggagcactacttagagtagatttccacacctacaaccatctcatcttcaacaaagctgtcgaaagacaagcaacaggaaaaaggactccctattcaataaatggcactgagcgtactgactagtattatgcaaaagaatgaaactggaccccttatcatcatcatatacaaaaattaactcatcatggattaaagacttatgggtaagaatttacactataaaaatgctgaagaatgcctagtaaaaacccttttcagtatcacactcggcacaagaatttatgatctttgtcctcaaaagcaactgcaacaaagccaaaaatcgataaattaatgaaactaaagagcttctacgcaggangagacaccatcaaggaggccaaaagaaattctacagaatgggagaaaacattcactaactatgcatttgatgaagatctaatatccagacactatatggaacttagacgaaacaacaagacaataacatataaccccattaaaaagtagacaccggacatgtacagacacttcacaaaagaaaacacgtggccgggcgcagaggctcacgcctgtatctcagtactttaagaagccgatgccgccatattaaagcgttaagaaaattaaaccatcctggctaacacagatgaaacctgtctttactaaaaaaaccaaaaattaacccgggcctggaggccggcagccagaaaccccaacttctccggtaagctcgaacaagaaaatatgattaaacccgggagggagaacttgaataaagccgaaatagcgccactgtactccagacagagttacaaagccagactttggtgaaaaaaaatacaaacag

SEQ ID NO: 11122 - DNA, 1624 bp, Homo sapiens
  misc_feature (1)...(1624): n = A,T,C or G
tagagtgaaaagaaagtngaagagaataaatnnaagaaagataaaaagaagggnaagggtaataatgaagtgaagtaagaaanannnnnnaaagaaatataatttatgatnnnaagtatanaaggtaatgagngataattnnaaaaaagtaaggnnaaatagatagatgaaatagganaataaaatgtgaaatagaganntagaataaagtaanagatggtatgtgttttgtcagtattgctagactgtgtctcataatgtataggctaataaatttcctgtnatatttntaattatgtaaattctacatatgatataattaattatgcagattacacgngnaaatgaggtnagnatgaggaatagtggttatctgtgntcaatagttgnaagagntgaggtatatatantataagtgtagtgagagnnntnnanatatntgtcagatgtcgtgatggtnntgatgtctctatacttcgagttgtgctatatcctctagtcnntcgtagcgagtgtgtgnccgcgtctgcgatctacgcgtgctggtgnncnccccgtcatgtcatctcatatgagcttcagcaacgagcagagcncacgtgcacgactcgtcncactagcgcngatacatgtacacttattagtatgtacacacncacagcgcagatagcgccngaccacgccaggcactgcccgcacgaggcagccacgcgactcgacgacaccagacatcagcgacgcgcancaacacacaatgnacctcctgcctcactgcgccttccagcaatagtagtgcgtataactgaacgtgagcaactctctcctctctataatcgatcgtgtacacaccgcagagtcatgtcncactcacatatctctctgtncacacgactcccctcgcgactgtacacgtctctctcgcgcacgcgtgtcacttatactgagcacatcgagtncaangcatatgccgcnctcgcgtctactctcangtatnacacacagtccactagagtacgtcntgatctagtccnnncacgcctaaacacacagagagtgctctacacgtcagtgaacacatcgtccnacnaccagcacgtgtacatatactcgtctgtcacctaacctcngagctagtattatcccctcacagttactttcgcagcgtagcactgctgtatatgcncagtgagtattggttacgcgcgcgtcacctcgtcgcagctcncttatatgtcgctgatcatctagtagtnccncatctacgcacgagagatacgncacgacgagtgtacatagtttcacagacacgcatctctagtcggtatgatgtccnctcgcgaggatcncncgcncagagtgagagagtctatctcatagcggtgcgtgagttncnnnncanacacaggtagtagagatctgactcgcgacacactgatcnncagaacagcatagagancgnnnccatacacgctgcgggaaggtatatgcnccgcgagagatatatgatgtcgncncggtacgtcatgcatggcagtgatctgtatcngcncatacatctctatcaatagtcaacgtagtagctactatccacagagttggtctcgcncntatgagtgtanctcag

SEQ ID NO: 11123 - DNA, 968 bp, Homo sapiens
  misc_feature (1)...(968): n = A,T,C or G
cctattcttataactagtcccgtcgtcgtatgtacgtttgcggggcgggagggcgggtgggaggagacggtgggcggggcgagggcaggagagcggggcgcagggaggttgangagcgcctactctactaccgagcccccctatgcggcggccgggccccgcgctcgcggggccagagnacctagcggacacggtcgcggtccacggggcgcgctggtagncccgatgggttatgatcggcgggctttctctgggcgaggctagcgtgatcaatatctgctnaatccgcggaggggtgagcccggccctggtgggcaaggacgtgagcgcgggggcgatgataaagggaggtgccaggaccagggggcttgggtggtgcgacgtagagtgcggtcatggacactatttgngccctaggccacacaccgtgcaaangaccacaaatagaagtggctaggggactatttgtgtggtanacggcttagataccagtggccgccgagngtggatgggactgggggagcgtgtgggctgagcggggggggctggggggagcgggaggctggtctcggggcgacgcgggaaatggagagtgaccgaagcgtgggatgtcattagttgagataggatattgtgcatactctacccacgcgggnggcgcggggtgcgtgggccctcgtgagcgcgtgctttcgccgaccctctagggctccttcgctgcctcatcactcactggttcgcgccccacttgccagcagaggtaaatcaaggactgagaacaacacaggtagtctgttagagtactgactctatctcactggtcatttgtccttttccattccattcctgctccccccccaatacacccgcagcctcgtgccctcagcggcggagtcctncgcccaaattattattatttgtgttataannnnnnnnnnatnnaagaatnnatatgcttattactttcc

SEQ ID NO: 11124 - DNA, 165 bp, Homo sapiens
atggaatgctggcccaaggaggataagcacatatgaagcagacctgtaatcaagctacagcttggagccaagtccaggtgaaggtaagtgagatcagccaaaccccagccaacctacttatgcagattcttaagcaagaaataaatgcatgctgtttcaatccaa

SEQ ID NO: 11125 - DNA, 265 bp, Homo sapiens
ggttacctaggaggcttttttcgggtggaaaaaccggcaggatgcttaaaggtaactcccggctccaggaagtcgctgggttttatattaatcaaaacatgtgttctggggcgaattgagggattccgctgccaattgtgtatcagcatttcgtatagagaagggagcgagaccgccattgaacacttatctttttgcaattttggaggttttccctggtttttcggatagaggggggtcaccctaaaggaccggtagtgaaaca

SEQ ID NO: 11126 - DNA, 1138 bp, Homo sapiens
  misc_feature (1)...(1138): n = A,T,C or G
aaagggnnnaaaaaatgagnnnnanngatagngnaaganaagagatgaaannntgnagaaatagnaaggntaatataagtntnatnnntaagtagttntnnnnnnnnnaaaaagaagttaatttagtttntattagaagannaattaaagtnnaaatatgannagaagttgattnnnaaaataatagtagtaagatatngataagaagaatnaagtgagnnagatgtaagggataaannatctagtttattatcnatcgaattagtacatcaacaaatacatctgaataatctactacaggntatcattagtcactgagtttacacatttagtcgtttaggnaggtgagaagaggaaggatgtgtaatgaaagagnagaaagtaagtatatcaagtaaaagngagacagtaatgacagaancaggatagttgtggattaaggcttaccgcatagaatccccgccactaccaagaaatgcaaggacctcatgacagccgtgtggagagacgacccgtccattaaccatataagtccaccccctcgccaaccgacgcgacccagcccgaccaccctccacacccgccgcgcacgccccacacccgcgcacccgcggcacccaccgcgctgccatccatctcatcccccctcctctacagtccccccctgccgcatttgtccnacgagtcacgtccggctcctggtacgtgtcgaggaccagaatactcagtcagaacgcgtctgacactaaagaaacagatccaccgaccgaacgccattcagctagtatattaatgnttacgaatacactgagcggtgcgataacctacggttactcatatatccaacaacggcatatagtcnacacacgactgtgcagataccagcacaccaaccactaaccgcgacaccctgaccaccctcccctcgccagaccncaccaatcctcaaccactattacatgagacactcnacacccattcgtgtgagattcaccnccccgacgtatgaagaccgcacacacgtccctaccgtacactttacaagcgaagaacacgccatgagtgttgcccncaaacgaacccacaattaacnnattcgcgtgcgttggtcgtggggcagtggttcactagagacgca

SEQ ID NO: 11127 - DNA, 891 bp, Homo sapiens
  misc_feature (1)...(891): n = A,T,C or G
cgcttgtgtcacgtctttgggtggatgggggtagggggcggggaggcggcggggggcaggctgggcgggaggggggagccactgggatacgcatggtgaaatcgggcgcctggtagtgggcgcggcggtgggtcgggggcggtgggggcgggggtgttgatgntcggggagagtggggttgcnggcttgtgctgctgggagagtttcggctctcgcgtgtggggggcttgcttccggtcggcctggtctcccggtggggattagtgaggtgggggtgtgtgtgggggggggggggagtgggctggtgttggggcgtcggtgggcgggcggcggggggggggtggttgggcgcgacgtggagggtgttggggctgcggcggncttgggagctcgtcttgttgggtcttgacgtgagcacccgcanccctatttgtcatatcatgcggtcatgttggccgggtcgaagcgtcttgacgttctccgctggcgctggactggtgtgatggaggggagtagctcatgtgtctggggctgtctgtgagactgtgggtggatgtgatttttttgagggaggggtggacggacttaaaaaacttaggtgtcgcggcattactttgcnacggtctggagggccggtctgtgctggggttccattaatttattctccctacttctcgttatttggcgtgggnaccgagaccattctanatctcctcgcctcttttcctctctcttnncttttttcttctctttttaaatttttctntctttcttttttctncccccccggtttcttcgccttacgtggtgttctggttcccccgactcttattnactgtgccattaaagaaaaaatttgggtctttttttttttctatattgtggttgacg

SEQ ID NO: 11128 - DNA, 907 bp, Homo sapiens
  misc_feature (1)...(907): n = A,T,C or G
ctctgaccgatggcgcagtcactgatctacgaagaaagagaaggggctangtgcgtaacaagttatgaaggctacataacaaggccatgaatatggagatggagatctggagagctatatgtgtagctaaaagagatcgcgggacacagggatctgcagacaagaagaaaatcctacctctctacatgttctgcatctcaatttagcatctcctattgtctgtgggtttttttttgtttttagctaattataattttgacataattaacctttcttaggttcagtgcggaaactttagaaatgtggctaaaatgaaacctaaatttagtcaatttttctagattaagttcactaaaagccatgatctcagccatattacttaagctttctgtccctaccttccccatgaaaatagtacttttatctccattaaatactgattcctggccgggcgcaggggatcacgccagtgaacccaacactttggtaggtccacggggcaataaaactgagattcggagttattatcccgcctgaccaactttgataacccccatttttacaaaaaactcaatattaagatcgcattggcggcgctcgcctagagttcaagctcctcaggaggctgaagacacaaaaatacgcttaatccagggaggtgacgtgtcttattaacacgtaaatcattacatctggccacaaagttgacctttttcgcaggatagcggaaccaaatgtttgtatcgaaaaaaaatagaaaacatgttagcctcctgcagctccactgatctctataaagagagtagtccttcctacccttagaggggttatcttttacggtcattgtcctctagtgagggtgaataatttaggagtagtatctacaacggtgactttattgatctct

SEQ ID NO: 11129 - DNA, 187 bp, Homo sapiens
gcgaagaaagtcgcagactagaaaaaagaaagaaaaacctctacaaggccgttttgttcttaaaatctcaattcagctctgggaaataatgatttctctgattatcccttcaacttttgaagattaccagatttctcaacagcaatactgtgggtctggaataaaagggggcccaaaaaaaaaaaaa

SEQ ID NO: 11130 - DNA, 980 bp, Homo sapiens
  misc_feature (1)...(980): n = A,T,C or G
ttgtgtttgtgtacctgtatgctgcttcnagtagcgggtgtgtgcggggngggagacgagcgaggcactaggcgtgaggtggggagcaagatgagagcaggagtgatagagtcagtaggcggctgggcgtcggggccgcgttctaggggtgggncttctttgtgcatcgggggtataactaatcacgagncatggggtgggcgcgatcacggtgaaggtgagaggggtggggtgtgcgactgcggggagacacggcgggctgcggctcgaacggtggcgagcggcatcgacaccacgggtgagctctagatgggctcgcgcgcgaggcggggaactgtcctgtgccgacactgtattggccgtggtctgtgacgagtgaggactcgcgcgcggtgctgggacacaggacagcgggattgtggggncgctttggcgtgagggtggcgcgggtaccttaacaagtcttacttctttannacgtaaacctttaagtgtgaatagcagacaatgtacgatgtatcgtnncccctctccanccctcacataagcgactcttcatattaccgggggtgcgcgcntccgttctttntacacctctcgtgcgcgtctcgtgaccttnaaacaatctatctcttatatacaaacaatcaagggaggggaccgnaccaccgcacaactcaccctaacctgctggctcgtcactaaaacctaatgaatccgtaccgggcacgctaccttcattaatatacatattttactatcctttcttttacatttnttatctgtagtctggtaaatctcactcgccactanatacctgtctcgcatacttttttccctcccttcctcccccccncccncctcccccttatnnnnnatgnnccacnccccccctcacactnccctctttnntttttaatattatttaaataaaaaagttnttttttaacgtgcgtaanaaaagacgcagacactttcgc

SEQ ID NO: 11131 - DNA, 1094 bp, Homo sapiens
  misc_feature (1)...(1094): n = A,T,C or G
ccgtgagcatactngtcgctgtgtggatgggtgaggggctactacatagctctggtctgttcgtttacgtgatgagtggtgcactggagatggcgagtgcgcgagagaggagtattggatgtgcgcgcgtgttggtgcgggtctncgacgcgccgtagcgagcatgtgagtgtaatagcgtngtctgcggcgtcgtggnggacgaatgtggaagagctgtggagctgttagtgagagggctagaactgtgggtatgcgggcgtatgatggtaggttgcagtggatcggcacctgcggacggtcgacggggggcgngctgttcacggtgcgcggggcggngacgaccgggggcatancggtgtggaggcggtggagaggcggcgggcaggggccgcgcgtagcgggtgggtgccgatgcgaggggcgtgtgaggtggggcaggatggcgggggcgtgcgggcgggcgctgcgtgcgcgcgtcgggctcggggcgggccgtgggcatgcgtgtggagcagcggggaccgctgcggggggggtatcatgagatgttgcgttccattcggcgtgaatgcggtagtgggacggaggggtgaagtgtgctgatttattacaaacttctactcgcatcgctgcggtctatactntctggcgatctggatcctgatgtatatgtttgtgctgggcgcgtggggtttnnncatgggtgtggggtggggcttgctttcttggttggtattgnttttggtggttcccacttatcctcgtggggcaccacctatgtttatgttggctcntgctttcccggggcggttgcatttctatatcgttgtcttttatnacttttgacatccaactgtctaatgatcgtgtgtagaaaaattaaagagtgaaagactgctcataacctaaacatataaactaataaaattcaaaaaaagaaaaaataaaacacaaaaaaaaattaaataaagattctggtcctcgttggcgtaaggcggtggtagttctnncgttcagaanatctntnntnctttctttttattggtgattaataaacgaacgtncnnnnnanactctacactacataacga

SEQ ID NO: 11132 - DNA, 141 bp, Homo sapiens
atactttagaaaacaacagcaaaccagaagaggacgagataatccacctaagcaggactacttgaaaagaagcaagtgtggaaactatgaagccttgtaatagattttttttttttttgatgaaaaagaaaaaaaaaaaaa

SEQ ID NO: 11133 - DNA, 945 bp, Homo sapiens
  misc_feature (1)...(945): n = A,T,C or G
ataagcgtcggataccatggtagccaggtctttcgagtggacagacacacacagcgttggtgataactctgctaagatatgaggcagaaggatatataaaaaacttggacaataggcgcaggtccagaatccgcttaattcttattccatcacaaaaaacagaagactgggattttttgttggagggtaatggggaagtgaaaattctgctttattatagagccttatgattgcattgatagaatttatcattttttttttaccacttacctaccgagagtngatgggacatttgttaaaacaaccaagcatgcctctaacttatcttcattatcctctatatggagtgtatgtgggaagcaataggtatctncgctttttgtttatataaacgcaaaatgtattccctctacacttcccaacgcgtgtatccctgcacacccccacattgacaggaaggaaaatacacctccgctaactaacttaatgcgtatagctcgtgaatcttctagaactgattatattacattaattacaggcgttcagtctgagtcctataaattcaatgcccaccctaggaccttcatttcaattatgcgctctgcttggcactgttccctacaggccccctttgccctgtctgtcgacttaacggctttttgtgcagggaaatatagttccccttactgatatgaacgctctctatttcattattccttccgtccgtctctagtgaatctagatcttcctcatgccaccagcctagattaatagtatgactcctttttccaccataggagtagtagtaagcgacgcggcgcgttgagtatagcggccggggaaagaatgaccacccagtttctctccccctgatcattgccttttcatgcgagatgctttctnatgttctgttataagtcgttctctgtcccaccatcgtcgtgt

SEQ ID NO: 11134 - DNA, 908 bp, Homo sapiens
  misc_feature (1)...(908): n = A,T,C or G
ctctcgctgcgttgtgccgcccccgcccgctcctgtgtcggcttcctgcgcgggtgtggtgtgtgtcgttgcgtcgggcggcgcgcctggggggcggcttcttgtccctttgcgcgcccttcttctctcctgcgggcggtcggtggggctttctctcgccgggcgggctgctggtgtcgccgtggcgcgtctcgtcgtctgctttcttcgccggcggtcgtcgcgcggccgcgtctgccggcccgtctggcttgttgctccgttctctcccgccttgtcttgcccccccctgttgtttcctttggcgtgcggtgtggtccgccggggggtggcctgcccgtttgtttgtctggcctggcctccctccgccctgtctttgttcgtgcccgcgctttcctccccccctgtgtcccgccgtttgttgtttgccgctcgtgcgtgcggtccgtggcgggggccggcccgtcgctggcttgggtcggctcgctctcggtcggccggcgggtgcgcgggcccnccttggtgggtgctctgcctgcctttttgtccggcgggtgtttctcccgcttgggttggtgtgcctgtctgcatttggggtttgctttctttccctgcccgggcgtctgtcggctggctggttttgtttgtgggtgggtgccgcgctnggcgagcccagctttttgtttgttcgtttgcgtgcgttggtcgggtccgtcttttttttcccaacacctntctgccctgntgggtcgtttctttcttcnncctngcttgcctgcctcttnttttcctttccttcctctgtaggagncggtttcccgctcctntcaancgttngtnttttnnnnnnnnnngngggtngatnnntcnaaaaggcggcnggttaataaccaatcggttttccggaa

SEQ ID NO: 11135 - DNA, 1624 bp, Homo sapiens
  misc_feature (1)...(1624): n = A,T,C or G
cctcgtcacgtagcctgcatgcacatacagtgggcgagtcgaccactgcgttctaggagtgatcagacgtacgtacgcgacatccgacgacggangcgcggctatgtatgcganggcttcgtnacctaccgcgcgtcacacctcattgatgagtccctcgcgacgtgtgatgcgagaatggtgtttnnngagtcatcagagaggtggtggcggtcgtatcatagtccgtcttcgnactagggacgcgttgtcttttcgctactctccacagcaccaccgcatcatgngagacaacgcgtatcgtagttttgagtggacgttgaatcgctcgcgaggcanacactctgatgtccgccatgtgcccgtcatgggctctctacctgcgtttccttgactctgctcttgtnagtcgtacgtgtcnacatccccgatcgagcatncgaagtgttcactgagtatgcgatatgtacacggtatcatatgatattgctgcagcgctgcgctagtcgacgttgangcactgtgactctctcgtgtgtaatgtcgcgtgggcggtcacgcggcgcgctcgngantgcgcgctgatctcgtatccgacacgactggttgttgantcctctgctctcgcaccggcgatatctagtgcggatcatgatgtgccctactcatcacctcgttgtgacatgtggttantactgcgctgtgtcgagtgtgtggagaagctgtgtttgnttgtgtgtgctnactgtgcggnccgcgcgcgnaatcctgcgctctacgtgctgtggtgctcttcgnctcctgctgatatactggactgtggtccgcgtagatgtacgcatataggtcgagtagatggtgtgtgacngctatctctactacacactctcttngtcgctcttgtcgtcgcgtcgctnaactattcgtgcgtgacacagacgcnggtatacgcataaggtgtactgtcgtagtagaacagtgtgcagcaagacacgtagagtcatctcatagntngctgcgtggctatgttgtctggtctagctgctacctcgtaccgactgnagctgtcgcgtgacgtgtgcagtgtgcctcctgtagcgctgcggcaactttggtatacattctctcctcaaanangcggtacacacgctattagtgtctactacgcgcgatctgagcgtgngtatcacagaggncgcaactatctatgaatgacgagcgatctgcaccttgtatgcctcctgtcgtgttcntccgtgcttgatctgcttctgccggtaagattgagtgtcatcaagaccgtcgacaccgcttangnacctgtgcacctatgtgttccatatcggactctngcgcttcgctgctcatcccgctgcggagcacagtgacagctggctgctcgagcagctgaagacatgatgccatcctagggtggaatccccgtagtacctcgctcactatgataacaattagatcgattantgcgtcttgntaccttgtgtctcaaaacttntgacttgngctgttggtgttnccgctttagcgaaccatcatcgtcgcggctgtgacatctcacgtcttacatatctgtataacaaacaggatatctctattaccagattgt

SEQ ID NO: 11136 - DNA, 1047 bp, Homo sapiens
  misc_feature (1)...(1047): n = A,T,C or G
tatataaagattatagtgtaatgaattaaatataggtgggttatcgtaatcagagggtgagtgagaattaggtactatgatttgtagtgtgtggaaggatataaagtgatgaagatatgtagatgaatagatatagtgtagaatataggaattggtggagtagagtgtgtgaataggtgcgtaagtagtaggagtatatatagtggattaatattatacggttagtgtgagaagaatatgattgaggatatgatatttaaagatgtgcgtagaggtgataaggaaataaatagatgtatattacagtatttagtataaggttgaaggaatgtgagaatgagtgtggtgaatgaatatatgttgattaggagttgggattaaacaagagattatcaaggaaagtgtataaagaaaatgcgtgtggaagtatatggcgattataatttgtgtgtattgtgagaagagtgaatggaaaagaaagaagtagagatagagaagagtagagaaggagaaaattgagagagagacatgaagggatagatatatgtaaataattgataaatgaagcttttatacgaaaatacatataatatgtagaagattattaattagtggatcattaatttagatgaggattagtcgttccagagtcataaagatatttaaatgtaacatattntctggtaacgaaagatgtagatagttcgaattagtgaaataattaagtatatatgtagaatagatatttataaattgataattgtaattaatagtnanaattatttatgttggtatgaatttttaattattttttactgtaaatagatttgaatgtatttacaattagtatcgattctgaacgtttaagaattagcgaggtgggtggaggggaggttgtgggggcgttggggttatggggagtgcgtgggtatatgcttgttggtgatggatgatggagtgtgaaacagggggngnnnnnnngannncttnnacggcngnnnngnnatnntctcnagctntcgcactccatttnnntttnnnnntttt

SEQ ID NO: 11137 - DNA, 201 bp, Homo sapiens
gtggggccggtggcagggggggggtttcagagtcaatgtcccttgtcgagagtccctttcctagggaggacgacccgggaggcgaatctttcaataagcagatatgggggcgactgaactacaacctacacaacaaaaccaaactctatctcaaaatctaaaacaaaacaaaaaaaaaattatgggctaatagagcatcaa

SEQ ID NO: 11138 - DNA, 248 bp, Homo sapiens
cataagcttttagtgcagtgttttgctccagggataggaccttggcgtgggttaatttccccagaaaacagggctaaattttccaatggtacgttttatcaaatttggaccctatcagtgtgtgtgacgccgaacgctatctgattaaccttagatggttgcctagttttcccttatcacgcccatttttggattaatgtgtgcaaccgccggaatttttatgggtttccttcagacctatgacaggg

SEQ ID NO: 11139 - DNA, 730 bp, Homo sapiens
cccctgcgttataccgtcttattcttcctcctgtcagccgtttttccttcttctctttttctgccttttttctccactacgtccttcctcgcctctcttttccctatcaggccctgccttctttcctcgtgctctcttctcggaccgttatgtctcttcaccaatcaccgtatctctcctctctgtctcacgcttattgctccctccgtcattatgctatttccctgtcctttccctctgttttccgttctcgtcgtcgtagtcaccgcttctgtcctcctaccttcacctctttttcttgactatcacttttcattgctcgctatagtactaattcgtttcttttctttcttgttcttctgtcctctcatcgccgtcgtttctctttccgtccaccctcttctcctgctttccattttttttttccggcgtccctttataggtcacttcgctctgtgtttccgttcacttcccgccctctggattcgtatcctctgccttcacctcttcggcgatcttctcccttcgtactctcgttcagcgcccgtactctccccatcgtcggttctttcccctttggctctccccccctctttctataaacgctctccctcttttttggttttgttctctttcttgtttttttttttatttcctttctctttcatcttcactctctgcttttctctcttttatcgccgcccttgtcttttccatcttctgtgttatc

SEQ ID NO: 11140 - DNA, 932 bp, Homo sapiens
  misc_feature (1)...(932): n = A,T,C or G
tgtcgagtgtgggtgcggttaggcgggaggttcaggacacaggctccttctgttaaatcttgcaccagacgtgggcttaccagggcccgggaaattacctgcctggggagggggtggggggggactccacaactgagcangtcgtctctgatatcttcatcagccagacaacctttgggggcatcatccctcttgccatggtgagaacatcgggttcagaaaaagggccacacacagggcttttttgcatatccttaatattcacagaagggggggggcttcttataacctgctgttttcccaagcaccacatatatttgtttaaaccaagaaggtgcagcgggagttaagtgtgcccgacctggtccccggaccggcgccgccgcctccccgtttgcctttgcgcgcccctcgagacgaagggccctgcggctgtctggccccgcggcgggaacgttccgggcggctctttctacgagggggaagtggttagacccgtattcttaatctggtcgggggacgactctacgccgggcagggggctgccgcttttaagcgcggccgaacgcgcgccccgccaccggggtggttcgccgggccgacctttgccccggcggcccccggcccctggcgccaggaggggcggtggggcgcgttgtgctaggtgcgggccctccgtgcggggcaggaggcgcgtgcggtcagggtggcggacgggcgggtactgataggcccccgccctgcagggagaagggaatgggaggccgggggagcccccccgggtaaccggtgtcgaatggctttaggaccaggttgacccggccgcgacgggcgcgacttacgtctgtactccgcccgctactcgccatcgcgcggcgcgcgcggcggtggtgcgtccgtctgtgccgcggcttgtgggggggcccagcgat

SEQ ID NO: 11141 - DNA, 902 bp, Homo sapiens
  misc_feature (1)...(902): n = A,T,C or G
tcctttctgcttgtccgcccccgggggctggtgccgtttctcggcgacgggtgcccgggggcgcctttctcttccgccgccccggtcttgttggcgtcggggttcgggtgtgccttcccgcgggggcccgcctggtctcggggcggtccccttggggtctcttttgtgcgcggcttgcagggccgggtttcccgccggccgtctgggttttgggcccctgggcgggcgccttggcccccccggggtttttgcgggccccttggggtttccccggggggttcccccggggttttttgggcccgcggggcttcctgccgacctgtgtttgtgtcccctcccgctttcccccccttttcgggccccttgtttagtggcgccgggtcctgccggcggtcccgggggcggcccagcccctgggtcgggttttcggcccccctttggggggcccgacccagggggcccctctgttttgtcttgcccccggggtggcctttcccgggcccggccaattccccggctggggggtccctgcctgggggctccccgggtgggccggtggttttttagttattggggggcccccccccccccgnggggggggcccctcnngcccggggggggnnnngggggnnngnaacccgctttntttgacggggcgtttttgcctttgcttttttttccccgggaccctttggcgcttttttttccctaaaggttttcccggcgcccccgttttttttgtttttccgcagnnaatcccgttaancccccttnnaggggcccgnttccnaaaaaaaaagctttcccccccccccnaaaannncccccccnnnnnnnnnnnnnnggggggngttttnncnnncatncggccccgcatttacatcgagttnnttttcgcgaag

SEQ ID NO: 11142 - DNA, 995 bp, Homo sapiens
  misc_feature (1)...(995): n = A,T,C or G
agattaagagacagagatacgaatataacgtcctgcgggtcgtgcgctatggctgcgatttgtggtgaacgtagggggagagtgatgagtatactaatatataaaactgcaggacagcacatgacagnnaacaaaatagtgtgtctggctgggagaagaaagagcacgtgtatgtgtgtatacagaggaccagtggtnncggggtcacgctagagagggggggcagaggtggagccaccaggaggtgtgngataaagaaataggcttataacttataacaagaatacactgaggggggaagtaataaggatggacagcgtagtggtgagggagagcaagaaatatgaggaaccagtactagtctcancagcaatatcatcacaatcatgccttcacttgacgtgatatagtgttcggcgatggagagtaccgcacaacggaggagatatcagagcacaggaggtgtgggtgatgcgtggaggttgtggagcggngggtacggggggcaacaaacgatataagtgatgaataggagaagcgagcgtatttatgtatatgaaacaaatcaaaaagaaacaacaattgagggatgaagcacaaggcgaacgatggacaagtgtagttcattgtgtgactcgtctgactgtccgggaatatttacatatatgtaaatctaagggaaagaggcctcagacaanngggaagtcgtcggtggaagtctgaagtataactggggaagagtatacagacccacctaataaggtaatatcttgtatatttatcaagagcgaagttcatatatgggtgatgtatagagagagcgagttggcacttggttactataacctaggctccaagcgtatgagattactctttaccctctccggttccgatactttaagacttacacaatcatatgcgagatagagagccgacgcaccactcactccaataataaccaacacttagcataccttcataaaaaaaaaaaaaaa

SEQ ID NO: 11143 - DNA, 883 bp, Homo sapiens
  misc_feature (1)...(883): n = A,T,C or G
tggtggcgtctcttgtgtcgttggggttgtgtcgttgggcgtgtttgtgtgccgcttgttntactgcgtccctggtgcgggcgctggccggagcggcggccacgtcaggtgcgcgcggggcggcgcggcggggcggcgctacgtctcagccgctgctctgttcggcttttgggtcccggttggcttgtcgacgctgctgcgtggcgtccgcgcggcgccgggcgccgccggtggggttgcggttccgccccgtgtacggcgtgtcgctgttcctcactccactgtgggtgtgttcgggcgggtggcgggtttctgcgttggttgtcgcttcggcgccgcgcggcgtgtttgcgctccggtgcgaggggtccgcctggctggtgtccgcccctcccctgcgcgcgggccgttagtgttctgtttgggtcgggttatccgcgttgctgtgttgtgtgtggggtaagggtctgcttggtgtgctgcggtttcctctctttgtatgcctctgccgcccctcctcgggtttctttccgggtttgcgggcgtctgtcggtcttctgcttggtcgatttcatccctctttcgctttgccttcttttcatttgtttgaagggtgggatgtaatattattgtggtggtactggttttanttcttgtgatcgttgtcacttttcgtgtctcgcggatgctttctgtgctggtcgcgccctctctccttgcttttttgtttgttttcgttgtttttttggtccccttgtggtgtgggtgcggcgctgcggggttgtgcgtcgtggcaggttctcgcccaggccgtgtctttttccggctccctggtaaggccgcgtttggttcaattaagtctagaagnagggttttcttcagg

SEQ ID NO: 11144 - DNA, 1025 bp, Homo sapiens
  misc_feature (1)...(1025): n = A,T,C or G
aaacacacgtatcgcaaaagcaagcaagacaagagccgctcgaggggaaaacaagcttcggagcgtttgcaaggcaacaccacacaaactttaaaagataaaaaacactctgaatcttcattcaatattattgctaagtattatcacgtcaatccatatttatattatcgtgacaaataagtattgccgatatacaaacatggcttaaaacttgaaaaaacaaaagaatcacaaatagcacaccacaaaacagctcaacaccaaaaacacacaaaaccatctttttaactaaatgctgggtgtacggggcacactggcgacgctccagccgacactatattctctaggggggtgattaaatacaacccaaattaaaagagcaacagacacgcacgacctatatgccgaaggtggcacatcctcactctcacagggaagctagatctaccccacacgccggatggaacaacacaaacaataccccgagaaaggatctctacccctcgttcacgcacccatattagacgcgtaagatcgagactaaaccccacaacccccgccccaccaacataaacaaataaataaacgcgactcaaccccgcggcggactccccacaataggcaatatataacaccacaacaagccgctccgttagcacttacatgcgccgtagtaaactatatcttgtagtaatccacacccactagccaactacatccttactaagatgagcgccccgccctccacccgtcagccgcgacgatacactcatatctctcacgtgcccgaagtagactctaaatcgcataaccaccaccacactatactatccacgtccccagaacggcaatagtcaatactaacgcgactcctccgaagtagacaagaataccggcgagcaagtangcgtgttgacgcgagcatgtaccgggacgcgccgctcactgtcactcgtcgactcccgactccacccccgctacatcgacaacaatcatttcagtgtaaaacccaaacattataaacc

SEQ ID NO: 11145 - DNA, 183 bp, Homo sapiens
gctatctttatacaacaattcaccttactcccctccagaaaacatcttcggaaggttgcttggaagacagaaatatgttttctgaactcttagttattcatggaacctacaagatattgcccctgtaccttaagcatttgaaaaatgtgtgtaacgttttaaaatatcgctgccaacagaaaa

SEQ ID NO: 11146 - DNA, 1789 bp, Homo sapiens
  misc_feature (1)...(1789): n = A,T,C or G
ttggttgggtgtatggttannntntgtttgganggtngntgntgtgtgtgaggtgatgatgatttttnttagagtgantaggttngtcgtncgttgngcggcncgtgaggcgtgtgtgttcngtgggttgatacctcgtttatatatacgcaagaaatattacctatatatcgatacatccntcatctccatatactattttactacctatactaatacactgtaattcacaatttaatccacttcatgctatccgccgcacgtatcgtagtcggttatgtgcgtgactacacgtagcctgtatcatacgatgaccatcgcagaaagtagcccagttgaggaccgacgcgcaccgcccgcgccccntccacctcctcccgcacacaagttacatatatatataataagtatatcgtcattattaattaaatataaatatacaatatatcatatgttaactcataactacacgacacacacaattacattcttatctcaactctactcccccccactcacagcacaccccccccgcgcacccccataattcccccatcntacgcaaaaatattaatacatttgtgacgacgcccgcgcacatcaattatacccaaacctcaaagacacacagaaggaggacaaaacgaccggcaggagcggatgaagatatggaagtgataacaaaagacaatataaatatattataacacatacnatgaacaacaacaccgaccacccaaagatactgaggaataagccgtaggacggaaccgatatgaccaatcagcctatacactataccaccagtcgcgctccccacccatcatatgtgtgagtcagtctcaatattatataaatgctgcgctctcatacacccgatacattactgtcgagtctgccgacgccacgatataacagcacgtcaaattcgtatagtacataacacatacggaatacttcgcgtaattggtaatgtaataattagattacgtagcaatgtatcctctcaatgcattcttctacgtgataacacgaccgaagtgttcacattgttacatactcgcgcgttatttgaggttaatgttagtttatantgtacatctattttgatcacgacactacctgatacacgtagcgacagcgacatccgccaagctgaagcagacattgttgtccacgacgcatactcactccacattaatacccacgcacgccacacgccacatctaccaacaattattgttcacttatacacacagctcgtactaaatctgcattacttgtcctctctacgtctccgcacgtatgccgtagaaaaacgtacaggaacaccagntgtagctatataataantatgtatgactgactgaaaatataagagcaagttatagttatgatgaccaaagtagtacaaagacaccatagtcaaccgaactcgaagtctaatcgcactagtgattatacaaagaatagcagaccactgtntcgcncgacttgtatgatctaactgccatngcgcgacaannananttacatactantcacgaagtacacacacggcacaacgtaattaactncataagatactctcgcgtcgatcatatcgacttgtattatgattattagtctatanatagtnantgtatataagtgtctaactgacaataatgtgatataagtaagtcacgtctcataccngcacgatcacangcttcnactaacatgtctcgatgcgttcgcatcagtgctctctagtacacatcataatgagaagcgttatntattagcg

SEQ ID NO: 11147 - DNA, 277 bp, Homo sapiens
cccagggaacagcagttctggactgtacaatacatcaaccaacactgagaattcagcctgcatcattgggctgaactggtgctccgaggaggccactacatcctagggaatgaaacacaagagaacccacatgaaggcgtaagtcagatttcatctttcgaagataagacaagctcaagaatactaatgggaattttatagatgcccctctatttccatagcagcaaatgtctgtgccataattatagtctggctttatgtaagaaaaaaaaaaaaa

SEQ ID NO: 11148 - DNA, 501 bp, Homo sapiens
tcaaagtaatcaaaaccaccaaaacacacccaaaagccctcaatcataaacattcgacaacactctcaacagggctaatcataaaacaattatctccatccgccatcatccacttactccaacaacggaggttacgtctcccaaaaaatactaacctaaaaacaccaaacacaccccaaaatcacattctaaaaacaaacaaacacaatttaacttttaaaacatcacaaattctacctaccaccatcttttattttaatccgaaacaaatataaacctcatccctttctgaagatatatccttttacagtccctcttcttaaaaaaaactcccaacctacttcttttttatttcaaaaccttttgtacctctcccgactacccaaatccttaagaaatcatatcgacatttcaaaatattccccttaccccctcagaacaataaaatccaccacccccttcaaaaaatccccaacccacatcacctccactcccctccta

SEQ ID NO: 11149 - DNA, 1109 bp, Homo sapiens
  misc_feature (1)...(1109): n = A,T,C or G
tcctcgtcctcgcctcctgcctcggtcgatccttgcggtctccgctccttccgcccgcgtcggctgcgcctggttgcgttacctctctcgcgtgtcccccgcgctctcgcgctccctgccgcttccgtcctcgtgggtgtccttgcttgngcgccgccccggtgcggctcgctgccctctgctgctccgcgctctcggcgtgtccgcgcgcgcgtcgcgctcggctgtcgtctcgctccgtctggcgccggctcgcgctgctgttgctccgctcctggttcgtctcctcggccctcgggcgcgtgcgtcgcggcgccaggtcaccgggcctcgccctccccggtcgtcttgtgggtgtgttcgctcgcgcctgcttctctgtcttgctcatgcgtcctcgcggtcgcgcttcccgttcacgggtcggcgccgtccctcgatcgtgacgtcgtgctttccctccccgcccccgcttctctctctccctctctttctccgtcgctctcccttcttgctcgctcgtggtttgtcctgcggcggtgtgctcctcctgtcccggcgcgccccctccctcggggcgcgccccgcgcgcgcccgcggccgcgccgcnnggcccgccgcgcggccggcggcgcgccgcccgccggccccgcccccgcgccccgccgagcgccgccggcgcgcggcgccgccgcccgccccgngcgcgccggggcgganggcggccgcgccgccgcgcccgcgaaattcggtggggggcgccccccccccccgcccgcgggggcggggccccgggcgccccccgccgcccgcgnngnngngngcnncccaccctcnnnnccccgacggtttttttttcgttgctgcttcctgccctcctcccttccgcggtgntgtttttcccccccaaaaagctgtgtccgcctggtttggtgctgtgttcgcggtctgtgttctgttcttgctcgcgccgctccctccgagtgggagacaaccggctttcccctccctgtccaagtngnctccgtctcnnnnncnnnncnggggggtgngtttnnnnccnnaaggncggcccggccatagctacnacaatcttnttttcccggaac

SEQ ID NO: 11150 - DNA, 2052 bp, Homo sapiens
  misc_feature (1)...(2052): n = A,T,C or G
atacatcagatagatacatatatggtcacgatctatggatcgagagctancgtcgctgcgtctgcgagcgnacgtantatacgtgtatgtgnagctctcanangcgagtngcgcacaggcagancgcggantgtgatactagagagactatcagctncnatacttctcatctaaanagactacgatcgacacgcgagtagtacttcatcgantntctgtcntgtnnggtcaacttgtgatnaagacgtgagacctcgtacatactacactagataagtgcgactgacactctgcatctgttatgtcgacagaaatgagggaactgtcgtgttgnagagaggataggagatacactagctaagcgcngangtancgagcaactcgcacaccggtcacaagctctatacgaacccatatnatcgacgtatngtanncgacgtagannngtatcactagtacncgtcgactgntancatcgacagcagcctnanctcgtctatatgttctcgatncgcgactgctccgacgtcgctgactcgcgatgcgctactgctgtcgacngagtctcgatcgcgacgcacaccgctcanctncancatagcgancacatcacatcgtngacatgagcgagcactgacgacgatgagcgatgcgcaccgaaaangtagacatactantgactagtacatactaccgtctacgtggcgnagcacgtctcantnacgagtcgagtcatctactctcgtacggtcgntncacgctgcgccgtcagtcacngatgcgnacatgcggntgagacattgntgactngcagcgtaagctcgacgctgncacatgagatgacgtcgtgaagtanacaccgcgcgncangatcngagaacgagacgtacgnagangganatgtngngatagcagngacgtganangacnacaccgacaaatnattgtgatgcgagagcgtnatgatcngcatcaccgagcgtcatcgtcgacagctcacgacgtatagatacgcatgctgangtacgcgncgtngncgtncncntcagacgacgcactaccagctcaacgtactaggatctctgcgtcngngcgnttgctncacangtagtgacntctatctctcnagtgangngngtatctatcgagtcgatcgatgatgatagangatcggnngagnntcgctaactgtcacacagcagtccagagtnncacacacacgtactccatcaactaatcgatngnactctacgcgtctcgcgtacacnactctaccnacaanganngtngncgagngcgcgtgtacaacgctgngattcgctagctggantagaagatgtactatgatacttagtgctcatantacgatcggtattgcacatangtggataccgacagagatgagagatatgcccgtcagtaagaggtatgtactcnatcatgatgcatgtcggtgcgtggcagtcgcacactgagtantgnatgactctanagctactatctgaggacgtgactttatgaggtagtgagacaggactagataatattcaatactggaanantatncagtgactcgatagtcctgacgcagtcctgtgcngcacgacgnctagcctgtgcagctctcatcgacggctgacagtgagnngngctatgcgtantnacngcactgnacgcaatngtgcgactcgtancgacgagtcgagcgtaactcgccagcctacactcaacgtcgngantgatcttggacatctgctgcagtacatagagactagtacacacatattaagtatagcgcacgatcgctaacgcgtcgtgtgnttctacgnaaactaagtanctcnatagcagatgatcgtgctgattagggtnacntgtacntnctgangctgatataccaggcttatagctatctgagcgnactgtagggttcgtnngcgtcctgatgatacactattctctcgtgctacatctgcacngagctgactacgtcagatcacacgctncgctcagaagagcgagtaggtancgcagtgctgagagcaggtagta

SEQ ID NO: 11151 - DNA, 1597 bp, Homo sapiens
  misc_feature (1)...(1597): n = A,T,C or G
tacgttgnangatactctcgaccacgtacatggtacggtagagacgagcgtagactcgtagatactctggtcgcatctactcgtactgacganagtttgnacatagagggtgcangatantctatcgacacagtagtcgtaatngancgacatacacgtcaggcagagatcatcgcacatatgttngttattactatccacatcanattcatatacttatatgagtctgtgcgtcatgactctaccgaatgatctctcacananatgtcatagatgcgtactgacactgcactagctaagtgcatgcgccagcccanctacgcatcataganctcacatcanacaacatactcattgcttcgaaccatcagcttcattctcactcgttaatacgcattctcgaactacgcacacgtcagagctcgacgngatcgntatctctanataatgacacaagatcgctgatcgacctacaatacacntcatatagtaacactacacttngagtacgagncgatgtnantaagtctacatgcgcactgtctcggntactatctacaaatactcgaccactccatacacgtatccagacagaatacatagaataactcgtactaactcagacaatacataacaganacgacagctatatgcgacgaatcaggacnaccgtcgccacatcagtcacgtgattacgacgaacgagcaataacacaaacgaccgatcacatactatcacgccgtggcgcggtcggctcgaggtgtgccgcgctgtggcagctntcggtgaagacgcaatccccctgactttggtgctctgnctattgtgagcgctgtgatcggaggtcaaatcgctacgttcctgtgaggacatagagcgtctaatagtctgatacataaaactacactatgagcatgtgatagttatcttctaagatgaaaaatgtaatgatacagtaatttagtataagagtgganacatgaatacatacatnctaagatancacagagaacataaatgcaaacatatacgactcggaggagacagaaatcgacaaatcataatacgatacgatgttctaagattaaacatacattacaaactctacgacaacataacaaccataaccaatatagatatactatataaacatacaccacanacatattaaacgcagcgtcgtacgacagctcacagtatcagaaagagtagacatacaactactccataagcaaataatggcaatacaaaatacaaataagtatcatatcttttcaccctattatcatcctgtctctcatatcccactcacgctctctggctgctagatgcaagcgctgccactcacgccactcgcacatcccgtctcatctatacgtgctcgacnctcctcatgccgtgacttccgccaatctcggcaganccacancaatctcactagacgccatcacaacacaganatcctgnnncnnnnnncntanttcgnnnnttntccntcgnnntattcngactacatcctcnncgtatcatcccgttcgatnaatcacnctcacctnnntctnnnntcannntnnnnnaaaaannnaaannnncccc

SEQ ID NO: 11152 - DNA, 904 bp, Homo sapiens
  misc_feature (1)...(904): n = A,T,C or G
acacgttataatcccaccacacaaacaaaaaattttcaatatacattccacacatgctcaacangctcatataaaacgattatctcatctgtcatcattacttattcaacaacactgatccttctcgatcaaataaaactaaaaacacnaaacataatgcaaaattacattctaaaaacacacacaaacaatttaacttttaaaagataacatattctacctaccacaattttttattttaatctaaaacaaattataaaacctaatactttctaaggatatatccttttacaggacatcttctaaaaacaccctccaacctacttttnttctatttcaaaaccttttttccctctccacactaaacaaatacttaaaacataatctcaacttttaacactattttcctctaacatacacaccaatatacatccccaatcccttctaaaaatatccactacacacacctccccaatcttttctatttatacactactccctcatccaaactcctactcaatacaaaacctcccctcctcccatatccaaaaaacacttccctccccaaacccacctcaacactctgattcctacataccaaaaaaacatattctaacttcttccaaacttctccatatataacaacataataactataaatcctatcattcaccccacccataaaaaaaatataatccctacttacctaaccataatcttacccccctccttcactaactttatcctctaatcacaccccacccaaccaaccattcctctccctactttacccatttcacccctccatctcatcccttactctccacctttccatacccttgactacccccacacccacccccccccccctcttcccattccaactcacccccccaatccccct

SEQ ID NO: 11153 - DNA, 914 bp, Homo sapiens
  misc_feature (1)...(914): n = A,T,C or G
ttctccccccccctctttcctctccctgcctctgtgccttcttcttccctcggtcgccttgtcctcctccccggtgcgtgcccgctccgcgcgtcgttgtctcgctgtgcccgttcgcnactctcgctggcttttccccgcgccgttcctctcatcgtcccctcttttcccctcccctccgcctgtctctgttgcggctctgcctccccccgctcgtctctgttccctcggcctccctctccgtcgtcgcttctcgcgcccgcccgtccctaggttttctctcgtcctcttctcgcgctgcgtcccccccgggtccctcgtctccgcgtgcccccgccccgtccgcctccttttggcggcccctcgtgccccccgcccccggctttcctcgcctccgccgggtcgttctggctcgccccttccccgctttttcctttctcggttctgggtctttcgtgcctccccccccttcttgtgtttgcttctggggcttcgggccctctcctggtgctcgtccctcttgccggctcctccggtcctgtccccccctcgtccttccccctcccgcggcctcnccctcctcttttctttgggggcccccccccccccccctggcgtgcttctgttcttctcctttgtgggttgtggntnctccccccttcttccggaggccggggtttctgttctgccctctcccctcagtgttttttttcccccccttcaactgcgtcctcctgttttggtggtgagttagcgcgctctattctgttctttttccgccgctccgtcggtgtggatgtcatttccggcttccctccccgtctcaagngnctccgtctcnnnnnnnnnnnnnggggggtngcttnttccnnccggncggcggctcgtagtacatcgacttnttttccgggacc

SEQ ID NO: 11154 - DNA, 1259 bp, Homo sapiens
  misc_feature (1)...(1259): n = A,T,C or G
aacgccatcgacaagacgcgcgaatacgcacgcacgtacgcagcgacggcaagctcatantacagtatcgcgatacagatgggccgagctccgctcgccgcctgctctccgtagaaagcacgccagccatccanancactgcgacatacaccttactcaacctacattcacgcagcacacacnaccntcgccatcgctcagatctagcgcgagtactggagaatacacgaacttanagtataactagacgactgatcgttngcgangactgacaccgcacagcgcagttgtggatgcgtagcgcgtcttgangacgcgctacgctgcgtacgatngtacccagncgtgcatcgacttccgtcacccncctacgcgcgctgcgaacccgcggcggcgacagcaagtcgccgactgacgactgcgatcgagccggtgccacaaacaattcanctcgttagagattcccagcgactagccacacgtcatgctaatatttataattgggcctcatgagtgagtattacacaatcatcgtttcagtgcattccagaacgaatcacatcaatatagagtgagagagtgcgantagtagtattgtaacgattgtcacatgttactggctctagcgttagcgcatcgacaggaaggagagtcgaaggcagaccgagatgcgcctatcactagctctgcagttatgtgaagtcgcgacagcgcggtagtgttgcggagagataagaccatgaccaactacactacagagcgcgaactggcacggtgcggcgggctccgaaggaggcgccactgccagggagtcgcacgacctcagcgggccgagccgggcgtggcggacgctcacgacatgccgatgtcaagggcagagtgagagtgcgtgacagagcaatctagaaacacacgaaatctgtgcgtgagaaaagtgaagacactgggaaccatattacgaacatctacatcctactatacgtataccaaatgcacactagtcgagggccgctctgattattagctgagagagttagaccgaagacaacgccagactacgagaggcgcttacagaacggaggggtgtagcgatacgtcgcagatgaatatggtgcaaatcatacatagtgcataacacaacaacactcgtcatacgtgtttgctcacgtnacatacttctttcggcgcgttgttcctactattacgtgctgtcgtctgcgtctcacgatgatcaatattattagcgccacattgttcga

SEQ ID NO: 11155 - DNA, 1018 bp, Homo sapiens
  misc_feature (1)...(1018): n = A,T,C or G
tcctcacttaaatgcaatggttacaggacnntatactcaccttcannccaccctcttctacagagaggtacataacctttgggtgcctggaatgtcacccccttctgccgaggccccttcgggatcgacctgagaaaaccanccantgagagttccctccaccctttctcaatggnatccccactcatccagacctggagaggacggtgantgaggatncgtggctccctttcacctaaaatataaactacaaaataatccctcgagtaaagngatggaccaccccaangccttcagcaacaaacttgggccaaactttganggtggtgcatacataancacctagatcgctgcggccaaacaatctagccccccacttcgacccttttttaccaaacttttttgacaacttgcccaaaaattggtccacccttgccctcccccattgaaatgtaaataaaacttgctgtggctccatgggattacctctagaataactcagaaagagaaaacaaaacacatgcgccctccttgtggcctcacaccggcaagccactctctcccagccccctccactctcttacatgaaccggtctaaaccacatagaactctcgcgttacctgcactcccgtcgcccctccagtccattcagaggttcgagcaaacccgtcatcacacctcacctccaagccgccgcctatcccctttcatccaccacactgccgcgccgtatactcggtcgaagaaaccgtctcggcacacacccgcgccccaccatgtcgcgcgcacgctcacaacgcgcgcctcccttctgcctctcttctccaaccgccccgccccgcgccgacactataagacaagacaactctcacgtgcacccgtgtcgcacaccccacgccgattcaacatccccccccttctcccctgaggccgctctcacacgtcctcaccggacccncctcaccccgacacctcacccctctccctcccaagtcccgcacctctattcncccaccg

SEQ ID NO: 11156 - DNA, 732 bp, Homo sapiens
atactgacaaattgattgtaaacatggtgtgtttgtacaatatgaaatcagttcaccttgaaaaagaccagaataacagcgattttcagggaacaaggggagacaaccataaggtctgactgcctgtgaggtcgggcaaaacagagccatatttttcttcgtgcagacagcctataaatgtacgtgtaagtagggaagatatagataaattcttttcctagcaaggagtattaataattaataccgtggggaagaatgcattcctggcgggaggtctataaacagttgctctgggagtgccggtcttaagtggttgagataaggaccaaaatacgccctggtctcctgcagtaccctcaggcttactgggttggaggaaaacctcgccctggtaaatttggcatcagattggttctctgctctcaaaccctgttttctgttgtttaagatgtttatcaagacaatatgtgcacagctgaacacagacccttatcagtagttctgttttgccttgtcctgtttcctcagaagcatgtgatcttagttctgctttttgccctttgaagcatgtgatcttgtgacccactccctgtacttgcaccccctcccattttgaagtccttaataaaacttgctggttttgcggctcaggtgggtagcacggtcctgccgatatatgatgtcacccccgaagtcccagctgtaaaattcaaacaaataaaaaaaaaaaaa

SEQ ID NO: 11157 - DNA, 1235 bp, Homo sapiens
  misc_feature (1)...(1235): n = A,T,C or G
ggcggatggtgccgcaaaaaggcccagggggcctctcctattcacttgccaactctcttcacaggctcacctaaaagcatttctcattgtcatcatcacttactcaacaacgcagttcgcgggtcacataacataaaactaaaacacaccaaacaccaacgcaaccctcacattcctaccaccaaaccaaaaagaatttaacctctttaacacatgaaccaaattcttcccttcccaccatttgtttatccttaactctcagaaaaacctataacacctgctacctttctgggggggggtatcctctctacaccgcaatatctcttacaaaaaaactcccaaccctacttcttctctctatctccacaaaacctcttcccacctcctccagcactaacccacaaataccgtaaaaagatcgatatcggcccacctgcaacatctcattcgacctctagacacttcgagcgagcaactcaacacctcctccacttccctgtactcaagaaccaagccacccggccccatatcccctccaaatcgtgtaacactctccttcccagccgttttgccccttccacgtgacacgcgttcactacgccacatccactagccttcacctcagatcgcatggccgacccgcctccgcacgccgtttgctctcgaaccgcatgttgtgtcctcacccgcgcgccctaatgatacgcttccgtctccgactcgcgcaccattcctctcccgtccgtcttgtagagacagtcgggcctgtggtaccgcgcgcgcacatacagccgcgcgacccacctgcgcagcgcgcgcgccttggctgcctgccgctcgttcatatagagtaaagnagtcaccgcagccgcgcgcttcgtacgccncntagccgcgccacgcgcacgcggcctgtcgntcacattcgatcgtctgctagatacagacgcgccagatagtctactcatcacaatcacacgaactccgcgtgcngcctcgtgatacggctccccacgtggcngcacgccacatgactgtagtacaacaccacccgcccgtcccacaacatcgtctcggcggacatctgtcccgtgagtgcganaggaccaagcccggcacacacgccagcgcgtcgacgcccggccgcgtacacctcgaccccctatcacgctcgacagactctcgacctcgaccttcgtgcacagacccacactctcacacaccgaccncgcgcg

SEQ ID NO: 11158 - DNA, 1211 bp, Homo sapiens
  misc_feature (1)...(1211): n = A,T,C or G
ttcgtctatcagttgatacttcctgtctctcgcgtggccgcgctctnccttcatagctccgcgcgctagtcnggcgccgttggacgccctgcttgcgctggcggcactggtcttctgggcgcggtgcgtggagctgcgtgcggtggcgcgtggcatcttgcagctcgggacacagtggtgcgtggagagtttgatggagtggagttgtatacgtcggtcgcgtggcgtcgggtcgcgggtggcgatggtgcgtgtcggctgtatacgtacggctgttggtgaggggagtatcggctgatatggtctacgtcgctgcggctctggtgcgcgtgtgtcaatcgtggactattacatatattccacacacattacctcacacacattcattcactatttcctccttatctcctctatctctcgcgtatgctcccgcgtatccttatgtactacgcctccataccccttacctcgcccncgacctatgtacacccttgtcacgtctcgtctactacttctcgctcgcatatnctatttccacctgctctcttcagatctatgtccatgtttcttctgggccaccgatcccgtgggtctttaatagacggggaaaatatgataagttgcagtcgcacgcaagggatcatatggggcgggtgtgggacgcggacgaccagcgtggggtggatctggctcgggcgggtttttgttgtttgggttccctgattatctcagctgatatacttctggttaagtccagggcagatcgaactatggtgtggcagtctaagttgggggcagccggggcgacattaatatcatctctggcntccgccttaatgtactacccggttcgttcgtctctcgctccctctctcatctctcctgcatttatcaaattgtcacgcatctactcgcctacactaccctccgttggcgtatgatgaggtgaggcggcgtggggcgtagggggagggttgtcggtgttggctggtgggtgggttgtgggctggtagctgctgttcttcgcttgcgtgttttcgtccgcctccccgcgcccgctccgctcctgccccccgttctcctctgcccggtcgcgtttctccgcccgccgtgcccttcctcnnnccccctccccccttattcnctcntccccnctccctctccctccccctcccccaccttccttcctttcnttcccnnnnnnncccccc

SEQ ID NO: 11159 - DNA, 884 bp, Homo sapiens
  misc_feature (1)...(884): n = A,T,C or G
ttattctatgtctctcttactacttactacaagttctgctccaaacataattaaaaataaccaccaaacccacatgagagtctaaaaacaaacttcatctttttaacttttaacagattacaaaatcttcctgccactattatatattccactctattacaatttataaaactgatacttcctgaagtgttatccttttacatgtgctattctaaaaaaatctaccaaccttcttttcctttatttcaaaaccttttgtacctttccatactaaacaaaatacttaataaatcatattcactttcataattatcttccttcaaaatatacaacaatcaaaattcacatttctttcaaaccaatatccaattcacataactttcaaatatttattctaatttataacatttctagctacaatccctcttcactactcaaaaccacaataatatgcccctttacatctaccaaaaaccttatccctcctccccccatacaaccatctccccctgtttttcttaattaattaaagacacatactcctcccctctttcaaagacatcatccttctccccctaatatctcaaccttctactctccttctctcaacccacctctataaaaaataaaacaacaccttcttctcttccctaaccttgaatctttcccaaccctttccttcaaaagaactaaatcacccaccccccccgcttcccccctagncttccgccatcaccccaaccacattattcacttatctcaatcccacatacttttcttccaccacacctcctaacacccaattaaacttgtacacacagcacctcatacccctacaccatacaagcctccttctcccctatttcctacccctccccccttac

SEQ ID NO: 11160 - DNA, 1114 bp, Homo sapiens
  misc_feature (1)...(1114): n = A,T,C or G
atcgggtagagagaataacgggatggtatgcgtagatcactattatcatattcttagtgtggtcgtgcacaggagcgaggagtgtagtggagtggcgtaggtaggaggcagaaaggtngattaaagaggggaggcgagaagtggtgggagagaagtagagtaaacgagaagttgagggggagagatgtgtgtgaagagcacgtatggtaagaggatgaagagggagaggaaggagaggtgaggtggagaaggagtggggagggcgagaagatgnatgttttgtataaaagcatcgaccgaacatcatcagtantactagaccgggaaaatgcgtgggacggcataagagagaaagtactggagagcggggatggtgagagtgggtataaagtcagatgatgagacaagtgtggttacggagattatatgaggagaacgggacgcatgcgagaataccgtagggcagggagtgggtggtgggtgggtgggagagagggggagtgggagagagaggagagaggggcgggggagagagggtagtgtggagtagaggagtgacacggaggtgagtgggagctcagtgggcagagaaggggatganagtgaagagaggagagaaatatgtagggagcaagagaggagtgagtgcgtagggagggcgggggggcgatgtgtacaatatgtatgtaagtagtggtaaaataatcacaggagcggcgagaaatgagcaaaaacaggaagaccatgatcataaatgattgcgctaaggacgcattactgttagatggtcgtgataagtagttaggaaatggatcgtgagtgtggtacgtgtagggcgcgtcagtagtgggcttctcgtgtgtgctttctattgccgatagcgagtgttacgtgggcactacctctgtgaggcagcctagtatcgatgcccgatagtgatgtcagctgctagcagttagtacaactcgttgggtctatatagtcattgtaacgagtccacgagtgaactaggtgttaactacacaaggcttcttcaacggtttttgtttgttctattctccttcttcttactcttttncnnccttnntctntnnnttattnttttttttttttt

SEQ ID NO: 11161 - DNA, 912 bp, Homo sapiens
ccgtggtatcactattgggagcgggaggggtttttggtttacgaccgcacacacttcgaggagggtactgtaaaaggattatctgatgtgtcatcatgactttttgaagaacgcgagtgcgttgtcgatgaaattgaagtaaaaagaggaaacagaagggaaaatgagagtctaaaaagaaacaaagagaagttaacttttaagagatgacaaattctacctgccacgatgttttattttaatctgaaagaaattatattgttttttctatctgaggatatatccttttacagtaaatattcttgtgaaatctgccaacctacttttgttttatttcaaaagcttttgtacctctccagactaaacaaaatacttaaaagatgatatggacatttaaaaatattgcacttaaaaatatagaagaataaaaatcaagaattcattcaaaagaatagtgaattcaaataacttttagatgttattctaatttatgagctgcttgtacattgtccttactactgaaaacataaatatttgttgctgacatctaccaaaagtgaattttttctcacataaagctgggttctcctgtgttggttatgtattagataaatacattcttctcttttttagaagttccatacgagggaagacattatgaactcattctaacgcctattagagctcgtttataataaaataataatgggtcctatggtttaggggtggagactgatgtcttttctttattgaggttaatgttgaacctcattccacttgtaaccttagccttgggtgggaatttgtaagtactaaggcggtattgtgtatataatttgtgtacctagaaacattcggcaatggcctaatgctgtaccgataagtctgtcttgtgttttaatgccccctctg

SEQ ID NO: 11162 - DNA, 1862 bp, Homo sapiens
  misc_feature (1)...(1862): n = A,T,C or G
cacattatctatagacagacctagacgtagcgatcgcgagacagaagacgcatcatatactagactaganagacgccgagcgacgagataagtgagaagtatacgtgatgtgatgagaatgagtctgattgactgatagtgatatatatgtagtgatantagtacantacacgacatacacgtacaacactcgaccgctanagccacactcacactgacngagatatcgcacagcatancactacacaatcatgacatatactacatacatggatagtaatccgtatatcatacgtaagaaacgcactaactatcgtacaataaatagnagtagaaagaatacgagacaagcttcgcgacagtncgagacgctaacagtgtatcaacgataaacaacaagcgacagagangcgatagtgcacgntgcatattatacaacnataagtagtaatagagntagatagtagtgctgagcgactagctgagagganantattgaatgatgatgngcgaacgagattagcaacacgcaaacgtacacgangacgagtaatagnanacagctgatntcatgcanaacgaatatacataatatatncatatcataatcgagcacgctcggtatccagcctcaatacagctatataatatancagacagacacacatatgcgcacacatctgacatcgantaaantatanataanatctagtacantacacatatatcatatgctgttcactcngagagcaatncaaagacacaaagnacgaacagatgacggacagtatgagcgaacacatactgtgacgactatacgagtcactcngacagttgtacacgcaagatgtcatantctaccncgcacntgcacgatacaaacgcnacagacganagatacanagagcgagcgaangagtgacncacgatacgatacgacagctaacgacttgatacgatacatcaagcatgcactacgaacgcacgagacacaccaaccactagaagacgagatatgtacacgnagattcacatatagatagtanatgatgacnangaccagacagtcacatacacgcggaacatcacatatactcatcgcatgcantcacaataccttaaagtatgacatccactatctnacgtacacacagtctcaagcatctctaatgatgacactcatcaacgagagtcgaaaatcgcactacgtatcagcagagcaantactgctatacgacagagtagaacaagtagnangncngtcacgcacgagcaatagagtaatatcaacagcaacatctacagttatctaactcatcatttacacactgatganatatatagatcacaacacacatcacaagaatgtaagtactgncntatctatattacaccgcgcaatcaatccacatatcacggagctgtctacagtcatcacagctcaatatgcgtgacatatacacgcgactgagacatatgactatnagacaaagtgagtatgaggaggcagngatacgactatatagtggacgncaacacaacagaccaanatacgcacgactcacatgcacatcgtacatgatacagacggacaancgcanggtctgacggtgtgtngacactgtattcntctncatcactagatcacataaaaggtatatganaactagcatatgacangtacagactanggatagagacgacagatctgcgacacantaaatnagggtatgcctgttctgcgctcggtaaggnngcgtntgcgtgtnnnngtntaagtcncgcgtcacaatngtaggggtaggctggcgctgcgtctctctgntctctgggcaagaataattcgtgagacaacgatacat

SEQ ID NO: 11163 - DNA, 1278 bp, Homo sapiens
  misc_feature (1)...(1278): n = A,T,C or G
acctagttgcacaccgcatcgtggagcgcggagatgtntgtgagtatgtgatatgcgaagagtgaagccactgaacatgagtctagctcgagctacagaccaatacgagtccgacgtacgagtgcatcttaagatcgtgtttatgacagcgtaccggccgacacatagtctaactgagaatcgcacatccgtctacgtcagagaatacagtctatgangatacatgagagacgcgctatatctgacatcgcaggctatcagttctcgctatgtnactcgatatcttagacgcgatgcggtcgtcgtagtgttgtgtgtctgatactgtaatgatcatagatactatgtggatagcgctatacctttcactctgtcaacacattcgtcttatacattacaataataacataacactaaacaccatctcataactactatgcattgcttccgtacctttatatagagtgtagtaccactgtgtaggtatgatgataaacagcaaagtccatatacgagatcgagtaaactacacgagcctgtcgctacacatcgaagaccaataccgcaaaaatacaatcatatactcgtctcacatattacgcatggaagacacgcatagagaggagataaagagatgtcacaaaccatcgaagagaacggtacaatataactcacacattgttagagagtttatataaagtccagaagggggtagtcgatacatgaagtacagaagagcatgtgtttgctattgcagctttatcttcatatgggtcgtgaatagatacgaattatctttaattacgatctgatgtgcgactacacaactacgcgtgcgcgcacagttttatgtggtttgatattgcgccggatctatattattcatcgctcctcgtgccacctacgaatcttcatccctttcactaagtcattattaaacgtataaaaggtggccaagctcccctgaccgaccgctagctcttnttaacatctaaactaacgtttctatgctacatatattactctctctgcggggtcaagtgtgggtgatcgttctcttcgcgcctgctntctccgtctcggcgctcgctcgcgtcgtgcgcgcngcctcgcgcttccctccttcctcctcttctnccctctcgacccttgtttgctcgtcgcgagtgtttcnnnngcctnnggtcccncgctatgatanttnctncnnncgctcctttnnccccgtcctcttacccttctctggtnnccntnncccnnnttttcccttnnnntttt

SEQ ID NO: 11164 - DNA, 986 bp, Homo sapiens
  misc_feature (1)...(986): n = A,T,C or G
atatgtaggtacgtcgaacacaagaagacccagaatcttcgatgatacctttagacaacatcctcaacaagctcctgtaaaatgattatctcatgtttcatcatcacttaatnaacaacggggatgcgggtccataaaaaaaaactaaaaacagcgaacacaatggaaaatgacagtctaaaaccaaacaaagagtaattaacttttaagagatgacaaattctacctgccacgatgttttattttaatctgaaagaaattataaagctcatactttctgagggtgtatccttttacagtgaatattcttaaaaaatctgccaacctacttttgttttattctcaaaacctcttgtacctttccagactaaacagattactcaaaacatgatatggagctttaaaaatattggccttaaaaatggacaacgactaatagtcacgatctccttccaaagaatactgaattcacaatccctttaaactgttattctaattcattaggtggtgctacctcgcatctgcctactgaaaaccaataatttcttgttctggcctctcccaaaaagaggatcttttccccccaatttgggctggatccgcctgttttccgcagtgaattaacacaaatatattcttagttttttcgcacccctccttctcatgccggcacttttgtgacccattacaattgcctcttcaacttccctctcaccaagcatacagttacgctcattaatcctccggcccctaggccttctcaccctttccttcttgatggggtcattattcatcctcgcccatttattcctctacccgcgtatcactcgtatgagacagccctccttcccccgagtcggcaatcacccaccgcacctccgctcgctcccgcacaaactctcgggacaccggcccgttctccggcaccaagaagctccgctctcgctcttctagtgtcgcccccacgaatcccaaactccttccgt

SEQ ID NO: 11165 - DNA, 928 bp, Homo sapiens
  misc_feature (1)...(928): n = A,T,C or G
gcagcagagtgaaggcaagaggggagagacggnacaggagttaacgagaacagattncgcaatagatatcttcggccaaaagaaaatttgccgggtcaacaaaataaaattcatacaacttttccggagtccagggggcttaaactacatanactaaaatattccatggggcgggaaggatggacaaggcttgcgagtatcggaattgtggactattatctaactaagtgggctgagttcgacgtgaggctggacctcgggtcatcattttattaatncgacacaaagggggggggggcgtatggtggtgaccccttgtgagaaaaccaagcccagaggatgaccataggcccccagggctgggtgagggccgggccatgcaaaccccgccatctcaagcgaaagagcaaaagggggccccttcccccaccagccggggcccgcgaggcctgcctcgcgcaggggaaaaccacgagagtcggccacaaccgcaacggccccgggcggcccgtccgcgacccccgtcgcgctactgaggcgggggggccgggtccccacggtgggggacccccgcgcaacacctggcagcagaggaaaaaggngcccctcacccgcggggggcgcgccccccagccgactccgcggcgcgcgccgccccaaaccacggcgcggggcgcggcnaaggggggggccggggccagaggccaagggaagccgccggcgcggcgacatgtctcagcccgacggccccccaccgcccccagccctcgacggcgccccccgcgagggagcgagcgcgcccacggcggcgcaacgatacagcgggggagggcagggccacccgagtgagtggcgcggcaccccggcgcgcgcctcccgaacccccaccaccaccccccacctcccagcccccgccccccgcgacgag

SEQ ID NO: 11166 - DNA, 1765 bp, Homo sapiens
  misc_feature (1)...(1765): n = A,T,C or G
cctatntagcagtcangtacgatcagcagcgccgtcagcgagcgcacagaggaacgacagagtaagnaagtcatactntgcgtgatagagacgtgcgcatctactgtaaganatacgattaccttgagtcgctgcattangagtgctgactngtattcgtgcagtgnnttgnagtatctagtataacntgcntcatccatatctcctagagtactgacacatgctacagtcatagtagtagtgcgacgtcgatagacgtnagacatcagtatatgantcgctgcngtcgtacgacgngttagtagtcgagcngtgagtgatatagtgctntagtgcgcanactatgtaggatggagtgctgctgtgtcgnatgctntagtgagcgcgntgactgtntcgtncgtcgcgttactgtgactacgtgcgagtgtgacgtcgtgtnagtattacgcgactgacatcatgagtaacagattattactagtgagtatacagcantgttcatctatactcgcattctacntcagacatacgccgtctctacgtactagtgtgtgctagtgcagtgagacactgtgtgtatgagtataatatccttcgcgcaaantggnactgcgatcgtgtaacacagtgtcgccnagagacgacgatcgcagcagcagacatgcactgagagctattgatnagtatcgacgacgacgacatgaggacgatgtactagagtgcgncgactgatactatgcgacangcgcanganagangacagcgctgcagatngatacaaatatcgatacgctcacggtatcgntggcgaacgcaccaccagacgagccagccagctcccagcatccncacanctacgacatcacacaacgacgacctanatcagttacactctcgagatatgagtgacgtgtattaagtggctatgtctaggtgctgcgttggtcacaggacgtacatcagccgtncagtcagggtaggtgcggatgctatcggtactatactgcgtgtcatggtggagatgnttgacagagtgcggttagagacagantatatcacgattcaatccttcttcgtatgtcttagcactaccgatctaatcctccgacggaccgtgacgtgtctgagcgtacgatagacggcaccgaagcaangttgtcatctgatagtggagactgcgtgcgagcgtcgtcgacatgtgagacaagagtgtcgcaggcgcactcgagcntctcattcattcttatacgaactgtgtgtcgcgtgactcgacgcgactcagtgtcagcacgtcatcgangagtgtagtatnctcgtgagtcgtcatggangtcacatactcggatangcgantcgttattcgtgacgctacggttgtgtacntagatacatcagcgcgactgtcctcatacgaaggcgtctcgcctgaaccaacgcgactaagataggtngtggatgtcggtgtgagagctcgtgcgctagtgantggattgcgctctccgtgttcgcttatggtactgagatcttgagagcgtatggtcaaagaatagagggcgcgccgtgatactcgattatcaattcgtactttatgattacgatcaacgcatcataattgttcagcgcaatacacacctcaccttgtgctatatagcacatcatgtcacacctatctcactatttgtactatcactctcatatatgttacatcttattattacatgtatacctcatctgtancgttngactatatacgagctacgat

SEQ ID NO: 11167 - DNA, 976 bp, Homo sapiens
ctattagcggttatgttttgtatctaattatctattcgccactttaaaacttaatataaaagcatatgtcattgtagagaataaacattagacaacgaaaaatatgatgaaaatatgttatataaaaaaataaatattcaaaaagaaacaaagagaagctaatgaaatataaaaaaacaagaagatctataaagataaagatctatagtggcagtctatgtggaagttacattaacagttatttaactgtaattaagttaaaagaagatcctgtagataccgtacatgcggcggataaagccggaaatcgtcctaagtaacagaaagggatcaaatatgtgagcggacgtggtcattcttaattttcgaatttctccatctacattcagacgaacatagtaaactcacttttaagagaaatgccaagtcgagactgataaacataattatactgtagttaagaagaaagatagagtggaatataaggagaaagaaattacggcattgacaataaggaaacttagggcatatagaaatcctctgggggatgtaactaaaaaaaaaatattataaaaggtattggtaattacatagaaggtaatttgtttgttgatatgaataaacaaaattccacaggtgagtaaaagttaataacaacgtttgtgaaatatgtgtcttttcatctattataaaaataagagtaatgagacgttgtctgccagaacatgtgattattatattatttaatattataataaaagtgtgagcaatgcagaatgatcttcacacccatatggtagaacaaaagcaggatgaaagccatatccccccagtgctcatcaaagtaggacaataaaaatccatctatctcaaaaaaaaacaaaaaatggcctcgttggctacagcggtggagttgttacgtcatgagatttttatatttttattatgatataatctaaaaagaaattatatttta

SEQ ID NO: 11168 - DNA, 1310 bp, Homo sapiens
  misc_feature (1)...(1310): n = A,T,C or G
tgatntgtgacatattacatcttgtgtngacgcgctacgngtgagcgnacgctgcgagtgcgtgctgtgtgtcacgattcgtatgtcgtggtagcgtggctgangcgtgacttacgntcgtgagcgttgattgagatgtgttggagtgtcangatctgcantcgtatatcgacggtgcgcgcatgacgtgtctcgtcagtgatgtaggctcgcggcatcgatgtgctcngctgtcacgtcgcggcgtagantgtacgtgtcgcagctggagctgtgtgatacatctagcgtcncgcgtaatgcgtacgcgctgtctactcgcgcgctgcgtactgtcgnangnggggcgtcgatgagagtcggtgantacgcgtgngtgtgagatgatggtgantggcgagtngtgtgagagtgggtggagtggggaagagtagatgtangggtcagttgcactgcgatgtgcgccgtgcgcctacnagtgattgacagtacgtgaagcgtgcgtatcgactctngtgtggttcgtgtcgtacgctgctgactggcggggtggcgtggtggtgtgcgtgntgtggtggatcgagcgtggtgataggagtgcaggaaagagtgagaggggagatagagcgtggggaggtgaggaggttgccgtgtagtgcgccggatgagatgagcagaggggtgcgtgagcgagcgtgggctgtatttacgattcgggggtgtagtgcgtgtggtgggatggagaggtgtgagaggggcgtgtgtcgttgagagatgataggaatggtgtgtttggctgtggggctattttgtgggtgggtgtcgagtgatatgttgagctgtgttttagtgnattctantcacatatgcttactatgtctgttattcgttcgtttgttcgtctaattctgattccaggtatatggcgcgtggtgatgtgtatgcgacggggagtgaggagtaattagcggggcgcgggggggggtatcgatgcgcaaggagcgaagggaggtgcgatgtgtggtggtcgatgtattggtactaccatgtggcgcgttttatggtacgtgtgtcttcattcctactgccgcctcgatgtactcgtttctcctcgtcacatagagggtgatttgtcgggtgtagcgtaggtgtactcgtgcttcatcgtgcattcgcaatagaggtagtgctcgtcttgtgcttctcttgctgtgtcgccctgttctgcttttgagccacgagaagtttaagttcttgagtgtgtttagtagggnanncannnnnngcgtggtggggttcgggtgttgtgg

SEQ ID NO: 11169 - DNA, 1095 bp, Homo sapiens
  misc_feature (1)...(1095): n = A,T,C or G
cacctcacaacacccacgaaaaaaagacaagcttcgaaaatacacacagatcctatatgacaacttaatgacttttcacaccatctaaattctataatcaccacctaaattaaagaatcgagtgctccaccaaccttnnntatcattttntctcaacttccaaaaattatttcccttttcttcaaaaataaacattaataattctttatcttttcaaattcatatactatctactttttctctctctcttctttcatttcttactttattgggaggtaattcacattcgcggcttctcgaaaaaaaaaaatctctaataaaactccttctctcggttaatattcccataccttaataaatacctcaaaccattctaccactaatctatcacttacaaaactaaacctttgtatcaacctctcttacacattatcttttacatattatgtctacaaaacccatttttttaaatatacaaaaaaacaaatagaattacttaacccttagaaatcaacttaatattatatataagcaccccacccaagtatgcaaacctattgataagaaactcttatcaacacaataaaggccactctactatcaaccttcatatctcaaatacctaaatttcaccccttcaacacaaaaaacacaacacatcacctactcacacccttaatcaatntaaatccattagagaacacacatcactctacaacaaagacataataacacacacgacacacacacaacctgacctcgacataaatatatatacacacaanttcaataacagcaccatcacccgacagcaccgatactcacttaattcacatactccacctcatccactcacaatggacataattaactatcgtcctcgtcaaaagtgtatcatgaatatgtccnacaacacactcagtatcacgtcctagtttaactcagatcaccacggcccnaccacccctcccaacactacattatacctcatctcaagactgntatgaataacatctccatcaacattatantacactccacaacgacgatccaaacgaatactatgtgtaaacgacgtcacacacaagagaatag

SEQ ID NO: 11170 - DNA, 1585 bp, Homo sapiens
  misc_feature (1)...(1585): n = A,T,C or G
gagatgttgaagtaaaaagtatgagaagggacatagagcagtacagaagcagatatgctaaaagactacacatatgtgcagtcacacgggtgacgatgctnattgtataacgttgtggggttgtgaaggtgtaaggnagaggagaggagaggaganaggngggagagagttcacatatgagtaaagatagaagtaataagagtagtatgtnantagcgcaggaacncacagagnnnncnnnnnatnnagtactgatggnnnnggngtagaganaatacggggtggtgtagcgcagcatacatacaagcgcatagatgaatacnacattagatactgtagattcttggtcagantataagcaactctgggattagtatnggtggagagagtggcgagngagatgataagagcgcgtccgataggagtgatantgtatgagtgtngtcgatactagcgtgngttctatatgagcggtgaagttaatgatggtgatgtatgtgtgctntctcggtggagtgggatagcacatataggagngagaaagtagagaggagatgtgatgagtaganggatgagacacgagagagtagaagggtatatagacgcaccgatgngatatctgatatgtantgcagtatantatgatattatagaggagtcatcttatatatatgagatagtatacgtaagagattccactctgngacatagtgtagaagaacttngatatcctacgtttctactgtcagcgtggctgggagtacgcgtgaggcacgtatattcannncgacagtcacacacgagcagagtcgtgtncactataacagaggagcaagaacagttgntatctcagctctttggngactgctcacggtacatacaaatgtgtggaatcagttagtaaacaacattaaaatgtagacgaaggctcagtgnanaacgatatgtatagatcangaggagtaatgtatagtctntacgctccgtctcatcantnaagatgaaactacggagcgtcacgtctgatgtttgtatgtagngaacatcacttggatgtgatctatggtgaggatgtatatangtgtgngcagtgacagangtgagactgcaagatatgtaataaattcgtanctatcttctnnnnnagcgtgtagangagagaggtgacagagatagaggcacgtaataaggtanngaaacgacatanggtaacatcgtgtgtagtacagtctgaggacatctcaatatgtggaatagatcataggactacaagagtatgcgacgaggagggtggatatagagacgatggaggcggtagaggataaggaatattaaggncaatggtatgaagttgtgcagaaatgattggcgtgtggggtatgatgcgattatagccatgtatggtgattatttccgttgtggaggagtaaatacaagaataatatatgtggccgtgcagatgaagtcntagcatggagagaggggagatcgttnngcgacgctcggcgatgacatagtatgctcaaggtacattattatgtaatttattagaaatcacatcattgtgggagatttgtatcgatat

SEQ ID NO: 11171 - DNA, 1303 bp, Homo sapiens
  misc_feature (1)...(1303): n = A,T,C or G
cacctctgattaactctgatcctctagtctatagtcgccactcgacgtaccagcgcacaatcgtaccagacatgaagtggtaagttgtgcatgagggtatagactatcaacgccacgactcctcattatatanatgagatacgtgctgtggtgtcatattaggtagcctctccnatagagagcggacactgaagattagatgctggacgacgagacgcagagtgtagagtagagacatgacatatcggagaggagagatanacacatcacgacctcntgcgcagaacgatatgcattctcgacgactatagtcatcttgatacgcgaaataganagtaggagctgcgtcgcagaatgcgcgtgtattataccgagatgacacacatgtacacacattacctcgacgctactgacgtgctctggagacgcggatcatatcggcgcctncgcatatatacagaccacgagtacgaaaccaagtgagcaatntaatagaagatgcctcgtaggatagcgagactagtctagcgctaccactnacaacggtcgacntatactccgactgcagcgtcganttcaaagcgtngaggcttgtgcgagacgtggctgaatgcgacatcatagcatctgacgctggagtctgctcaggcacgtactagtccgtgccgctcgtagagcaacatcgagtgttgcagtcagttgagttaccccaccatcatctatcttctcatcacctccgtgagctccatcgtgtcagcacaatacaacttgtatgcgttatacactccgtcattactagatcgactgaggtgagaaatagatattaaactataagccagagacaatactaacgcactgatggttgatgcgaagccgctacggtcaatattatcaactaactcattattacgcatgctgcatacccgcgccctgcgtcactgcatatgangagagtacgaaacgagtggtggagttgcgtaagtcgtcgaaagagaatccaaagcgaaatctgcgtcgactccacgctcatatcagtcagtgccaatgagcatgggtcgacgcactcgatggggccgatattatggagtatttaacgtagatgtaaagcgtcactacagtgcggcaacatcactagaggtaacaagtcacacagagacgactagtgaacacgcgaggaccacttcatgatcggagtgggggctacttatgttgaaaaaagtctactttngcgttcgttctgccataagaacctctctacgtactccgtgtctacattcgcgagctataagatccgccgcctacg

SEQ ID NO: 11172 - DNA, 1004 bp, Homo sapiens
  misc_feature (1)...(1004): n = A,T,C or G
cgtgtctgtcacttctatgccctttccatatctacttgactcgtcgtactataattcttcgcgtggccatgcacgattattgagtcgacggtacgaactggacatatagtgattgtgcttncgtggtgtgagggagtagtgtgccattgagagttgcaaatcgagttcgagcccgaggctgcagcatacccacaccgtccatcttcagagcgagcggggtgctcggcggtgtccgctactgaagaactagagctaatagtcgtaagtaggtcgagatgtgaggtctccctcccctcgcatccccatctcattcaaactcatacgacatcacgtcgcgtaccgggccggcgggccagacagggtagtgccattctatgcttctcgctatgacaactgcagtctgtgatgaggcgtggaaagacgcgaagccgcgcccagaggacacggtctagtacggaaggcgacgtggactatccagccgcgcctcacgatcgagaaacatgatgtataaagaaacgggagaggggtgaaggggatactaatagtgctcatgtgatctaacgaggatcatgttagcgaagtaggacgtactcggtccgcgcgtaatgtatcggaattggtgcggcgatgcctttcttctatggatactctgataaattttatttcattgtgtctcgtggtgtgcttttttgattgtgccgccgggaaacagttcacggcgggctggtgcgcgaggctctcacaatcccggcccgctcacgaaagacagcgtcatttcgcgacggcctcctctgccgtattgctgttgtgttcgctaagagtaatagacaatatgagaagcgggacactgcatacgtctttcataatcgacacccacgccttctctggcaggtttgtcctgatgtgcgctcatgaaagcctggtgacttacacaattcgacatcgctgtgaacgagtgcatcaacgctgtaacatttagggatgctgtgtcgtactcgcaggtc

SEQ ID NO: 11173 - DNA, 1427 bp, Homo sapiens
  misc_feature (1)...(1427): n = A,T,C or G
tactcgtgttgtctctcagtctanactctacatgtacgcantcgtactcatgcaatatanttgtaatcagtcgtagaagagactcgacgataagctatagcagagaagtatcaaacagttcgcttttncntgntgtaacnttnnttataactnncatantntntgtgttgtggagtggnggtgagcttgngagcgcggtgagaggagtanggatatggngagagagagactnacacaatgattggaggtcggtctccggatctgtactcntactcgtggttttgtcganctgctcttcgagagaatggagacgctgagagacatgtgctcgctagtgatgcgtgnctgaggattgggntagcgcgcacagaagtgctatcactacacctccatggcggcgacgtactgcgtgacatctaacgcgtgtacgctgtatcggcagacgtaggctgtgagagcgaatattagatgtcgacaggactggagcacgatagtgtggtgtgtcgaggacgtgtgcttgacngntgctanattactatgtgatggagaacatgagtagcgcgatgatcgtatcttgtgtctatgcaaatgtagtagctagctatcgtagtggtcatgacacaccgcgngaatgtgctgctgtgtcgatgatgcggcttatctanaacatcacctgagagctcgcgtcgatctgcggcggtcgtgttgtctgctgagtctagcagcagacggacgactaatctgcgctatcgctgcgcgcgcgcagtgttgccgctctgtcctcanttatcctgccacaatatcgagtgaccaatgggatagattgacatagtgcgcggtaaaccgagaggagacgggatgtcggagaatatgcaaagggttggatgaagtgatatacgttctgtttgagctacatgaatgtgtctctacattctacttgttgttgctgtgcgtaatcaagaagagagttgattagaggtagacacttgatgcacatatcgtgtgctacgactcgtagctgcacggctccgatgcgatatgagtgtataacgtccacgtgcgggtgtgagctgcggtgcgggacggcactatcgtgtaattagaatcatataatgtccctgtggtaggaggatggtctgatcgctagagcacgagaagtattactgtgcgagaagtatcttcactctaggtgtcgctgcatagtagttgcgacattgatcactatttattagtgatcgatgtcactgtgctgcgattggaaggatgagtttctagatgtattcaacaagaaacaaagaagacaacaatatgcgcctagcgatgtgacgtgcgaggcgagtggtagatccntgtcaggagaagtacagcaccgtggagcgacagagatgagtaatgtggatgatatttgaggggagtggatagagggt

SEQ ID NO: 11174 - DNA, 1336 bp, Homo sapiens
  misc_feature (1)...(1336): n = A,T,C or G
ggatgcggagctctgacgggactggggtggtgcgtagatagagtgaggtagagtgttgtggcgcngntcngcgcggaggcgtgagtagcagtggtgaggcangcgctgcgtcgccgcatcctgcggcatgatcggcgtcgcgagtgcgctgagatagagacgtgtgtgaggatgtcgatgtgattcgtngttgacgcgcgcagacgcgagcgacggcagatatagtanattttgagttgggagactcgcggtgctcgcaacgagtattgtntgtaaagtcgcatacgcggatcggaccatcttggttagntatagtcactcgtctgtgtgattgtcttctcgttcctacttcgtgcgcgtgctgctgtggcgggctccgtgctgggtctgggagcatgcgtgcggaacgagcggtcgtgtatgtgacgggagggttgcgncgctcgttgtgttatatatagggagtctgcgctggtagtngtntgttgtttgtcgtgtcgtgtgttgtgtcgttgtctgtgactatatagcttggttcgtctgtagtatgtagagtctgtttgggtcgtgtgttcgtggtgactcgtggctgtgtgtgggagcgagccaccgcacgcacggatgctgtgccgctccgcgtgcgacgtctgtgtgttgatcgcttgtaggagtgcggtgtgtcgctttgatggtagttgtaagtggagaatatgtgggcgacgtgttgagtgtagattggcggtgggagtgtggccctagtctgttcgtagctcgggagtactctcgtgtcgcgcggtgtgtgcgtgtcgctggtgggcaccggtcggttgaggtaactccgcagctccgtgcattaggtggataccggtactnctgtccgtgtcgcgtggcgcgctgccctcgtcggtgttgcgtgcggctcggtgggggtaggtgggggagagtatgtgggtcgggggaggggtgtgtcagcgggtgtcctctgttctccttcgcttgttgtgtgtggcgtggctgtgggcgaggaggtggatctancctatcccgtgttcggtctgttgctcttcgtaaatagaagagaggtatatataggagtaagaacatgatagaaagagagcacaagtaagagaagaacgaagaagaaagaacgaagacagagaacgataaacaaaagagaagcgagagaagagtaaaaagagaggaaaatacaaatatatgtgctcttcgttgggtcgtacgagccgtgtggtagctggtgtcgttgcgcgaagtgttgatgtgtggcgcgggagtcagttatgatttgtgtatgatcttagcgcggccggttgtcaga

SEQ ID NO: 11175 - DNA, 247 bp, Homo sapiens
  misc_feature (1)...(247): n = A,T,C or G
gctcacctaaccattcccatatccttcgcccataaaaggaccacctgacagagcaatatnaatnnctaantnttnccnatacagtaanagactacaacaaacatacnnccaacttcanatnntncaacttcanagaaaaatcaccttcttcccccaccatcccctttcctattccccattccactnanaaccacatccattncccaataaaatcctccacatatactacccttcaaaaaaaaaaaaa

SEQ ID NO: 11176 - DNA, 1819 bp, Homo sapiens
  misc_feature (1)...(1819): n = A,T,C or G
actnagtgagcgagtaacnatgagagctagcagagatgacgcgagcagtgtaatcagagtgacancggttagagctacgtacctgactagatggtatgcntatagntgcaatgtatanttgtctgtctggtgagatcacaagtgactgctgatatacagaatgtgcacgngatgcgagcgcgtacggcgtaactctcgcggccgtacacanagagtcacatntaaaactcaacacgtttantncatacgttactaancagcgctgagtacacgtacacacatcatacacacgcatcacagcgcataacgacatcccatacacttctcggcactaacaatctctgcctgtgaccagcagaagcagcacgaacacgtcaacgacacacgcgacaacgaagcgtgcaaacacagcacgataatatactcacttcataatctactatcatcgcatcgtacataacacaacatataaccatacattcactaactactacagtgatcctatatcatgtgatgtgcgtacgtcggtactctcataacaagactatacatacatnactacatctcttantctcngtaacatttagatacagaatattactcaggacactacttgataatacttgactataataataacttattgtatgatantctcatacttanataacctantaatcatanattataagacncgattacatgactgccgatcgcaattcatagaataacttgtgtctattcgtgctnttccagcgtgcgtcgctactgcntctgntcgactgagtatgtacatgtgtgatgaggagagagacagagacgcgctgagtaaggagcgagggtggggtcgcgngttgnttgctantntgatacanatngcntgaagncgacgacgctgtacgcnatggagcgcgcacgctcgcgtatcncctgagaacgcgtgcgcagacatgactagaggcngtatcacatanaacgcgtagtcttatancnactgaatagtccgcacatctgtgtntaccntacctactctgcngtctaaggacttcgatagatctactactctctcacgcaccgcgcagcgtaccgtcctcgctgcgacacaaantgaaagacttacgtacanangcgcnggagcacacanaacatataaatancgaaccagaggcttcgcagcgngtatngcagatcagcgncacnnaaataatacnagtaacnaacanctntatnactaattctnactataganaatatatacttgtgtnaatgacanngtcgctcgtctgcttatcatcacntctgacgtgtatacgntcgctagactctgangcgataaatctacgagcgtggtcatgatgcatcttcgtcantncaactacnagagcgcacacacagtcagacagagagagagagtagatcgagcgctatgagacagactcgtgctcgacgactgcgtacgctatagtaatactctagtctacatgatcacncgccacgcgagtcatcgtgcgnacgcctagtgcggncaacgcncgggtcgcgtccagaccgangccgctgccgatatcgcgctgtgtccgacggacgcacgcacancgctgacgcccgtgcctgcgcngntgtcgannagatttcggntgtgagcngttaggagtgngcggggnnnnnnnnnnnnnnnnnnnngcnnnnnnnnttnannnttaatnnnnnnnnntctncnncnnnngncnnnnntnnntatctnccnnccantacttnntcctacacactctccctnnnnttnnnnnnnttnnnntnnnnnnnnaaaaatttttttttt

SEQ ID NO: 11177 - DNA, 1152 bp, Homo sapiens
  misc_feature (1)...(1152): n = A,T,C or G
attgcgcatggacgcatcgggtccgctacgttgcaggtccggcacattagcgnaagttagacaacgagagtggacggcggagagaggagacaacacatgtaaacgagatggagcgccccgtcgaggccgatgaaagcatgtggatgtgtagaagnnagatcatagcatcgtcgtntatatcagtnatcacatttaggngaggngngggggcgggtgntttatangnnnggggaaatgattcagcttaggntacatctggacacagaggactgtcgcgctacggcgcaaagaacgtactaatagagaatgagcaaaggtgatggcgtcatcggggtagagagagcaggtcagagtgagcgagatgggcgagatccagtgtacgcgacgagcctctaaagatgcgagccttagtgaacacacgaaggacacatagaaagtagactaatgatattgtctacttgtgtcacacacttgctccagtgtctcggagctcaggtggtgggggctcgactgtctcccaacagcactaaacaaaggtcgcacagtagatagtgttgtggcataggagcggtgtgtgtgaagcagcatatatgggtatgcacgtcagtgcagaataagccataacgccaggaaagggcgacgcgggcaccggaaaaatagcgcggcgtaacgtactgcggcgcgaggcaacagcgaccagtgggcgctcagttgcatagaaggcacgaagcaggtccatcagataaagatgagagagaaaaatggagtggagggtggtaatggccctccatgcggcagagaagtaagaaatggagtcttgaaataaagcacacgatgggatggattgaccccgaaaggcaccgatgctcactgtatcgaggaagatagggctaactgacgaaacaagcgncacccaggacagaaagagcaggcgtgaggaaccaagcctagtattctgagaagaggctggagactggcgcctacgagccagagacacagagacagtagtgcatatccactcaaagaaaataaaacaaccaatgtgcctcagttggcctgcaggcggtgcgaggtaataacggtcctgaggaggcaaccttggttcaccttactcctactctcaacaatactacgcgacagcaactcaccacc

SEQ ID NO: 11178 - DNA, 1509 bp, Homo sapiens
  misc_feature (1)...(1509): n = A,T,C or G
ctgtagtgttactctgtgtgtcgcgttgtcgaggtgcgggtngtcgcgtcttcgcttgtgtgtccctctctcgtgtcgagcctccgtgtactgtctgcttacnctcctcgtcgtgcncgtgtgctgtcgtcgctctcgtcgctcatcttcattctgacgtctcagcgcgctgnggtgtgcattcgtctgctntgcatgtgcgcgngcgttctgttgtgcacgcttgctcgcctcctgctgttnatgtcgtctctcacgcgtgcgatctgttgtcgtatctcngtgcgatgtcttttgtctcgccgtcgcgctctgtnctggtgtgtcgtgctgtcatgctgtgtgatgctggtcgcgtgntacgtctntgctgtcgtgtagtcctcgtctctgtcgtgtggctctggtctgcctctctatctcntctcgctgtctcgtgtctcgcgcgngtgcgcggctgctgcgtgtgcgctgtcgctcctgctgctcgtcgcgctgcgtctnttcntnattctctctctcgcgtgccgctgttcctcccgtagcgccgtntgcggtgtctgctgtgcgtctctgctcttctctctctctcgcgcctncgcgcgtctgttgtcgtctcctgtgcgtcggcgcgcccgcggcgggtcgcgtccgcgtgccgtcgcgcggtgtggtgcggcgtcgtgtccgtgttcgtcgtttgccgtgtttgtgtgcccgctgcggctgtggcgcggcgtgtcgngtgtcgctgggctcgttcgtgtgtccgtgttgcctcctctgctgtcgctgtgtgcacnccgtccatgtgccatccggccctccctgcgcctttgtgtcggcgtttgtngcgcctgccgctgtgtacgcgtgagtcggtctctcgtctctgctttctgtgtgtctctgtctttttctctcctcgcgtgaggcgtctcgctggcctgttgtgggtgcgtgtgcggtgttgttcgtggtctgctgctccggtttggttggtggctctcgggggtgtccgccgtgcccgtgcgttgctggtttttctctgtgtttttgtggcggggtgcctttgtgcctcgttttttctccgccggtctgcctcttcgcgtgctcgttgtgctcgttgtccctgtttctcctctcggtgcgttcgcgtcgtcccggtccgctctgtggctgtggtgcccgcgctttgcgcgttctctcgctcggggcgcgcgccccgttctcgttccgtctgctgctcgttcgttcctgcgttctcttgctccgtctctcgtcttgttctctttgtcgtctgtcgcttcgtctgtgtgcgctctttgcgtcgtctttctgttttcgtcccctttttcgcctcctcccgtccgtcccttttggttttggtgtttgggtcttgcgtttgggtctacagcctcttgtgtgctgctcttttcccgcccgcggagccttctctcgtttcttcctctcttgtggtgttgtgctcttggcgtcggtcgctggtgg

SEQ ID NO: 11179 - DNA, 975 bp, Homo sapiens
  misc_feature (1)...(975): n = A,T,C or G
gtgccccgcccacgtgcgagaagggaaggggctcagggggactaggctcactcctatgtggcccagcctggagtacagtggtgattcacaggagtgatcacagcacactgcggggggggggtgctggcctcaagcactcttccctcctcagtctacaaaatagttcgggacctgcaggtgtgaaccatgctgtggctccccgatgttaatactcttagcatatagataaacgcccctaacattatatagagacgcgccgcacttccaaagaagctgcgctgagagggcgtgatcggcaactcctgtgctatactctacaacacattgggcgaagtgtaatcgcgatttcaaaacacacatacgagaccaggcgcacatatcctatcctctcttactcccgaacagacagacaaaactgggacttcctcgaacccagaagggcgaagtctgcgagcgaataccctgagtgagatgcgccctcccccgcgccatcgtcaatggatgctctgcagctcacgagtgcggctccgccgaaccgtcttatccgtcccctacctgctggcgccgctgtcttcgcaaagaatgggcgcgcccccgacacnacacgtcccgccccaagggcactcaagggacacgaggcgaaagaggtgcggctcggcggccctcatggtagagcgcctctcctgaccacgagcaagcagtcgcaactcagactcgcgcctcggtttttccgtaccgcttcggagttctgctggctacgccctccgtccccccccgcccctccatcgtcagcgccgtcgttattgtaaacgaacggcccatgccgggtaataagagattgcgctgtgtatcggtaaggcgcagagatcctccggccccgccgccacgagctcacaattgagtattatcgggacaacggcgcgacaccaactcgacgacgacaccactcgcgcacacgtgcagagacttgtctgt

SEQ ID NO: 11180 - DNA, 1459 bp, Homo sapiens
  misc_feature (1)...(1459): n = A,T,C or G
cggagaggtantnagatcgatagcggtactgagccgtagtgtagtgtcatgtgcngtgtacgtgtgatgtntagananagcataaagatgaatgtagaatattaagcatcagtcatagttgaagggacntgatatgtatatggctgtgtcccacgcantgaaccagtnatcangtancaacatgcgaganncatgnagntatatntntntgatacngtncatctaatgcacacatnctnttcgcatatacntatgtntaatgtacacacatcgtgtacngngngnnnnnggnaatggtgggagtagtnntgagcantatacatatgcgtctacaacacacagcgagtnaccgtggactcataactgtcgcgagtccattcggaacagctcgcncggtgcggctacgtatgacgctcttcatgtatatactctagagtatcacgcagantagtgnggcattagttgagtagaggttggtntgtggagtacggtacgtggcagtggtagtgtcggtcgtgtgtagngagngatacgggganaaatgtagcgaattcgctagtataatgatagttatagtggtatgtgtatagacgtcgagatgttatattgctagtgacgtggtgtagtcgcgtggagaggagatacagtagtagcatgagatgctgtantagagtgaagacatacaggagnggggtcatgagagcgatagatgtnantaatcataacactgacaagctaacagtatgtgttcaactactttgcgatcatgtctacaagagagnagtacgcatgtggaacgaagtagtgagtcgtactcatcgcctcgctagcagactgtagcttgacactgacgagatgcgttgtctagcgtctgagtcgcgatgtgcacgggagatgattgttaaggggggacatatcgtgtaatacacttacgccgcggttaagagaatagtacatcaatatgtagtatatcggagactaatcgaggctgcacgtgtgaattagtgtgggtcgaagagatgaactactttagttctatagagattaaagtgtgaaatcactgtgtgaagtgcggtgacgtgccacgggtcaccggaatgggagctatgatattcaacagtaagtggaattgagagtagaagaagggtagaggcgtggcgtacgtgcgcgacgggctgcgggtggcgctggcacgactacgaatcgctctccctgccatgaaccagcgctaacgatgtagttagttgggccctcgagcacaatcgctatgtctttcgaaagagatataccacgtcaacgcaaataataagagccgggactgccggcgtcgtaaatagcgtacttgcaatgttgccgtgaaactatcgaatatcggggtggggatcaagtgcaggcatggttctgttcgagaacgcaggtgtatggtgatgtgaggagacggcacgggggcgctgtccga

SEQ ID NO: 11181 - DNA, 852 bp, Homo sapiens
ttattgtacttacgaacttgccccttgcgctactctacttaccattcttctttcccgcctctcccctccccctcatctcgcgtaactttgtacgtaacatatttccgctgggcgtctccccgcacccccgtgtcacgcttccctagtctctgacctccatttacctcctggacctatctttcttttttcctacccctagcttcacccgtcagaactcccatgtcggtagcaaatgcagctatacttagttagctttgacgtgttcttgtactgtgtggtttcttgtcctatacgcggctgcaggtcagctgtctcacaaccgctcctcctcactcttccgtggatcattagggggtgcctcacatttcaattctccatcttttatccactcttagtttttcctatcattttcctattctcgcctagctcggcgtcccccatgcgcttcttctattatattgtagtttctctgcttctacttccgcattactggcgtactcctactccttggtcagtatgcccctcggccccctacaccttccttctacctttcttcgcgtcatcgatctcccaagaaaatgagtgggagggcgctgcgtcgtgacgcactttagatcgtttccacgtgcccacgctacgtgctctacacccgacaggttgcgcaccttgctgcggggggggcctatccctcaccctctctagctccctattcacatcccgtacagaaattcttctctctggggccctttctcgacctactttccctcggccgctgttttccgttgaaccctttgtcgcgtcccaagaaactccttccttcgttttctcatgtgcttaaacctctttttctcg

SEQ ID NO: 11182 - DNA, 1976 bp, Homo sapiens
  misc_feature (1)...(1976): n = A,T,C or G
cctgactgtagcacgcgcagataccatggagcgcactcacgntacntgacacntcgtctgtatctcttcgtgtaggtcgggctgtgtactcgtntcgtgattcatgtgacccgtgnccgctacgcgcagcgncacttnactgcgggcgtgcctctgatgcactgcgtcggcaggcanaccactagntgtcgacgtgcatgcatgacatctatacagtcgctcgaccgacctatcacacagcgtgatcgcgcgtcgtattatgnaatcggcacgtgattcgatcgctgtgacgtgctcgcggtangtctgctatgctgtcngcgtcgtcntncgtctctgcgtcgcagatcgagtatgcgtctgtgaatgtngtccgtctagtacgacagtgtcatgtgcgtcgtgttcatctctctattgnctcgctntctcgttcgatcggtgtggacgtantgcacgcgtgntgccgcgactacgcacttgtctcacantatcgcgntgaccngntngaaacgcnactgtgacatcactcacacactcccatcacgcgacgcncncgagtcgccgcgtgcgacacgcgcgtcgacgccgtcccgacatcaccntgctcctgcagccggcatactnctaccgtgcgcacagcgtcgttcgatccgcgcggtcaccgcgtactcacgtctctaatcccatacgttggtcacgcttcgcgggaacacacgcgaacgcgtgctccgngctcattcanacctcgtgcgcgcgagcagcgagacgcgacacacgccgtgtgagaagtagtgtcactacggtctgactgaggtgtgagtgcgnaatgtgttagatgtggtatattgatgnanacttagtgtatgtatgtatgtgtagcattagtagncgcgantcatcttatgcctgtcgactctttgccagtgctccacagtgntctggcggtcgctgatgtgctngttctgcgcgcgcagcgctgcagcgcagtcnttgntgtgtctgangtgttgcgtgcntgcctatcactgagtgcatcantcgtgctncgtgaatnagactagtatatgtcctcgtctgcgtaacncgtgtgancgccgtcgtggggctgncgcgcttacgctctcacgtcnatactctgttcggcgcgcgagtctgtgagtgtcttcgtttacnctggntnctcncggcgcgccgcgcggctcgctcgctatcgcacgatcgctgcgccnctagctcggcgcgcgcgtcnngcgtctactagtcaactctctnncnaccactctcatgcggctaggtcagtngtcatacncgctcnattgtnatctcgtcgcgtntngntacgnctaacactgcgtatctcntntngtnttgtcgctgcttcgcanttatgtcattcangtatatctactacttgagtatantgtncagngtagttgccacagagtcctagcgcgcagaattngtgacntcaccagtctcatnacncgtcangtcgtacgatnggacgcntgcgancgacgatctcgtattatttgtatgtgttgctanatttnatntcgtatctgtgtngcgtgcngncngngcgcgcgntcgcgctgtgcgntgctctcatnctctgctgtcgtggacgtctatgtcttgnttgtgnggtgctntgtcnttgtctntgtcgggtggcgcgntattgccatctctcctcactncntngttnntnctttngcggtcatnttntatctnggnnntanctntatcaacagatgcacgctcntangaggtcgcgcaggtnnnaggctctgtggctctnatnctctncaaaggggtgtngncgctntctctntcgcgcgcgcngccgncntcgnctgagnancggccnnctctnctctgnctcncgctcttacnaggatntnnnnnnnctccnnntnnnnnnnnnnnncnnnnnnnnnnnnnnntttntttttcttnttctttttctc

SEQ ID NO: 11183 - DNA, 381 bp, Homo sapiens
  misc_feature (1)...(381): n = A,T,C or G
gtgggggcgccggggggggggggaggaaggggctcggggggaacagtctctcagtgcagtgttcttccacgacacaccatctaatgtactgcctgatttcatttctgacatcagcacgtggggggagtcctaaaataaacactcttttanaactgtgcaagagaagaataacacatgtttagaaagatgatcctgaatattttaaaattcagccaaaggttccatataaaagggactaacataaaaccggacagaggacatcactattaataggagtggggaacacgttatagccatgagaccttaggaaggcattttaggtcaatggggcttcattcccctcaacaattaaataaagagggtgaaccaaaaaaaaaaaaa

SEQ ID NO: 11184 - DNA, 924 bp, Homo sapiens
  misc_feature (1)...(924): n = A,T,C or G
cttcagagtacactccatgaccaggtatctgaacattgcagcacccactgattcctactgacgtgagctactcctgctcatcgaggagcggtgggacgctgatcttgaccacaaacctgatgctctaccctgatgtctctgctctcgttgctgaaggactgtcccctaacttggcttgcactaattgtgctttaccctccacctgcggctagccacagtactcccaagctggtgacctagtacaccctatagtttccacaagaaccttattgtaaaaagagacagaaggccaggtgtctgcccattagctattgaaactgtcctgtatatacatatatagatgatcctggatcacatctctgctggataatgtcgaatctcatacacctaccagactgaaggcactttatggacactttggctgttaaaacagtaactgcttgactcttccacataaaacatctgggcaatccgctctaaaaagccaaaaaccatgggcctgcctgggcctctgggggtggatctcctacggtcccctcccctgacgggcggtttaattcattgaccctcattcactaacttcgctaaacctccgccggtccttttaggaacacanggttttacccccctcaaagtgccgtaattccggtttctcccttcaatccctggctacctccgggaaacactttccgcctttttccctctcccagaaggcccggacctcttaatagggcccccttggtgggtttttttcctggggctccccgccctttcaaccttccaatattccccctcactccaaatgggccaaccccggccgtatttaaaaatcccgggtttacccatgaagttccacgacgtttccttctcgacctcacctttaccaaatcttcccctctttcctatgggagagtgacgttttat

SEQ ID NO: 11185 - DNA, 1709 bp, Homo sapiens
  misc_feature (1)...(1709): n = A,T,C or G
aactgcggatgagnccgacnaacaccatgataggtgntnaaccgacgtatccgctgtcatccgacacacgacggtcgccacatcaatcgtntgtgcacgtgactacgtagncactcatatacactcatctcgtacgntagtntctcggtacgcacgctgcaancgaccgaagcntagagcgaaatngccgctgatgcgacncgtgtatgaagacagagagtactctctcgcacagtcntcacggtancatcacagtcgactatcgtntacanagctacgatgtaatcactcgtngcacgtgcacacgcatgtgtcanacgcgtggacatgacgatcactactacgactacactaactacgctcgacgtcgctgccagtcgcatgtncactatgatagtccgnatcacagcatctgctctgtgtancttactagcgttgagagagcacananacgagacatacgtactaaatgtgtntaacgtacgactcgcgtcgactcgtctcantcgtcgnatcactncgagattagatcatgtctcgcggagatgagtacgcgacagtagtgcgacgtcgtgcgcgtcactcgcgacagtagcgtgttatagatgacagcgcggacgagcgcgtgcagacgaacgtcgactctanctgcgcacaacgtactcaaacattgcgaagtagctnactgcatgtacataccactccgacgatgagactantaacgtcngcatatactattaacgcgcgtagatgtncgccagtccgagantcgtaattnacacgagagcttatagagcgacanaataacgtagcgagagcggagaggcgtaagatacagatacggagagagaccagtacacagatgngatacatanatagtcacgcatctcacaccgtnttcggactgcactacantcgtacacaatactaggaagaggacagcgatagacatagaacataacatcgagccgcacacatccatcgtgcgcagtatattatagcgtcttatacatagatgtgaattatcacgagaactagacttgtgacggagtgtagctgatagatacaatatacatctattaactgtacatacagcgangtgcgcggcgcgagtggncaccgcagcgngccgtgcgttgcgctgctatgtatgttgtctcgcgcgttcgccggcggtcttgcaggacgctgtctttatcatcactnacgtcgtatgataaacgagcaggactacaggagagagatcttgctgcgatgataacacactgcctcacgcgatcggcgtcagtttatcatatgtnnggtatatcangtagncttagacggtgatatgtcacatatcatctatatgtcattgttgacgtactttatttgcatctatntctgtgctgcgcgtctaccgatngtgcgctgtngntgcgcgccgtcgcgcccccgcgtgcctcgcgtcgcgcgcgcttcctgtcgtcgccggcgntgtccggcttcgtgcgcgctaccgcgccgcttctgcgccgcgtnctgcncggcacgtcgtggttcgtcggnttgtgtctcgcgcactactgtntttctctgcnncnnnnnnnncnntttnnnnnnttnaatttcttncnnctnngcntcnctcgncgcctctcnccnccgctcctntcttctncctctccncgccttcnccttnnnnnnnnttttttcttttnncccctttt

SEQ ID NO: 11186 - DNA, 1678 bp, Homo sapiens
  misc_feature (1)...(1678): n = A,T,C or G
atagcgttctcgactatangtgctgtacaccagacagcacaggagagcactgatcancagtcgtggagagagagcgcgcgagagtcacgactatggtagtctngagtcggntgntacgacagccgagaggaatatttcatatatatatctaccgnctganatatacgctactactataganagtagacacttcttacaatagtggtgttatgaagtcangggcagccgtggaggattgttgagcnngnnntcgaagaggagatgaatagaagatagtgtgtgtcggttgctgtgcgacgcagagagatgtgaggtgacgatataatagctgtctctgtgtatcctcagacactctnagttgaagatacgtcacataatgatacaatctagatttcaatataatgcgtgggatcatactagtagagcgacagttgtgctggtatngagacgtgacacgacaggtacantgataagtacaagagctgtagtcacatcgagataagctcgtattaganantaagcgagntagaagatggtttaggtcgggagagatgtgtgctccgagcctgtctgtagcgtgttcggactgcattatgntatgcagtatggagatatggtgtagctaacatgagagtgttataganacagacgcttgtgangcagagtcacgctcgtgantgacttgtccgggtcgcgctccgggtggtagtgcgcgcgcccgtattgnctattgagtgggcaataggcgagagatgtgttgacgttattattactcgatggtgtcgatactcacacgtgtgtggcaagactgaatgtatataggatgaggtaattngatcganggaccgcttatacgtcaccacctcgcctatgcgcgtaccacaatcatatccgtngagtcagcgcagagnantgcgtgcanttgttatagangagagantaataagcgccagancgcgtaagacgncgatggctgntttgaaggtctattgtatgtatatgcgaagacacacgagcgcaccgacgattnagtgaggtatcaggtaggactacgtcatagtaagaaccattacgagagggatgagtaataggtgtattgtgttgacnaatatgtgaatgtagcgatntncgtacattctcgtcagtggagtataggctttcgattagntctccagcgtgccggacacgactagagcactgtatgcagtgtggcganatatcncttgatgtggtatagcacacggtagacgctcagttctgcgtcttatggacgcgngatgtcgcggcacacactgctagtacntcgagcgtatccgccattatcanataatacgtgtgcacacgtgtacaactatgtngggatctctnanagagagcgaagtcttcgactacgngacaatnggantgcgcntagcagatcagtgtcagtgtgtagactaccnataggagagagtcagacacggtgatgtgtatactactctcgtgcgtgagtgtatgagagagaagaagacatagatacaatatgcacatggtgtctcttncggtntgacgctctaacgagancggtgtgagttagnttgtgntttgcggaagcactggacatatccattaatatgacattcataagacacagatatgaantgccaatatctgtcgctgccgctcaagttgctcgact

SEQ ID NO: 11187 - DNA, 1552 bp, Homo sapiens
  misc_feature (1)...(1552): n = A,T,C or G
acatgtagctcgtgcnatgtcgtggatagactnttcgacatctagctatctgtgactactcttacaatccatagtatgcatcatctcctatatcatgagttcactcantcacgcgccgncgcctcgcaactaanacacacnccgtgtttataccatgctttcnantgntagagatatggngggagggagagacgtatacgatcatacaacgacgagcacgtgtgaggtatatgtagcngtcactaacacagcatgtgtgtcgtcngcgacgtgtcttgctctcctgcgtgngtatgattcaccactgagcatgtttataatgagatgtctccgttgtagtgtatgagttagagatcgctgcgacgagtcagcaaacaccactattcncttataactancgctcgtagtttagctctgcgcacatcatgttccttatatatgctcatcgatcgctctaacaccgactntttattnatatgattctatgctgcttctacgagactcatgctcactctcatcttacatctcacacgtcattaataacagttagatgtagagatagctacaggtgcgactagcgtgactcgcagacgagatcgtcgagcgnatatcttgcggagcccgaatgaagtgtcgcgtagcgagtaagctaagtgatgcgtgtgttacattaantcactaatacangngtnaaatatgtctgtggatctgtgctattgttgcataccactagtnctagnatacgtgcactacnagcgagatataatattaaggacaatgctagcgttcgcactaggctacctccgggcagcctcgacacccccgccggccctgcngtaaatatctgnatcaataatacatatctagtgtatatatattattaactaatggntcctagattctagtacaaatccgttataagcactgaagcttcgagctgtaagatcagatactgacttgtatctcgttgtgaccgatcgtcaatcttaaaacatcgcttgaaccagagtatagaaaacggtctattgtacatgagatagctcncncatcgctaactncataccgctcattactaccacatacagtgtatagaaactagtnagatgtaacttcagcgaataaatctgaagcattgtcganattgatattacgcgctctctgtctcgtgccatgtcatgatgtagctgntctctgctgagtgtgatcatggatgagtgacgagacgtatgtagatgtatcacttgtactcacgcttaggaccgacacacgacgtgatgctgaagtatatatacttatagatgacgtagacacaaatgacaganatgaacgacgtgtgtgtcntcgtgtctgttattctctacgnttanaatctactaatataatacttaactacgcatagtgatcactagtgatatatatacgtagagcagagtgtttagntcgtgnntgttgtgactctangcgngaaggctatctcgattgctatcanctgttttactagagngtatatgagcagatcgtgtgtgcagcggtcgcactctctgcgtacaca

SEQ ID NO: 11188 - DNA, 746 bp, Homo sapiens
catatatttccggaagcagaccatatccgggttgatgtaatgatcactttttaaggacaccaggcgcaccagggatttttaggtgtaggaaacactaaaaaatacaccagtttgcgctatcaaaaaatccatatggttcatataaacatccctaaagttatatttcttcgaattcgacgctcttacaccttaccaggcccattgggttattcaaaagagatccacccgttcataaccatttatctttaaccctttttgtgtggccaactaatgggtcctttatataatgaataaaaatattggtaaatatgttcaatagattgacccccttctaagaattttatgtttttacacctcaagaataatatttggtcattaaaagtaccgattttcaaaggtggaccattttataaatttccaaaaatggtagatatacccaaagccgccagaaaaatgttttaaatttttttctattttcatttcttccaaaagccttaggattctcttttgggtaccaaatgttcaatgccatagcctaaaattctaatacggtttttgccaattaaaccttcggttcttttttccccaaccattcatccaataagtagggtttaatgtaacttaaataaaataatagttcttcctggttaccaattagcctattaaatgttatttcaaatttattaaatattttgaaccttatttaatcaaattggaacccctaaaaattaaatgtggtttatttt

SEQ ID NO: 11189 - DNA, 1660 bp, Homo sapiens
  misc_feature (1)...(1660): n = A,T,C or G
acgtcgtgcctctgcgtcatatgctctcgcgctgcctgcgagcgtcgtcgtttctcgcgcgctgagatgcgttgcgtcgtttantagcttgtcatcgncgtctcgtacgagtagatgcngcgctcgaggtatgtagcgtgtgtgattagatgcntgtctagtgacggcgacactgaggcngactgcgctcggtgtgncgtcatacggtcntgagtccttgctgtgtctgngctctgtcgctctcgcacgcananccaagcggtcgcacgcgctcgctctgtctgcgtcgcgagacgaggtgtgtttgtggtggacgatattactcgtctacgcgtnctcgtgtatcgtgcgagatgtgatcggtgtgagcggtcgntgtgttcgtatcgtctagtacgctcttacagcctacgtgcgcgtgtctgcgtgcgtgctgcacgcgctcgcgcgaagctntgttggtctnatctgccgattcgtgacatgttcatagcgtcggtncgtgcgttgtacagtntgcattggtacgtagacgtgtctacgtgcgctgctttccgcatgcggatgtctgaccgtcggcgtgcgtacacgatcaagctctgtangttctcacgggcagtgctcgtgtttgtatactcgtataatagcccgtctctgaacgttgtactagtgttgactntcagagctacatgtcgatgtattgtttctgtggtagggtgagatatctgtgtgtgaggcgctatgctctcggcatacgcgcgtgtctatcgcgcgtccgagctgcgcagtgagcgntgttgangatgtgtgaatgatatcgtgcggtgtggcgcgttcctagtatatctggtgggagtagcatcgcaggctatcgtagcgacacggagngatctcgnggagcggtgcacagctcagacagcagacgcgtctgatggcggntnctctgcgtatgtgttgttacgcataggtgcgcgctagatgtctnttgattcgccgcatgctctctgtgtagncgctcgtacactcctatgtctagacgctgctgctcgcgtcgatgcgtctatgtctgagtgctgtggtgcgtatacagctgcagtcagtgtgaggagtgtcgtatagacgcgagctntgatatganaggacacnctctgcgtacgatgcgcatcgctgtctnatccgacggtactcgagtgacgctgtgtgtcggatangagtgcgtgattcgcgtgccgcgaggtagtgcactggtctaggtcacttcgcgctacgcggctacgactctgtgcgctgcatgtggcctcgccgccgcagttntctcgtgctcgccgtcgtctgtcgtcacgcgtatagatagacagatacgcncgtgcgcgacacgactcgggantgccaactgcggacactcgcgcggtacgtcggtgtgggtngttgntgttgntagctgtgagagcggtggtgtanaatctgagangtaaggtgagcagtgattagaatatgttagattactttggttctctacggcctgctcgncgacaaggcgtggttcttgtgtgtggttttgctcgctcttngaanattctcatatagctagagtntgcttgtagttataggagcagctggtgcgagcgcgtggtgctgtctgccccgtctgtcgtctgct

SEQ ID NO: 11190 - DNA, 1372 bp, Homo sapiens
  misc_feature (1)...(1372): n = A,T,C or G
ctcgtcgctcgtattctgctgccctcctcgcctcccgctgtcttctgtgctccggcccggctctccgtccgccctctctgcggctgctctgtntctcgtcttcgtgtgctgtcgcctcttctccttcgctcgtctccgttggcctgctgtcggttcgtgctgtgcgctgtttgtgcgcggctctctcctcttgccgctgcgtccttnttcttgtgtggcttctcgccttcgtcgtcctcctttcgcttcgccgcgttgtcccgtcggtctctgcgtctgctggttcctcncncgccctccttcgtggccctgccccgtcctccgtgcgctcntctctcttttcgtcttcgcnttcttccttgtgtggcgtgtgcggcgtggtgtcttgtgtcgcggctgttcgcttcnctcctctctcttcccttctctcttctctgtcgccgtcttcggcnctttgtgctcgtcctcgtgttcgcgtttgctccttttcctctcctgtgctctctcctttctcttctcctcgttccgttcgtcgcctgttcttcgtgtcgttgcggctgtggttttgtcgtcgctttctgttgtcngtcttgntctctccctttgcgtccgctgctctctcctgttgtcgctcgcttcggcttgtctgttcctctttcncggcttcttcttttggctttgtgctttctgtcgcctgtcctcttgccgcgtgccttcctttcgtctctgtctgttcgngttctcgcccctctcctgtctctctcctctncttgctttctggttcgctgcggctnccgtctcctctccctctcgtcctccgtcgcgccgcgtgcttgntccgtcctctctctgcgngcggtgcgccgcgcgcgccgcgcccgtgcctgccttcccttgtgncgntgtcgttgcgttcgtgcgctcttggtgcgttcccgtcgcgcctgctgtttcctgttcgccctcgctcgtctgctttcttaaaaagatgggtccgcggcgccctcttctgctcgttngctgtcngttcgccttgtnggtcttcttctccctgctcttctctcgcctgctttctgtcccctcgggcctctctcgttgtgtgtcgtctcgggtgtcgccgcccgtgcttttctttggtgctgtcgcccgtgttgtttcttcgttcggtcggtctgtgctttgctcttctgttgctcgcctctctcccttccttttctttttggttttcccttctcttctgcttcgcttcctctcgtttcttgcgtgttctcngccccgctgaaggccggtgggcgtcggttctccccacgaggnttttttttcccttctttctctcgctcttgctgttgtatatggcgtctgccgccgtctc

SEQ ID NO: 11191 - DNA, 1126 bp, Homo sapiens
agtaagtcaatctcgagagacaccaaggaaaaagcttctatggatgactaactgccacagggcttaaggaactgaaaacctacatcgccttatttgtcggctccacagctcccagctatgagctctggggcgccgcgggagcacttacgataggagtggtacttgatctggcatgcactcatggcacccgtactcgcccagcatggagcacattacctgagcgagagtattaaactcaaaatcgccgtgacgaggaactcacgtggaagagcacgaaatgaacgcgagtactgagtaagaatatattacttacactcacacactccttattaacagagatgcgctccatgaaaaacatgatcggaactacctaagaccacaagatacactaacttcagctagcggagcccagaagtctagcaaaagcgcctcattctgctcatccacacgactaatccagcattctaaacacgccctactcaccaacctctgaacttccaaacagcgacttcgtgattcaccccaagcgacgtcgtcaaacctcggacaactgagactacgtgcatccacaagcaatctcgaagcccacaaactaatccctgcaaactcccctaacttaaccacgacacacaagtagacaggccacactcgcgccaggctcaataaacaaatccgacgaaaaacgagatctcttagacctcttaaaccaatcaccactatatgaaaacccctcggtccctccacgaattaacttagcttagctctccgcacccacccaaaaggccacccactttatgagatatattcatctgaaacccacacgcggccgcccgtaagatgcactcacacagcaactcaccaaagaccacaccgctcatctaatcggacttcttcgccagaatcacagcatttaatatactctcacaccatatttgttctctcgacattccacaaggcatgcacacccgccctccaaccatccaaacaagtataggaaaaacagaatagcacaaacgagtactaacatctatccgtgagaaccagaagagtataaaacggtagagggcaatagacagatgacgcaccaattttaacttagcaacacagcactaccagcatcgaaata

SEQ ID NO: 11192 - DNA, 1460 bp, Homo sapiens
  misc_feature (1)...(1460): n = A,T,C or G
cctctgttctcgaagtcgtgcagcttgntntttacttactgagctatgtgtggtatgnctatgtattgtcagagtgctggtggcgagtggtgtgagataatcttatggggtgaggtgatattgaatatgatttgatannatttcatncanantctctcagtaatcttntagtgtnganttataagtctgtgtttcttcatgtatngatgnagtcgcagtngagcatncgnggccgngctcgggggngngangagangagnnngaggatantgaganggttagtggagagantcactacaatctactcacttcactacgctnncncnctcgcgcngctggcactctccgtcgttcatacatatacgnacgtagcantgcgctgtccacactcttcntcacgagagctcaacgcgactgcgataacaaccataaggaagtgcaagtagagtgattgacagtcttgagtgtgtgtgtctattcacgcgacacaatcatcgtactccatagataatttgaggaaatgagtanagatacntctctgagctagcatcagatcgtatgtagctaattgagatagcatgacgagatgacgcgcagacagtctggcaagacaacgaggaaagggagatgcgagagagagcatgatacatgatgaagtggctgctccacgtccgtatctcattcgcgaacaaatacatacatattatactgtgatcatattgcctcttgcgtcctgttgactcgttgcttagggcctcaatcggtccttcgggtcgacacttgggacagtacgcgagcgctcggcgcagagaacattagaaccactgtgcacttcacacgtcattacacaaataaaatcacaagtggaaccctccacgtacgtngctgacgcgaggcgtgacattattactacatatgcaatatccatctctcacgtatcacaatacaggaccatactaataccgtggtgttcagacggagtactagcgagcaccactgagcgcgtatagtctagtccaaccaccactacactacattcgatcacgcgncgtctactggtgtactgtgtacacatgatggtgccgtacgatgattgatgtctagtgcaactacgtactaaggcacgagatcagtgacactgcacgcaccgtgacgaggtcatcgctgacactcaacaatgtgtctgtctctgtgagaatncgagtgagctagcaatgtgtnnagttattggcatatcattgcanctcacgaacctatctcacatgcgtctgcgntcatattctcgnaccaccagctagcaatacacacactactcatcaacaggagagctgtgnataggatatatgtaagngtagtgatgagtatggtggcagctgtgaacgagacgaacaggcctctcgtgcaatctatttcgactatatacttgaacacatctcgacgtggacagcactgtcacgcac

SEQ ID NO: 11193 - DNA, 1220 bp, Homo sapiens
  misc_feature (1)...(1220): n = A,T,C or G
atcatataatgtccgactaccatatataacgacggcaaccacgacgtacatatatacagaactctcacagactagaggcgacgcgcgcgagcgatagtcgctacgtgagcactcatcacttactcacactcagacacgctatgtcagctgttccttcttntcacaattacgtatccgagctgtatcgatgttagttgcacaatagaggaagtaacgaagaccagattagcggttgtcgtacagcgcgcacactatcnncncacntatatcttcagcgtttacaatgctcgatcacatacgtcnttgtcccgtcgtgatcgtcgctgncatgactctgtcgatcactgactatgtcagagcgttgttctctacaccgctgcatctgagttacaatatgggtaggtactcatccttgcacatatgcatcagtctcngagcgagccaggcgtcacaaacaagcgcgcgatcagcagtgaagagtatgagcgcggaagagatacgagcgctgtagcactgtggctcagctcgatagaacgcacagtaaccacgacagaatgaagaagcggtgcgcggccttctcgctcgatgctactctagcattctcgcggcgacaaggttcgcggaacataatcgcatgacgtgacaacggaatacaaacataactaattacatacgatcatcccantaaacaccgccacacacaacgacaacccaacagttctcaaccttctcttgtgatgatcccgtcaagcctgatgtctaaccaagctagccctcatacttggaaaacgtacggtaaaacaggtttcgagtagtattctaacgaaaaaaaggacaaagacctggggtgcgcatgcctctatgctcccacacagatatggctacagcattgcgtccaaaggcgaaccatacgtatggcggtcgcggcgggtcgcgccgcaggtccaatgtaaaaaataggaaacagtgcgctctttcaactgtcgcgcaggcgtcgtgtgacaggagcgctccgctgcggcggctgtgccgacatcgaaaggcgcggggacgatcctcgtatagtacataaaacgagacctgcaggacagttgcgaacgcatttcgatctatataacacagaaagtaccggttgtttctgcctgcctacaccgtggataggagtcccaccaaggaggaagccggcgcttccatacagaaaaagtaagggtacgggcgtc

SEQ ID NO: 11194 - DNA, 747 bp, Homo sapiens
cgtcaggtgtatgctgggtagggaattcggtgggttgttcctatgggtgggggatccttgacggtggattggccgcgctggaatttcgacgttatcacctggttcttgcagtactagtgtcatagtattttatgcaatattattctatcttttcataaggaatatgagtaagtaggtatattttgaagtatcctcagattccattccgtcattatggtttaaggttcaacaatcacccttctctcataccgtttagcagggcaacagaggttgctttgatacatttacccctggcacagagcggttgttcagtattatatgtcgggtggagatgacagtaataaataaaatacagttactaatctgaagaggctatgggttaatcaggatgcctctaacgagttcaaggttggacggtgctctgataatgcactcggctctggataggagatgggcgctttgcatacttctgggcccccagtgaagtagagaaccgtggtgagaaggaccagcagtttccaggaggcactcgtaatagggtgggagggtacagaattggcgcagacagcatctatggctctcagtgattctgctcgctttgtagtacacttgatcagaatggctcatgtgggcattcaggtcggtagtcatccagtcaatcccatccatgtagtgccccccgggtacagacatcagagctcggatgatgggagccaaatataaggcatggttatcagttaactcccc

SEQ ID NO: 11195 - DNA, 928 bp, Homo sapiens
acttctcacccctatatcaagacaaaacaaagtttcagatacatcagaccgactttcataaagagctgtatacttgtctagcttttgaaggaactcaagaaacgtcacccagaaatatcccacattggtctgctgattacttcaaactgagggaactttgggaacagcaaatgcagggagagactttctctgaacttacatcatttgcctaaagatggatcctacaaaaggaatgaaatggtcatgaatccccttcccaggaattttattaaccagggtcaggggattaacttggaccacaagagaggagacgagagggcaacacagcatcccaaaaccatttactctcctttaagtatcctatatacttcctcccctctctcctatgaaaaggggatataagcttttatacctcaccgcggttgggggtatccactcttattccatgcgctacccctgaccacacaatgaatccgtacacctcttcaaccgcctgccttcaacttattccatagactcccttattaaaccctttgaaagaaaagggaaagtctttctttccaaacactctcaaccttcaaattcaaaaactccctaaacctatcgactttaaaggacaccgcgtaatactgcacatgattattataccacaaatatcttcctctactctgctcctaaacaccaagaccaaggcaccctcttaagctcagtatgatctactacaccagaggaaacaattctaacgcacccccccttccttctacccacaggactccatcccctctctagcgagtgattacaacccttctcaactacctacttgcagcatcaccgcaccgtcccacacaaaacaagaatactgtttttctccacctacccgcgacctatccgcccttctcttcattcagtatacaaacaactgctctat

SEQ ID NO: 11196 - DNA, 1039 bp, Homo sapiens
  misc_feature (1)...(1039): n = A,T,C or G
aggcacacaacacagagggcgccgggaagnaggcctgaagttcaatcggcgcggcgctttgnaagcgngaccggaccgcagcngcaaggaacaagaaaggacaaagcctcagccgaggaacagcggggactagatgcgcaagcaaccacacccaggggaaaacgaggcacagaggagtgccagagccggatcccagagcccaccagcggacagcagaagagccaggatgacaaggctaagatgccgcggagccacagacgagacctcctctccacngaggcacacngccaccagcgagagacgaagcgaagggaccaccnccccnncccgcggcgacgcaaaaagcaaaacgaccncagagcgacggggcgccccgagaacacaaaccaaagacagcccgggcacaaanagagacgccaccaccaaacaagaacggcacaaggcgaccaaacaggccccacaaggaagcacccccagccgcccgccgccaccgcagcgggggccaacccagcgaaaccaaggcccacaacacncgcaagagcgggcagccccgcgcgccgccaaaccaaccgagcaagcccaaaggaggccaaacgggccaccgacaggacagagcgggcacaacaaanacaaaaaacaagggccccncacgcgcccacaaagagggaccacagccggccgcaggcccccaaggcaggggggacggcaaagacccgcgcccaccggccccgagcgcccgaaaacgaccgccgcgcaagcggccgaaccccccaagaggccgcaagagggcacgccccgacccacgggaaccccgccgggacaaacaccggggccaaacccgcgcccaaagcgcagcacccggcccaacggcccgccncgaggcagcanagcacacagcncacccaccaccccccagaggacacacacacaccacccaaccncgagcggcggacacgcggcgggaacaaaacaacagagcgccgccgcggaccngcccgggggcgccgaacgagccccgcgacacagaccagcgcccgca

SEQ ID NO: 11197 - DNA, 1069 bp, Homo sapiens
  misc_feature (1)...(1069): n = A,T,C or G
catgcgagtgagatcatgaacgaatcgatagtgacgtaataanangagctcgacagagcgctnacgagcagatgtaatatatgtttactntgaggtgtgtggcagtggtgaggtgtantagtcgttancgctagatagtagtatactcgagtaggatnangaatataatgaaagctanancntctcagtctantatntgtactatacacattantacatactnatntnacaaatcctgcagacgcgcgggggacgagagacagcggttntctagngnggnnagagannaganganggntaggtngagcgcacaagaagcaaccatatatagatgcacagaactgagaccgaggggactgcaggacacttagcgcgataacttacagcataacgctagtagagcatagatggtggcacatagatgctgtcaggggagataggatgaatcgataatatagacaacgtctgtatacatagatcactatgatgagtggtcagggggagagtcgtgtgggcgacggtgcgctgtccataagcggtgccacagcacaagtcgacggattggtactcaccgtgcctcgcaaagcactcagngtccacgcataagcatctacgagaacaaacatggaacaagacaatgaaatatacaggagtgaatacgactgagaggaataaggtggagataaaagaacacgagtcactaataagggctaactgtggcttatgtaaggggaccgcgggtaaaataaggtgttcacttgaagtgaatgtgcgtcggtaccagtattagcgtgtgaagtgaatggagaaataaataggtacgcaccaggattggacctgtattaggagatccaaaagataagaaaaaaaagaagcaaaatatagatagactacatgataatcggcccctgatgccgacaagtaaagacagttgtagttcgttctcagcgggtcgactgacgacctagaggagcgtgtttcgacaatgtctctgcaaaacaactagtaaggctgatgctgagggggatggggttaaaaaataaaattttaaaaaatatatgcggtaccg

SEQ ID NO: 11198 - DNA, 1764 bp, Homo sapiens
  misc_feature (1)...(1764): n = A,T,C or G
caacatagcacgcaacgtctattattgccaatcactctcttatcaacgtatacactgcacttcactcaccatatgtgctgtctagcactcaccatacacctcacatcgacaaccaggatcgtgacgcgcagacgctcatagacatgacagcttatcgatgttgcagtgactagaactgacgtagggcgagacgacgtagtatcgtatcttgcgatctacgccgctagcgacgagaacgccagtactaaggagagcgatgtcacgacagacagtaagcagagacaaagtaagtgacacgactaagagtcgccagctaacacattatgtacgtatcagaactacgctgatcgttgtagtgtgtacccacatatagacgctcacacactgcgatcaacgtctnatagtagcctaataataaaattaatgttcgctcactgctcgatgggcagcgaggcgcacgtcagcgacgctcccttatcgtcgtctcacgtcattcctcacgcgtgcatctgtataacactcaagcagtctcagaacagtgagcgcgctatccacgtgatcgtaactgagcggaaccgatgccgtacgnagtctacatcatcaattcgtatcgtcggcagagcgacagcgagatataactgccggcgtgtacatcgactaagtaagagagagtgtacagagagagctagagagcanagagagagnagtgtcagtgacgtcgtacatgatgtgntcttgtaccttacacgtgcgaggtncagttaggtacatagatgcttcgatatctcgacgtcgtattacgantntctgtgacggcgcaaccatcggagctgatagtgagntgatngtnactctgcatgagtntgactatgcgtgtacaggcgagtgtctatatntctgacgtgcgtagcacgtcgnagagagtacactgttgacngacgntatgaagncatctagttacgcgacacgccccgcccctctntacgctntcactagcgcggcgcggtccgttngacntaganagacgccacagagcgaccgctcacncctcaccgggcgtgtaggngtgtaacgtacncgatcntgacntnaacacgcgagccagtgngcgctatatcatactcgtagtaccagctatcgcncactactagagcatcgtatcagctcactatctaacactatcagatctctcaccgaaccacatnancccgcgtagcgagatcatacgtnntcngacatcgctcgacgcgnacacctgcgcatgacgacggcgacgacgngacgcgaccagactgtctggagagatgagagtatgtgtntaatatngtncgtatnactcgagcatgtgcagtatctaaacanaaacnantnacgtgantgatctcttcgttctcactcctgtcgatngtgctgtgtgcgtcgccngcgtcngcacctgcccgncngtgcgtgctcgtgcgtcgccgngctgtcgnctgcgcctcgccgtctcgcctagccaggcgggtcacctcngcgtgtctccgcgtccgctgtgnttcgatcgagctcaccggcgcgctcatctgtctnntatttcgcgtnaagctaacgtggtnnnnnnnnncnnnnnnnnnnnntgggnnnnnnnannttcgtcantcngnnnnnnnnnntgtnnnnnnnnnnnnnncnngnnntncnnnncctannanncnnnncttanntcancctcttaannnnnnnnnnnnnnnnntccttttttnnnnttttnttttnnntttt

SEQ ID NO: 11199 - DNA, 866 bp, Homo sapiens
  misc_feature (1)...(866): n = A,T,C or G
caggtgacgacacgtggggcagtcgagggtttgggtcgtgtgaggggggggagtgttgaggnggccgcttgtgtgtaatagcctcatttctttttcttatggatatttatattttgcttgttccggncggcaggggaagtaagaagatgggggggagggagantatacacgctatccccacgcacgcgtgtgaaagtgtgtgatggcgcctgtcggggtgccgcttcttctttgtggtgatgggggagaggagggaggtagaggtgagtgtgtcagaataatatacggtgtcaagtttaggtaggtagtatttttaacttgtagggagtttgggagtggctttatttacgtctacggtgggtctggggaatacaggtagataggaggtgtacgccgtagcctggggagcctatctaccgtttgtgttcgggctagtgtggcgggggattaggtggattcgtgcgcggagttctagcttatgtggtgctctgggcacagcgaacaaggaattttagaatcatctcttggctatgtgtggtgcacatcgttttcgtaagagattctttgaaatgtaacagtagaaagtgggtctctctaggggggtcgttggaaaagaacttgtacagagctgaatgtactgccaccgttggagaaggttgtacgccagcccgtctcctcggctgaagcgttaggagggcgatgtttcggttgcgcaaatgtgtggtcttcttcagccaacagcatctctatagttcgtttgtgtcaggcgaaaaaaaaatatgtaatggcctggtggcaaacatcggagagtttngcggccagcacgttttggtctctagacacttaacaattatggccattttcct

SEQ ID NO: 11200 - DNA, 251 bp, Homo sapiens
tcctgtgtgaactgctggcgaggtttccaggccagaaccacgttggaagccaacaaaatcggagagagggaattccaggatgctcactggcaagatagaggatggagaaccggcttcacctggaggcgtcattgtacttattcttgactcatctgagtccaaacattactctgtccatcggggggcatagaatctgcttattaaaagctcatcataaacaaaaacaaaaatttttcactgtggcctcacca

SEQ ID NO: 11201 - DNA, 1808 bp, Homo sapiens
  misc_feature (1)...(1808): n = A,T,C or G
acacgagcgtgtgtcgtcgtgnaccgcantcgtgtcgtgngtgacgggctgtgcgtgtgcgtcgtactcgtgtcttttctctttctatgcgtgcgaggtcgcctcgtgacgtcacacaatcgtatcctcanactcnaaanagtnagactgacatgcggcgtagtgtgnctanatattganctatcaacagctacgtgctcnngatcnagagtagctcgtgcgcagttacttgtgcgcgactacgtcgtatcatnacgtatatgatgangnttaagnagatggctgtctatgtcctcctcgntgagctttctcgacatgttgctcagcgtggatgagtaactatctcttagaannnaatacgtctctgacagagtgngctctcgtcgtgtggaggnnagcgtgtatgtcgcgtgtgtatcgtgtcagtgagtcggctgtgctactctataggtcgagacgctcacgacgctcgaccactgtacgncgtctctatagcacgtgcgcgtcgcgtcgtactgcatctcatganaccgcgaggtnngncatgctacaatcgatcttcctacnccnctcacatctcgacgtcgcgcgngngccacatcgtcgcctgtngcggattagcagtgtgtgantatgtantatatatgtgtatgtgcgcgttgaagcacgtcagacncgtggtgcgncgcgccgcgngcacgctatngngagacatgccgcgcgccgtcgcgcctgcggctcggtggtngttgacatccacaccatgaaggcgagcgatacgtccggtgcagtngtgngngcccgtatagtgacggttggnncgtgtacttagtatacgtattactctgccgcgggcgctcacgggngcactctgtcacgcanacctctctctaccacacgaaggaatagatattgacatctatatgaccttcatgtagactctcancacactcatggagggctgtgtcgatgtgngaganagacgtcatagatcatggnattagagaccacgcctgagctgcgtgnggtgcccatatcgcgactagcgctcgctgtcgagtcctctgtttgcgtcggcgatgcgtgcgngggangtgactcgagganagcgcgtacgtcagacaggtaggacagtcgacananntacctnnnnnnnnccgctcgcttcttccctctttcttcttacctgtctgncttntgctctntcatctcttcatncntnnttctgtctctcgcgtcatcttcaccttctctatcttcgaannnnatacatcttacaacncgcattcgtgtctctgcttacctctatgtactctacttggtctctcgtgacctgtgtgctctgcgttgcgtgtcgtggtnncctctctgttnggctcgcagcgtactgttngtgagttgtacangagacagtaganaccatatatganatnctataccactcctcatctntnccccttctcncgcctatacctncccactctncncnacttcncntcccctactcngccatcacncactnnntctcantactcatctcncntnnccatcgcctctctcatatcncnnnnnnnacccacntnnctcatanacctcttnnnnnntnnnnnnnctcttctcctatcnnnnnnnnnnnnnnnnnnnnnnnnccctnnnnnnncctnnnnncactcncnnnnnnnnnnnnnnnncnnnnnnnnnnnnnnnncactcancncaccnnnnnnnnnnnccnatctnactcatctnnnncatctctnnnnnnnncaatcttctctnncnnttnccnnnccaaccccccnnnttaa

SEQ ID NO: 11202 - DNA, 916 bp, Homo sapiens
aacagccactccaatccccacacaaaacaaaagcttcgaggtgacaaagaagcaacgtcataaaattatacctcctccgcagaaaatatatttcagaaaatctctatctcaaaaatgaagcacccaagaactgtctggctgtgaggatctggcctcaacttgactcaaagcaacaacctccacctacatatcaagatgcccgtgagaatgaacctgctctgctcaaccaacgtgatgagtgacttgatgtacgtataaacacataacacacaaccgctaacaaaccactatgccctcactgccctcaccacccgaattctgagccccccccctcaccgagggcaataactgatcgcgattcactgatcactcatctcgactcacctataccccccccatcacatcatactcaaacccgccaccacagcgaaccatacaacaaacaccaacctttgctacacactaccccacacgccactcaacggccctcctaccaccaacgcctactcactcacaccttagctcgccccaagtctccgctaccaccccaaacacaccccctcctctatggcctgaaaacacccccattcatcaccagcacatcctaatcgcctcaccacaaacaaatccataagagaacccacacaccatataacaataaacctatacagaaaagatccattataaaatattctccaaataaacactacagcaacatactctaatacccctcaacaacaaaataacccatagtcagcctcacaaacacacaataccacaggcacttcaccaccccaacacaccgaacccacacaccccaaacacgacaacactaacaccatcacacaccataaacctcgcaccacaccaacgataatcgttaaacacaaaacaacacttcacaacacctacaaat

SEQ ID NO: 11203 - DNA, 601 bp, Homo sapiens
  misc_feature (1)...(601): n = A,T,C or G
cccactcatgatacacgctantctnccgccactctgtgttacactcatgctctacctcatgatcgtcatacgatacatnncaaccgaacatcatcgcatnaacacactctcacacgacgctcacacatgnacgctcgctancacatctcacaccatctcnatgcgatatcatactctatgnggngagacgtataatgtnactatantantagcgactcgtagatgcganggaacgctatgttctagaanggcctgcttcgtctagcgctccggcgagcgttcacgtgatcgtctgtannaacacacacgatcgagngactccacatcttacagtaactcgcgtcgctagtnnccagcanacccgtgcctcacctacgcggcgagaccactcaacgctcactctgcgtccancagctccaccgcnatgatagggngacacagaggtanacgtacctacttctactcctatgatctactcagnatnntacgcctgtcacgtaccgcactccttccggcgcgtgacacccatatccacgactcgactctattgaacaattaaaaagagcggcggcagcgaagacttcggcaccagggagnagcc

SEQ ID NO: 11204 - DNA, 328 bp, Homo sapiens
  misc_feature (1)...(328): n = A,T,C or G
gtttatgatgaatatacccatgccacccaaaaagaanacaggncctcanatgtaggctacggggnacacganaaggatttatgagataaatagccatccttgtagctctgaaaacacttcaatcccagacatgatgaatagtcatagcatgatatctcacgtacaaccacgttttgtattagagtatgactctcctctgcgatgatgaacttgaataccacaagattcttgggaaatatttaccattggctgaaatatagcaattattcttcattctgccattactgtgtcattaagtatgatttcaatgattaaaaaaacaacaaaa

SEQ ID NO: 11205 - DNA, 1716 bp, Homo sapiens
  misc_feature (1)...(1716): n = A,T,C or G
actcgccagagaggctaatactcgtctctgcagtgtnagagcagtgactactcagtagagacgtcgatagtatacgtgnacagggagtgggcancgaacaatncacactcgaaccaccaccgtaagagncncagcgatgcactgcngcataagtganacacgagaagtagtagattatgcagcgaacacaccactagatgagcacagaganacggtcggggtgtagaagatgtggagangaccgcttggatacgcagcgacggactgcgtcgagnggcacggnggaggtacagacagcagaatggtnatatcagagaagacatacccagacatcaagngcatacgtatacagatanncatgagtagatnataggacgagacggagacgtgtgggggtctnatagacgtgagncgtgtnaggagtgcgtagtntgagaacatacgatcgagtgcacgagatgataagagttagagagagaatnagatgagaacgatntgatgtagactattgatagcggangngagaactcgtcatcgnancnatagcagatgtaggngacgtgcgacatgacgggagtgtgcgaagatcgtnagtgcgcgagcgntgatnngtanagtgcgatgagacgcacgtgagagaacagaagtggcagagtagaggacagaggccagcgcggaggtncgactgccatgcancagtnagngnagacgcnagagtgacgcggtnagcgaaatntatntaggngacaaagcangggatatacangatatcngtgcacgtgagtgncagaggagngatgaaatagatagagngnagcgagtaagtgtagcgattagcagacaaagagaacanggatcaacatgtgaggcgagcacgaaggacactacagnagaactcatgcactacacgcatagatgcctcagaatacatctggtatanacactcatancnaaatngngatacactacatggtnatgtactngnagagtgtgngcgatagcgtgcagctgngngcgcatgatagcatcactggcgtgagagggctactgncgcggagnggaagaacacgnacagagacaccgaggagcgaatagacggactaaatgcactgacagaannnnanaacgtggagtacagcacaccacaaacactctcacacacgagtacacgagataaatncagtacgtaaannaacatgattctggtcctatcctatcantccaactttcccactttctnnnnacacactgtactattnatcncaacatcccacggtcgggcagtgtgnnggactcatattcgctctgagngtnggcgatgtgaggctggagaggacgcgttgcgtctcctctcgtactgtcgcngctcagagaatgagcagagtgagcagtagnnaaacagaggacatcgcgcaggtnnacannnnntcgtctncancattctatntngcgcgtnnttctngtnnacagtctttcntactcgtntnnacgatatacgttnntnnnnctctnanacctatccttnnnnncagtttnatcacttcactnnctnnnnncnccactcgcttcttnnnnnntnnnnnnngnncnaatnncctnnnnnccttnnnannnnnnnntnnnnnnnnnnnnnnnnnatnccctnctntnnnannnncntntaatacttnnccctttntnntnnaaattcnttnnattnnttanttttttttaaaa

SEQ ID NO: 11206 - DNA, 471 bp, Homo sapiens
  misc_feature (1)...(471): n = A,T,C or G
gttaattaacacaacccgccaagacaaactttaagggagctatcttgctgtgtagactgagatacagagcagcagctattcacagccttgatcactgcgctatgcagccatgaactcctgggcccaagcaatcctcctgcctcagcctcctgggaagctaggattacaggtgcatgccactgtacccagctgtcattacagcttctgctggttattgctgatatatacaattttttgtttcctcttacagaaaacactctgattcctgctactggctaccaataaattttcagttccttcatattttctagacacataatcaagttatttggaaaactcttcctagtttttcttatcaatgttcatacgtctcaatttcttttatcgcttaccgcattggccatcacttcttccctaacacgggataatataccaacacaatcaaaatatggnctagttggccttagctgc

SEQ ID NO: 11207 - DNA, 1018 bp, Homo sapiens
  misc_feature (1)...(1018): n = A,T,C or G
caaccctctaataataatagtgaactcaaactatattattctntatatttctcctccgctctggagtggacccttgtggggtggctgagacggagataaacacgtatgacattaggaaaaacacaaaaaagattctatgataggataaacacnacattagagggtacaaacagagaagatgacggaaattgttggccagatctgggttaatcgatgaaatattaagagaagtataaatctaaattgatgtgttgattctctacacacacaatgattaacaaagaagaaaaagaggaatatgaatagaggcaatgatgcgatgaaagctaacattcagataagaggaatgtgggacggctcgaagaatgacgcggacgtgggagctgattggacgggaggaggaattctgtngagnacaaaaaattacgggcataagcgaacaagatgctagtgaggaagaaaaaagccgcgtgggaggtggaggagttctggtagggtgtgnntttgctctctatctatatancaccgtcccaaagagggaaagtggatgtgaagactggngnctttgagggggaggacgggggggggcgagggccggnggcgctgtctttcttggctcatactatcaatatgatattatcactaaatatgtgttctgttttcaataacatattcattaacaaaaccataaaaaaacaaatattatccttatannnaactattactaatctgtaaacgccttctggngaacccactcgcatatatttgagtcaccgcatgcttacttacctaagtgtgtgattggncgctctgttcctccgcggcctatttcggncccctctcttccctccctgctctctcttcnnnnccttctctcnnnctctnctttnncnnnntnctcttnnctccctccccnnnccttttnttccctcctncnccttcncctnnccttcnccttatcttcaatatattttcaaactnacacanaaaaattaacattacacatacattttatcaa

SEQ ID NO: 11208 - DNA, 346 bp, Homo sapiens
cgctcaaggtgctactggctcgggttagaggcgtcaagtgcactctgtggggttcccaggaacggggccagagcaaccacccagatccatcagcccggctcctcctagagcatgtcctcatccaccagctttctggccccgaactcggtatgaatcatagaaaggcagcagttcttttacctctgagagttcatcttgatgaactaaagaccagccagtgaactggggagatccagaggggtccctgactcagcgtctatctcaggccactgagggcccgttctctcccctctcgccttgcaaaacgttttaaatatacctgtacatagagttaaaaaaaaaaaaa

SEQ ID NO: 11209 - DNA, 971 bp, Homo sapiens
  misc_feature (1)...(971): n = A,T,C or G
gtgaataacgcgaatcgactcacacacaacaaacccttctagggctcggcgaagttcctttttatccctgagcacaaaatattcagttctctgtcagaccatacatcaaatgaggcagaggcatacctgccagagaatgaaaaaggacaggcgcccgtcttgaaactacaaagcctgctttccacaactagctgcttatacactctggtaccaaggacacccccatgtaaccttgcatgacatgctgcgcccttctgcctgggactgtgattctacaggactaaaacactgctgcacatctcatctgaccaactgcaggtcacatgcgttgattcatgctcatcccttggattgttaatcccgtatctcgagaccccgacgagaaaacgattcacacactatcatattacgacgacgccacccggacaccagcaacacaactattccgccatatggaccacatacctggcgaaacagcactaccctttttttatttaatatttgaccactagaaccaagccctcgcactgcggatacagactacggaactccctttgagagttatgtatttggaccaaactatagtggtagtttgtgagtagtcaatcagcttaagtgcaacagtcaccagatatttagcaccaaaagtgcgtccttaggtggggtacgtgaagactgcagtggtagtctgcctcttcatacatacaccccatgcgctcgtaccatggtaagcccttagtctaaacatctctacacgccaacctcctagagatacctccgaataatagtgatagctagatgaggacgatgacggtatgccctctcccctcaaatagaaacccggtgtcaccacatctgcgacgcagcgcgaggaactggacagtcccgatggagcgccccatgaacaacttcgcgcncacttgagtaggtaatatgtccatcattcagaagtatcgactgtatcctatacg

SEQ ID NO: 11210 - DNA, 774 bp, Homo sapiens
  misc_feature (1)...(774): n = A,T,C or G
ctatgaggggcagaaggaggaaaatgaaatgaaaagggtctgggaaaatagtacgggaaaaagaaagagcatgggtgagagttatacacatcctgaaaagggagacaagagccggtggaggtcgggcgataaccctagacaaaaagnaaaaagagttaagatatgccataaagtctaagaggaccgtcagcgtttttgcaagtaaaagataaagttcagagcaccttctgaaaaaacagaagacaaatttacacgagaaaaaagattatccattatgtttcaagagagaccaccgagtgacctctgcatggcaaagtgtgcccttatacttaggactgagagtatacggaggtaaaacaaactggtccatatcatctgtccaaaggcaggtctcatgtgttgagtcaatctcaataccctggagtggaaaatcccttcctcatgaacaagaagagaaaagcattgacacactattgaataaggctgagccaataggagaaattcaacaaaagaatttggttatttaaataaaatacatggaaatttgtttaactttttttttttttttttttagcaaaaaacaagaaggacttgttttgcgatatatttttagggaattacattttaagtttatgtttagggcactaaacataagtttagattgtaatgaattcattaacatgcctgcactatccagagattctgatttttgaaacctgtacttgatgggggccaatggaaaatgaaggtgaaatgctaaaaaaaaaaaaaaaa

SEQ ID NO: 11211 - DNA, 1101 bp, Homo sapiens
  misc_feature (1)...(1101): n = A,T,C or G
tagcccacatcgagcgactccgacaaaaccaacactccctctcaccacttctcctcaccattctactcttaatatctcctctctcgtcccttcccactcatcttccaccgagcataaatcagctggaactccaagaaaagacgcacgtacgcagaaatatgttctatgccctataaccaccatccctacacgtcgcatacatccatcacaatgacgacaagccacgtcactagaaacttaccgcacccccaagagactaactaccacgtatgggtatcatgcttagtatcatacgaatctatgacaaactttcactacnaaggaacacatgcccccacccctcgtcacgngactcccctcaanttctgtancactaatacacctaacttacctccaaaacggatcacacccgctcnnacacaccacctacctctccacgcaagnacactactatatggtcaaattacttctaagagaacctcattacctgggaccgcgacacgaaccccccgggccacacgccctgctgcaggtacccccgcggatcggtgaacgtgaacctaggcgttcacaccaaacatcacctagataaccgtacactctcgcaaccccctanaacccctgtacataaccccacatatcgcaacttccttggttctacggacttctggtgttctcttctctcctcnnnccccctccctcccctcccccccccccctctncctccttctcntctctcaccttctcctcccctcttactctaannactcccccctcaacctatctcccgccacagtaaccctaacactcaacaacttgaaccaaacatgttgncacacttcactnactcgctncgtctaggtnnaacttnaatcttattcattatnnntnnnncctctncccccctncacctccacncatacctctnnccctccnnccctcccacctnncacacccacaccncnnnccattncccaccctnnnnnacaccccctccnnnnnnnnnnnncctnnnccnaacacnnnnnnnnnnnnnnnnnnnnccctccctnnnncncatcaccccnnccctnnnnncccttcnnnnnncacccccccccc

SEQ ID NO: 11212 - DNA, 329 bp, Homo sapiens
tgcacaccatttatcaaccacaccaaaagcttgtgtgtttccgctctgctacagtgagtctcctacccacagaggaagaccacgaagtgtcccctggccacctcatcaaaaagacttaccactgtatttaactctcttatgtattgcctgcatgcttattatttgcttttcctccctggactctaagattccctttcttgtccatctttatatgctgacacagattcattattagaacaggacgcggtaggtgcttaatactttccaagtgaatagaagaaggggtgcttattaaataaattgtggaaatcagtacaaaaaaaaaaaaa

SEQ ID NO: 11213 - DNA, 297 bp, Homo sapiens
ttttcagggaacgccaaactgttttttatagtggctgcaccattacattcttaccagcaatgtatgagggttccaatttttccacatctgtttgattttgctttaaatcaaactttcaagactgctgacagtcgatccaggatgttaagatggaaagaaatagagatacagcaaccatataaagtgtttcagggctgctgacagtgatgtgagcctgttggatgaagaagagttaggataaaaacttgttaaataaaatattttaaacattatcatcatcaaccaaaaaaaaaaaaa

SEQ ID NO: 11214 - DNA, 1225 bp, Homo sapiens
  misc_feature (1)...(1225): n = A,T,C or G
ggcggttacccgacttcatgcgagccaaggaagggggccctgtgttaactccacagcaggangcttgcgcgtgaacaaccggaaatctccaagccttaaaaggccttaaagatttggacctaactatggccgcagtttgggagcacaagaggtgatgtcaacctgcaaaactgtggagatcatcatcaccactgggcatgtcgctccgtgtattgacaaaaataccgacggatagccctagctgcattacgtatgacatctgtacgcttgataactccagcacgcgacacttgaggggagagcggacttgcacccaaggaaaagtatccacgctgcttctagaaacatgagattctactgtcaactctacttctgcaatcgccatactcctgtcgcactgttatcactagatggtggttacctccaccaatctgattccaatacccatcacactccactcactctcctgatattagaagacctgaaactatcactgtttgcgcccacatatcgcgccaaattaaccatcctatcacctacaaaacaacacacctaggtaggacgaggacgacgacgaaggatactagtcctaatgtantattactgagatccaggctgcactcggcgcgattgctctgtcgattcgagagccagtccacacaaccactactcatccgagcacgtctattcacatcatccatcgtcttcggtcctccgcgtctcgtctcccgccgtcgcgttcgaaccacgcggcactcaacatcgtcctacatgccacagcaccattatcgccacctatattcgttgttcatccagtacggagactactagtgcgtcgtgcctactcgtaccgcacacatactgcctagagacctccgcgtgtctatctcctccagcacacngcatggactaccactaatccgtagaactttctacatcatactcgctctatccgttgtcttaacatgcccgaagcagcgtcgctccatcgatcacgcaccgtccacaccaatctctccatccatgtagcgtatcaccgtccccggtactactaagttgtcccaggagtgcagaccgcttcacgcctactttcgcagacacgaaccatatcctcttactactccatcttcatcccgacttatccatccgtcactctattcttatcttgagctaacagacagcattggctcctgagatagatgatgcgatacatcactccgcgccg

SEQ ID NO: 11215 - DNA, 1621 bp, Homo sapiens
  misc_feature (1)...(1621): n = A,T,C or G
atgtccatgctcagcatccnagactgcagcgcgcatacaatcacatattctatctncgagtcgtgttggatagtcacacagttcagactgcgcagcgtgtgctcgagnccgagtgtatcgcagtgcatagtctgactgcgatacttcgcgttcgactacactatacgtactcgtatagggcgaataaggtgatcgcgcaaggagcgagagcgatgngtntgagntaagngagtcatacgcacgagcgcaagcagctgtgtgttgtctnctagacacgcgtactcgcgcacgcggtagacgccgcgactacactgcagcacactgacgcgcgcactgatnctatgtcgattattgtagtatagatntacagcgtgcatcgctcaatcatcantactgatcagctcctgtcgcttctacgatactcgcgtccatcgacgcctatcgagactatagagatgtgcgtgctgagtcgccactgtagtacgcgcactctatacagatcccttcgcaatagcgtcagtatngtcactgagaccgccggcggcggcgccgttagtatgctgcgcgaacgacgaatatgcgttgagaataatagagcaatcgcgagtacatcatgatgcgtcaatgatacgtacagagtataatagtagtcgctgacagaggacaacgacaatgaaaggtcatacatacacgcgtacacgcgnctgtagagtattgcgtcntgaagctagatactctgcggtgctatacagtgtgcgtcctatntagcacagatagcttgtacgtcgatattcactccgctcgctccgatgtcctctatactgagcacgctacacgcgctgagctcactgcacagcntcacacgacatggatgacagtaatactcatacttatctctacaatagatacactcactaaactaccagctcaaccacagcgcgacataccacgtccatatctcactacttaacttctcggtatatatcgctgacatttctagctgtaagccgaccgcgcgactgctaccgtgtctgtcctttcctgcgccatctattgagtncacacctagacatgcgtcttcaatgcaatactatccaaagcatctataaatcatgtgtgcatgtgctctgcgcaccagcaccatcgttagagtcagaataggcgacactgtagatcgagagtcgccgtctctcattctgtgagatacctgtcgtctgacatcactcactgancacaccattctagctcaagctctcgtctgtcggctctgctnttgtgtctctcgccacacgctggtcgcccgtcagtgcccttattgtatactgcgctaccgcaccgactgtttgcgtatatattcancagccacttgcatactattgagctataatgtaatactaccagtagngccggtatagcagtatcactatactcttatctgcatacggtgcgatctcttcgtgncttgtatactatacagatctctcgcgtctctctangaggtgttgtcgtcgtggtgctggagagaagtctaagccgctgtntcacagcgtctcgctgtatctgatgataacgcagnacacttcatcatgattacgtgctacgacctgtttgtgagcgtatg

SEQ ID NO: 11216 - DNA, 1556 bp, Homo sapiens
  misc_feature (1)...(1556): n = A,T,C or G
atagtttgaataaatgatcatattattatgcgatatagctgccatgctttgtatgttagcacatatcacactcacacgtctactgtcgagtcttntcctaccatggatcaccgctcctcgacgccacaacgtcacatcacctaaatcccagtacatcgactttcgcggcgcggatatctaaacacatgtnttgcctcatcctantctacactcatacgatactagcgataccacgccactctanatgactacgcattcgtatcaagatctgtctgtgcntatcgttacnatatntactctgatcatgtagngntcacctgttcgcgagcgtagacactacgncagacattaacatcgactacttnacagtattcgagttcgctacattgtgaatctactacatatgtgcattancgtagacgtacgctncgtcgncacacactactgactctgcagagctntcgctgtgaatgtcgcagtntncgncccactcacagtcgtgctctctgactgtctcatcttctcancgctctatcttcgcgtagttcgacattcatccagtgtatntatatatctcacgcatgcacacgtatagctccacattntcgtctgctcagtgacgtcgctcaacatatgatngcatgtcgtgctgcgaatgactgnnaggtgcgcactcatgtgctggagcgatangcgatcctgtcctctcttgaccctcganactcgttacntgctccgactcctcacctcgtgctctctgtctctacatcgctcgctctctactaacccgctgcgttgcatntacanctgtcgagcgtatcgctctcggtagctcattcntgctctctcgtgtctatattctagctgagatggggtcatctaacatgaatactgttatgacgcagcattaacgtatcgtagaatctcctacatcttgagcaagcctccactcttctgcgtctccttattgtgcgccgtcatgtactctcagtatatttcacgctgttctcactcacactactatcgtctcacacaccatagcagcacgagtgcgtgtaattatactcatacataagtgactatacatcacatttctaagtgctgttggatgtcatttgtaggatattgtcaatcatagagttaatatctaactatatgtttatattatcctctaccgcccccgctgtctgttatccattgaccagtagctacgtttagttcatcgcgctccccgagtgtgctgtatattatactatacatatccatcgttcattatgccacatacaacatctcaagagtattctttcgtcttcgcccttttctctcctaaccgttcctcaatatctttgtttcccactaccccgtgagtgtgtccgagatatgctcttgtatacctctccctctcaccccccacgcttttgcattttttccacgcgctataaaaaaataaaaaaataatgtgtcctcgttggtctaacagcgcgtggtgctcgtctccctcagaagtctcccctcctccacttcaatagtataccactaaaatattttctatttct

SEQ ID NO: 11217 - DNA, 1356 bp, Homo sapiens
  misc_feature (1)...(1356): n = A,T,C or G
cgtcctcgacgttataggtacttagaagttatnatcatgtgtnagtcactcctcatcttcaatgtaacataatgcatcgacgtatcgagtcagtacacatcgtctgccatatactctccactagtagagtcgaatcatntatctaatcatcgtctttatacatattaagattctatacgaaggatctcgttacaagaggactctagatgaacgcaggccgactggtgtcttgtacgacgtccgtatgaagatatatgaataattctctgtctcggtccggtggcggctgcgtcgagagtgccactagtccacagaagggggaatttcgtgcgagcttatcaattctaatacaacagtacccatatcactnaatccacatttagttaatcgcctattctgatatcttacgcgttgtctagtgcgctgctctgtcttacctactangatatatagtactatatgccgtagaatcaacagagcgangaaantgactagttatattaatttgctctatcctcctctctagtaaagatctctaaatattttgaatgtttatctgtatactttgacatccctttctgtttctgagttgctaatatgcatatacagtagatggcacagcgtcgaagcagtagatatgaatctgaagtggtgggtgtacgaatatgaaagtgtagcggacgcggacttaagcctctgatatattctgattctttcgctccatatcngtgcgctcttattttcgtctcatcataatataaaatttatcttaaatggaggaattatctcaanatataattctgaactcacgtgatctcgtccctcattctccctcccttctcctctttccatacaacacactctctccctccctcccctcttacactcttcttctcatccctcctccccttccccctcttaccatacaactcttncctactcgctatattattatatattttgtctgatatgtgtgaccttcgcgacgtagacgcgcttcgcggcctctgttcgttgtcgagncgtctcgtgcgcgatacgaatctcaactagaacgagtgaattattggatcaatataatattatcacntcctcnnnncacatnctcatactaaatcactnacactatcatcacttcntacacaacntanncatatacttntannacaattatcactatcattntnnncactnacctattatttnnnnnnnatacctttaacntnnnnnnnnnnnnnnnnaantnnactnnnnncactnnnnannnnnnnnnnnnnnnnnnnntatatctactnnnnnncacataacaccttnnncatatnnnnncatctnttcaanaanntacttccttttcta

SEQ ID NO: 11218 - DNA, 298 bp, Homo sapiens
  misc_feature (1)...(298): n = A,T,C or G
ggggaacaaaggggcgggggaaggggcttaagatcatcgccccgggcgctcgaagangcacacacacagaagacacagcagcggccccccccacctgcaagggagggggagaccganctccagaggaggcccgaaaccagggagaggaccgaagccaanagagaccgggccgggccagacacagaacaaaggccaggaaccagggacagcaagagacgaaaaacgcaaaagaggaggcaaacgcagacgcgctctttttctaagcgggagaacggaaacacggcgaaaaaaaaaaaaa

SEQ ID NO: 11219 - DNA, 1660 bp, Homo sapiens
  misc_feature (1)...(1660): n = A,T,C or G
cttacctcactgtcgttcgancgctacagcttctgtcgtgngncgcgctctattgctgtgtactgcttggcgctatctctcatcgnantagctganngacgatcgtcgcgtacagcncacagtgaagcacgacgatagtgnngncgcgcgcatgatgtcacatgcatanatactagnanganctcacaacgctgncgtgngnagacatcgctcgatgtcgcattgatctcgtctctcgctcgatactcngtgatcggtcgtccacgtgagtgcgcgactgcagcgctctcgcctgatacgctcatctgncncntagctgtcanacgtcgcgcacgctgcgaagangtcacgaatgtctagtatgactactctctgtgtggntnatcggacgcttacagctctncaccatatctagtacctgtatgtctctcgcgcacgtgcngagtcgcgaggtggtgcgcgtgtgctgcgccgtgtggggcgctagctagctgactcatgagggcttcactgtngactgcatcgctgcggactgtatccgctacacgctccgcgagcgnacgcggtcgtgagagcgattctcgtcgtganactgcgtgtagtcgatcgcgcgcgagacgcatgtgagcggagcgacggagcaggctacagactcgaganagtcgcgcggtcgtcggacgcgcagacgtaaaggaggactctgggatctgtgcgggactgagggcgtctgcctggagtgcgcgcgggagtcgggaggtgtngttcacgtngattgcgaagtcacgcgcttgtgcctcgctcggntgctgtgcttcacttacgtcttactataccattcgacgcgcgagacgacacctctgancactatcatgacanctccgacacctcacacgaatctctcccagtagcgcantaacctactctccttcctctctactctctcgcgacttctgcgcaccgcgcgagactactggtgctccatcccgatctantccgcgcctccctctacagaagggggaagacctctcagggaacacgcgtagggagaggtacgacacatntanactatanatnacgccctgcctcgcctatacttacatcactacatagatgcgtcgtattattctatcactatttttccttcgtgcgtgtgtttctcctcttctctctttttgatttnnannncttntgatattttatctttaatatatctgtggcatatcgngagtatcactgcctcttcggtcctcgtatgatcttgaccaccaacccgaaccactgaggacgagggccgctatctgttagatgggtagaangcatatgaaccctactacccttctctccttcccctcnncacacttcctcatccatctcntctccttcncctctcactaccctactcntcctctactctccnncctcttctcctctctnnccnacctttcccctgtcccttnnnnccgctctnccctacncncatannnnncaatatcttcctcctctttnncnccnnncnntnnatncacttnncctttaaaacctctctnnnnnnnnnnnnnncnnnncnnnnnnnncnttcttctcctnnnncnnnnccnctctcatccctnnnccctccnnccncncctctcctttctcntccnntcctccttcttcttcc

SEQ ID NO: 11220 - DNA, 606 bp, Homo sapiens
  misc_feature (1)...(606): n = A,T,C or G
cgagcgtcacagatttaatggnatccacgaaanccttcgttagatgactnccccccannnanctgcnaacgcattaaaccaanngatgaatgttcaangatgctctccagnagtttttatgccacttcaaatagatacttgcaataaatcacctttcaacagaacactagcaaaaaacattctttatacattacatctacttttaggatgtccttcttttactaaatctcgttttagtcattatatgtttagtaccatttactgtttaggttttttctccccttcccaattatctaaccttagcacttattttttttttgtataatcgagagatatctnacaatagtgctctgtcatactacatttccatcttttcactcacgtatattctattcggttaagctttgtggcatctttaaaatctacactcttcatcccagacaantttttaaaaattcgcttacatatctcaaatgctatcttctcttttatagctttctggtgtttcttgcttaatataaaaatatacataaatagatggatggatagaggtagatggatgaatacacatttatgctgctgaagcacagaataaaaaaaaaaaaa

SEQ ID NO: 11221 - DNA, 1044 bp, Homo sapiens
  misc_feature (1)...(1044): n = A,T,C or G
gggaccctagacacggtccgctccgagcggagacggtgtagagagtataaagaatacatggcacacgaggatagatgaagtctcactgtacccngctcttgttgtttgcttatancacgccagttaaacgaggggcggagtgtgtgagcagatgaagagggggggggaagatgttaggagaagtaaaaatcccaacacgctaacaatggctataagaacatgaacagggaaacatcggatgagacatggctggcggcggaggtaagcgtgtgtgcggatgcgcggactaatgtacatatcggcattcgaaggcagcctatgaaaggcgcacaggattgtatatgattaagagacagcagagggtataatagggcgaaaacagtgcccgacgaagcctcacactagcgcataattacgatatgagaggggcgggtgagggtgaaataaggcaacatgttagacggtagacggtcaactgagagctaggcgctcaacggcgacgatagaaaaagtgggagcggggagtagcgcttaagagcgtggcattaacgggacgtcggcgtcccatataacgtaatgagggtaaagtcgtaggggaggggaaggacgtagaaaatgcactcgataagtatgtggagttgatgtgagtgagggttttcttgcgtgaacgacacatagggataatgccgggaccgaagatgtcgtatatggtagatagggtgagtcggaggtatgagaaagatctgacaaaggaaaatggtgagggtccgaatgggggcctaatcttgacgagtcgcgacgtgcgggagtgaagaagagggagcggggagtgagggacttataaagccccgcgcacatagaactagacagagatatagcaggcgtggcgctggtgaggaggagaaagattatggcaaagaattggatacacacgctggtgatagtgttcttcagcgcaaatcgaggcgccttcgtttgcgccggctaactctctcgccggccgcatatctgaaactagacaagccggggtgaggagcggaaggg

SEQ ID NO: 11222 - DNA, 1381 bp, Homo sapiens
  misc_feature (1)...(1381): n = A,T,C or G
ccctctatcgaggtttcctgtgcgtctcgcgcgtctgcgctctgcctcttcgtttccatctangcattctctccggtgtgctcgcggcgtcnggcctgctcggctcgtttgcgcgccgcgcgcgctcggctcggtgctccgacgcgnccgcctatccctacgttcactttagttacgtcggctctgttgctccgctgcgtcctgccgcggccgcgtgttcttttctgtgcgtgccgctcccgcggctctgttcgtcctcgcctctacggcccactgccttcncgtcgcggcggtcgtctggggcggctaccgctctccttnccgttggcccttcgtctcctgtcgctgttctctgtgctggggtgtgcgtgccgccttcgggtgtctgggtgtgcggcgcggccctgtggcgtgcctgccgctgccgtgcttcgcccgcgtcggcgggctgtcggttcatgtgttcgcgtgttctgttcgtcgcgttgttcgctcggtgcctcgtgtgccgtgctgcggtgcgtgtgtggggtgtgtggtctctgcgtccgttcctcttggggcggtgggctgccggtgcgtcttctgacctctcctttgcgtctgtccgcggcgactcgtngtctcgccgctgcgtgctcgctctgtgtctgttgctctgctctgactgtgcgtctctcagttgtctcctggctctgttgcgtgtgtctactccgcgtctgtcgttctctctgggtgcctctcttcgtttgtntctcctcgtgctgtcgcgtggtcgtcctcgtcccttcttccgcgctgtcgccgtgtctggcttcgtgcgtgtcgcgcgcggcgatgtcgcggttgtctgggttcgggcggcgacggccgcngtctcttcgtctctggtntcgcccgtctcggggcgcgcgcctcgggcgctctctgtgcttctccgcctgaggcctgtctgcttggtctcttcgttgggcgtcggcgcggtgccttctcgctacgcctggttgtcctcgtgctgctgtgttgttcggtttctgcttgtcctgtgtcgctcgttggtgcgcggttggcggcgctgctctggtggtgtccgcttgtgctgcgctgtgctctcggcgtgngtctgtggcggctcgtctctcctgctttcttcgccgcttcctcgtccgcccgcgccgttctttgggcgcgttnggcttctcgcttgtcctcctcgctcctcttccgctcctccgcgcgctgcgcgtgcgggcttcccgtctgcgtcctccacactccctgtgttcgcctgggtcngccccgcttgaaaaggtttctctccgtcttgcctcgctgtcgcgctgatctgtnggcgcgagatgggggtgtggttctgtgtggc

SEQ ID NO: 11223 - DNA, 1145 bp, Homo sapiens
  misc_feature (1)...(1145): n = A,T,C or G
catgcgcgtgttactatagcgccacgccactantaccaactactgcgactcatgctccgcgctgctaatncggtctctgcgccgtcatagacccacgcggtgactgctcgtggagggcgctcgtcccctgtcgcaccatatgcgcccgtcacacttagattatcacgtgttgcacgtcgtgactccactagagacacgcgcgcatcggcgcncgctatcacgantcgtgtgacgtctacgagctcgcttcgaaggaagtccttcttgagtatatctctataggtactgtgccgctaggagcgctactgtacagacctgttagctactctgtgtcggtgcgtgataacactgtctctgcataattcacacagtanatccgcctcctcgccccgttatacctatttcaatcaacaccgcacttgcgtcacggtcacggacgatggtgccgcgacctgtcttcctcgtctangtagtcctctcgtcctgcacacgccttcacgccgcgtacctacgcgcatcatctaccctaccgtgctactccgcatcccagtaccgccctataacaatatgctctttcatcgtgtatgctggcctcttatcttcgttgcgctcgttcccgctctcctctccagaccactgtcctccgccaatctcatctcccttgcggcctcttcccccgcctcaccaccacccacctcccgcgcggcgccggcccaccccgcgcccctcacactaacgacacggcgcaacccccagccacgcacccctaccacgcccgcccaggcagacttcatccaccggcgtgacgcccaccccccccctcnnccccctcgcaaccaccccatctccaacccgactaccctccccataacccttctccccattctcacccacctaaantctgcatcaactactcggctatcgaccccttagggcgtgtgtggccctggcctttcttaccttagcgttttcttcttttttccttgccgttcgtctgttctgccttttgcttccttcttcttttccttnnnnccgtgtctnntnncttntctttnnntntncttccnnnnnnnnnnctnnnnnnntattnnnnntnnnnnctttcttncttccccctctcccttccccttcnnnnnnctctttcc

SEQ ID NO: 11224 - DNA, 1084 bp, Homo sapiens
  misc_feature (1)...(1084): n = A,T,C or G
tcatcctcatgtacgttggacggtgcggctccttacgtgnggtatgcgtagtgtccgcagtgtgagggtgtggaatagagtgtgcgctctgggcgtggcgcggctggctgcgctggngcccggtcgccgcctacaacaccctgcgttgccgggcgctctgtcgttttgaagatatctgnaacaatacgtcggcgctatgtgtgtatccctgaggctgccgtggatgttggtgggncagggtagtcagataggagtctgcgctggaatgtagcgtacctcgggcggggggcctcggtnatttaacatcttatccgttcctcgccgttcgttaggagactaggggngggagagggtctggctgtgcgtgcgacctcgtgagtactttcgagggtggggccgagaggtcggtacatacaagttagaacaggagcgagggtgctagagtgacttgatagagaggttaaggccggacccatcgcccaactattccactacgtgggctttgattaactggccggcggcgggggctagagggagcgcgcgcagtgggggcgagaggagacagaagatacgcgagatagtagcctcgttgtgcttcgtgcccgccctctctttggtgggatcgtgagggttatatattatggactttcgtaagcgcgcgtgtccagctgggcgaaagccggggggagtcgtgccgcctcggctctttcctcccgtctgcggtgacacgctctgnatngggaaacgataagttatgaaccacgcaannacttctttnatntcccaccaccatccccaccnnnccacttctcccccctcctccgcgcgcgggacgcgcatcgcttttgcggtcggctccttaggaccagaaagaggattggagaggacataatgcttccctcctcatcttttgacacacttcttctctcttccctctctnctnncctgccttcnnnnccccatcntcctnntccctnnncccttactnnncctctactaacaatnnnccctanaatnaacatcaccnccctnaccaccttataactataaaacatcactctacctcaacacataaactaacccc

SEQ ID NO: 11225 - DNA, 331 bp, Homo sapiens
ttgtccagcatgcactttttggatactctttcaactcagaagtcaacataaagggtaaaagtgtttacttttatattatgaattatcaccccaataagtccattatttcatgactttttgttcatgttgatgttttacacacacaagattttaaccttcgtgagtgcgcagtaatattttttattgatcttttattttttgttgtttcccacgaggtcaaacataaaatatacctacagtcactgtgtgctgataaactgaatatttaaaaacagaaaaagttctcaatgctattaaattaaattgaacaatgctattaaaaaaaaaaaaa

SEQ ID NO: 11226 - DNA, 261 bp, Homo sapiens
cttcagtaacactcccttggaaaaagatcaagaagtgaactgcaataggaagacagagaagctagtctaacaggaaggcatcgtatgtctagcaaaaggaggaccggccctgtctctcgtctggaatctcaagtctatcattagtctatctcaactaactaactgtatttctttagaacctttccatgcctcagattgttttaatttttttaatggggataataaaatctgctacatttacttcgcagaaaaaaaaaaaaa

SEQ ID NO: 11227 - DNA, 482 bp, Homo sapiens
tgtagcgctgatgattgcacatggaggaaggtgcccttcataagcagaggagggtgaagctcactatcaccagaccctatgacgcatgccttgtggtcaggtggatgaatagtgcgaaaagagctggactgattgattgagggtagcacttcccttcattcaggaccccatgcaacaagctggctgggccctcgactgacatccatagtaagactctttcttcctgcactctgggcgctacttccactgcgcttggtcattcatccacttcatgcctacagaatgctgtactgtggccgacccacatatgataatgcattctgagtgtgaataatacatatataaatggtctcagtagcctaactgtgggagactctgagacgctaaactcctacgagagtgaatgatgattcctgactctctggactcttaagatgcggctgtttgctgctggaagtggtatcacctcgacttacgtctga

SEQ ID NO: 11228 - DNA, 1014 bp, Homo sapiens
  misc_feature (1)...(1014): n = A,T,C or G
agatccaaacgtaactataagggaagagacagcgagagtcaagaattgcttctaacgcaagtgaaggtgtgtaggtgtccggattgcgtgtatcaaaatagtaggtagtatggncgtggctagtgnagggaaaagagaaggaaagngagaggagtatantatagaggggtatctccaccgggaccgagataggaggagaaagtagggaaaaaacaagctattatagagggtaaaagagaagcaaaacgggggggtgcggaaaagaatagctaaataagaatgatgcgtgtgacgggggttggccatagaaggaagtcgtcgatgactgtaaggagttaaccatcctagccgtgataatataatcaagggaatttaaacgatagtcgggttggtagataggggcaaggagccgcgcgggctcgtcatgagatattgagaatataagaaaactaaagtagagagaagagggggcggcgtgaaggcggagtccgtgaaagtgggagggaaatcatgactactgtgtgcagaccgaccgggttgtaaaaaggggtgaagagcaaaaataggagaagaaagaataagtggaagataaatgagaaagtgatgtaagaattacataagaagagacttaacacacgagagaagaagactgcgaggtcaattttgtttccggcgtcgaatgattagaggactaataataattggtttgacgggccgctatgtgtacaagtgatctgtcgctatcgcaaaccatgctcgactatgatatgcgacgcggtgtagtaggaagntcggttcaatgatcaganaaaaggaaacactactcggtctagccctatacgttgattagtaacgtgcgtgagtagggagtaggagagtggatattaggacgagaatatatagaaaattaatagttggagagacacccaagggcgacagatgcggttgcagcgcttagacagacacccatgactgcctttgattagtgaacaattcatgtggcagacattaaaa

SEQ ID NO: 11229 - DNA, 1500 bp, Homo sapiens
  misc_feature (1)...(1500): n = A,T,C or G
cctcgcggctgctgctgtgcttttctcttctcctattgttctgntgtctgtccgcgcgcccgttcctccctctcgtgcccgtctgcgtgtcgcnttcgcgggtgtgttcngtctgtctgtctctgtgcgtctctgcgtgtctgtctgtgtttcgttctcgcgcgtccgcttcctctctcctgcntnttttgtngtcgttgctgtcgtctctctngctcctctcncgtcgccgttcgtctcgtgcgcttcgtcggtgtntccgccgcctgcgctccgttgtcgttgttcgtgcgtgcctgtcttcgcttcgtgtctgngctctngcgggctgcgcctgcgcgtctcgctgttcgttgtctttcctctggctgtcgcgctcgtcctcgccccgttcggtggtgtgctggcctgtttcgtgtctcgcgtctttcgtcgctcgtcttccgcgccgcgtcctggtcttccctccctctgtcgctcgcgcgtgttgcgcctctnggtctcttcgtctcctccgttcgcgcctccgtcgctgtgtcggtggccgttttctggtcttctccccctcgttntcgtcctcctgtcgtgcgtctctcttctccgttcgtctctccttctcttgcctcgtctctccgcgtcctcctcgctgccttggtnctccgggcccgtgtgtggtgttgccgtctctcctgcgtggcgccgccgggtcgcttctctnccctgcgtcgtctcgtgctgttctcnccgtctgcgcgcctgcgcncctccgcccngtcctttctctttggttcttggtgtgtgcgtgtgctgtgtgctgntctgcctttnccgcgctcgctgtcgcgcgctctcgctggctggctgccgccctctcggtgtgcctcgctccgtcccgcgggtcgtcgttctccttccctctccccggtcgttctcgcgtctcgcgttgtctcggtcctgtctgtctgcggcgtgcccgcgccgctccgcgccntccgtctttctttggagagctgctttccgctctgcgcctctctgcttgtcccgtcgttgtctcgctccggctctctctcttcttgcgctcccttctcccgttctgctgtcnctctcgcggctccttccnctcttctcttcttgcttgctctctgctcggtggctcttgctctctccttcgtcgtgcgtgctgtctgtgtcttctgcgtcgtgcgttgcgtccgtgctgcgcgtgccgcgtggcctggttgtcgtgtgccggtgtggtcggcggcggcgcgtcgctcgtgttttgtgtgcgtcgctcggtgctgcgcgtcgctccgtgtcgcgttgcctgcctcggtccgctggctgcgggtctgtntgctttcttctccctcctcccaaagcgcnctctgtgcgctcctgggttccntcctcaccgcacgggcttcttttccttcctcgcctctcgctctttcccttgtcgctggcctctctcccgtgttctgctccctcttctgcttc

SEQ ID NO: 11230 - DNA, 926 bp, Homo sapiens
  misc_feature (1)...(926): n = A,T,C or G
cggcggggtgtggcggcgtagggacagctagctgtgacgagcatagatgtggtgtggaggtggggagggaggtgaggggcacgagtggagagtggtgtactgtggtgagtggatatgtcgggaggggggtcggaaggtcctctgaanctcctcaagccgcgggacgggaaacgcgggagaggtggcgtaacaagaatagagtagcggggtnggctgggtgtaaccatgagcgatatctgtctgggagggtgagggtcattaggcgcataagatattgacgcttatagtctctnagtaattcattcatcgagttggtgggggtgcggcccatgacggcacacggccgtgctgcggcggatggttgtagggatgcgtaagcattatgaacggagggaagacacaataacagtccaattgactgggctcctgcggcctagtgcgtcgagcgggttgggcgcgacacacctggctgaacctagatcctgaaagggccggatgtgggggggagtggagggtaggggcgtggtggtctgtgnagggatgggtaacaatgaagaagtggactttcgaggaagcatcaaacggagaagagagggagattagccacttgtcctgtcgtntctatnnccttgtctcaatttctctccttcaaaatcacaacaataatccaccactccacatatctanaacctgaattcctctctggcgcggctctggcccggagttggcgtggtgatggagttggtcgcccagagggaggacatcaatatacctcttnttgnctggatttctgcatcacttttctcttgctgggttgagtgtctcagagtcaaggtccatttactcaactcttttggnncgcagcttcagaccttnnnnnnnnntnnncctnctnnnntcctctcctnntcctccntnnctttttc

SEQ ID NO: 11231 - DNA, 950 bp, Homo sapiens
  misc_feature (1)...(950): n = A,T,C or G
aagtgcaccatttgtgcgtcaagaagagggctcgtgggactactcgctaccctaagaaggccaacctatgttcatgggtccagcacatgacaatgggagtgggtagctgagctagcatggaggacaagatcgcaggagaagagagatcaagaaacttgggaggatcatctccacccagggctgatatcacctggtaggatcagtatgtccatttcagttgttaagatgttaaaattctttcatatcagttggttaaattttttctgcttaagacccatgagtgctcctccattgccttggctaccctggctcctgtccctggacccaggacctccctaagatctgacccagcaattaaagggtaataccatgcccagcaggaggccctccagaggactgacattacttctgattggtcactgcctgtgctttaactgaacattgcccctatttccatgaatattgaaatcaccaagaactgagactgacacagtgttggagagagagacaatgaacgcaggctaaaaccctcaaggagcaaagacccagagctctgaagaaggcagtgctattgtctgaggctaggagcttcagagctgggggatttcagagaaggagaacaaaggtctggaactcttagcggggaagaagcagacacctagcccacttctgagtccagtggtaggagggtgtangagagaaagcaaccatcagtgtgagggctacagaagagantagattctgggaagagaaccacatttcaagaaggcacaggaactttcagagagagatataaggtgagagcattgcagaccccaccctactgtgtatatcctcatattctgaaaggagtcaaagataattacctgcctcatcctgatttataaggaattacccccaggtgataaagataaaaaaggaaggtttgataatatgtgattcacaagaaa

SEQ ID NO: 11232 - DNA, 1241 bp, Homo sapiens
  misc_feature (1)...(1241): n = A,T,C or G
ataaggtatctatcggatgttatagaggttatctactnggtcaacgtaaggtgtactataatataatatgaagaattgcgagacgtatgttacgacacagacacgggtgaacagacagaggtcgtggatggangntatgatggcgggtgtgcggtgtggaggtgtattaaagagaccgaggattnggaagtgagaggaggagattgaaataggcgctatccgtactccgctgagatcgtgtatgtgatccggagctgtagagcagngagagaggatgtcacctagcgacgnaactagactgtagattaaccaagtgtatgcttatatacttctgataatgtgggcgagncctcataagctgccataagagatgctatatgtacgtcgagagatgagaaagcgcatgtgatgcacgttgcctatagtgtgtagtgttaatttagagaagcctgaacaagaatctaactaagatcagcgcagagacgtacagtatcgtgcttactgtgactctgtccacttctgacgtcgctcgtgaggtgcgacagtcaaggtcgagctggtcgtcgtcatgagccagacatatatgatatgtataatgtggcgtacgtagnggcggcataatgacatacagatatcgctctagtgcgaagatgggagcgtatatggaactgtaataggatgtgtgcatcatnacgctgtgaggtgcgttagtgatgagaattagagggcgcgctgcattatttgtacttctgtggaacgataggtggttgatgtcgaagaactgatgaggcagagggggtaaggggagaggaacgaggtgggatacagcggttgtatcgtaagggatcgaagttatttaaaagtttcttgagtatggcacacgtggcgttgaacagtctgctaaacaaggtttgcgtgcatgtgtgttggcggtggagattgtataagtgagatagatgaatgatgttggaagggtgatggccttgcgttggtttgcgctgtacgatctagataaaacaggtaagccgttgcacttgtaccacgcagacaaacaggctatagccctctagaacctgttttgggaggtggaagagggcgaggcggcagtggtcagggacatttgtcggaataaaatgatatagcgatggtcttccgaggtcctgaagcgttgggttcgtttcgggactactaaacgaccagacatgattatactttggacaattcggggtgaacgtaggaag

SEQ ID NO: 11233 - DNA, 818 bp, Homo sapiens
gacatcccaccaccgtctattaatctgatctcaatataatctaaagacaatagatcgactcgctcgagtaccattctacatatagcgcatcataataacaccgcgttcatcttacaaaatatccaataattccaaaagtgatagacaatagaaaagacttataacatatcataacacatagcgcaatgttaaaaatttaaatacaaaaaccacgcaaacaagcataacagtcactgcacaaaaaataaaaataaaatcagagagaaacacagcaatatattattagtgaagaaaagggaccaaatataaaattaagatataaagtaacaaaataatatctaatattaatacacaaaactaacgaacaagaaatatataaaaagaaaaaaggacaagagtcataagtccatagtaaaaacgcacggcaccaagagtcgaacccaaaagataaaacagagaaagagcacaacaaagcatggagcccagaaacgttgtaaaagtaacccagtgtacatataaatgttcgaatccccgaaataccaacaaaaaagagacgccaccaacaccggatttgaggcacacctcacaaaaatgaacccacataggataagaaaaggtagtttcctattacttccccaacacgaaatcctccccccccccctcttcaaaccaataaaacagtcccgcaaaatttggccccatactctttaaaagtttttaaaatcccaaacctcaaactccacggagtggcccatttggggtttcctcccttctcctcaaacaaatgaataacaattaacctttttccccccaacccc

SEQ ID NO: 11234 - DNA, 266 bp, Homo sapiens
acaaaggagatctgtagacagaaggcatattatgcagtttcgcagagatatcaacaacgttggttgccaagagacaggttttctcaagctcccaaatgaaatggagtcttgggcaccaaaaattgtcacaacacattttaagaaaagcgcacataattctgacacacgaatgaaagtttgccaatgaatcaaacaggactacatgaaagtaaatttgatattgttgcacattaattacaacattttaaaaattaaaaaaaaaaaaa

SEQ ID NO: 11235 - DNA, 300 bp, Homo sapiens
  misc_feature (1)...(300): n = A,T,C or G
gttccccgctcttcagaaaaacgaaaagcacctctaggacactccatttttnatctgaaaacttggaaacagaatcatttttagaagctgcacaagatttcattgtatgtatacaccatgatttatggatctacagctccatttttacacatttctgtaacacattttgtactatactaaaaacgctgtactaaaaatacttttgacattttgaattatttcctacaaaatattcataattaaattttatgttaatgcttttatttttaaaaaattttttaaaaaacaaaaaaaaaaaaa

SEQ ID NO: 11236 - DNA, 661 bp, Homo sapiens
  misc_feature (1)...(661): n = A,T,C or G
actcganagataangcgggggccttgaagagntancgagcccaacggcnaggaaagaaaaaagcccttaggagaccaggaaaccggtgttcaaggacacagaacgagcacgccagagccctacagggccactgagcctggacgcaaaaccacaccgacaaaccatctatccccaaccatgaatacgaggccacaagagaaagcggacataagaagaccaaacaccccttttcctaggaggggaggcaaacaccacggagaaaccgaagaccgcgaccacacgacaaaacagggaggggaaaacgcccgaattcgaaaggccgagcaccgaacaaaagcccaacgaaggcgacanaacccaaaagcgacagaagaaagggccaaaccggcccgaccccacgccagccgagacgccagaggaaggcccacgaggaacaaagcgccaacgcaccaaaacacaaagcccaaacggacacagacagcaaagccgcgcaccacgcacacagacaggcagccccgaagcgaggccaaaagcaacgacgcaaaggccaaaaaccccgccgagccccggacgccaaacgggccgcacaccaccaccaccccaaggcagcccaccaacagaaacccaacaacacacgccgccaaccagaaaaaaaaaaaaa

SEQ ID NO: 11237 - DNA, 217 bp, Homo sapiens
aaaggcggaaaaagttgtgggagcatgtttatgtgaggtgtttaaaagaggacggaagtatcaattacgtcggtctgggtataggcacaattatcggcgtggagtggaatggcgcataaaaatgtttagcacaagaccgaaggggaaatgatcgacgggtcgtatatccaagtgattgttgaggtcaataaaaggcctccattgagagccggttttg

SEQ ID NO: 11238 - DNA, 1132 bp, Homo sapiens
  misc_feature (1)...(1132): n = A,T,C or G
accattttgtcaaagtctgagccgtgacngcagattgtagcagactattctanttatctctacctctacaccaccaactacttgttccttggtgcgctcgcgtggctctaagctgctacactaacactgagtactccctgtcgtctgcttactctttatctgtagtatgcttactgtncattaagttgtgacctgtcagtacatgggctgtgtatccgactcacatatgtatataccgtgtcaacctcaccacgtgatccttactctaattaataacgttcgtacactaccgtcatttctattacgttatattatgcgtcctcctccttccctccgtcgtgtcgcttttcgtcacctaacctctcatgctcccgcacccgcggctgtgcactcgtcgtatctaccctattcgggttatcgtcttttccttagacattagcacgatctaaccatctccgacttnttcgcccctcgtcaccgccaacgcggccacacctgaaagagcaggtgtactgtgttatatagctgctcttatttgtcgttcggtctttgccgtccctttcttgtcgtgacggttgtggccgggttgtctggctcataacgccggctctcgccgtgagcgcaccgccctattgccgttgcacacggtagccgcacccttcccttcaactacacagtcccactgcatcaaccatactaacctcccgcccctcgtcttactcccgggttttctccttccctctttgcgcgttcttctcttttatatcctctcctacactcactctacctatgtttctctttatactccttctatcctttcccttctatctctctaatnatcattnnncctatgctcatcatatacctcttgaatagggcccttgctctcgcgcttcgtaagtatcttcgctcttggcctccatccggttaaaggacatgggagggaaatgatttggtgntctccatttgtngctaggtgnttctctggcaccgtntgcccttnnnnccttgatgttgtnnngtattctctttngggngctgtgttnnnnnnnnnnnatnnnnnncatnnnnnnnnnnnnnnnnnctcctcttccttcctctcttncttnntctcctcttaacccctccttcc

SEQ ID NO: 11239 - DNA, 279 bp, Homo sapiens
  misc_feature (1)...(279): n = A,T,C or G
cttccttagttcactccgggcaccatgcctcngaggtgcaaaccaagaagaagcgaagacagcacagagtgaatgactgtaggacgcacccccagcggttggttcccaggcgagaagctggtggggttctgacttatatcccgattcacacccttttctcctgccctcagggcggaccttctcctgctgtcgtacattcatccccttcagccctttcgtattctctgctgaagccgcctccataaaatgaatacattagaaacgttaaaaaaaaaaaaa

SEQ ID NO: 11240 - DNA, 1030 bp, Homo sapiens
  misc_feature (1)...(1030): n = A,T,C or G
aggcgttagaaataggaaggcccataacacccagcgtaggatatcattcaacgcgacgttcatcctttatgacacggtcatctcctcatattacattactttggtggcgggtataatcccggaccagccgggtcacacgacctccacgcgctttgcgataagggaatctggctggttgactcgtggtgggctggggcccacagcagaccaccaaactcacccgttcgcgcgatttgtgcagcgtgattgcgtcgtctttctgaatcgggctggatatcctataattgaactctacatactcttatcctcctcctctcacctatgctccgctcgtcgcgctcaggggtctagtatacagattcttgatagcccaaacgagcacctagaaacgcgcgacaaagacaccatcgactttcacccactgcgggcgcacgcacgtcgcaagagtcacaatggggattgcgtccgttggcacctcgctggtactgaggtacacatggctcgtacctgaccctcgggcctggtttctccatcttcaccgtttcctgccacgcgcgtcctcgcccgcggtctcgtccctcctgtgccataaggcggaattatagccacaaatatgcccttaaaatngacatcgcttgcataaacttagctgggccacctgcactcgcgcttgccacatttatcttaatccacactcacaaaaacataaaagatcacgatacctcctaaataccaaattaacttccacacacaaatccaaacaccgcaaaaatttactttatgattggaattgtataatatctgtctacggcgcccggacgcgactcccaggaaatacaatgggtagatttgttaggcagaggnngcccggctccgncgngtnngcggctgtncgngngngctcctgggccctnctttnnngccttngttnnnnnnnntgnaggggnnnnnnnnnnnagncnnnnaaagnnnnnnnnnnnnnnnctcnnnnnatnntcncttttactnnnntctttnnnntcttnnttcc

SEQ ID NO: 11241 - DNA, 1037 bp, Homo sapiens
  misc_feature (1)...(1037): n = A,T,C or G
cacccccgcaagagcgaccgcggaggagcggggcctcgacagggacgagtaaaatcacctttcatgaagaagcccgtctcatggggaaaacgcactatgtgaactcccaacactgctnaagggcacgcgggtctagataaacaaataanctcttcacatgggcaggtgtccccttcaggatcctgggatgggaccatgtacctctagcaatataaaactgggactgggattaccagcaggtgcccttctgaaaaccactggaatggctctggctcctaggggggagaattaggtagtaaagggccctggaatgaggatgcttacctttcaggactagacttggggtcattctcacctgagtggctgaggcacctaggaaccatgacccaggggaccattatctcaagagcttctgtcgggcctttgcaggagataaaggcaggctattctctagcgactccaatgagaataagaagcctctatacctttattaaaagaaaacctgtaccaactggctgctgggttgaagggaaaggggagggcgcaagggaagagttcgagggcgccagtggaaggaggacagcgaggggctggatgcgcggagatacgtgcccgacgccaccacccctcgccgttcgaactgggacacctcaagacacgtgtggttntgctgtagggaggggcggggcggggaaaccgtcgaaaataggacctagcgcgcgcgcagcgcctaaaacggggccaanctgcaggtgggagacgaggaacacttttctcccccgcgtgggacggtagcgcgggttcggggagcgccgggagagaaacgaccgcgagacgagctgtgtgtgggggtgtgggccagacacggacaccgacgaacaanacctctcgctggttaagggagagatccaccgcggcggnagcgcgccccaccccagacgaaacagagcggtcgcagcgccgcccccacgccgcgcttaccgcgatgatctaacgcgctgagtggcgcggcgcgggtcggcnccacacctcggacg

SEQ ID NO: 11242 - DNA, 771 bp, Homo sapiens
gcgtgaactagaccataagttttgcaaaaagggtgcgaaccattggttttcaagcgcagtggcgaaatgttttcaagatcggcaacaattatcgatccgttcaagtcagtaattcttgttaaccagacggaaaatggaatctactttacacattcagcagtaggaattcctttccaaaagttttttcaagcaaatgtcttattcccaatttcaaaaattccataatcaattttgcgacccaatttacataaattgtttaagctttgggaattcatgttactctgcaattcatatcaaacctgtgaaaagttttccagcatgaaaaagaaaacaaaatttggctgtcttaaattttattaagaaagtaataaaatatttcctttcaattgagccattcatttaagatagtacaagcatgtagtttaaaaatcaactagtaagataaagaccaaagtaccacttttcttttttgaaattgtactggattaacattcatctggaataggcttagaaataatctagtctagtagttgtcttctttggatcagggacccctttgagaatttaataggagctatggatcccttccccaggaaatctatgtttgtgtaatttcaagggattcatggaactaggagctctataaaatctatatttaaaaatctatagtccaaatgaaagcattccctttttaaatgaaaacttcgtggctcagaaaatggaaagaatccaatgtcaattaaacagttaaaaggaaaaaaaaaaaaaaaa

SEQ ID NO: 11243 - DNA, 1126 bp, Homo sapiens
  misc_feature (1)...(1126): n = A,T,C or G
gtgagggaacgtgcgaaatatgactaactgatatacatgtatatgtcactcatgaataatacggtgctgtaangttacaagtagtgtagcatagactatgagtatatatcaactgacgtacaataaggagaaaggagtgagaggatagcagtagaagcaagtaggatagagaaggacgcgcagagagtacgagagagtcactaagacgtttcaccatagcgcacacnacctctacagacaatatacagtagtacactcagtgacggcggccggtgtgcgctggagcagcgcacagcatgcgacgcgcgatgaaacttaactatacanacagcgatgcactgaccgtgtattactttacacacaatgagaaatcgttctacacaaccagacgagagagggccggggagtatagtataatcataaggcaagacacaagacctcagcaacgnaatataacaagatagaaatagccatagatattatccgcacagctcgcgacgcgcgccgcaatagtgccacccaatagatgattgtcatgcagcgcggtaaacgcgaccggagaaagatgtgggcgtgcgagggtggggtgtgggtggggggagaggcgaggagcatgtggggggggggggcggtcgatgtgggggcagtgacgtgctgtcaggcggaagaagagatgacgacagactaactaattgttacttctagttacgcagatatatctggatcagtaagaggngtgtatagagaaggtgcgtaacataaataaaaatntantcatgtgataataataaaagttatgtggaggtataataataatatcactaaaaatgaatattatacaataaataatgnaaatgtgagatctaatataatttaaggtatgatgcagcgcaagggtacgcgcgagacacgtgcaccagctgctacgcctccactgtttcgacatgattaggattggggagtggattgggnntgggagtangaagtcaggtggtggtctggggggactttcgttgggngagtgntggttnnngnnntaagaagnntnnnnnnnnntannnnttnnaaagttnnnnnttnnannntattnntctgnnnnttgttctttaaatnncccctttntttt

SEQ ID NO: 11244 - DNA, 1613 bp, Homo sapiens
  misc_feature (1)...(1613): n = A,T,C or G
cgagtcgtgagagtagcanactatgcgcggtcggcgtgcggagtcgagtggcgagtggccgatgacgcgcggtgcacggagcgacntcgtgagtgtgaatctatgcgtgtctctgcgatgaagctcatgtgcgaatgcgatggcgtaagacacgcgatgtcgtngcggcgcaggacgcgtgngnggaagagagagagaaacggaattcagagaagngggtagcgagacaggagtgtgngacgtggatgcgatcgcttctctcatctagtgcgcagagctgagancgaggagntggagaggagctgagtagggtagcgaatatggagcgggagtagagcgtgaagtggggcgtgtgtgctgagcatgcgacgcgagnggangtgagtgtcacatagatgtgaacagtgtngcgcgtntaattgattcacnatanaaaagactntatactatcacntctcgacangtgaccactngtntacactgtcacnntcnntnacgactnantgcagatcgtangtncanancgtgtacactggantgatngacgngatgcgtcacatagagaatcgacatatatgactgaancatagatgacacagnaagacngagtactactaacaattgacgtggtcntacatcacancgttcgancatgtgtnanataacgcgaggtacatcactcgttgagtctgcgtacancnacngcattcctatcacacgtcatgcacgagttgccacgagtgtgcatacatncgagactaatngacatcgcacatattaacactgtgagcagcagagcagagagtgtgtgtgatgtggactctgcaggctgcgtgcgcgcgacagntggtntgctgtgagggatagcgcgtgcacgggagngcgagtgacgacggatcatgacgttatgcgctagcaggcgntnangactgtctgcaggatacggacgtaantcgagtcctttgatgatacatgatatacntnaatnnngtgtngtnntgaggacgtggtgatgtgttnntgantgtctcaccataggaagcgtatagtagatcggtaggatntggagatangantgtaggatntgtattgagcgacttgtgttgatagtgtatntntatctctnnnttnnatnctctgtctgtnttttatattnactataatttaattcgttctttttgctgatctncantactcatattattannnaacatctactctanatntanattatcattgacaataatatngtatntgtgttcnannatcttcatgtgtcttatatatatagtatcgtgcgnctgggactatcgtgcattctgctgtacgctgtgatgtctgcgtgcggctgtgtggggtcagcggctacgtacgcgcgctgtgccactgctgtgcggaccagcggcggtctggtgcgcgcgttgcgcgcngttccgggtgctcgcgtatganaatcgtccntcngnntcgttcgatnttcgctagngccagtctagatcgtcganagaatggtncncgagctaggttcgctatggagtngctgcgagcgtcgacaggagcnanagtacaaaagtcncgcgcttnncncgagcagtgctgcnagancncaaggg

SEQ ID NO: 11245 - DNA, 383 bp, Homo sapiens
cctcaggctaccaggaaagctgatggggtctacatgcacttttcctatatcccccactgacaagtacagtgaaggccgaatgctcagtgaacagtaactctctgccctaaatccagaatgaaatctcacctcatgtgatagtagtcatgaaacccaaagacacaatgcggagaggagttcacgagaatgcctggtatgaggagagcaccccaaatcactctttatgagctcatctcaaatctcgggctccacttatcccacgagccattgaagataatgatgaagagatcactcttaaagtgctctttttttcttttcagattttaatagtaaagcagaactttaaaaaaaaataaagctgataaaaattaaaaaaaaaaaaa

SEQ ID NO: 11246 - DNA, 163 bp, Homo sapiens
agtttaagggaggtaatagtaatttgttttttctcaaggcaaacactgcaggaagtgcttttggaaagaaacctctgaaaatctttttcttaatatggaactggggaaactaccccaagatttgcaacaatctgaagcattttactcaagaaaaaaaaaaaaa

SEQ ID NO: 11247 - DNA, 325 bp, Homo sapiens
  misc_feature (1)...(325): n = A,T,C or G
agtcctatatcttcataacgaaaaacaaaaaaaaagaaccttatagggtnacaagggtagcagngcctcaaatgacagatcatcaatcgcaatatctccagtgaagccatctcccttagaagcctccaccaatatctaaaaaaataaaataaaaaataaaaataagaaatgtgtttatgtggtaaaggaaattaagttatggaatggatgaagaggaatttaaaatgtacccaaatatgaccttctgtgccattaaaaaactcctttgcagcaatattaaaaaaaaaaaatggcctcattggcctcagcggaggagctctttttt

SEQ ID NO: 11248 - DNA, 197 bp, Homo sapiens
  misc_feature (1)...(197): n = A,T,C or G
agaagcagccacaancaaaacacacaaaacgnagttggagacaactgccaccngaagtttcaggggcaaacacgctgcctaccatgaatataaactacccgaagtctacaaggagcagaagccagcaccatatatcactggacagcctgcagaatcatgacccagtaaaacctcttctctttataaaaaaaaaaaaa

SEQ ID NO: 11249 - DNA, 1357 bp, Homo sapiens
  misc_feature (1)...(1357): n = A,T,C or G
ttatcttatcgtatatttgatcctcgtatctaagtcgatatgtgagagcgctatnaattgttantgggcgtgtgaggtgccacggtgaggncttgaagtagttgttctgcgatagcgtattacgcgaacgtacgaatgtactcatagcgtcacgttcattctntacattgtgtgcgtagtgatgcgtctgcgtggtgaggagtcggtcgacgactgtctactcgcttagtacgatcatgtcanctagctcagtgtgatggagctaggtcacgcatgatgcggagtggcgaggcagtgcgtcgtctgctacgttacgagcagatgcgagcgactcgcgaagcgcgcagaggagaagtgacctaatctacncactctactcttcacgcgcttattctnacnctcttacaatcttaatntatatctgttttgtcgtcatgttatagcgtgtgtggctgcgtntatcagcgcgtcatcgccatcccttatcgttctcgtgcacgttgtaccctcacgtatgtgacacanagatagcagcgctaacaaccaaggtgattacactttatcaccgtgacntcntcgcttgntactcttgtgtaacgatctctctgtgngcgtcacancgacgtcgtgcacatgtgcatctggatgtgtgtgcgtcgggtggtatgtggtgatggttggggncggtgagagtgggagcgctgtatgtgagcggggtgggcgtgagagtgggcagtcggcgaggtggatagcggatgcggatgtaatgtgtngttatggttattttaatgtatattacatatgnacagtagatctatctagtntcatcaactcgttccttgtctctcggtgagtnattgagtgtgagactatgtgtnctggtggcgcgtgacgtacatgttatataantantatctgtgtagtatatataaattatatgtgtcttatgtgttcacattatttataatattttataatttttattatactattcctatcngnnactccctatttttcattggctctgggagctacaggtacacagcgggagtgatatgtattctaggtatatgttggagtgagtgaaagcatactaaggagggatgacggtgtcgatcatgccattgctntgtatatgactggtcactcgattcttanttttctatctnaatcttnntttttgtcaatcgtctagagntcatatcgtactgtttnnggacgatgacatactcttctntggnngtatggtnnannnnnnnnnnnnnnnnantnnnntnnttatannannnngttannnnnnntcatttacattctttncnctcattctcctttattnnnnnnttttttttannntttt

SEQ ID NO: 11250 - DNA, 219 bp, Homo sapiens
ttagggatcggaagcacggagatgaccgtggtccagcgccctctgaagtcattggcgaccgcgatggaagtagttgggggtcgacagtaaagttggagactgaaattatttgagctcttaaaatgggataataaggtaactttcctcctcctggtatgagctcatttaattataaagatcttaataaattcagcctgattaactccaaaaaaaaaaaaa

SEQ ID NO: 11251 - DNA, 248 bp, Homo sapiens
  misc_feature (1)...(248): n = A,T,C or G
gcctagaggtactgggtgcagncctaaatgacagaactcaatcgcaatatctccagtgaagccatctccctttgaagcctccaccaatatctaaaaaaataaaataaaaaataaaaataagaaatgtgtttatgtggtaaaggaaattaagttatggaatggatgaagaggaatttaaaatgtacccaaatataaccttctgtgccattaaaaaactcctttgcagtatgttttcaaaaaaaaaaaaa

SEQ ID NO: 11252 - DNA, 1240 bp, Homo sapiens
  misc_feature (1)...(1240): n = A,T,C or G
caagtactaatacgagntgtcgagtgcagaggactactatcatggcgcctcgactcactcagcgtcttagactcaacacagtgcagacgtagcgctaccactgatcactgcatcagtcgtgacgagtactaataacgtcanacctctcacaacgtgatagtgtgacgtagnaaatgcgccatgacgcataaggaagttagncacaacgagagacaacatcactattattacataggtgatagttagcgtgcgaagtagagctcgcggacgcaatgtacttaaagagatctccgacataagtattgcanatggacactatagtagacaacgtgatgctagacctgtactgcgccctctaatcggcgcgcctattgcagatatattaactcgtattcgtttctagacaatgcgtagcgagtacacgtgatgtttcgatctactgacgataacagcgtgctaggtaaggaggtgaaactattcgataagagaagcaacgtccatcagtcggcgtcatgaactcgttcctactccctacgttatatcgttacgattacgctgttgcgcgtggatcaccctcangatacatcgcaatcgacgtgggaaggcagtagtgacgctaatagagaagaatagactatgacctatgccgttcntggtcgctntttataggatacttcactcttgtaatggccacaaattgcgcctacacaaatgaacagccagtagaaacagtaataaggcaagatccaagctcatcatcaagagatatatataagcggataaaagaacggtacaagaacgtaggccccatctctgagccgtcatgttgacttctctagacacaaattgtgacatattagaagttgttgtagccattcgggagataaacatgcgagtagaggatgaaagctgaaaagcaccagaaatgtgaacaggagtgctcttggtactaaacacggcaagtatgacagtcggccacatagtatgtgtcactgtgctacgggactcgagagcggggggcgctgcaaggtaccgatttctacacgaagataacggctactttgccatctatcacttaccaggaataatagataaattactcgatcacgcaacaataaaaaataaaaaaacaaatggtcctgcgttggcacaacatcgtgtgttagatgttacttggccgaactcctcctactgcaccaccgtttcttccaattattatgaaagttctggacgtgctgga

SEQ ID NO: 11253 - DNA, 924 bp, Homo sapiens
gatacgttcgtcgcaggatggcacgacacgcgcggctccggaactccacaatgcctcatttgccagcagaccctctaaactcacaaaaggagctccggtcctgctgagcaggagaacagcagggtttgggaaagctgctgattgaaatgcaagccttctcctgagaagatagaatatctagaatcaagaaagaggcatttggcttttccgggtgcacccaccccagcttcacttacaaaggatgaagttaaccatacgaagttgggcagcaaccagagtagcaactggatctgatctcaaaggacacgccagtgaaagagcataaaaaaaaaaaatggcctccctggcctcagcgagggagctctgcggtcgcttcgctttagcgacggcgtaacgcatgatcctcgatagactgcttttgtggccttgtctctcaggcacatcacacacccaccctcctctctgagcggctccgtagcgcccacccacgtctctctcgaatcgagttgtgaggaaatcacgagagcatccaccgctctcctccctctccacccttttgccagtccctctactccccgatcagtgcccactccccgttggcgttcattacctttatcgcggcccccccacccgcccctacgactgattgtactaccgttcgcattgtccagcctgtccgacgcacggcgtatgtctgctggtgaaatgtgtgctgttcattcctccctgagtttgtttatctatcttcgccaccctcaccccggcctcctctactttcccaaggcgccgtcgcttagtgttgtcacaactacctacggcgcgcctgtgcggtcaggtacgggtagttatcattgtttatatggacagtcccggcggatcgttccgccatgttgagtgcgaaaatactaagtgaaggcagttggg

SEQ ID NO: 11254 - DNA, 1480 bp, Homo sapiens
  misc_feature (1)...(1480): n = A,T,C or G
gggagatgtagatgagaggcggttatcgctgcaaacaccgcggtgtcggtgngtaagtggatagtaagcgagagtcatatagtagaaggagtgatcatacataagacgtgtcacactgtcgncagtgacgcagagagaagatgngangagaggtgtaagagagacgacggagcgatcgagtgtctggcgcgacgcaatagctcgagcatagaacaggcgcacgcgacacctactgaccagtttacatcacgcgagatgcgacgngctgnngngggtgtggagcgcgacagtatgacgcatatactgtatgagacagcacacgatgananatagtnttgtgagtntacagtatagagagagtacangtanagaacggatataactgacaacacgacgcantcgcctagctancgcgagcgatagatggtcgagcgntngagacagagagcgatcncnggagagatgcgattgctatancncgcgcactatgagcagagcgagtgacgtatagaggcagatgaagagagcgacacgacaggagacngnagatgatggtatatatagatgaatgtcgnactagagacacgtagtgannatgantagacgttgtcatagtgaacgaggatgtgctgtggagagatacgagaatgatccgcgcacagaatcgatagcgatgtagaagtgtgtaggtatgaaggatagcntggcgaacattatagacggatacaataaaggtgcatatagaaggagaggaggaagagagaaacggagtacacaagacgtacagtgagaggcntaagataangtgaacgacatgaatatagtaagtaaacaatcgcttcagaanagaagacctacaagagagccgctcgcagacataaggcgtcagggctgcagcgacacggaaatgcaaatgacacagcacagagtacnacgaatacatacttgtagagaggctgatcagacaattatatgcgtggtgagaggtacatgtgcgtagcgtnggcgcgggcttaaattcgggtacgtgatggtgatgaaagaggagtgtagtcacgtgctcgaagagctcgcatcggaccgatcatatgagagggtaaggcgctggatttgtgattcggtggtgctggaggagtgtcgagggcggctcggtcgttctcgcgcgaggacgaactacactatcgtcattccgtacacgtagtggtgagcaggaccttacatatacaagacatattgtctagcaggcgcgcagggtgagggagaacgccgcgcaatagaggggaaaggcataatgggagctcggggcgggggctggggtccaggcgcggcaaaccggaaagtaactaggaagagaaaggaaaaaaataactgataggtcctcgttggcaaacagcgctgcgaatgttacgcagccgaggtttttgcctgctctggcgtgtcgtagtaccggggtgagcggcagggcggccgtgatgagtgg

SEQ ID NO: 11255 - DNA, 837 bp, Homo sapiens
agccgtttcagataattcgcgtcctacaccgcgagggcgtgtgatcacggatccgcgcagatcgccgtcgagtgcgtagagcgacgccacgcgatcaacagcttgacaagtgactaagatctccatagaaggattactaccattagacgggtcctctgtcccgtgtcgccgtcaccattatcgcctgtatggcagatggcactactaagtgttccatattaagaggggatcctattcactttcaccttagctgatcactcattcttacgctgtgtgtgatcacgtgatgtagtccgcataattttccgcatatatcgtgccataccaacggggtataatggtggagaacgtcgacccggattacataccgcaatagttacagtggataatatccagagactatgtggacttggggtaaatcggtcatcactactaaggcacgcggtcaccgggtgaaataacactgctatagcgctcaaggggcagaatggcgggttcttcgaccgcccgcgggccatccagtcgtgattctggacactagggtgcagtggcgcccaaatgaaatccagccaccgcgcatcgcagttgccatgccaattgcgacgaacggactccctccccttcctcttttttagagggagttctgtgggtggcgcgcacccccctcacaattcagagaacttctgtctcccgttaatgttatagaaacaagttttatggggtctcacatcttttcgagcatggattacttttatgattatttctggtcacaaatcctaagaggtcatgatttgtggttgagggaaagtaaaaataaaaatccctccccccccccat

SEQ ID NO: 11256 - DNA, 1747 bp, Homo sapiens
  misc_feature (1)...(1747): n = A,T,C or G
acgtgcgacatatgagtgatcgcagacgaccacagcacacgcgcagcgcgccacacatagcangtcagcgcattctcactctctgangcgtgcgcggagtgcgacgcagagacgcagggangatcgacgtnctacaatcatgcacatcanccacanagatgatgaggggtntgaatgagattgnttagacgctctcgcatncncacgctacgtgngnnctgacgctcncgtatattgtgccgttggcgcgttgngtgggnntntagttgtgtgtgtnnggggtgagngggcnnngcgcgcgccgccggnnggcgggcgacggagnnngagagacgtagagacagcgttatgtctcganggngngatcgatcaggtgacgagtngacatgcgctacggtgcgagcgtggcgcgcggcatcactggtcacattcatctatcactacactagtggagagagtccatagcatgngnnncactactatctgnnatcgtaanagacgncgagngatatggggacgacgcgntgagagagatcgtagcagctgtgagctactcatcngcgtgntangtgcatagaactgnctgacagacacgangngagnagtagntgctgtatgaacgttaacatccagatagnancgtacactantcgcgcgaancagcgtattatatatggagnatcgtanagtgagaggatatgtgtatgagtagacgngagcatatacatgagtagtacacagatatacgagacactgatgaanagcgcatcttacaccgtatgctacacagtagcgagggtggcgtagacacggnacatctgctggaacacacggcgacgaccagcgtgggcagcggccgtagtgngtcgaanttcgtcatcgacatcttcaagtganagaatcatctccataggcgcgtcacacgngtacacgatgagatcggagcgattgactgtcgngncactctcatctcactggcgcaccactgctcgagtgagcgcacaccgtacnggccgacgtcactgcgcatcgcgctcgcgggtaccgnagcggcagaggcggcgacgcgagagcagccgaatatagagtacgatngagaggatgccatcatgctgcggcacgacgtcancagacgtctactatgnagtatagtattatgggacgaccagcagtagnngtgtactcggagagagcgactcagtgggatgacacgactgcgaatactatgctggagncagagattngaatgtctgtgtctggtggcgtcgggaacagggaggnggagcgatcacaaatactatgcgangactcgtcatatggcgcgtcgcanagtgngcgcgatcgactacacagacagatctacacatagtcancataacgcagatcctgaggcgttagctgatatggacactgactgtgtcacgccgagatgacatcgtgcacacactgagacaagggaacgccacactcgaccgctgatgcggagaatctaagctgccactatggactcattggggagcgatggggagagccacgccacgngacacactcnccgggcgctacgtagcgccgcggataggcatcaatacatgactacgatcatgtggccgtcgtgtgtgcgacactgctattccatgtgctgagnttnnntnngcgaggtcgcagaacgccgacgcgagcgcggnccgtcgcggcgacgcacgcgcgaggcacgcgagcagacagagggcatacatataacacaaca

SEQ ID NO: 11257 - DNA, 1517 bp, Homo sapiens
  misc_feature (1)...(1517): n = A,T,C or G
ctcgtgctcgtatcgtatctgtacgtctcaactagatcgcgctgcgactcagatgtcgtngcccggtgtcgtgctggctctcattctcaatacgagcatgcgtgtgcnctgaatatcgcatcgaagtgcgggactgcanagagctggncgtacgcacatcgcgatcgtgtntgcgcacgtactgccgtactctcgctacacacgaccgctcacatgctctcgcatcgtgctcgttacgtctatatgantctcttaaccacnctacgtctgagtacaatgcgcgtatctattgagacggatctctacaagccatcacgactctcaatgatcgctatcacctnactctctgtgtctgtactgtctgatggactactcantctcagagatcacccgacgctcacgagatcgttagtcggatggagtntatcatantacgactagtactacatatcgcatctatcatatactttaacttcctctacacctacactcgctctatgtctccctctctcctcgcagccgcggacgcaaccatcgatgatttaatcaacacaccatctctaccttatcatcacgcgtcactcgctcacacatgttacttcaaaccaacgctgcatacaccgtaggatatggtatacgctaacntatctncacgtctcaccacgccctagcgctacncngcctcgcgcgcgtcacatcatccccgcaactaccatacgccaccgacggatctacacgccagactactccctctcgacgtacacttcatgcgtacgtctcgtatcatatgtctctgtctcagtctgggtaggagatgtgtggggatacgtagcgcgtgcgtgtctgcgtgtgtataagagtgtgggntcgtagtgtttgtctcggtgtttctgttgctgaatctaattaggcgccggtcgctcaccattgtacatcagatatcgagatgacattagcatatacgaggcgcactagtttgagnagcgtgctggctgctgcgtggatgatgtgtatnannnnntaacttgcgtgtgtgtagcatattttatcttctagtcgtgttggtgtgtatatagtncaacatctttcatagtttattagtagactagatccttcttatacaagactnaatatccgtactgtcactattgtcgtctcgtgtttgatatggtgtcctagtcgggtttgcgaggagtgcggagtgcggtgcgccggtgngaacgagtcgcgggcacctgtttctgcgtgcgtttnttntttgggttgtgtgcttctaccgcgtccncggncgccaccgccggcggtncggttcgccgtgacncgcctctcgccctcgccgacctctctgctgcgcctnctccgctcnccnnnntgctctcccgtctgtcggctnctcgtttggcgtnnnnnnnngnnnnnnnctngtnngnttnntaattnnnnnntcccnnccnnnnntnncctcttcgnnntnnnntattcctcaatttctttnnnnnnnttttttnnnnnntttt

SEQ ID NO: 11258 - DNA, 260 bp, Homo sapiens
ctagagaaccctcagcccgttgtgtgggctcagccgctacgactatgtgatgacgcgccgacctgagaaacacacatgctgaccatctggccgagaactgaagaccagggcaaaaccacagcatatcgcaaacatttttccagaacagggttgtagtgtctcttttgatgccaaattttaaaataaagcaaattaaataatgattgttgagggaaaactaattttttaattaaagaagattccatctaaaaaaaaaaaaa

SEQ ID NO: 11259 - DNA, 235 bp, Homo sapiens
  misc_feature (1)...(235): n = A,T,C or G
gggagagggaggggggagganaaagggaatgggtatcaagggttgactgctcatccattatcagcagatgtctcttgagtagctgaaccacaccaagctgnacctgggacttcacaacgccctgggacctctatcacaacccacgctggattatcatctgctagggctgccgtaagaaagtaccaaaaaataagtgggttaaacaataaaatattggctcacaaaaaaaaaaaaa

SEQ ID NO: 11260 - DNA, 1413 bp, Homo sapiens
  misc_feature (1)...(1413): n = A,T,C or G
cgcgncaaggcaagcccgcgcnccncgccctaaaaaaaccgcaagacaagaaaagaaaaaaaaaaagttcttattnnngnnaaaanngngnngnnctttnaacgtttnnnnnnnnnnannacancnacaggataccttncggngggggnnnnnnnnnnnnnnnnnnnnnncnccnncnnncccncngcgcgcgcggccgcgcgncgcgcgcgcgggccccgcggccgcccgccgccgccccnncncccccgcccgccccggggggncgccccncgcgggcggnggcgncnccgcngcccccgccgggggngcgggcgcggggcgcggcggccgcgcccgcncgncggcggggaacaacggcggccncggngcgggcccgccgccgggcgccgcgccggcgcggcccgcggcncgcccgcgcgccgggcgggccgcggccgcncgnngncgcgccgcgcccgcgcgcngccggccgcggcgcggcggccggggcgcgcggcgcgccggggcggcgcggcgggcggcgcgcgggngcgcgggcgggggcgcggcccccgcgcccgcggcgcgcggcgccccggcncngcgccgcgccgcgncgcgcgcggccccgcgncgcggcggccgcccgcgcgcgcgcgccggggcggccgccgccgccgggcgggnccggacgggccgcccccgcgccgcggcggccggcgcgggcggcccgcgcggccgcgcgggcgcggcgggcgcgcgcgcgggcnggcgcggngcggcgcgggccgccggcngcggcgnggcggccgcgcgcggcggcggccgggggccggggcgcncgcgcgngcggcggcgcngcggcgcggggggggggcgcggcggggggggcggcgggcggacgggggggcgcgccggggcggggggggaaggncgcgaggggcgggaagggcggcgcccggcgcgcggcccgcggcgcggcacgggcggccggcgcgggccggggggccggggccgcgccgccgcccgggggcgccggggcggcgcgcgggccgcgcgcaggccgcgggcggcgcgccgccgcgaggcgcggcgcgggcgaagggggncacgcgcgccccgcgcggcggcgcgcccccgccaccccgccgcccgggcggcacgggacgacggcaaaaagggcggggngncgcgacgcccccacgcccccgccgcaanccccccgggggcggcgccgcaccgcgcgaccggcggcgcgcccccaacccgacggcgcgggccncaacccgccagcccgcaacgcggggcggcggcacncaggagcccgcgcgnggggcggccgggcgcgcggggggcggcggccgcgccccggcgggccacggcgagccgaagngggccgcgcgcgaggaccgcaaaaaaaaaaaacaacca

SEQ ID NO: 11261 - DNA, 322 bp, Homo sapiens
  misc_feature (1)...(322): n = A,T,C or G
attgctcggcgtcacgtgcaacgctcacgcctcccggggttcaaatgattctcctttctcanccgagcanggggtgggataacaaaaacacaacncatctgaacacacagacacatacacaganagaccccctgcaaggactgcanttatgctggctccagccaagccactaccagangccaagacagcggcttngaagagatcctnccccaggatcctcagaggggggagtgggcctnctaactccttgatcttgaacttctggcacttccataactgggagataataaattgctcgtgctctaagccaaaaaaaaaaaaa

SEQ ID NO: 11262 - DNA, 842 bp, Homo sapiens
  misc_feature (1)...(842): n = A,T,C or G
cacgataaaagaaggaggaacgcatcaactagtcgtattgaactatttagggcgtgggtggtatctaggtatgctagagtagagtgaagcacgggtccgacttcgactaaactaaagggagggggcgtgcagatgagggagtacggagagcggagtagcgtgaaagaaaccacaacgaaaggtaggatgacgagagtgggagacggtaatgtgagacttgggaggtggagaccgcgttgtacatgcataaccagtccttgtctcatacttttaatctcattaaaagattatggggagtggtataacgccaaactaggtataaaatggcgaaacgtggtacggatatactgtattatacgggctgggaatacaaataggacgtaaacaggagagcacacggcagcgttcgagaaacttgttgagagaagagggggaaggggaggagggtatttgatgggaggggtgtgggtgggagggatggaagagggggggatggtgtagggatgtacgaaggaagatgtatattttcgaatgctgagagtgggtttctgacgagtaaatgtgggatagacattaagcgtgcgggtatataaatatagagtggtatttttttcttacgcctatttattcatattgaaaaaaatgttatttagacggcatggcttcagtccgggcagggggtctctgcgtgtatgtgtgctgtctcttcgcatgccttctctttctgtaatcccagccactggagaggctgagacaggagaatcacttgaacccgggaggcggaggtggcagtgagccgaaatcgcatccatgcgactccagctgctttgctcgtnngtgcc

SEQ ID NO: 11263 - DNA, 370 bp, Homo sapiens
  misc_feature (1)...(370): n = A,T,C or G
ctcggaatcataccccatcttctgcacgaacatccaaaatcccaaatggagagattctacaaaattntaaccaagtctgggtgggaaaacatcaaaaaaangaaaaaaaaaaaccatcacaatccaaangagcccaanaagatatgacaactaaatattagggagccacctggatgggatcctggaatagaaaaacgggaggagggaaaaactaatgaagtaaaattaaacgggggggggttanttaacagggagggtgcttaaataaaggtctttcacagtgacaantatactatagaggggcttaaaattgacattttattgaggagaggacaataaaattataatcaccaaaccaaaaaaaaaaaaa

SEQ ID NO: 11264 - DNA, 1966 bp, Homo sapiens
  misc_feature (1)...(1966): n = A,T,C or G
cgtgtcgcnttttgagatganatgttatcttatctgatgcttantgtcatgctccctgcagcgnttcactctgtatatgcttcgacgtatacnangcncgtctgtatgcatatctacgtacactacgaatgtgcgatcttcacatacgtcgattggagtgagtacatagaccaatagtcgctcangtctctgntttgattaaacatgtgtagctngtaantcgtantacgttagatcgttggtcntgctgcaaatgctgatcttgcatgctcgttgtatgtataagcagatcangatagcactgngcgatgtgntatgctgatgtgtacagtttcacgtcgtcgtacgtnctcactgagacatacagnancacatctctcgtncgaatcntcacttgggttcagtgctgtcnctgaggtagtcgtgatcggactangcgcaaccacgtactcgtacatgacgtagtgtgtgcagtntttctgtcgagcctacgcccgacgnanactcagctcntaanacatcgaaagcacagtcatnctnctctatactgcatcgnccctcatangtacnagtaacatcantcatntacatnatctgcacgantatcgtgctgctgctctgacgatagancgcgangtggttgcagnngtctcgtctgtatcanatacgactganacacatcgtacatgcatcncatgntatctatcantgcacgccanctnncatacgattcgactacgtgatactaacactctctatataacttcacttacatagacagtntatantgctctacttcgctgcgcatcgtatntgcgtctgtcatgactatcantanatntctgtctnccattcatnatagtagnntgtngactctaccgtntgacgcgacagcacatncatnganancgcgtgccacgtacatactnatcctgtctcgtgcgttgtgagaggatatatgtgtgtagggatgggattagctggcgagcgcaatgagcggngangcagttcgtatcganatgatacaagtgacgtacgcttgacttaggtgttatcgangactgtntactacncatcgatnactacgtcagtgntgtgtcatntncagtgtgtgtnanagatgtanagatatatatagcgcattgtcgntagtcntgtntcgtttgtgcgatcatgatanatgntcntnttactngtggnnntntgtgtatattagatatgatntcgcacgcatgtctatacagctctctcncgatatnatatgtaggttgagngtgagatctattgatagcgatgtcgatagctagatgacgagagatcgatgacgagngganntgcntnatgnntacgctacggatgagtntctctagatattatgtatttattncgagnncgtncggtgttaatcgtaatgagtgtgaantatnantatactatcatcntatgtgtctagactagntactgagatcatactgcttctnttatcatattgtgtacctatcattatcagtctgtcgctccgcgtcgngntntatagttgcnctggactcgagnantgacntgtctagctggacgggcgcggagcgtcgcgtcgngtngntngcgcgctgcgcgacgcgtcgagcgtcacagtgtagcgagcgagcnngngatcttggcccgtccgcgtaatgttgattncgcgttcgctggctctcgtcgcgtctgtccggcgnngtcggcggtgcgcngtccactgcgcgcccnccgcgcgccgcacttccgcgntggntgnncggctcgccgcgncnttgnnggntgcacgccgccttcngtctncnngntcgtcntctcgggctnttnnnnnnnnnnnnnnnnnnnncttctntnnnntnnnnntnctntgncnnnncgnntnnnnnnntcnnncnntnntctcnncttccnncnnncttcctnactcggtttcccnnnnnnnnnnnntttt

SEQ ID NO: 11265 - DNA, 184 bp, Homo sapiens
gctgcacacaccggggagtcgattatgagagcttgccagtccaatgcattctccaaatagaaagggaagaaactagcagctcaagctaaatctggaagattaaaaaaaaatacatcgcactaaatatgttaattattaaactaaaagagttctgcggcttcttcttctaacaaaaaaaaaaaaa

SEQ ID NO: 11266 - DNA, 1161 bp, Homo sapiens
  misc_feature (1)...(1161): n = A,T,C or G
aaatagtgagatnatgtgtgaggtggatatttatactcgtgatctccttgtcttacaggcgcagtanagccntgcgcggcctcgtgcttggagctacgctttaccgctgtcgtgatgagcatctatgaagagtgtagatacaacggagataaataataatanagaancanntatatctctntaattctggatccattttnacttttnnnngncggcagggngggtgagnnnnngagtcgatgcttctgagtattatataatgacacgctagaagacctcgcactgtccgttgactcgccatactataggtgagctgacgcggnactatagtaaattatgagtnaataaacgttgagggatgacagcgtccgcgatgcgacgtcaacgagaataatgtagcgagntgatatccgtgggntagtattctcagtctctgttgcagcctcgagctcactacatgtgctcatcggtatcgctgtcgtacgtgagctactcaagactctttggactacttgctatttaaaaatacctcttaggagaggggggcgctggtctcccgttaggtagcgacctctactgaaacttctggaataaattggatagctgggtgaccgcggcggcgtatcaatagccctccggaggctaggctaccgtaatgctcacgaggacatagtgcagcgatctaccggnctctcatcgggccatgtgggcgatgtataacagtgtttttgtggcctcagccactacttagaanacgtatgtaggatgtngatggtgcccggggatacgagcgaattgaagtgaggtacagcctcgttggcgcaangtgctcgttgggaaccatgaccaccatcgnaccgaacctcaagcagtctcgctgaacaatgacgggagctgtgctatgtagtaacttgttgtgacagatgtagtgcagtgtacgccggcgcttagagcatggtgggataggatcgagccgaagataggaatactatagtcgctgccgtttgtgtgaaataataacaacaaatcactaatcgtgactctctgttgtgccctgtagggcgcgtgaaaggatgatatgccgggcgaggtgatagtgcataggtgggcaccgattagcgcggattgtnaactattctaacatgtcccttctctcccttt

SEQ ID NO: 11267 - DNA, 936 bp, Homo sapiens
  misc_feature (1)...(936): n = A,T,C or G
ctcagagtctccatctgtcgcccatgctggaatgcactggtgcaatctccgttaactgcaacctccgcctccctctggttcaagtgattcttgtgcctcgacctcccaagtagctaggattacaggcatgagccaccattaccagctttagatatcttttaatgatatggatatcttatttgcctacacattttaaatatcttatgctcaaaaatgtattttaaataaaatgtctggaatagagaaatatggaagctgttttatgtcaagtaaagccacaaatatcacctttaataaagtttgattatctgaaaaaaaacaaaaaccacacaaaacacaccacaaaaaaaaaaaacccacaaaaacaaaaaaaaaaaccaaaanaaaaaggcctcttttggccctcaggggggggtttttgggccgtttccctttaaggggggtaattaaagaaccccctcacattaacccttggcctggggtgttgggttcgggaaaggggttaatctctctaaaaggggggaatccgggttttcccaaaactcgggggtaacccccagaaagaaactttggagcaaaggggcccaaaagggccagaaaacgcaaaaaaggccgggttgtgggggtttttcacaaggcccccccccccgagaaatataaaaaaatccgctctttaaccaaagggggcgcaaccccccggggctttataaaaacccacgcgttttccccgggaaagtcctcctggggctctttctgttcaaccttggcgttacaggaacctcggcccttttgtccctggagaaagggggggtttctttaacacacctctgaggtccccactgcggggagcggttgcccaatgcggtgtgtgaacaccccctcttaaccacccggtgccttaataggaattcgttgtggcaccgctaaaccacttac

SEQ ID NO: 11268 - DNA, 919 bp, Homo sapiens
  misc_feature (1)...(919): n = A,T,C or G
actcgttctcttccacctaacggccgccacgctctgtgtagcgcactgaagagttgcggggagnaactctgnctgaggaaaatgaatccacagctctacctttgggtctaggccagacttctactactcgaaagcggacccgtgaaggggaagacgagggtgcctcacacgcaaagcgtccagccgcgtgcgctcgtctgctcggaactgcccgacctcgcccccacacccatgcccccttttacgctccgcctctttcttttccccgacggcggcccccgacacccaccactttatccacaggccaatttgccgnccctcccccctcccggttccatgctgatcacccgacgccagaaccacgctccccgtcgcccccggtccgcgtcaacggtccaggccggttctctgtgctgtacggtcatttgataagcntaacaggctgtttggtcaagagttatncccggacaccgcccttacagagcccgcccacctcgccttcctccgcccgttaccagtccacttgcgatgcctgtccccacccgcacccattgctccccagctccncatatcacgaatttgggtacatgtccgtaggctccctgccccccgaccgtatggggacgggcgttgcggtgatgttctatcggtccgatttacctctcgctagtcctttcgaccccctaatagcccgacagccctacagatccatttgctgatccagcttcccggttgtcctgtggctccccgccgtccgcgggcatgccggctcgggctcctcgcctcttgtcttccagttactcataacggccttcctccgatcgcaggtcgcatgtttgatccaacgctgtgatttgcgccccgcagcgacccacagccactctcgaactccgttaacctgtttttctattttgtctag

SEQ ID NO: 11269 - DNA, 1169 bp, Homo sapiens
  misc_feature (1)...(1169): n = A,T,C or G
cccggctgccctgtccgcgtcccatacatcccgcncatancaccctgcgccctcttgactccgttggcgccggtccgtctggcgcggtccgtttttcggcgacgcgcggtcgctcgtctcttgcccgtcggcacacctccgtcatctcgctcccgtctgtgccgctccctcnttgcctttccgttgctgcagtcgagctctcttatgccgccgacgcgactcgcagtgagtggagtgcgtggntgcgcggtggagcagcgcgagagcgacgtggccgtacgcgcgcgcgctggcgcgggtggtctaggagagngttcctctttnctcccactcccgtcttcgtctcctcatactctttattcgccacctgccgcccacatcccatcacctgggcgcgccgcccgatacccttcgcactcctccgccccccggcgcgtaccccccgcggcctcaccgcagacgctcttcaccctgcacacccctcccccctcccagcgcctttcagcagacgcgtgcgccgagtgccactgccccgcggccgatccgtatgggggggtgagtggcgtggtcgggcgcggtcgggcggtgggtggggtgctccgccggccggcgccggcgccggctgggcccgcgcgcgcggccgcgcgcgcgcggccggctcttgacgaccgctctgccacccgcaactccctcggctccatcactcgctcgctcctctcgccgcggctctaacgccccgcgngcgccccgcgcgctgcctgccgggcgcccctcgccactccaccctcccctctccgtcccacccaccattcatccgccggccccccccccccccccctctattgctcaccctcccctccccatctcctctacacccctccttacttgcccccggggctcggggctccctccgcggccgcggcggcgtggttattttggttggtgtttcgtttgtgggcggggggcggcgcgcgcgncgcgcccgccgcnccccctcccgccgtgccccctcctccccactcccttctccccgccccgccncccgcccgcccgttcccctgggctccctccttctttaaagcttctttttttcttgtttcccttttaggttccttttttttttctttcccnnctcctcctcttcctttttttcctnnnttttttttttt

SEQ ID NO: 11270 - DNA, 285 bp, Homo sapiens
tcctccccacgaccgccaaaaagaaaaacccctccaggcaacccaagctcctgtagaagacgatcaagacacccgaagcattgcttgctcctcctaagcagctcacccaccaggcgctcagccacaggatccaccatatacaggagctcagactcaagcaggagagatgtaccaacagtaccagcaacaggccggctatggcgcacacgtaggcggaggctccacctgaacagcctcaacaggatggggttcagcattcaaggacgccttagcgagcagactgga

SEQ ID NO: 11271 - DNA, 1102 bp, Homo sapiens
  misc_feature (1)...(1102): n = A,T,C or G
ctggtcctactcttcctccatgtctacgctgcggtcgtctcggcggttcaccaccctggtggcggcaaaacgtaccgaggatgtcacaacagcctctataaggagggtggggtggagcgcgaaggtgggtcgtacggatacgatagatggcgaatctacaaggatatcgtaagacgctcgtccactctccggaaccttcctgcgagtaccgctcgtgcctcgtgtcccgctgccgtcgtactgtcgcgcgccgaccggcccagcggactgtgtacagcgacataaccaccttatatataccctacacaagtataccactctctccataataccatcgctctcactctacgttgctgctgctccaaggatcataacaatatcacatgatattcgttcgctatactatatatttgtaactacatttcactagactatgtagcagaccggatacctaaacgaacactaaagtataggttagcgtgctgcttagtaggagcacgtcgatacataaacgggacagccgcacgcgcggggctcggcggcgcagcgtcgaccgctgcagtgggggcagggatgctggtgacgcctgtggtacgtttgggtagttgtagcgtgcggtatcatgaatttacgcaccgcatttgcgagttgttatcgtaactacctcgttgctctggtagtttggtaactctaattcggtggggtataattatgatttaatanttatgtggaaggaagtataattctgagtatgtgtgtaaagtcgaatatanattataaatacaaatgtaaatcaatcaganagatcctgttgcaccactgcctaagtggctattacatcattatatacaagttggccacgcggaaccttctgctcctttctcctgtctgaaagcagacgtataatacctcgcgctcttgtcgtcacatcattgtggcaagtgaagcgtgtaagtgatggacggttctactgcctaccactacgaacgctattcattcaagtgtcactcaagtacactccagcaaacacacatggccacaaccatgagcgcgtactcgcaagacgatngnctcnnntctntctacctcntttcttcctccc

SEQ ID NO: 11272 - DNA, 873 bp, Homo sapiens
  misc_feature (1)...(873): n = A,T,C or G
catttagtacatcagcaccnctgaaagcncatnncaggggcgacccangnggccagaaacggaagcttccagggggcagccaagcgagngatgaagggagcggaccccccagccccagagaagcccncagaagagaccgcagccccaggcaacagccggacggcaattttangagagacccaangagcagcnaagccacccggggaggccggttttcagaaacttgcaaaagagagttgncccccganaaagangnangnnnnggagaaacccgcacaggggagaaagaaccacccctttttgttatcaagttagggaacacaataacagaggtactcaaacttggaaactgctaagcaaattatgatatattatcttgatgaacccacggatattgctaacataccagcattctcgcgcgccctttacgcccgggcgcgcaaaagggtcgaaaaaccaggagggaatacctgcccctaccacacaacgcagagagtatgcctgcgtgcgtctactacaggacgcccaaaactcggaagtcataactcgcgaccctcgcggcgcaaatagcccccccggacaccccgcccgcccccactcgtgtcccacgaacgcccaccgcgcgggcgccagaggcccaaggcgggcggggccgtagtctcgttgagaaggccccaaccacacccccagaccacccccacgccccagcagacacccgcgccacccccaagcctccccaagcgcgcacccgcccccacaacaggggacacggctgccgacacgacgtaacccagcgcaccgagcggacaccgccgcgcgccccccgcacgtcccctcagggccgcccatggagcgccacccagcgcccaagca

SEQ ID NO: 11273 - DNA, 834 bp, Homo sapiens
cttggcgatcacttcatggtcgcaaactattttattatcaaactgaagagagactggaacacggtgtgatctccgtggggcggtccataagttttgattgtatttatacttcgcgtttacgagttggtcattgtgcggtatgatcggttgggcggaacggcacagtccattcaaaagtaagggtcttttgtgatcgtagggagttggtcgtgatttcagtggtctctcaggtactgcctgtccttaaaggaaagatatctctgcggtgcacggaatgagtgtttgccgttccctcacccgccggtaatgcccgatgattattctcacccctggtctgatctttcttcatgcttttcggagtgccagatggagcgttgtttccctgggtgtggctggtacccccgcacatacctctccctagcgtggtgtgtacgttagatacttttatgttgttagggggtgcggggcgtcctcgataaatactttccagttggatgcgcaaaggtgggtgtttttaatgatatagtgggtctcacctggtgagctgggtctatcgactataaaatttcttccattgtttgtaatggagtttgtagttgtcgcactactttttttcttttttccagcatgggtgtaaaaatgtgttttttttcccatagggggttaatgtttctagtgtttaacatattactatgtgtgggggcggagggctttttatgaagtagtctaaaaggggggggataccgttgtttctgcccctaatacaattctaaatttaaaaaatgtggtttgcattccaaaaaaacaattttatgaaccaaaaaaaaaaaaaaa

SEQ ID NO: 11274 - DNA, 784 bp, Homo sapiens
cgtgctcgccggatgtggcggcggtggggcgggggacgtggtgtgaggcgtggcggcaggtcggggctccgtttcgatggccgtggggattgtgtggtacgtcgtcttctgggggacccccccggggggttgtcccgtcgcggtcgaccggctgacatctcgctgtgtggtcccggtggggggcggtgtgggcgggtgtcgcctcgcgccccccaatagccccgcggtgggtcggggccctcccccccggggggcggctggccgagtgcgccctgctatttggtgtcccatgatcgccccaattccccccccgcgcgttgttcgtggccccccccagccgccctcccgccccggcgatggtgtttttcctctctcccggttccttgtgttggcgccgattggtctcggcctcgatagaaaccctcccgcgggggggccccaggtggtgggtgtatcttaagtcccgcgggtgtgcgcgccgtgtcatgttgggtccccggcctcatgaacagtctccccgtgccccgccagtgggcctttttggttgcacccagcaattttttgtttttttctggcctccccggtttaaggaggaggttttttcccttcggggggtccgcggctctagttttaccctctaactatgtggggggggggtgccttttttttaaatcgtctggaaggggggggttgctgttgtttctgcccctcctgctaatctaattttaaaaaacgtggtccgcattccattaaaccaattttatgaaccaaaaaaaaaaaaaaa

SEQ ID NO: 11275 - DNA, 1132 bp, Homo sapiens
  misc_feature (1)...(1132): n = A,T,C or G
ttgtcgtgtcgctgtcgctctgtagcgtgcgntcggtcctcgcgggcgctgcgctctcgcgctctcgtggcgcgtccttctgtctctttcttgctgtagacgtcggcccgttccgtcggtgtcttgcgcgctgtgctngtcgtctctgttacttgcgctcgtgcaggcgcgccgttctctttgctttgtggcgtgcgtgcagtgtcgtctccctcactcctccttgctgctctcgtctgttgtctgtggtcgtgtgtctcagcgttctgcgnctcctctgtccgtctcttcgcgcgtggtcactccttgcctgccttctgctgcgcgcgcgcctgctgtngtgtttcgccgtgccgctactgtgtctggtgtcgcgtgcttagcgtggtgtgtgcgctctgtgttgtctgacatggtgcgcgcgtccgcgtgcncgcgcgccgcnttcgtgttcgctcgctgtctctgcgtcgcttttccgctcgcgctggcgtccncgacntgttctgtcctgcgcgctcgcgctcctcgcgctcgctctctcctccgcgtctcctctcgggccttcgctcgtcggcctcccttctctgcatcgcttccctcgcgcgccgcgctgttcctacccntgtgttcctcttctcgttcttctcgtgcttcgtcgtgttctcccgttgtgctgcgtggagtgtcgcgccgcgcagggcgcggtctccccctctcgccgtgtgtggtgttgcgccgccgctttccttccttcccgctcgcgtccttgtcgctctctttccgcgctcgccgtttcctctcttcgtggctcgtctgtgctttctcttggtgcgtgggctcggctgtctgtgtcgctccccgttcgtcgcttcccgtgctcggcggcttccccgctgttctgaaaatctctgtccgttttgtcttgcgttgtcgcccgctgttgtgtcttctgttgcggccccggcgctctcgccggccctgggtctttctccttccgtgcttttgctgggtctgcgtctcgtgggggggccggctggggggtttttgcccgctaggtctccgtcgctgggtggcgttctgtncgcctgaggctggcgcgtaccaacacctctccggtgtttcggtccct

SEQ ID NO: 11276 - DNA, 1940 bp, Homo sapiens
  misc_feature (1)...(1940): n = A,T,C or G
ctgcngtgtctggcagcgtcatgcgnatacgtctacggtggcgannanctggtagatctgctgtnnttcnttnatcgatcgcattagctttgagcgtggcgtcctgctgtnngtgcncgttccgatctanctngtcngcncgtcgtgctgatcngcttaccgtctgttgntntattcgcncccantcttcattccttgtntgacgttcntcgtcgatcantagctanttgctcacngtcgctcgtcttcgctctgctngntgcgntgctngctctgctgtcgtgctgtgtatcacgtcgtcaggtttgctncggtctgctgactgctcgtcgtttcgatgtnntgtcgtgcncggtgncgnngcannttgccgngtnccgtnntgtgctcgtcgcggcgcgcgtngcgctgcgcgttgctngcgctgtagtntgcgatacctgcgtctgctcgactcgtagtacgtcgctgtgtcgttcgctcgtctcntccatgcgtcgtcgctggtcgctgcngcgtcgtccactgcgatngngcacgtcctgctgtnggctcctgctgcgactacctgctntctgctgctgngcnctgtagcntatcgtccgcgcgtattcnttcgtcttcgcgtctcgcgtctgnctctctgctctgtctctcgcgtcccngtntgtgcgtgcacgttctctgcnctgtcggcgctgatgtcgtatgngctgcgcgcgctgtgttgngtgctgtcgangcgtgcgttctgcngctgaggctgctggttcgctctgctcactcgcgntcgatgttcgtacgcgcgtgcctgcctgtcgcgtgctcgtgtgctcgtcgtcgtctgcnttgcgcgtggtcgtgatgtgngcgtttgtntctncncntctcgcgattcgacgtctnctgctgctctcgtctctgtcnctgcgcgtgtgtgtgcgacgctgngagcngctgcntcgagagtngcgcgctctgtcgtnggtgcgnttgctcgcctgtgnctggtggcgcatgtgtntcntcngggcgtgtgtgtctgtgtggtnctgtgctctgtgtagagtgccgcgtgntgncgtgaccgcgtcgcgtcgctgngtagtcgggtggntccgtgtcgatgctcgctgtgcgtcgcgcgtccgncgtgtcgcgattcgcttntgtacgtgcgtnattnntcctctgtgctcgtgtgtgtgtgtcgcgcgcngtgacgcgcgctcgcctctgcgctgcggccgtctggctgctcgtcgtgtgcgcgtctgtctgtcgcgtcgtgtgtgtggcgtgtntcgngtgtggtctgcngcntntacgtccgtcgctcgtcctgctgcgctggtggtccggtctcnttntntctccgcgccgcgcgcgtntcccttcttcctcggttgttgtcctgcttgngcgngcgtcgtgtggtgtgcgtgtgttcgtctcgctgctctgtgctcgcctctcccgtcgtggtgcttgcgcgttgtgctctctgtcttctcngtccgctctctgctcgtttctcgtctcgccgctttcggtgtgcnttctgtgtcggtggtcctggtcgtcgcgctgcttcgtcgtgcgtcgtcgttttcgctgttgctcttgcgcttctcctgttcgtgggctccggttcttggcggtcgcnccgtccctcgtctcttgcttgtcggttgtctctgcgctggctgctgtttgtgtctcttctctctcgtttcgtggtcgtnttccttctcntcctccttcttctctgtcctctctttctcctgcttctctctgtcgtctcttcggctttcgggncggtttctttgcgccttcttaacccctgttgtgtctttgttctccccctgttcagggtcttgttcgtctcctctctcgtttgctctcttccctccttctccctgggctgtcttgtcttcaca

SEQ ID NO: 11277 - DNA, 982 bp, Homo sapiens
  misc_feature (1)...(982): n = A,T,C or G
aaaaatagaaaataaaaaaannnntgtgggtttgggtttatgaaaaatataagataaatancttacacttgacccactacctgctactggctttgtccgggctaggggtgagagagaggtggtgagggagttttgatagaagaataggataatgaagaagatantataaacatccacgataatctgcgatctattagaaaatttacaagatgtacaggaagtgaggcgcgaacgcaggcgggggggatgggtgaggaccagaggcgagcacaacttatctccataccntatatttgagagatttttctgttttctatccacagaaacaacactcactgcactcggatgttcatcccgaaagcaggtggggnaggatcgagcatgcgctgatgtaaccaacnaagtaaagtataaaaaatacgcaccanaccccnctccccccccgcccacccgacacaaagcaggccacacacccaattcccacccgcaccctgctcctccccacccccctccccgacccactcccccttcaccaccccctctctcgctgctctctcatccatccccgcggatcgataccctgcgaacttccacagtctacgttcgcctttggctcggcccctccagcgcgcgggctgcgtcctctgaacacacaaccgtattcttccttcactcgccccacccagccacgcgcgcgccacacacccagtcgacacccactttctctcccgcccgncttaggtttttcagatgttgaattcggttagatgttactatccatccctactaccttaatataatgcatatctctaataatgtccgataccgaccacgccacttccctcactgtgtgttcctacatttgccctccccggcccgcaccgccatattcgcccaagtgctatcaacctacggcaacctagcagcgaatgtgcgcatctagccagccgcgcgattaaccgaacaaacatccttataatat

SEQ ID NO: 11278 - DNA, 1535 bp, Homo sapiens
  misc_feature (1)...(1535): n = A,T,C or G
agaggagaggggaatnagaggagagagagagaggaagagaaggaggagaaaagggagttgtacaaagaagtagtttagaaatactcgcggcgtggaccatctgaggcccgaatcctttgcacggcttaggacgcctctcgttctggttattgttgatgtgaggggagagaacgagcagtgtttttgatatagagagaggatgaggaagtaaagttggagtaccgagagantttctccgtaaccgtacctttctaccatcacgcacactccggcccaantcagtatcagctcactacccctctcgccgcacgcgatcgtgccccctnacccgcccgtccgcgcgcgcgcgtctcacgtcacgcgactcaccgtccgcgccatgtccgatccatacgnactactctcgtctcccgcacgcanaccgcgaatcacaccggcgcgtccttacactgttgcagggcactgatgtgttgttgcgcggaccgcgtccgcgccagacccntcgcacagacgcgccgcgcattcgcgcctagtcccgcaccgcgcgggcgtctatcatgcctgctagagatatgcacgcacgccacgaagaatcattggagtgagcgcgagcgatcccgacgcggactcggagctcgagacacgcacgcgacagccacccncgcacgggcgagcaccgcggncgcgcggcgggacgcagcagggcgcggngnaggcgcagagatacggaggatcgagcgagggagcggcggcgaactgtcagtgcactttgacagtcgtcatcatatngatgtanaaatcattcgactaccacaatttatacgataactacctacacgatcgcgaggtgacactggccaacactctcacccgacgacgcacaacatcgtgcantctcgancacgcgcgtcagcacgcgtcgttcgcctgacggcncaccgctactacgccgcacgacatgctgacgcatgtgagcatacgcagctgtctacgcaatgcgacatctcgcctgacggccgctgcgcacgacgagcgcgatgtgcagcgcgagcgcgacacgacgtcgacgtcacgcacacagtatcncgccacgctgcctcgtaccactccacacgcgctatctggtcgccgcgcgtctgatcgctcagcgtcctacanctgctcgatatacgccagacgcgcacgcncggcgcnccccgtctatccgtcaccgtctcctgcgcgacgcantagtgtaaggagngtcgacgtgagggtgctcgacgcgcgagagcncctagagtcgatgatagagtgctacagncgtcacgtctgtcatatantcganctatatagacccgctgcgcagtacgcatgacgtgtcacgcgcacgntggntncancacgcgcgcgcgtcacctanacgcacctctgcgntgctcgcacgactcgccgtcgccgctcgctgacgngcacgtctcacgagatgnacctcgctgagcgatctgacatcgccggcccagtctgcacgacagcgtcgcgccacgcgcggcgcg

SEQ ID NO: 11279 - DNA, 748 bp, Homo sapiens
  misc_feature (1)...(748): n = A,T,C or G
ttctttaaacaaaaccgtatgatcatggaaagaaaaatcatggttatggtaccttatatagagataagacaaanataaggcggtaaaattgtagcaaaaaaacttgatgttatgtttgtatttgtttttgttctttatttcttttttttnattttttatcctatctacccccacattcaactcccctcctccattattctctgtttttccctatcttgttgtatcgttttttcttgttgttttatctatccacctctccctcgttcctcccctgcctcccgccttcactaccaccccccctaccacacctaaatatctctctcctcactcaccctatcgcttcgctcgtgccagtgtttctttttctcttattgttttttgtttgcatattcttatttactatatttttctttctttcctctctttatttttttctctccttcactattcttccacatattcccccggccgtattccgtactcccttgcctatgctttcccccgccgccgctcacaaccttgtatcacctcatcctctgctcccctacaatgttatcttacgccccctcccgatcgtaccccatctctgctctatcactatatttatattctcttctcttacccttttcttcttcctctctctcatttctctaatccatctctttttcaccttctgcttgttttatcgattttgtctcttctttgttccccctcgctctctctcacccctctcacccttatattctcc

SEQ ID NO: 11280 - DNA, 657 bp, Homo sapiens
aaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagagattttcctcagttacttttctcgcctgaactcttaagcagcatctggaagatggcttattggatgtaaccacatcgccctataggcactgtctgagaacacggactcacatgctttgatgtcgctatgtcgaacgctgttgcctctattaaccaccaccccccacctgcactctgccgtgtagcagctagacgataaccgacaccgccctattgccgtatgcgcgtgtgccacctgtctgatagagagattgaccgcccagattaccacagcgtagaacccgcaacacaccccccattattgatatgtcattcgaccgcttcacgccctcgccctcccatccgcacttattactgcgcctccgccattaacactacttgggtacttgttcgttcctgccgcgcacgcaagaaacgagtcatgacccaaacttcggcccccttcagcgcagcgcccccacaaactggtccaccggacacgatccgcgcgacaacgcgcgccgcctgacgtgatccgcggcccg

SEQ ID NO: 11281 - DNA, 1549 bp, Homo sapiens
  misc_feature (1)...(1549): n = A,T,C or G
ggagtgtttatcggtttttgcatactagtaatgacaacaacagaccgatacacgcgaggacagcggagcagtcaaatcaattcgagtacagtctacatcgagcngatccgacgagtatagtcagacgcacgagtcacaggtcagaagattcaattctgtattattaggttgtcgttcgtatcagcctcttcccatcttcgaccgctaccgtatttccttcacctctagccantcgaatccacactctcacgtctcgtatctacatcaatagcatcgcagcgctcactcgganagaccagaccggtgcggtcatgatagttactagtatctgatcgtatgtttcgtgagacgtatacgtgagaggtttctgtcgcgcgtnctcctcccgttaatgtcattgatcgatgcgatnaggcgagtgttgaggaggttgcacgcgctcgattcttgacncagtcgcgcaccagaattgaacaacanttcntgagacgcgcacagtgtgcgacggtgtgtcatgcgcacctatgcgctcatacgcgcgntagtcaagcggatanacacacatatgggaacactcacaactcgaatgtaggagatgtcggatagagtgagggagatggagtgcaacacaagtgcgtgtgactantgtacagagagtgttgtgcgtcagagcatcngtcgcacgnctttgttgcagagatnagggagtacttagaagagcgatagtagagcattgagagataaatataattgtggtagctagtcgacgcgatcatgtgttggtgctggagattgtatagcggacgcgatagcgagagatcgattacagagcgtataactaagacgaccgagcaacgtgcgccgtctcctccgcgtcatagatgatcagaacccaaacggcgcgcccaggcgatcgcggacganatcagcggatgtcacgcgatgatgggcagtatactataattgtagatcgctacgcttcgtcaaganaactcgagtagaggacatgtatcggatcgatgtgtgatcgatagtgtgtacgagtcgaggcagacacantgctagctactgaatattgatggcactcatagcacactaggcgaggcatggcgagggacgcagcgctgcgctttgtagccgtatnagtgtcactccgagacgtgaggcgacatcatatgtgtgatcagagacgcagcatacagtgacgtactacacgactacactgcaacagcagngtgagctaggtctccaccgtgcgaacataatagatacaatcagtatatacgcgtacagcgtacctatactngtgcgtgcgcgtcggcaccatgagatagtgggcaacacatctcgcgacgcgtatcgtgagcggtagaancaacttagaatttccacgacctagtcgtcacatcanacatgtgtatgactgtactatcnagtgcgtgtcgcgagagtaagaaagaatctgcaattgcngaatccganttgatgatgtctgtgtcgatatagccagtgagtgagctcaccngatatcgcacnctatcggctcact

SEQ ID NO: 11282 - DNA, 1588 bp, Homo sapiens
  misc_feature (1)...(1588): n = A,T,C or G
cgtcgtatgtgctcctccgcacgagtatgtcgcgcngaggtcgtgcggcgttggtgctctatcatgatcagtcgtctgtcgcgcgatagtgttcaacgacncgactctgtacgcngtgtgtggcgtcttccggcagctgtgcttagattgatgtatagagacaactcagatacnggccatgtacgtatangtgtcgatagactacgtagcttatatttgcgcatatcgtgngaccagtgttggtgtacactgttcatatgcgccacatattacactacgtcctcattctgcgctgctcgatcgctctcgtctntacttactgtgcactcgttcctttatcttctcgatntcgcatctacgacagtgcgtgtacnagtgtgcgcggtcggaccgcgagangcgtctctcngtcgttatgtatttgtagcgacctatacttactgcgcgttggagctcngcgcggantgagtcgtgtgtctggagcgagacgtacgtagtgctgcgtactagtgtnattcgtgctgtatgntgatagagagtgagcgngacgtctatanatanantcgtcggtgtacgacgtcgatgagatgntgcgcatgcgcagcgagagaacgagtagnanctatcgatgcgtcagcgtacaccttcgagatgtcggtagagtgtgatgtatggctgtcgattcagctacgtgcagtggagacagacatctatagcttatctcagtgtgcgacgcgattctctatatgattcgtatactcgtcgccatgtgatatatcatatgaatttcatttattanagatatatcgtgatatagtgagctcatgtggactggatacgcgnatgtgcgntggcacatatcatctagtcatacgantgtggacatgagtcgatatctgtacgagaacgcncacggcgtacgcngctctacgatctgacatncgcggctcgctcctnctacacgagcggatgtgatacgctgttcgctgngctctccgtctgttgatgcgacnatcttaatgcgcgaactcttccncatggtcaaatngtactacgantcgaggtgagtgtctgttgtaccatgtactaagtacctgctgtgcctacgtcccgactctcagcanaccttncagtcgcatgctggcatatcactgctgttctgtactgactcacagttgtgattgacgtattngtgcgaagtgagtatatagttttgcttgcgatacaccagtctctgttagccggtatggttactatgtgatcgtctggtaagcgagcgtatttcgttgtaggaggctgtgctcggagttatttattgcgctacgttagtctcacgagagntgccgacaagctaccaccacgcgtccgcatctccgtgtgtggcatcgagcaacagaggatcagttagcatgccaactattgagatggaatagttttcttaacgctccggataagagtacgagtgtaaatgatgtgtcgctgctgttcgtgtcgcttagcgacagtgtggtaagtctctggtgccgctccttggaggagtgtggcttcctcgctctagctgtggtctgcattctggggctgctagttg

SEQ ID NO: 11283 - DNA, 1882 bp, Homo sapiens
  misc_feature (1)...(1882): n = A,T,C or G
attgnaggagctgcgctactcgtcggctacgnatcatcgacnaaacngtcgtcataccatcaatgcagtcacgcgcgaattagtcgtcgtatncgnctactacgtcgtacgactgaagagcatnatcnaagcgatgnacgtcgatagnacggtatcgtantagngcgtacctgntgtcgancatngcatcgctntgatgcagcacagtnatgtcgtcngncgtacactacgantcatgacnnccattcacgtaatctgcgtcacatnctgcactcgancaacntancgntgtagcangagantatngagctatgacgtncacgatgtntgncggangacattcgatacggagtancgtaccagatgcccgantcacacnatcacagactctcgtnctgccgcgtacatcgttcatacnacagtcaactgacatngcctcgctgnagctnagcggtatcgcgacgcggcnagntgcnacgagatgatgtgtacaaaggacgacgtgnggctacgagcgtatgcatnagagctcagagnngangatacgatcgaatatcgtctangtctatnggacgtacancngtatcgncaatgagtacgtntcgntcnanatgagatgntngnatantagcantagcntcatgctacnacgagcgtcgtcgcntcaggtacacgcgtanaactactcgagactagactgacgcancacgatcaaacatatacgtgtctctctggtgatncgtcagtagcgcgtgtggcagcgagtagagccgtgtatatatcgantggatctagcatatnacanctgtaatagacggtgctgtatgcaaatcgagagttctanangtagcggntgtaggtcgaagtngatanatganagtcaggatnanngatatcgcgctgacngtcnacagactangtgatatgacngaagtaacacgcagacggcagtctagagctgatggancagctagantcgcacgtgctcgtanatcgagtgtggactcgncgtatantctgtcgtcatatnaactggtgagnagtatanaacggcgaagtgatagatatgatagagatgagagtgtaagcagacacggagagttaatncacgangtgagnattatacgttgtggagctagangatcgaacgatagtgtncancacggcgngaggtaggatagagtagtgctnatgctatgctaagtgagaggtatagcagtggtgctgtgcgcggtggatgagtgtcgtgnacgtgatnaagcgntcgtgtgtctctgtgcgatagagtatatcactatgtcaagctcatacatacatcaacatcatggtgtacgagtatnattatagtacacgtcgagctgatttngtgagttatatatgtaactatctcgannggnngtgtcgttgcgggtgcagtgtgtagacntggaantgtgntggtgatcgcggcncgagtataatatagagacgtantactctcttcgactcgagaaccgatatagaganacaagtaagtttgtgattgatacgtcagtcgaaccatgtactgcacgcgctcgtgggcgacntcgcataaacactcagacgtaagcattccgctacacgtactctaactcctcgtcgcaatgcccgcaatcctcaaccctacccacccaccatgacttttttccatgtttggttggngcgctgggggctctctcgcccgcctctcgctcgcgcgcgatcggcgcctcggggctcacagcgccaccgcacggcggggcgagcgggctccggcgggcagagggagctggtggngggctggganncgcccnaaaaagctnnggtcgcnngtgtcggttgggttctccgtctctancgctcaattgggnnnccccntttt

SEQ ID NO: 11284 - DNA, 1103 bp, Homo sapiens
  misc_feature (1)...(1103): n = A,T,C or G
caccgcttcactcatcaggnaatccactgcgaaacgaactacaataaccttcctgaaccagccgccacccgcagcccatactggactacgtgcattttctaattcctgcataggtccttttacatcttactncactacgatgttcgagatcatgcatatcatactggatgcttgtaacgctgatttactgccttcgttcctccctttcnttcgtcntggctgagataagaactactactatcattcgttatacaagaaacatctagcctcatcgtggcctcgcagccgccgaagttgcccaccttcaccattaccatccgnccctggaacacccactctcaccgtagacgggaacgtcttcctccagggagcgcgcgcggtcgtcgtcgcgcccggcactgagggatttgtttgtcgcgctgagcgcgaatgacggcaagatcgctatgcacgggtgaacggagacttatctacattaactgctatctctatagcgagaggaggaccacgtggcggcgcccgtgaataggccctatacctaccctctgtctagcctctaagatgaaacatgacctccgagaatcctactagacataacgtggaaatagcctagcctcgtcggggaaaatcttgtagaacgtgggcgggggcttaaaatattccacgggatagaagagtgacatgaggactactgagcatggcgctccaaagatttggttcgacactgcgctcggagtgacaagcagcatagtacgaacctcagaccacggcctgggtcacacccttccgttgctaatnccaaacctctgcccccgtccggactagactcagagtgccgttataggctaagcactataccatttactctgggcctgtgcgtcctcaccacgcgcactgcatcgcaagaactataaaatacttacacattgataatatttagatgtgaccatatactgcaccataagactgcctatgaggnccacctgcatgnggctcactgactcgtctggcacgaccctcagacgcaccctgacctcccagagctccatgggacgcaattcttgacaataaacccacttcaaaatatntaaaccctcttacct

SEQ ID NO: 11285 - DNA, 1045 bp, Homo sapiens
  misc_feature (1)...(1045): n = A,T,C or G
gaaaaacggtccaggcgagcgnggaacgnccctcnaagtaactnccggccaaagcctcnaaaggnanaaccccacaccaaaananccaagagnaccgnggaanctttggaggccaagcaaagccgngggagccaaaaggacngcnggncangnncaaagcaaagganggaaagaaggcgccaccccagaggaaccaaagagnggtttgaccaccaccacggaggacgaaagngnancccagcgnccacctttttaaaaacctcctcagaanaggcggggncncccccngaaaaaacancnggacnnnaaaaacccccccaagnacggggcggggacagaccccccccccaaagaccgcccgagggncgnggaacacaaaaaccccgagaagggaaacagaaccgggcaaccggccgcgcccaacaccgaccaacccccccggcccgaaagggccacgccggcggcgaccggggcgagccgcccaacgcgcaaggccccccggaccccgggcaaacacggggccaaccgcagggcgcgccgagcccccacccccgccgcacccaccccccgccccgcgacccgcgccgcaggcgcccgcgggccgcgacccgccggcgggcgcgccgccccacgaaccgaccccacaccaaccgccgcaaacgngaaaacgccccgcgcccgcacccgccgcgggcacaacacgnacacagacaaacaggcccccgccgcaacggacagcaaccacgcggccgcacccgcacccacccacccagcacgcggcagccggaaccgaccaccaccacaacgacgcacccaccgaacccgcacagcagacgagcacacacccccaacccagccgcccgcggcgggcaccagcggcgcagaangcacgcgaccaccacacgcacaggcacccgccaacacccgcccaacaccgcgaccaccacgagcccgcgacaaacacacacacagccaccacacacccccacnacacccanccacacacaaaacgcacacaagcaacccccacaaagccaacccaaca

SEQ ID NO: 11286 - DNA, 925 bp, Homo sapiens
  misc_feature (1)...(925): n = A,T,C or G
acggtggacgtttgttaggggtgtgttgttgttggttggggttggggcggatttcggggagagaggagtaagaaatttgaactaatatnactgtttatttacagtctttcncatttntctttcnaatgttanatgttatagagttgaattggctgagnnggtggtggggggggagnnnncgccgcaacatacatgtgatactagatcgtttattagtgtgtgtatagtatatgtattatatgagagttgggtgggtcaaaggataaaatgtttgtagttgggagggttgtatgtctaaggagggagtttggtgtgaaattaataataagatgttgtgatgagtggagtgtgtggtatatattaataggatagaatagagaaaaagatgggggggtaatatatgggtgggtgaggtgaggggatataacgatgtgattaggagggctggggggcaatgagatgtgatatataggcacgtcattgagttgtttcagattattggagttgttggggtggggagatagggtgtgtatttgtaattgcttaagggatggggggttgagagggggggagagaggtcgggtacggattggggtggtgagagatgagtgagatgtgggggggagtggggagtcgagatggagtcatgggtttgcatgaatggtggattgtgtgacatataggcaattggatgtgggtgtgggtttatatgaataggaggggaagaggataaacctcatatagcaaggtgatacgataagtgtttgtggtagagagtagatgaggagactggttcattcaagtgtgactggtggggcagatgcaattttggcatatctgagaggaaaatgttcgttggaaagttctgtaatgatggggacatttaaatgaagatagtctgttagtaaaagcaaaaaaaaaaaaa

SEQ ID NO: 11287 - DNA, 1099 bp, Homo sapiens
  misc_feature (1)...(1099): n = A,T,C or G
gacactcctgggcgtccgggccgctcatttccgcgagagaccaacctacccctaccataggacatgtcaacgcaataaaacaatattacgttgcgtggtgcagggaccgctctgcgcgaggcagacttgttttccccctcgaccctccgcggacgaccgaacacatcctccaagaagctcactcgtgcgggagaatacagagataaagaacgtattagaagtctcaagatcagccaaaaacccgagggtgttgtcaacaggggcggaaccccatactcgcagtattccactcccgggaccgaccggaggcattaatatgttaaacaggggtagaatggtgagcaaatctaaagggacgtgaactactccacacaagggagccgatccgtgctctccatcgcacgaatggttcaaaggcgagccaagtcaaccatttttgaggtgggcagtcccatcccatgcgagtcaccagcttttaagcccccagaattactgaatgccgattccattatactataggatgagagaaaataagcgacataagaagtaaggccataatcccgttaagcgcggagtgcttggctatgtgagcataagacaaaagcccttaccgagggagtggcggagctgatcatagtctgggagaggtaggattgcaatacaccctttaatacacaacgcatgtacatagtcatatagtactcacttgaactggagctcgaaggatcgcatacttttcgagatcaccttgaacgcattatacgcagactaacccagacgtcgttggcattgcgctcagtnacgctgtgatcttctcaagcttctatgcgtagagagcgaatggccattcggtatcctaatcttacactagagtcaaactgttcccattaatgtaattctttaataactgcatgaattcacaatttaaccatgtaaacatagctgtctagtacaaacacaacaaagaaacaaacaataaagatgagtcctccagttgagtcttacgactcgcgtggatgntgttgcctgtgccagaaattccatttggccgtactcctgtgtatgtgcacatgatctgcactgtacagcgcgtagttca

SEQ ID NO: 11288 - DNA, 1607 bp, Homo sapiens
  misc_feature (1)...(1607): n = A,T,C or G
cctcgntatgtgcgtcgccgcgtgatgtcgcgtgtgtgctcgtcgtcagtggcngcgatctcactatcgtctcgcgtctgtcacttcctctactcactaggaggcgacgtcgatgacgcgcatctcgctcgcgctncgatgncgtcgcgtgcgnctcgcagtcgttgatgccaccgtgcacttgctcgacgtcgtcagtacgtcagtcnctctcgactcgcctgcagcactatcatgctcagcgtcgtgagtcacatgtgtancgctncgctctcactntccttnttcttgcgtcgtcgctctcgcgtcctcacgtctctcgtatcgtcntcgtcngcngcgcgtcacgtactgtcttatgtcactgtcgtcgtcgtactatgcgctgccggtgccgcttccncccggtccgcgtgcatcnctctgtcgcagattcgtcgatcctcngtctcgcacgctcgcgtcgctctgtcntgatgtcgntcatcctcatctctgtctacatacgcctcgctcctcccatcacgacactatctcnctagctcactgntatccaagnttgcgctctagctgntntntgtgtcnttcgantcgcgtgcgtcgtgcggattcgtcgcgctctctacgcatccctcgcgtcacgctagtgctatcgtctcncacgcgcatgcncnagctctctacgcgcgtactcactcatcttgccgtcgctcgatcnataacactaggcactcgcgtatcgtcgtcacnctccgatactctctccggccaataatacgagaagcgccgcctgtccgctggtttcnttctcgcggtgctctgtgtcttcgcgnctctgtcgcgcgtgtgccgttcgtgcgctccgtcgcactcgcatgggtgactgagtgagngttgcgggtagctgtgngcgtgtgtgctcgagcgctgttcgngcgctcgcggtgatagcagcctagcgatgtatcatgtacttggtgttatttgctgagttgagtctatggcgttgcttcgtctcgtatactcacgcgtgcgcgcgcggagacacacacatacccgcgccgcgcgtcacgctccgcgtcctcccgccagcctcacgtccgcctgcgctcgactactcaccactcgcgcntcaccacnattctttatccctcctctctcgcttctgcacgtatctcatcacncaataccganantctctncgtgtcgactgacactctattattaccttcgaccctgcgtngtgngtgtgtatcagtgtgctcattctttaactctgttttctcctactcctctgactctactatatcttcgctttttatatactgcgtttctgtttctttcgttccctgcgcgcntcttgtgtacttctggtgtcgcttggtgctgtgtgtcctggcgtcgctcccggcgccttcgtccggcggtcgcggcggtcgccgcccgtcgcggccgtttttgttggtcgtgcctcgcccgtggccctctccttcgccgccctcgccgaaacccgtgccgggttctccttttcttcctctcccgcggcgtgctgcttgtgttccgccggtttgaaaagctgttctgttttgttggttttctctntcagg

SEQ ID NO: 11289 - DNA, 128 bp, Homo sapiens
ccttcaggtgacaaacctacattgcttcctgaaggatctcttcacttcctcctgctccttcgccttgtatccttcatagatttttcccgcaataaaactttgcatatctaatatcaaaaaaaaaaaaa

SEQ ID NO: 11290 - DNA, 996 bp, Homo sapiens
  misc_feature (1)...(996): n = A,T,C or G
aagagcggtagaagggggggaggggttcgggtaccgagccccaccttcggggggcgacgngccaaggagactgcgccctgccttgacaacatttgctaaggggcggagacttcagctcggctccccagacggaatacccacgagtcgagtactggggcgcatgaggggcacgaaactgaatactcccgaggcttcgtcttaccggaagcggaggacgacattacctgttgactgcacagaaaaatgactcttttttgaagagaaggaacaacgccacccggggaaaacctcccgagagaaacgaccgaacggacgcgaaccnacaggcctagcaaccgcgcaaacacagagcccccaggccgggccacgggcaaagccccgcagcgagaacgaggacaagaaacgcgcgccgccggcccgaccggggacccaaagggaggacaggaaaaacccacccggagcccccaggcgccccgccggagaaacccacatggaaaaccaacggagggcgcgggcaggcggggcaccgcccgccccgtgcccgcgcccctaataaccccccccaaagagtcccctacctcaaaaggtccctacacgggaccggccacgagtatagccagggccgcgaacaacacaggcatcgtgacagaggacgtgcctttttcggtctaaacaagtaaaacaggccgcgccgcctctccccatataagagaataacgctcgccctcctaccccaaatacagaggagcgatcctaggcccgcccggcgagacggtggtagcttgatgcatacggtgggccactacggccatcagcccaccccgtcgacaccaaacagcacaacctcccgccaagcggcgcgcgcagatctagcacgggaccaaaggccccgtcagcgcgccggccgccacggcgtcatccggtaggcccgcacaccacgccccccgcaacagacgatcgcaacagagcctgatcccacgccgagaccaacagccg

SEQ ID NO: 11291 - DNA, 911 bp, Homo sapiens
agctaccactatcacggtctgcacacactgtggactatgaaacgcgggtactcaacgctggttgtggggctaagacgcctacctgtagacgcaggtgtagaagcgaatggcccgttgatacggcgtatacagcaggaccaatcaataatctcattagcgtatcgcatgacgctaacgtgacagttcttgtaaaaaggattcgaggacatatacttcaatatagtagaacatgactgtgtgagctccacctattgcctaggcacgggatacagagggattggtgcgcctgcctaacctaccgggtgaataaggcgcgtcacggttcgggatcgggatcgcgagacagaagacccgacgagggcggagttattgcggcgccatccggccaccggtaatttcagtgtctcgcgggagttttggtattcagggataagatagggggacattcacctggatgtatagagtaacctaggttcgccgacttatgagtagaaggaaatatccctccccggggtaatacctgcatttgagaaatggatcttttcttagtgaacttcacaggctgtgcagggtgcagtaagcggggccttatgctgctctcaaacgaatccgtgacagaagaatatggcgaagcaatagtcccctatgatcatttgtgtaaaaattgtcatcatgtaatagccgcacatgagtatcacttcagtgtcatgcatgaatttcaggagtaagccaggctgtgtctgttatgcggcaaagccgaaggtactatcagtattctccctgatgacccccgacaaatgactctcttattctaaggatccttcaacagatctgttagaactatattgtggtggtttcgaaacagcaacgcctgatggaatgtcttatttcattcaaaaaaaaaaaaaaaa

SEQ ID NO: 11292 - DNA, 885 bp, Homo sapiens
  misc_feature (1)...(885): n = A,T,C or G
agcatacatcgcgacataggtccttacgcgctgttaccccaagtcaggtacctgatgggcatcgggatgccgtgggacacacacgcgagactgtcccataacacactgcctccggggtcctagcgcgcccataggcggagctatgtattatgcgagtacccacaccttagcccgaggggggaggacagacgggagatgggactgggacgatagccttacaagggagacagagtcggtagccacgggatcgcgttttccgcagttaggaatatacttgtactttggcgacctcggacgagacacggcaaagaaggaatctgaggtacttacgtagcacctcggttcccccggngaggcggtgaaggaccatactcctactgttcgtgaactagccactgggtgccagtccttgttgtttgtgagctgtatcccgcaacgggaagatagactatagagcttacacaaaagggatgaagagagaagtgcaacattataagagtatgtccaaggacatcagataaaacgtgaatctaacaccggcgtagagaaacgaaggccggtgaaagaaggaagagtggctaagaacatagngcaccaatggatcagagtggggagggagtaataatcgagtaaataagcgagacatgaaatatacattcaagaatcgagcgaagaatttcaagggagaagacccatgantgtggctgtgatgcgagcagaagccgaagtgtactacctagtattgagccttgatggccccagacaaaaggacgctcttactctggggagtccttctccagttccggttagaactaaggaggggtggtttacgtatacagcaatgcctaatggtatgtcatatttcaatcaaaaaaaaaaaaaaaa

SEQ ID NO: 11293 - DNA, 1047 bp, Homo sapiens
  misc_feature (1)...(1047): n = A,T,C or G
tcgtactacgaatgctcgctccgcttcgccagagagctacgcggttgcataatgatgggtgggtaaacggtgagagagtgcccgttgttccgcccccacagccgctgtaagtttgttatcatctgtagtgcgtcgtactactccgtagatcgcacggcgtggtgtcgattaaagggatgccatgaataggtaaaccgcgtgtatgcggcggtctccagtcgcgtagcgcccctagagcgagtgctgtgatagtatatatcataacaatatcattactcgatactacttacttaatctcatgtcatgtcctcaccgtctcgtgcgggacagtaaaactctcattataatctgaggatcgtacgaagggtattagtgatagacctccgataaaaagctgctaaagtccagttattacactacaaatacaaagtaatctgacgatagacagcatggtatatatatgtggagtagtgggcgggaaggggagtgggaaggtgggcgcggacttgtaaaaccagcctctacctccctaacttgcgctgtggacggatgtccgcgccctcacccacaccacacacaccaatacctcccacactctgcgcaccagaattctaccaacccggccacccggcaccgtggcgtctcagcgcgcatcttaccacagtacgcatccacgctccccacacacgcataccacgcacaaataatccaactaatataaatacccttcaccaccgcaatacccccccccacctgggaaatcaagaaggcgcggggcaggaggatggaagagagtagcggactggaacctgagtctggggaataggtaattatgtgggtgtatggcaggtgtgcttgtcgttgcgtcgccagccactcgccctcctcgctgcccctcccgcaccccngtccactgccactatctgtgtcgaaaggcatnngnngctnngnggctcnnaacncaaagaccccanggnncnnnncttcctatccccctcncncccactacncctgggnnnnnnnnntttaatttnnnnnnnnnncccc

SEQ ID NO: 11294 - DNA, 902 bp, Homo sapiens
  misc_feature (1)...(902): n = A,T,C or G
ctcagaatagcgccaggaaattatgttttggcttcacttctgaatcaacattgatggccgccatctgcagaggatgattcctcccggttcagtttctttgaaaaccacagaagggaaaactcaatggagaacttgcgaacaactgggtcaggaacaactgtggctgcttttcagggctctgatctgggaaccccagatgcaaagacatgctgacgtcctctcgctcagccatcaccaggcaacaggtcaaccagctcgcttcatcaacctcagtgtgcaatgtagctcaacaaatgactgattgacaatcctttataaatattaacatggtgcaaaagtaatggcaaaaaccacaattacttttgtaccaacctaatactattgactgtgttgtcacatgcgtgcatttggatttactgaggcactgattcagagggtattatctggacttgttaaacattttgactcagtaagagtaatattcctaatgtacttctttttttggcatagaaacactatgttgagtcttattttaacgtttcaaggtttcaaatttttcagtttgctaagcaggtatgtgtatagaacttctcctanggggatgaggaggacatgaatgattgagttgagacaagagttgagcaattacgtgtgttgtgcctttgcatatggatagaatctatttcatttttttaacaaaaccctaaaacttattcagacaataagtactattcttcaaataccttccttaatattacgaatttgttaatgattgatgtactcaaagtgttacaactctctcttgaatactcttgagcagttaggactaaacatatcctctattctctggccagactaatttgcaatacatatcaggggatatcacctattaccaattggtt

SEQ ID NO: 11295 - DNA, 1222 bp, Homo sapiens
  misc_feature (1)...(1222): n = A,T,C or G
aggtgaaaaanagaggagatgttatatatagtgctgatgttgagggggcgtgtgggagtcctggggttaagtaagtacatatatagtacaacaatatcattctcgtgtctttntttatttaattattagatagtattgtaagatacagacggggcgggcgggggngtgatagagagaagggtactctatcatctccatgtcagttatctgtcgagtagggttcattgtgtggtcaataaccattataaatgtgaggtaatgtgcgagcacaagtagggcaagttgggtgatgtgagtgcgataacatgtggaaggagggtgagtgagggagggcgcgtgggagtatgcgatnaggtacgcggaatgatagtgggctttcgtatgtgtatgatagtatggtggtcggtgggtgacatagaggcgactggacctgtggtggttattcgtgtcggtcctgtaaggatgtatggggaattagtcacagaggcgtacagtcaacggaaccgngtggatgaagagaaactgtaagagtataagagagcggaggagtgcacgtaatcttgagaataccatgtaaatggagtttgntngtggtcgggggcgtatgcgagaataggaggggacggtgggagcgctgtgcgtagaagagctacgagtgtagtaaacgcagggggggcctattttactaggatgtaacgtccctctaatagagcgtctggggggcatgagagngattacgcgtggcgaggaggggagagagggggaggagggggngcggtagtgcttaacgagcgatgcgctcgcctccacagcctctagcgcaaggtggagcgtgcacatgctccagcggcccaaactgtcgctgaacatgcccactctaaatacgcggtgtngtggtgagtattatgggactagaggtncgacgagagcaccgtcgtcgtgtggagagacgatagatagatagaagagagatatagtggacaacagangagacatgcaggaatgaacataacataaganaacacacagaacgtagtagagagacagcatacagacacagcacgatcgcgccacgtgctgtgtggggccactgncgaggacggantagtggaggactagctgnggctggtgcgcagactcatagttanccgctgtgatgcgactcactgaggtactgatgagttgccgcgctcggagaggaggaggactgtgatgcacccac

SEQ ID NO: 11296 - DNA, 795 bp, Homo sapiens
ctcccgaaaaaaggccgcatcaaaagttgaaaattttttaccaagtcaaaacttccaaaaaaaggtttaaaaaatattttccaaaaaaaaatttacaaaaaagaaatggtttaagggttggccaggttcacgaggaataaatatttctcccaacccttatgtgtgaaggaggcaacaacaccccactccgggggctttttggattatgtgtgtatgtggcggggaattctcccaatagggagggggggaaaaccagggttctagggccttttgccccctttctttttgggccagggtttggatacctagttgggccagatgtcgggaccccacccctgagattttgcaaccgggatccccgccttggacagggtttctttaggtgccccagtccctcttatggtggggtcagggaaattggagccaaggacttgtggcaagaaaatggttttaactgcaaggtcacccctttacccattttgaatgcctaagccctagtccataaagacttccctgggcctttttaaaaggccagttttaaaggagttggccttcaccagtttacccccctatgagctgtgtcctaaatatcccctgggacggaacggttcgggcccgtttttatcaaattttccccctcctaagaatgggttctagatttaggggcaatgtccttaatcccactatatgtgggttggggctttgaataaatccctagacccgtttgggaaaaaaaaaaaaaaaaaaaaaaaaaaaaaaaaaaaaaaaaaaaaaaaagagaaaaaaaaaaaaaaa

SEQ ID NO: 11297 - DNA, 754 bp, Homo sapiens
aaattctcttagttctctccatcaggtgtctctccgcgacagagttgggtcagggtgggaagtatataaaccaccaccgcaccaaaggtggtaggaggttgtagcaccagcctaaggagacaccgtaggcccagtcaagggggccagaagcttccgcgtggcaagattcaggtccatccaagctgcggaatttgaggacgccctgcccccagcagcaggtggccttaaagattcagcttttagtaacaaattgtggagggggtttgtggagggattattgtggggggcgtggggccctctaggtgatctgttgcagaataactaatacctattgtaacagaggagtatagatttataaaatacatgacaaatgcttaataaaaaagaaaaaagtgaaatgaaaaatgaagatcagagtggtagacaaaggaagaaagggggaagaggaagggaggagggaggaggaaaatgaagacaagaataggttataagtaaagataaaatgtgtcaaatgaatttaaaaagaatgtattataatctgtacttaatttcttgctcaatcatcggaaagtgcccatttcatgccctgtacagttaccataattccttttttctccacattcatttttgttctattatatttgtagaaatgtaatctttcatgtttaaagttcaataatgaaagtaccgtcttgtaaaaaaaaacaaaaataaaaatcaataaaaaataaaaataaaataagtaaaacgcaaa

SEQ ID NO: 11298 - DNA, 1342 bp, Homo sapiens
  misc_feature (1)...(1342): n = A,T,C or G
aacagagacacggcagggagtatgagcgatggatgctttacacttagagagtgctttgtgggggtaggantgctctgtgtgtgttgcgagaagggangtaggtatattagangtacaaccgcacacgccgctcaacantcttacctctcattcgttantggcctcatatnatanaatcancttccaagcgcacacgtncngcgctgtcanngacagtagntggagaagacacgggnnnggccggcgacggnggcgcgctgagncccatccgcttcactagtttaagtgctgagtattgtgtcaggcgcggctgtctatgtgtaggtcgcgcctgactctcgtctacacagcgcgggtcgctngtgcgtgggacgtgagaagagagggaatgagtaaagctgatgtggagacagtgtacgacgccacttagtcggcctacattcgttgcgcgagatcggatagatggcgtgtgaggatgtggtgttggtggngtagtgngggtagagttgctgnagtggactaggtctgcattaatcgtgcaggtgacggtgtgatcntactcagcggtcttgctctgcggcactcctctcgatgtctcacatcgtgtctgctatctgagtgacttctgttggctacgttgagttttgttggtcacgcgtgcgagcagcatcgtagcgttctgtggtgntgcactcagcgagtgagaatcataagcagtgcgctcagggtacgaccagatggncgcgctgggataatagctcagcagtctaataggtcgttatatattgagattatgtgtacggcgcacggtctgtntgttgtgtttttctcgtgggatgtctgtgagggngctgttacgctttcttcgcaacncaatgaggtntgctatactatcacgactatcctactgtcgtctagttcggtcacagagcacagggttgtaagactagntataatatgtgcggcagtgtgggcacgatgacgagaagctcagggtgggtgtcgacacgaagtagggcactgagggcgcacgggtntcttcctaggcgtattctccgcggcgcgtcaccgcgtggtctgcagcacgtcatatgtgctgtgtctcgagagcagggtgaacgagataagacgtctctctgtgtgcgataaacaaaaaaacaaaaacaaagaaagacatcgtaaaacagcaacaaaataaataaataaaaaagaataaggaatagaaaataaaagaaacaaatgtccctcgttgggccctgcagcgggtggtagtttgtagcgaccaggccctgtcctcggaccagcagaaacctcatactccatctaaagtctgattgaccag

SEQ ID NO: 11299 - DNA, 1016 bp, Homo sapiens
  misc_feature (1)...(1016): n = A,T,C or G
attctgtcttggcggttgggaacgcacgctttgtgtcccgtggtgaggccctcgggnaccggggcgccccgggngccccttgatanacgcggagactaactcgctaccttatanatctctggactccaagggagatccgtgggggccggaggtctgctcctagatagtgtgcggggtcgtgaggggggtggcgttagttccctctttggagtggtagntcttatcgtaanattatgtcactccgtggttgcacactggcctcgcgagcgcacgcggncgtccgcggacgngctctcgcncgcccttgtcttcgtctcccctcggcgcgcatgtagcgtggactgtggccggcggcggggagcttcccccactccgtnncctctcttttaccgcccccctcgtcctacagtcgcgcgacgcgcgcgtcgttctctatgggcgtcaacgggagagccggtggaatggggtggggggtcgggggcccgacagagtccgggtgtggtgccggnggcctgcctccttctcgtaccgtcgcgtgctattgacgtgggttctgcgtcccgcgncctctcgcggtagctgcggccccgtgctgtcccgtgccttttctcgtctgatcgtggnagtactcttcggatcccggggcggggcgctataatagaggtcggccgagaactcgtccccggagcccgtattgcctccgcccccgccctcacgacggaggacttgagcgctcgcgggactcctgaccccgcgtgctcctcgctatgttctgattttgggccttcgccttcgcgagccattcctccccgccccttagcgccgctgaataggaatgagagtagaacgccgccctctgaccgagcgaagaattgaggcgaacgaaaaacgccttgatataaaaaaaataagagcaaatgaatcatagaaaaagacgaataatggcctcgttggcctcagcggggagtgtgcggccaatctctgggccctctggggcccctctaaagggccgcgcg

SEQ ID NO: 11300 - DNA, 1636 bp, Homo sapiens
  misc_feature (1)...(1636): n = A,T,C or G
agtatgagattcatcgatgcgtagtatgtcgagctgtcagtcatgtctcgccgtcgacgccgtagcngagtgctgagcgatgttgatcatacgcgtctggctacgcgcagttgcatactcctcgagagtgtgtcaggatgtctacttgaactgacgagtctgagatagtgcgtgtcacgtactggttagctagnttgacagtatacactgagtacacgccgtatagttatacgatgcncntaggatgttacgntcatagtcgatncctgcgtgtgagataatcgcgcgcgcgcgtacatngctgtatatcggaagagattanagagtcgccaagatgtcagtactaacatctgtgtatgatacagtatcaaatacagcatgaccgactatcgtatcgtgacacgaagaactctagaatcagtcgacganaggagaccgagttcggtagagtcgcatgtgagacatatgacgagnnnaatataacgcgtaacaataactaactatcgataatacttagaagacaatcacacaactacttagctccgcgcacgtactatantaagcagctngtgtagcgcgagtgacgcaagangatagcacnttatatagatacagacatagtagagatcgtgagcgacgttatccagacaacaatgagtacgtatatagatgagtctacanntattaacggtctagattgagcggtatactgatctcagttgncgtctatgtagtacacgttctatcatgatcgtaagtagtgagaacnaactcgccgcgtggacagcagagatatggcgcggtcatgtggagtatggtgacgcggagagtgcggttggttcgtcgatagtgatgtttgataatataaatatcatatgtgtctcgtcctcatactctcgttgcgtaattgttgtggagtgtcgtgtgaggatggttgtatgtgtgacgtcgtggtatctctgtgtatatgcttggtgtctgcgttatagttngtatgtggtatattgagatctttgttatctaatatatatatttatatacatattattaggtgatctgttatnaattatgaatatagacaacgaagcgtggacgagctgctatactactattgtcggcgcncgggataccagaccaaacacaataggaagaatcgttgttaattacaattgttgtaattaactgctttatggtgagcagcattactctatctccaaatactctatctacgtcctcactactaaactacatacctctcaataacaaatatacgaacataaatgaaacatactatataagtaatgtcatctgtcgtactgcgactncgtangacatcgtgttgttagtattgcctggttgtgctgatntctcttatgtcttataggtacgtgtatagcaagtgatcaatatgcggatgctgagcagtactgacgttaagcgactcgcaggtatcgtgttagcctagtttcctagtgtaaacaatctngacaaatggcgccntggtcgctccatctctaagcctcaggaattnnnnntattcnctnncgtatctctctcactaaccgcctctcttctcctctcctcatttcctctcntnnngatttatnntnnattnttttaannnntaatttccttt

SEQ ID NO: 11301 - DNA, 1226 bp, Homo sapiens
  misc_feature (1)...(1226): n = A,T,C or G
atgtaggtagtatagataggcngatgaggacataancacacacacanacaaacctcaccctccccatgcngaaaacaggngncanngtccatcttttaaatnacgtnccagaaaccggagaagcaacatntagcgcgcacgtagtctactacgtagatntacacctagacaaggaactctcacacagggatggagagtatgtcttcacacgacctacactgacgtactctgcaacttagcagcctctcgaggtccaggccgtcatgaagtcacacagcccgacgcttcctattgctttctatcaatcacgtggccgctcttgtggcgctataggctagttttcgggacatcctcgcagcatcttgtgtgatgagtgtctcggtcctcatccttggcctcttctaaagagcaggacagtgtgtgcggtccacaccgcaagctctgcatgagaagggcacatcaccagtatagagtacacaattacttctaccgcctctcgtgcgccctgcgccccgcttcttgttgtctagggcgactatgacttcgagcactcgacaacaccctcactcagccacacgcgtgtcccgcccgtctggcgcgccgggagttctgatcagtgagttaagtgtgaaacggcgtgcaccaccaagtgcatcgtaactctaccaacctcacacagctatatagataattcgccctcattacgtctcctagaacccaccacaaacaaccgtacacttgctccacaccgtcgccactacaacgggtcgtcgactgcgtcatccctccccagcccatacttatcgacccctcaactccgataatacctccccgcagtctcaactgccttccatcattgtggagtcgccggcgacacccgccacccgctccggtcaataaaatactgatcttcagacttcttgaccacttctctctcgcccacctcttttctcccagcgcccactcgatctccgcacgcctaattgcctccatctcaccatagtgtatgctacgcgacacccgctccaccagcattattttatatatcgtggctgaaacccccactacatataactgatcggagtattcttcgtggtcgcgtatttgatatagcgtgctaggctagcatttctcgttgaacggcccgacatgctcacacgtcgttccgacaaccagtcactatctttgatctcagcagagtacctcgatcttcagaggtatagagt

SEQ ID NO: 11302 - DNA, 149 bp, Homo sapiens
ataaaatgccaaggtaaacgtgcgaaaaatgcaccaatgcctaccttaagtcaatgggtgaaatcacccaggatgggtagcccaaaacgtctttcagaaaccttataggagaaaggcaagttctgcgtgcaacccccgtttccggaaaa

SEQ ID NO: 11303 - DNA, 1371 bp, Homo sapiens
  misc_feature (1)...(1371): n = A,T,C or G
cagagaatatcaataatactcacgatcatatacacgaaagaagaagngagagacatcccttcgcancgtacccaacaggcgaagagntagctgattggttgngcgcgatgcgacaacagcagcactacacgaaataccacacctcgcgaataggcaagagcatacacttcgtagtctagcacacaggcctaagcacgtagctagccagagacataagatactctaggctctcacgtagatacgcactcctctccctnctctcgcgagtatcacacgcagatctacccactatgccctcagagcccgtagcgcgtaagtcaatactggaggacctactagctatggctctctgcgcacaccactgtcgccaatgtgcagatcgctcgcggtcactgttnattcgagtagttagaagcgcatgatctactgagtctttctttacacgacatcgnagatgacactgaaaatgagccagacgaaaagaccacctgagaatccggtaacgttcacgagcaataactcgcggcctctcacaatcatataacgacgacgcgagatgcgacgccacttctatccgcgcagatacacgtcgcacccgccgccagactgaagctacgccgagnactgccgtatntcacgctatcgcgtgtcgtcctccncgccntatcatcgagcactctgcacataacagcacccantcactacnatcgtagtgtgaattcccacgtgatactgccaccagatatggcttcggctactcaccgcgtctcaccgacaacttgacgtcacgagatgtatcgccacccatcttcacgctcagctgtggncgcacgcccacatccgtactaccagtatatcgtcatgactaccctctaatctgtcctatctaaccactacttccggccaccaataacacattaagacgccacccaacatcagaaaaagaataacaataacctagctcaccgcaacttgatagatgaactagcccacctagtgccccacgcaacccacacgtcgacccaaagcaatactacgccactggcgggataagctccccccgccaccaccgtccaacaagaccaccgctattccccaccagccgccccatccagcacggtaaacgagcagcaccaggaaagcaaacaccacagcccactatttgttcagtagctgctaagcgccgccccacttccctctgcatctaacatcaatcattagacacccgcgcgggcaactagaacgcacattacactcacatcgcgtaccacacccacactcccagagctcacccactcccacaactatcgctcacagcgcgccccacgcgcgaccgcgccgaacacaccagcacaccgcgcagccacaaag

SEQ ID NO: 11304 - DNA, 793 bp, Homo sapiens
acgggatttccccaaacggcccaaaagttttggtctcttttgcgtcaagatacaacgggcattgggccttcgcaaaagggctggggatctccggggctgaggccgccctggcccgggcctctttgtgcctgtttaaattggggggacccagtgtgcaattttcatatgtgcaccttataccaaccaatccaacggggataaatggaaaagtattcgagttatttttaggtttaaataatcgatccccttttcccactaaattttaatggccatcttttcacctatatttaaattactttattaaatacaaaatgtttcctccaccttctgttgtcttctgcttaatccacttccctatccttattctaatcacacaccattaacataaaagggactttctaatgtgaggtagatataaatgcttcatcactattgaccacatttttgttccttttcttaattatttccatatatttattcttctatatgaaattacatgtgggcctacattttcttttctttccaaaaaatgtctgtcagctggtgatatgattcaaagtatatttttaaaagtataattaaataatctgatgcttaatatatttggtaggaaacaacattttcatgttaattgatatcatgtagtaaaatgatctgttactctacttatcaagatcttattttatgctcttctataacttttttaggttttatattaggtgcctatatatatatgtatatctatctatcttattaaatttatttttaagtattttaaaaaaaaaaaaaaaaa

SEQ ID NO: 11305 - DNA, 1584 bp, Homo sapiens
  misc_feature (1)...(1584): n = A,T,C or G
cgacgtgttgtaatgacatctgtcgactatntcacgcggtgtaacgcgggctagtcatatttcgaccgggacacgcgagcgtgtcgagnggcagacgaagatgaagctcgtgagcggtgacatgcgaccgcagtcacagtgcattccgagctantggtgagactgtgatatatagttgtctagtcgcgctctattgactccgtntntaccactgncactaaccttgtgtagnggagtaacgctgcgtgcgcactcgacgccgcagttaatagagctgtgcangtgtgagtgagcgcacagaatggacacacagacctcgacgtgcgctcgcgcgtatatttgtgttatcacagctactacattactatatcgtggaggtgaagntattatctgtgatantnagacagaacagattgcatagtgctactgtcgtgctagtcaaatattcgtctantcggcgagtcgcgagtatggtgtgtatagcgcggtgggtagcgcgcgatgatgngagcgaggacactatgantagagcgctatcgcggctatgtntgaatgtgagagcgcgtgcgtaganaactganaagagtagtgtataagattatggacgtatgtcgatntgngggtgattangtagcaagtgctactgcgtgatagaggaggatgagagcgagcgcgaacggtgaagcgtatggagagcagtgcatgcacagagatatagcagagagataaagtatcgctcgaagcaatagagtgtgtgggaggtggacgtcgtgtacggagngtttgtaatcgagtgccgtgccgtgcganggcggtatctctacgtcgtctcggagcgatgtagcgggacgcgcgctcgtccgcgngactatagtatgacatgtgtacttactaactaaatataactantaantcgatctcgagcagcggatganttatatatggcgncctcactcttatcgcctacatnctgctgactcgattatattacaatattgtagcgggtgctagacgtacgagagcacganaaagaagattagatagagcgagtgcggctacaggatggngtacgtatgcgtgtaggtgagatgatnatagcctagacgctatatgtacgcgcgggctgggtctnagatagaagtgnactataggtgttgggtcgtgtgttgttagctagnatgaccacgtatttgatgttaatagcattaggacagcaaatgtatctagatacgtctattaattaacttgtagtagcatgcanactgtaatcatatagtgtagaagtcttgnctgactctatacactactatatgggctgctgcgtgtntnctctctcgcctggctcgtcgtccntgtcgcgagtcgctctcagcngatgnaagcntagtacgaagcatcacgctactatcgcatatgacacatgtanatngcacagcaggatctatatatgtactagncanaaataacagacatctgatcgagtgtcccagttnagatcatcgctgctacggcgaggcgagttantgtnntgnttgntcnngnngttnntnngtctntatagttacgctntnngtatnattanca

SEQ ID NO: 11306 - DNA, 1449 bp, Homo sapiens
  misc_feature (1)...(1449): n = A,T,C or G
tnnnnnattggaatagnnanagggaagagannaaagtgttgtgataaagaatatatagatntnttttattttttcnngtatangntgagactanantagattgagagaagcctttagatntgagaggcgatgatagattgctgtgtgcgttttgagggtgntatttgtgatgtgatagttgttgatatttatngtgtttattatgtcatatgtgagatgaatataagaaagtagataataagaggcgcgcggggcgcgctaccaacgatgaacgacgcgtatccagaagcaattaattgaanatcgctgagacagagagcgatggagcacgagagtgatgcggggagtggacgtgagccggggagcgcggagggcgaggcgtcgcgcatgcttctgcattgttcatatccagtgggtgcgtctgttctgcggcctttctgcaggtgtatctttaggtggagagggcacggcacgcagcggcggtgcggcgatgcggtgggcgcagagtgnccaggcggcgctgcgcnacgcacacggtgtcggtcgacgcaataagcgagagacagagtaggaggagggacgnaggnagagcgcgagcgtggggaggcaaggtgaggaggaggaggccgcgcgccaccgctccgcgcagcaccgacggncatggcggccagcgacancatagcntcgcagtagcgccgtagcgcgtcatcactcgcgtggctagaacacatgacgctacaccagccgacactcncncacgtccaacngagacgtcggaagcgaggcgagagagtggagtgagagtgcgaggagagtgcgatgtactattgtccggtccgcgtntgacgagcgcactactgtaggactcacgctgtcgcgcagacgcgcctacgcgcgacgttccacctccgacgcgagtagctccgagctctcgcaccgcacgcgcgtaatgagtgcgtaacgttagcggagacggtcatgtcgncaacncgacagcgagcgcgcgccgcgncgccgagtcgcaggacgcantcncaaaatctagcacgactacccgcgcgcaccngtantatcagacacagcatcacgcacaacgcgacgctcccgcgtcnctgtctccgctgcgcggcggcgcggcgcgagcgagcgcccgcgcgggcgcgccacagaacgtgagactacgcgctgcgcgacgtacgcgacgcgccacgcactcgctccgtcgtacgtctcgcgtctgcagctgaagagtgctncgcacctatcgacactcncacgnctccagtaccaccgcgagcgacgtgcgacgcgtgtaggagcgttatgctctngtnctcnacatgagcatcagactctcacacgcgtctngtctcacacctgacacatcgcgcgtcacatgactctgcagcgctgggtcngtctgacgagcnacagagtagatgagatgag

SEQ ID NO: 11307 - DNA, 569 bp, Homo sapiens
  misc_feature (1)...(569): n = A,T,C or G
gcgcgcgcggcccccgcggagcccgtagggacatccagcgccagaccaagccgagcaacctcccccccatctcgcgcgatccggtgacaaatcaagagcaggcgagaccgccagaggtcgacgcagcgcccgctcgcgtcgggagaggttctcgcgggccggctaaagcgagcccgccctttccatatcagacgtcggtcggacggtgaacacaagcaagtcacgcgggcgcctaggcagccggcggcccccggcgttgttcgacccgggtcggggcggggtggggccgcccccgctcctctnccagagaggggggcggccagggggggcggtcctgggagcctcccgcgcgaaccgtgttaaaaatgggcagtcttcaggactcttttgaccttcttgccatattgctgttgtatgagctgctcacacggtcttgacgctgtatctccacgttagagatctgagaagcagatacgtgagaacttaatgtctttcttgcataaccaatggtttctggaatcagtttcaaacgggtggcctccaaatgctaaaaatttggaactcttttt

SEQ ID NO: 11308 - DNA, 946 bp, Homo sapiens
  misc_feature (1)...(946): n = A,T,C or G
ggaaaagaggatgaaaaanganagggangagatgaggggaagaaagtnaggataggaaaggnnaaaagnaagaganttttnaggaaatannnagggnggaagttttttaagaagttggagttaganaagagagagttaaggaagtnaataaagagtaagagaaagaagggaagtagagagtaaatgaaagantcgnnattgatatgtgtctagaggtacacacagtatatgtnaagcaccacacgggaaactagaggataacaactaactaccactacattcactatgcaacgcccttgccgcctcttgccgcctccccgccacggtcggtgctatccttcgtgacgtgttgaatattgtgtatgttttattaatcgccgtctggttttcattttttgtatcctgatcccagccacgtcccgcggtcgaccgcccgcggaggttttatctgttgtttcntcgatgtagtggtgcgggctagtgtgcagtnagagtgtnattgttataaaagagtactcatttagttccctctaagcgcatccaacaccgcacccgcacgatctctccctgatgctgcctttcttctcttctgccccgctcccccccctcccaccgccgccccagtcccctctttattcattaccgctctcacctgacatgtcacctcccccccctcacagcataagtggcccccctcgcgagtttccctctctccctcgcccttaattgaatcttcccaatccatgaggcgcctcggcgcccgctactgtagatccacctccccccgcgaccgcatccactgtctaattcanccaacactaacagccaccagcactatgagttatatactacatcctctactgccaccatgccatactcacatataaatacttgtcgtataacgtcctcctctcccctctcactcgagacgccgccttcctctgtc

SEQ ID NO: 11309 - DNA, 630 bp, Homo sapiens
  misc_feature (1)...(630): n = A,T,C or G
tgaataataggcgcggtcgaccccaacgcccaccttcacagagagcanaactgatagcagtcgctacgaccaaccaccgtgccatccgccatactcatatttcccacatccacaccccccctaacccctcttttataaatacatacacccggctatacccaaacaccacaatcaataaaataacccctttccctcctaaaaaatatgcaaccttacacatctttctttccttcgnttttttctcctcgcgctgtcttcttttttttggggcgcggggggncgcggggtcggggttggtgtgcgcggctgcgcggcgggcgggggcggccggcggtgggggcgcgcgcggcagcgatggtgcgtcgtgctctcttccgcccccaccnccctccgcgccctcgtgtctccccgtcggggttgtcggcgctgtggggggcggggcggtcggcgcggcgcggggtgggcgcgtcgcgggaggcggcggcgccgccggacgctccgcggcggcggcgcggggggggctccgcgggctttaccgtcccatccactcatntgttcttcttttctactcccccctataccacaaaaaattaaaaaatatttcggggggcgcggacatattagagtggg

SEQ ID NO: 11310 - DNA, 128 bp, Homo sapiens
cattgttaaactcggagatttgctgttgttgctcagatcaatatccagttcgtggggtgaggacgagggtaacaaaggggaccctcctcattacaccggtaccagttttttaaatcatccgaaattaa

SEQ ID NO: 11311 - DNA, 1611 bp, Homo sapiens
  misc_feature (1)...(1611): n = A,T,C or G
atagctgtcacaatgcactatctcaattcagaacaatcatcntattacacactgacacatacgatantagagaaacacatactanttgaatcgatcgcgctanaagtagatatgtagacaccgacacttatcacatactacatatctactcaacatatgattacgtacactatcacacgacttctacatgaatcgtcacgangaacactacgagacaggtgtacgatatanctagtngacatagtgataagtgcaagtgaagacgtgtgaaggtgatcctctactcgaacncatctctcctcacgataatgtcacacgaatntagtanacgatgagacaatcacacaaccgcacatcatctcacnaccgtctctactacacaactattatcaccaagcacgttagcgcacaaacacgctaatatcctactgacaacatactaccagtcgaccacaacgtgtntatcgctactcttgtcactgtcactatccatnaatttctcaattctagatgcacagtcttggtcgtgaggcgagtcgcgtagatacctacatatagttactagaatactagtagctaccacgcatgcgcctacaaccacactacgttcattctctcncaatantataactatcgcgtggatattcttcgattatctgcgctatangctacattcattcagatacatcgcgacacgccttgnttcgtgattatgcttccgactcttatttcttanactattggcagattaatcagataggtagaagtgctgaatactcgcaggcaggaagcgacctncttcagcccacagttcgaatatacacaacattcgacatatcgcgatccctacgactatcactaaatagaaataagacagaaggagtatgtttctgacacagatcatattacgagaaaaacgaatgaacacgtatcagacttaatttgacagtgacaggagcactactaaccacntgtatagacacgacaaacgacgaccacaangcatgatancatatcttatattcnttctctgctctgcgcaagaccaacatatgctactcgnctgccgcgtcctgctactatcacgctatcatccattaggattattatagtatagtaaacaatctacacacgacatanagtcctcagccgacatcataccgactcacagttacacgaacgcaaanatatatcnacgttgatatcagatatnaaattagagtaagccgttacggaacagtagngtcttatagtattantttaaccatctcacgtatctaacgcgtctgctcacctcgccntctgtacgtctntctcgaggtaggcgtgtctgttcggggtnctcctcctccacctcctctcgcccgccggctctgtcgtcgtctctgctctntcgccntcctccccgtgtcgctgcgcgacttctgtgtcgtcggcnncctcgcttgttcggggacgtnnnnngccnnntngncttnntcgtccnnnnnnctanctttngcnnncgcntncnncgcnnnntcncnncctccttttcctctnncaccgctcnttgccgccctcttnnnntnntttcccnnnccccnnccccnaaaannnnnnnnnnncccc

SEQ ID NO: 11312 - DNA, 537 bp, Homo sapiens
gggtgagggcgcggggatgagcctgaggggttcggagctctctggagcccttaccagagcagatgccgatgccatgcattctgtacagcatgcagaatggaacttgtcactataaattccatcttggtgctacttttgctgccttcagtaagttttgtcttgcatgcagaaatacgtccagcagaagagagtcaacaaataggacttatcaatcagaagaaagaatttctaatcgcataagtacattggtcgaggtgacctgattttacgagggtagactctacagtggctgcctcctccatttaacatccaagtcgggcctatgtgatcaaggttggccatgatagtcgaacctacccacacttggttgagtggaacacgagtctctattcttcagacatctacaaacacatattagtctgttattttaacatagtaaggaaattttttgggggtcgaggagcggcgcacccgcgccgcgccccagaggcgcaggagagtgtcgcgccctggcgcaaaggttataaaccgccggct

SEQ ID NO: 11313 - DNA, 742 bp, Homo sapiens
  misc_feature (1)...(742): n = A,T,C or G
cggccgcattatacaactttatatactgtttccccatattatagttttactatatttgatcaaaatgtaactggttagagatttnttttgaacagtgcaagggtgcctttcaagttaggtgttcgggaaacgataagggcataataaacgtatggggtctgctatcaggggaaatgtgaagactttgactctaaaggtaatggcaataatcgtgttgtttttatgggtcacagtattttatgtccatacgtgggtttggagtgtctctatgcagcaatgtaataaggatgtggttttgttaatttttctttcatctttgttcttagtttgttgagaaaattgggtttatttcatctggttgtagtttgccagattttcatcgattttttttttacggttgattttatgtaaactcccagggctttataattttttggaggggaagattaaaaagggtattttcaactgtaccccctcaacacttcaaaaatcctactaataaaaataagaagttaaaatttcattatttcttttttcaacaaataatctcaacttgcaatgtggttatgtcccaataaatgcataataagtcaaaaataccatgtcaaaaatgcatttaatatctccataaactcatcataaagtagaaaacgtaacgtcaaaccatcttttgttatcaacaatttcacagcatcttaaccaggagtagagtctatctcaataaaccacattttttttactc

SEQ ID NO: 11314 - DNA, 1798 bp, Homo sapiens
  misc_feature (1)...(1798): n = A,T,C or G
taaacaatatctaccgatgtcctacaatctcactcagcgacgccccgccaacaagcgcactttctctcatagtgcatctacgcgncgacaggtcatactgtatcctaatatacgttgatgggtctcngcacacaatacgnaaggctcacgatgattnacgtcacacacgcaatagcactaccctcacacagacaacacatatgcaaaccaacgacgcgtctgcgagacgacactctcatcagcgtcgaatcctacaacacttacatacatcatagtcaacttcaatactacgcgtaatacgagtctacatgcgctaccatctttctgctcatccgcagtacgtggcgatcttctccatgcgtctccgtcagactctcngctcacgnctncacgcaccatcgctctctactctctacttcactatgatgagntatgacncatgacacacacactaggcgcacacactagcttctctatctnatgttctctgtccccagactactacacacgcanagctactctgagtagcattccgcgtacnctgaacaatccttatctctcaatgacaccctccatactcacgacgaccaccacgcacccttcgcgaatactctaacgaccatatcgatcctcatccccgtataacgcaccacacactccacattacttctctgacacatanctgatccctatgaccactcagcgantncatttgactacttattacaagcagtattcatactactattactctcaacaccgtcgacgatcacaacatagcattatcgctaacacaatcctcaactcacctagatganagattatgaatgtctgcactacacatccctaactcacaccgnatctnacacatcgactattntacaaancatatgctctcgtgatacgactccaactctcgactcgagactatatagtcagtctctacccatcacacatcgctccaatcntcnagcatacgcgtatcgagtgcacgagtcatctcctctatcactcacgactgcatcactcactactantctcactactgctntctctatcgcacgatctatatntgtcttgcatctctcnatcgatctacatatagcacgcagtacacacgtgtatactgnacactgcgcttcctacntcacatctatcactcgnantntctctacnctatctatatactatctacatgatgactacncntncatacatcnctgactaccacatccatcatacggcacnctggatatactctacaccantcacgcgtgcactactnacacatctctcacgtacaacacatntcgagcgacagtcattattactgantgnctagttctaagctctattgancatcaganatgactnactccattactctacgacccacagcgctagtgatagagaactcgatagagctcgcgatctntcgcgatctagatcgatatatcgtagtccnactacacacagctatcgcgcgaccgctcgcgcgacatcactatgtacagagtcgctgacaactacacatctctatagagtctctcatcgcctatctatgcttacttcttacacacagcatcaatctcgcgcncgccatgcaccatatatacctnatacacacttntatcttacatatacatctcgcgcctcgcgtcacaccgacaccagcagactctcacagtcgtcgcttcaagtacctactctcttcctctaccatatctagacattattatntaatactagtcacacgcatcagtctcacgctgcatatacctatcacaacacactcaat

SEQ ID NO: 11315 - DNA, 895 bp, Homo sapiens
  misc_feature (1)...(895): n = A,T,C or G
ctcaggttacgatacggcctcatgctctgagcccacctgcacccctgcagggagcttcatggaaaccgactcactccngaatgtgcgtttttacgaacggatcaggaggacgggtctcatccacgggcatgtgcccaaacgtaccgatccacaagaccgctgaccatggaaaagaagaacttatggtcaatgaagcccatacatagaaaggaaaaaacacattagctaaacattgtgaaataaggaaaggagaagacagccaaggcaaaaaaaggaagatagagtgagaaccgtattatgtacaggcattttcctcaggtcctcttctagcctgaactcttaagcttgatctggaagatggcttatgtggtctaaccacattgtcatcgcggcactgcctgtgatgacgggttgaaatgtttgtattcacccatgtaaaaagctctagactctaaaatctagatcccaaccctgactctgggttggtggcgacagagggtttatcgagctattattttaataaagaactttgagcatgtgtataggtatatatccgtcctctgacaaatgtgttacaggaaaccatataactgcttaaatggacgcaacatcgagaaactgttcattgagagtgcgagaggacctccgggaacaactgtcttgctttttttggcgcacccataaacctatatgagggctgctggggttcgggactgatgccttaagggaatacagacacacggaaggtagcggtgaggtgccctgcggttttcctgtcgcgatattcgaagctttgaaaggctgtaccccgacttcgaatgggagtatggggggcgacatcaggggcgaggaggtgtctggacacacaaaggagaatgggccagggccggcgggg

SEQ ID NO: 11316 - DNA, 1211 bp, Homo sapiens
  misc_feature (1)...(1211): n = A,T,C or G
ctctcgctgtcggcctgtcgctgccctcgcgcacggtgcgttattccgcctcacggctccctcgtttccgtcgttggcgtgtctctcttctncgtgtgtgtccgcctgcgtgggcgcgtttcggcgtcgtgtgattgtttctccttccttttccgccatctccgcggtcttcgctgtcgcgctgctgtcgtgttctccctcctgtgcgtcgtccgcttttgtgcgagcgtgtgtcgtgttctcgattggcgttcgctcgtcgcggcgtctcgtgctgtcgtgtctcgncgtagccgctgtttgtggtctctgctgtgacgccttcatcgtcgctgtgcgctgtgtctgtcgttcttctatttgccctccttctgtgccgctctgtggtctccgcgcgtcttcgtgtgtgtgcgtacacgcgcggcgcgatgcgtgcgtgcgtcgtctgacgtttgtcttgtgtcccgtccctggtgtggttgtctctacttctctctgtatgtctgagcgtctnctcggttcgttgccggcgtgtgttttctctcgtcgtcgtctgtgcgcttcctctcgtcgttcgatgtgcgctcgttgtctccgtcgtacgtctngctcgtatttctcggtcttgtgctctggttttagtttggtgtgcgtgcgcgtcggcgggtctccgtgcgcccttgtctctttgtgtgcgtagcgttcctcgccctctggtgacgcgcgtgcgctcctctgtctgctcccgctctctgttctggtctccctctctcttccttgttggtctgtcctgttttgtttcggttgtgtttgtgtccgcttccgcgctcccgcggtgttggtgttgtgtccctgttttgttttgctgttgccggctgccagaacaacgctctcgcctgtttgtttttttgtcctttctcttcttcgcgctcacgcggggggtcgttgctgtgcctctcttctgccgcgtgcctccggcggcgcggttctggggctttttgttgcttatggggcgcgtttcgtcggcggtcgcggccgcgctcctgtcgttggctactgcgcttgggtgtggtcttcgtcccgggcttgacaagtgtttcagcttcttcttcggtggtcggcgtgttgtgcgttttgccgccgtaaggcggtggntgctcgttcgcacagcgaggttcttgtttcgtgtggcgtcaatccggccgcgcgtt

SEQ ID NO: 11317 - DNA, 1589 bp, Homo sapiens
  misc_feature (1)...(1589): n = A,T,C or G
gagatgattgtcatcgtatgtgtcagtagngnacgtcatacacagtatgtatatgactaatactactaacactacataccacatacggtgagcacgcaatagaagtctcgcacgatcgaataatcatactagatgcgcggtccagtgcctcgtgtgtcccgcgcgagtatcttcactgttcacacctcgtacgacacgcattctctannctcactcaactacgatagaatgacgtagcgcgactgtntatgttgtacacaattgggcgaggtacgaggaccgcgataggtgagagacgtagtagatactgagacgtcttgtaattaggagaagcttcgatgaccatgcgtactcgaacatatagtacactactgcacatcgcaactatctagttagtcacgacgcaccacacacacgatantattaactggagtacgcattatacgtacgntgtccacacgtgtgtgccgcctcccacatgcaccgngcgcgtcctggtgtaacgtgtcggggcagcctacccgccacatanngcgagtaagtganaagacggcgcgcgactcacgacatcctcgtaatgtatagtcttatatttatctccaacaaccaatagagtacatantaagtgacctatatcngctcgcgtcgacgcgcgcaagacaagtagcgtggcgacgtgtggagtgagtggccgtcgccgtacctcacacgaggttcttaggccatctgcggaacacaatattaccatcgtatgtttgtgcgggcgcgaaaatacaccattgcggctacgaccctcatgtgtattattatccatatcaacacacagtnccactactcccgctctcgcgactagagtatgactgtagagcatcatagctacaccttgatgatgcagcttgatattcagcactagggcgtgtcactgtagcgtgtaagattgtaactctcactatnaattcgtacgtggaggatactcactggttagagtgtatgcgcgcgcgcgagagggtggtggtgaatcnccccacacaacccaagatgcacagcgttcgtaggtgaatgggtggccgaagatagtatagtgtcgtgtggtgccgcatcgcgcggcatataccacgnaaggaaggcgnngagaatgtgcagatgataccccctcttctgtntattgtctctcctctcaatataaattgcatatccattgaatggagtatcgctcttaccccttctatgtgtgtcctacgatctctcgcatgataggaagtctgcgaggcaacgctcgttagaagtggtcattagagcacaacttctgatcaagtgcccgctggtatngaacacgaggtgtncgtggtgccgtgcaatataatatcgcaactaaagactgtttcccttacttacttcantatactattaataatctactactgatatttataagagtcggaaacgaacaatcgcgcacacaagaatatgcgacctatcgtgagaaccctatcatagcgcgtggatagctgtgttaaccacgcacagaaggtcccgtgnggcctcacacatgggatactatcatcactatcatgncttctttgtgttac

SEQ ID NO: 11318 - DNA, 1857 bp, Homo sapiens
  misc_feature (1)...(1857): n = A,T,C or G
agtagtanttcgtncgtatctcagtcacggatttgtagagtactcacgcgtgactcntctgtcntaatacncacactgcgctagcacatcatcactgctngtactagcctgtagtacgttcgtgtgtngacttacgcgttgctatctcacacgatagttgttgagatagatctaatgatatgtcagngcgtgttagcgatacgttccagacacatcagatcgctagatactcntatnttcgatganatagagtgagagtgatcatagcgttgagcagagtgnatgaagtgangnaagcagtgacagtgggatacacgacgtagcgagngtagctcgtgcgcnatgatgngcgacacgtgtcgacgntatgtattagtgcatgagatcgtgtagtgtgtgangagggacatatgtagtatggcgaagaacatgatatgngcngacatgtgcgtatctgtctctatgangttcgttagttcgttgtatctactctctacgcctactcaacatgagctcctcaacanactcatatcncactantttacaaccactatantcacactcanacgactgatagacangnacgcggtcgtangnttatatgaatcgaacagtgcacnctcgtgtcctctcttagccatcgnactacatcaataacacatncacgacacatactcanatcgccangtcttctcatacgatnatataaagttacgcgtcgacatacgatagctattctcgcacganattcacattatcacataatataagtatgtatactgcacgatgactcgatangantncacgtcttgtgattactncttcttcttatgatagacgccatcatgcttagtcatatagtctagttcctgntgtttgactggtggggagcgatagcgtgtgggatgagtacgctagtgtggcggagactccgcgaggacgaganaacatngtcgnaggangagtcatgcgcagagatgcgtgtgttgtacaacgcaatantatcagtcaccgangancatnttacgatagcatcatcgtgtgtattctactattctgtaanattgagtacanaaattacagtgagtgaatgtctagactatgacgagnggtggtgagctcgtcatatagacgctgcgtgggcagagcgtgcgtattatatgtggattatactacnatgtcngcgggtagctgcgnatctcagnatatnaacttcanaccaccgncgcncgcgacgcatnacatatacaactcatcactcaatatactacttccacacctcattatgtataanttatcattcgcttcgtatanagttanttncgtcgcgtatcgactataagtagatgcctcgtcagtgttctcgcgtgatttctagtgtntttatgaggaggnagcgtgtgagatgcgagatacatatcgcgtgtagntcgagtgcangatngtgagtcgagcgcgcgagagaggctgcgcangtgcgagtagcgcagtgctatgtgtatttcgctgctctgncgancgtnanntcgcgcggtntgcctgccatgggcgtncgtcngtcgctgcgtcccgtatcttgnnntngctccccgctncgcccncnacgccctctcgcctcccgtctcgcagtacgccgccgcggccncgccccgtgtcgggcnccnctncnggcgggcncnannnnnnnnncnggcccnnnnncnnnnnnnncncnnnnnnnnncnnnngcnncncggtnnncnnnnnnntnnntngtnnnncnnnnnannttncnncgnacncnnnntcncntnnccccacccccttttnnnnnnnnnnnnnnnnnnnnnnnnnnnnnnnnnnnnnnnnnnnnntttt

SEQ ID NO: 11319 - DNA, 890 bp, Homo sapiens
ctcagactacaaaaatgatgtcagtcaaaaagcaaataaagcaaattcaaaagattttcctatttgagtgcaaaatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacaacgaccaactaagaccaatcatggaagctgatcctcttacaactacacaagaagttgcctaagaactcaatgctcaccattctacagttgcctgggatttgaagcaaattggaaaggcgaaaaaacttcattacgtggatgcctcatgagcttagcgaaaatttaaacatctcaagtttcgaagtggccatctctcctatgtacaccacaatgaagaacatctcttgggcggatcgggaactgcaccaaatacggctttatacacacctcgtaaccacagctccaccggctggcaccaacaacaagttcctaactactgctcacagcgcacttgtaccccacaaaaggcatggtgaccgctgccggtcctcgtgtcgccttgaaatcattgttgattggtaatcccccgcccgaccatctcctcttacacgtctcgatacgcactcgatacctaccaaccgctccccgctatcccgctccagtctcaggagccaacaccgcatgctatctctccacgccccaccccagctatcgattcgacagttgacacattgtccataaatgtctgctcatccccaaggggcctgtacggtcgatctgactcgcgattttttctctcccgcgtcctcccagaaagtctctaccacccccctcgcg

SEQ ID NO: 11320 - DNA, 1372 bp, Homo sapiens
  misc_feature (1)...(1372): n = A,T,C or G
tcctcactactgtgcatcgtctcgtgngaattcatctacaaggatacatatatatatntaattactaattatgtgtgattgtgctaggatcttgatcaactaggtagagtcgatacataggaaggcgctgagctctcacccgcgactcatatattcgacacttggcatgtcactttaactgcctcgnganactctcgtggacgttaatgaggacgattcgcatacgcctgcgtcgcgcgacgtagaacaacgcccatggtaacatcgcaggcactgagcaaccacaaagaaagatgtaaactacgtaacgagagggctgtatattganngttttagtctgtcttgtatcgtatgaatgtttcatatgatggagtcatagagaatatacacgagccactactcgtgctctgctcacactccgaagangaattgtcgtagtggtcagcctcgtcgtcttcgtgttctacgtgctggatctcatnacgagatggggtggtacggcaccgcgtcctgcggctggtgcattcagaagccgtcccaacactcaactcaagctgagtcgccaaaccagttaagaattacagagagtacatctatagacgtattcaccttcttggtcgtgtcgtagtcatacgagtggtgtnnncatcacgaacatcttctatatcatngcgcacagtttctgagttgagatagctctcacagacagtaagaaaagaagaggatagtgtgagggtaagaaattagagtatgagaganggaaaatagtagggggtgtgttagtgtgtacaggagagtgtagagcgacatcgacacggcgctctcgaacaataggcggcgacaacgaatataaatataacacgcgncttctctatcttnnnnacaccctcctccncaacacactccacacactacctcccacanctnnnnaacacacaactaaccacctctcgcctccaaccttacggannaacaacagcctctgaatttgcttgacagtgggtgagtaatttgnnntnnactacttacaaaggagataacagtgactgatggnccctctacaccaccatagatnannaaattacagactcgccaagnnctcttctatcatantnncnccttactctnccctcctctcttnnccannnnncntctncctctctcnnnnncccctcctcccnnccnnncnnnnnnnnaccactnnnnncctctcttcactttnnnnnaactctctcacnnnncttncctnnnnnnnnccctccnnnactnncacacatnacnctacnccctccnnccnactatataaanaataccacaccattnacacaaatacacaccttcctctctnacaacantacctatctataatacc

SEQ ID NO: 11321 - DNA, 1728 bp, Homo sapiens
  misc_feature (1)...(1728): n = A,T,C or G
atctatanaccgtatacttacgtactcgagtatagtangngacgtnaacactgctctgcgtagattagtagcgccaggtgggacgcgtgcgactgagagcgagatgtcgcgcgcggntgtnnntnngctgtgtcagantacgttactacgctcgtcgttctaatagantaatacaagacatgtcntgataggctcgctatcggnactctgtagtgctgtcatgtgcgcgatcagtatcagtgtanaccacgacatagtctacatcatntggcccttcgcgtcagnggncaccacatatcgtgagtgactgcatcacctatctgtccgtctcgaccggccgtcatgagtcacnttacgtaaggnagagagacgtctgtctgtacgctatggttcttcgcttgtatacaacacgatantctcgacgatatggtcgctcgacgattatggngacgacgaaggtagcagatgcgtctcagtaggggcagtagacgttgagcgcgggggggggggngnnagtnnanggtaccacatccactcgggtacgcatcgagctatggcgctagacacacagtttatgtaggccgcgtacctcatcgtcagtcaatggtncctccgtcgctcgcanacactatagnnccgattacgctgtgtgaggcggtgaacatgatgtctacatgggatgagananctatgtgaacagtatgctggagaatgaaatcacaaacactaacgttnggagctcagcgcaccatcttagaaacaagcctcaggcggccgcactgatactcgtgntgcgtcgttgtggtgtgaggtgagnagtgatgtctactatagtatactgtggcgcgctgngggctccatgcacgctggctacgtatcactcgtgactgantcgagtagtagaagctcgagacgacaatagacgaacgcgcaagctcgccacaacanangaagcttatggtgagagattgcagtataataacatctgatcatgtggacgtctaatagtagggnngcgcgtctagtggtngaggcagtcgacgtcgctcgaacgagtctgcactgagaaatactgcctacttctctgtcnatcattnnncntcngtgctcatgtntatntatntatcatnattatatnnnttctcatcattatatanacaatnaaactattatanatctaacatctcnctcaactccatactccnnnngannnanaatctagacaccctacaanaatcagtctaacaccgccaatctagaagngngnaagttatatacctacttatctcactgcgagtcggaccgcgcgccccactgcttctgctncnacatctagacgtgcgtgagcggacacgcgtagannnactcttacattacttcgtgtagaggtnanangaagagtgcncganagnnnacnatactccttcatcnccnnaactacctctncactccctccttccnnntncnannnnctcttctccctctcannnnnnnccctctctctacntcnnntctncnncnnncannnccactcnntnnncctcctctcaacactcnntnnncacacatnantancancccactatattnncncncccactactnncacttccccacataatntattatnaatcactattaactnaaaacaataaaacacaataacacataaataaaatacacacaaatanaaatattaancacacttnatcatctattcacaacatc

SEQ ID NO: 11322 - DNA, 1065 bp, Homo sapiens
  misc_feature (1)...(1065): n = A,T,C or G
cgaacacgggcggccgcggcccgacagcacagagcagttccaggcgaactccttcctgaggactgatacaggccaacttcttctgcctagatgaatcaaacccagcctgcccaacgaaaatgtggcagagcttctcggaaactcaaatgcccatcggcctgaggaaaacttttccattcaacaagttggggttgcgtcgtggatcgtcatcactacggcggccgctcgctaggagatgcactgctctcgccatatcgcgctcgcggtgcatggatctcgcggggggtcgtcggtcctgcggggggactcccgggccatccgccggcgcgaagctcgcnccgctcgcgcgcggcccccgacggccagcacgcgagccggcggggccgcgcgcgtcgcgcccgagggtccgcgggggggccgggcgcagcagcacccgcccctagcgcccgcgtgcggcggggccgcgagaggggggcgaagctggccccggcccgcccgcggcacgcgccgcgggcggtcgatgcccccccccgccgcgggcggggcggcggcgcccgcggcggccccgggggcggccggccgcgcgccccgtgccgcgccccggcgcgcatggtggcgcgtctgggggtggcgcgggtcgccgcgcgcgagcgtcgcccccgctaggcgcggcggggtagaggggctcgcgtcgccgcgagtgggacgggccgccccgcgcggcagcgaccgcgggacggcccacacggggcggacgcgggggagcccggggcggaggggcgncgcgcgcccggcgtgggccgtgggggccggcgccgcataggcggcggccctgccggcgcacgcccgccgaccggaggtgccgcccgggccggcgaggagcgcggggccgccggggactggcgccggcgccggcgccgcgccccggcggagacgccccgcgctgcacggtcggcgcggcgaggcgccgcggccggcgccgcgcgcgcgccgcggacggctgcacagcggctcgttggcggctcggcccagggcccccgcggggcagcgggcgcgcggcgcgcg

SEQ ID NO: 11323 - DNA, 959 bp, Homo sapiens
  misc_feature (1)...(959): n = A,T,C or G
atncttcaatagttatgtgtcggtccgacatgagcgtcttgtgatcatggtaactctcagtcggtggtgtgggcgaaaagaggccttccattaggagatggttatgaggcccactcaccacattcagagcacgtaagcgagaaatattcatgatatgaggtcggacattatgcggccaggtctgagccgttggaattcagaacaatgaaatgcactagtcatcagacagaggtagtttatgggttcactccctgcgaggacatggccccgatagcaactgtagaggatacactgaggccaggggagnccgctgtggccccagttgcatgccgttgcgtgcacaagcgcgaaaacttttataatatcacccgatcccctttaccgggataagaggggaaagatgtcacaccttttcccagagtgatggcgtctaaacaataaccgccagaggcgaggctttgtgggaccaacatactgtgacctcacctccggtcactgaaacattgagctgttaaaggaaagacctctgaataagtcgtgggagccctcgggtcctgcagaccacaagggaggaggcgactgatgttcactttggaaacgcgggcttatgattgcacccttgccccaggccccgtgaactccaggaaaggatcttccaggggcacagacaccagaacaaaatacttgtttgtcttcaagacttcagggtcttcagcatgttcaaacccacaggtgccttcggggaccaagaggcagagagatgggaggagcggttgggtggggcccgggcagagcggaggacacaggtgtgaacttgtgcgcagccgctgctccctccggccagccgtggccaagtggacattcggacccagagcggccagatcttgtaatttccaagaaagccagaaacccagatttttatataaaatttctgaaatgttaaaaaaaaaaaaaaaaaa

SEQ ID NO: 11324 - DNA, 1560 bp, Homo sapiens
  misc_feature (1)...(1560): n = A,T,C or G
cntntgaccacctatcatactatcacatatatcgagcatccactcgctctgttanccgncgtacgagtgccacgactgctcgcgtcacattactatcgtactatcaaggatatgagtgcacattacatgacagcaagctcantgtctctgatggtcgnancgnacgtgagatgatctctcgcatcagtgtgctcgcgtcgcatnctctcgtctctacatncgntatcggtcgacgcgtgcnctcgtctatgtatcatagcgtactncatacgntgactctnggcgacgtcgtcggacgagcgagttgatatcactgcatatcatgcactgtctcgtgctctcatacatgtacggtgtgatcactcaatagactanttcgctcagacactataagacgacgtatatcgcagatcgtntcatagtgatacgctacatctcgcgtgtaacacattcacgacgcgatatngcaacatgtgtgttcactctgtcgtatcatactattcactntacatctctctctantacaccntactctcnatctcactntgacatctgtcatcacttctacnactatactctgatcctcatgctgcgctgcatgtctctcgcggcgcgccacgcgtgctcgtntcacatcgcgtactcgcgancatatngcgacccacacgtgagcgttcgcgtcactcacgtatcatctcttcctgntatacgccgctatagcgtatacttcttnactcatgntgtatagatatacanactcanantatacgctcgtacctcacctctacatctctcatttgacctctcgctctaactaancccatcgctacactcgcgcgcctctgcgccagagcaacagcacgacaggcgactaacagntctgagtgagcntactacgtgcgtacatcattcatatcantaacatatcggctccctgcgtcccttcaagttgnccgtcggcggtcacgcgcgcgtcgcaaggcggcggagtatgtgtgatgttcctctgtctcacttggcagcacgtgtactcgccgatatgaaatcncctgcatttctgtaacggactaactaattactactttttttcacccctgtccttctattctagcatataaataattacccgacggccgatacatactacatcataccctctggtccgtcgtatactcccacttacncatcatccccatctgaaaaatcacanaatncagtanaacgacgggactcactatcccgccgcagattacgcagactcccaaccctacccaccaccctcacaactatgaatattgttactcaaccacattagtcggctggtactgcgctagtgaaggcgctggagcggtgtgagcgtcgtttcccccggcccggtcccccgcctcccctcggtacttctcccgctcctcggtacctctcgcccacgccttccgctcccggttcttccccgtnttcncnttnnttgtatgnttnntattngnnnccgcnnncncgttcntccctttcctccttcactctctcttncnnnnccttttnaatttaattttnnnnnntttt

SEQ ID NO: 11325 - DNA, 1127 bp, Homo sapiens
  misc_feature (1)...(1127): n = A,T,C or G
tttttttaaagtaataattattannantatattatatgnaatattnnaatatgttcttattaaatatataacttttattactgttattaaacatatagtaatgtttagattgtattaatatacaagagatgtgaatgaaatattgatattgagtatatttattgtatagttattggtttatataaagagagaaatagtaagtaaaaaagaaagttaatgataanatacagtatcaaaaattaatatgagagtaaaaagnnaagaaaccagataanaaagaaaacataataacactggttgccttttctcgtctttgtttttttttttgttttttgtagaattttataaagatgccttatctatgtnattattgtaatacggtaaatcataatacaaaaatcaatacaaaataataatccnccaaacaaaccaccaaaaaaaactaacaaccaccccagttaagacggacaacaacataccaccaccaccagatccacaatccttaccccgcgcacaacccagcagaacactctatagtctcaagacccctcnccaaacctactctcttccccttcctcgtctcccccntctcatcctctctcccacctcccctcctacacccatatatcacacctcatctagccttacctatccaacaatgaccttatattatagatttccaagncttcgatcattctaaacagacagttaatttcactataaactttcgtttaataantcattatacgagtactatacagaatataagcgttgatcatgtcatgagaaacgacaatcaatctctaaacacatagtcacaacatacctgtgtaacctattgcgcccagagacccacgctcaccaccccccatatcacctanactagtcttccactccactccctcctacatctcaatactctcaaattatgatctctcctcactatctcgttcctttgcctccgtctgactcccaatcacccaatcgctcatattagttttccttatattttcaccactaccacacccattagactacccctatgtttttcgattatacaaacatctaaccataccaaaggaatatttagactcagtcctatcaatgagagcccaacaatatgaatt

SEQ ID NO: 11326 - DNA, 872 bp, Homo sapiens
  misc_feature (1)...(872): n = A,T,C or G
ttgtaggctacacncctctacaatgctggtgggaaatatcggcgaggagaaagatccaagttatatcacatatgtaacccgaaggtgtagtctcgctctgtcatccaggctggagtgcagtggggtgatctcagctgactgaaacctctacctctgaggtgtcaggcctctgagcccaagctaagcttgtggatccctgtgacatgcagatatacgttcagatgagactagactcttatgaagaaggagaaagcaacggaaaatggcgcgtcggctggcttaactggtggacgtgcgcttggtaaattcattgtactggcgaagaagctatcagcctaggagcgattagaacacccaccggcggggggagaggagcggcgggatttaggtggggctctcattagacggccggatcgcgtagaaaaggcgccacgcattattgcctaggagggactgattacgagagagagcgtagagaggagaagtaagatcgggtgccagagaagcgaaggtatatagagcggatgaaggggaggggagcgagagatacaaagagtgaaggtcggccgctaaggtcaggagatcgcccgcgaatagaaggtagggcacaatatgtgagggagtgtgagaaggggcagcgacagcgccgggtggggggggggaggcggccgtatacaagggtagaactgccagagagagtgatagcgcgggatagattgcaggagcggaggaggtgcggccggcggtcggtacctagagcgcagagcgcggaagggtggaggggcggcggtccgaggacgcgagggggagggcgcgacaggcggagacagtgaggagggagaaggtgaggtagaggaggcgccgaggcaggt

SEQ ID NO: 11327 - DNA, 1172 bp, Homo sapiens
  misc_feature (1)...(1172): n = A,T,C or G
agaacaacaagacacagcacacaccacgcgnctcgaggatccgcaggggagagaatgtgctaaaatcgctgcagaaggaatttggagttgactttcggaagaattttcttgctaataatagttgagagtgcttggagaaacctcacaagaactgagctattagggctttcggctactttgagccatatgacatgagcacgattactcgtacacttacctcgatgcctgtgcgatacatgtggagagcgtagatacttatgtaccagataagattatatctccacatagcagcgaaagacaataatgagcgcgatggggcgctaaccgtagactacacctatagcggatagtcttcgtgcgaacgagacgagagtaacgagatacaacactatcggaacatatatacagagtgagatagcacccgatccaacgtggccgaccaacatatatgtatcgacactagtcacacactatcgaagacgtgtaattcataaagtatatatacccctcgcaaccccctcaccttttattgatacagatgttgttgactccaccacctgatgcgtagaacggacagcgaacggcccatagccgacactgggactcagctctcgctgagacacaacgcacagcaccagcacgccccaggattcggcgaataatacgctccgtgcgagcaagactatataagagtcaccactgtagagcccagaaagaagtgagaagagatgatcgaggtggatgataagaagagataatcgtagcccnaccgccgacaagcgaaacccacaggatggtcgacgctgatgggcacatgaagtgatgcgaacccagccagcagccgcttggaataaagacgtaggtacagggcagtacagcaagtgttgctccgtagcattcacaacgacgaagaataagtgccgtcctactcgtcaccgatggattagacggacgcatatnaataatagcagacctgcggagctgacgccgaagaggacgattatcgctcacgacctcgatggacgagtgacaatcgtataagatatgcagtcgctccataggcgccggaggcgaaacatgagngctagtcgcaggattaggtggagtgagccgccgagcaggcggcgccgccgacatagtaatattaggactacgagcaggacctcaccgag

SEQ ID NO: 11328 - DNA, 513 bp, Homo sapiens
  misc_feature (1)...(513): n = A,T,C or G
ctccacctctaacaattcgttggaaattttggcgaggagaaagatccaagttatatcacatatgtaacccgaaggtggagtctcgctctgtcatccaggctggagtgcagtggggtgatctcagctgactgtaacctctgcctctcaggtgtcaggcctctgagcccaagctaagccatcgtatccctgtgacctgcgcgtatacatccagatggcctgaagcaaatgaagaatcacaaaagaagtgaaaatggccagttcctgccttaactgatgacattaccttgtgaaattccttctcctggctcagaagctcccaccatnngcaccttgtgactcccacccctgcccgccgaagaacaaccccctttgactgtaattttccattacctacccaaatcctacaaaatggccccacccctatctcccttcgctggctctcttttcagactcagcttgcctgcacccaggtgaaataaacagacttgttgctcacaaaaaaaaaaaaaaaaa

SEQ ID NO: 11329 - DNA, 999 bp, Homo sapiens
  misc_feature (1)...(999): n = A,T,C or G
cgttaagggaaacggcgcttactctctgctcggacgagacgcactaactatacgagcgctggaggtgtcaacgcacgagaggcgcatgcaagtggctgtggacgtactctgcacgccgaagagggtacgtactccgtagtccggagcggtatcaaggtcagggtgctaacaacaccaaaaactcaaactgactcacgtgcagcacgctacacacacactaaccaccgaccatgaatgggaccacgcatcactgccactcatatcttcaataggtgatcgctatatttctctatgagtgccataagtgtacgttcttatgaacacaacacacgagaccacgttcgcccgttcgaccacacacctgtccctattccgctgggcaccgcgacgatacagtcggtaccccgtccgcgccatcaccctacatcccagcggcggcatccgcctgccttttgagtcggctcctggctgttgggccggccccggtaacaactttatcctcgacgcccacgacccaccctacgattctcactatatatctcatctcgcctctcacccttaccgcccaaattagtatcaaatcatgacaccaaccaccaaccaaacgatcccaaaacgtcaacggattgaatcaacccccgtcatctacccaaaagccacgccacaatccacataataaaaagattaaatatagaacgggcaatatataccaattctacattgttgagggcatagggccggcacaaccggccctccaggcagtgtacgccgtctttgctcgtgcggcacgccagtgggctacattccccatagccttacgtctgctggcgggtggtcgggcgcccggcgcacgcccgtggggtggagggggagggggggcagggcctcgccgcccgccgccaccgcgcggcagcccgggtcgcgcgccacacccgcgtctngtnaaaatcttacatgcccgcactgacctcttcttntatcttctatccccccatcttt

SEQ ID NO: 11330 - DNA, 518 bp, Homo sapiens
cttaggtgtatacggtgagacattatgtctttggtccatggcaaccgatcattattgtacccgtgcctggcagagaaaggaagatggagctaccatcttgaccatgtctagtccttagttcctgccagcattcactgtcaggcctctgagcccaagtgaagccatcatatcccctgtggcctgcacgtacacatccagatggccggttcctgccttaactgatgacattccaccacaaaagaagtgaaaatggcctgttcctgccttaactgatgacattgtcttgtgaaattccttctcctggctcatcctggctcaaaatctcccctactgagcaccttgtaacccccgactctgcccaccagagaacccccatttgactgtaattttccattaccttcccaaatcttataaaacggccccacccctatctccctttgctgactctcttttcggactcagcctacctgcacccaggtgaaataaacagccttgctgctcacacaaaaaaaaaaaaa

SEQ ID NO: 11331 - DNA, 1552 bp, Homo sapiens
  misc_feature (1)...(1552): n = A,T,C or G
tatgtctcttatcaacattgtgcgatgactgggagagagacgaagctgcgcgcgcttgtgatcacatcgtagaacagaatctctatgttacgcttatcgtgtacattaaattatagtcacgtaccgtcaggcatactacgtcgacgttatgagctcttataataccttctccatgctcgacaattccgccgcgccacgcacacgtctccgactgtagtangacctgaggcttaattgatatacgtacctacgacgttnctacacactcaacttcatatcattctctcacgatctagataatgtcgcatactcgtcttgtgcgtgcatggatcgtgtgcacgttcgctaatagtgttagtcaccggcgctccnactagtcagttangtatactatgatgtgtgttatgttagtcgatcgtcatctcacctaatnacttaggtctatacattgtctagagtctgagtaacanagaggtcacgtactatctctcaacnctacctgcttcacaggactctatgtagagtaccgataggcgaacacgattgccgactcgtatatatgctgacgtctcgtgtntagtataccgnacgcagtgtactagtntcttctcgtatattcgtctcgtgantctctgtcactctanctagtgactcagtcgcagccgtcatgaggatgtcnacantatatccatgcacctnccgctcgtatcgcacatngctctcntaatgtatcgtgtgcatngcgctgtagtatgtgccaggagcnccacaacgacgtaatcgagnacgttcgcatatcatgtcgtttcagtctcagcatgngtgtacacgacgtagcnacgactaaccgcgtgntntagttatgactactcacctcaccagcgttaaaagttgtgcgtactngactccgacggctagtcnatgctcccacganctacgcagtaggcggcactgtgtagagagatgactgcttctcgtcgacctgcattctacgngacgtatgatantctcangtagtattcgctatagctgaccgcntgacgcanatatctacgagacgatatgcacaagtgagctgctccctcacgacatactctctcgtctatatattgtatatgcggcgcgctctccgcactacgacacgcgtgtgcacctgcgctgactcgtcactctgctccttatctactcntgtagcgtgctatgctctatccacgtgtatactcgcgtctcatctcgtactctnatctatgtaacctatatttctatcttatctgatacanatactcatgactcgcatactgtatactatatcgtncgcgtcttcacgcgtgcctcgntcacgttaagacgatcgtcgctcgcgagtgtccactctcattcgtactctaccgccaggtactcactccgctgctcgtagagaggagatgaatagtgtgagaggagcgaagtgagcacatgtagtacgtcacacgtgtcgaccntcgcacaacatgtatattatatagtatgtatnttacagcacgacgnagatgtagccgtgactacgcacgat

SEQ ID NO: 11332 - DNA, 943 bp, Homo sapiens
tccacaatcccacccacactccagcagaagaaagaggcctcaaggaaatcgacaagctgatcatgctattcacatcggaaatacaacccaaaatagccaaaacaatcttgaagaggaagaacaaagttggaagaggcatagttcctgatttcaaaacctaccagaaaactacagtaatcacgacataaggcataaggatacacatatagatgaatggaatagacttgagagactaaaaataaaccctcacattggtattgaattgaatttctgaagagtgccaagacaattcgatcgggaaagaaccgttttttcaacaaactgtgctgggtcaaccggatacctgccttaaaaatgaactcaactctcacactatccaaaaaaacaaccgacttcctcacccacgattatagccctaaccgcctgaattacaacttaacgcccctatccaccgactatagtgtagtgctcatgactcttgattcactcaaacacggtattagagatgcgcatcctcaacacgaacctgcacctgtcccttctctattcgcgcttcacgttcactaccctactcgtacccacaaacccgctttcccccccccccataaatatcgcaatacccgcctccactctctacccaacaagctcatgtacaaaacgccatccccacgatctaccccctctctctattactctccaattcacggccactcctgccacaccattcggccatctcctctaggtcgtcaaaaccgacccgctattagtactctatacacactcacaagacgaacgaagcacacgtacactataccacccatataccccagaactacatctgctcatatcacagggatatagcttcctcatgcccttattccctcttcccgtcacacattacactctcactctcgactcttcatcctccccgtaatcttcagcc

SEQ ID NO: 11333 - DNA, 196 bp, Homo sapiens
ggctcccccatacgatgatggaaagcgctgagcggatagaaatagacccccccctttggtatcgatttaatttcataaggggccaagccaagtggtaagggaaagaccggtttattccaccaaagtgggggggcacgtcggttcctggtcaacaacataaagttggactctcagcgcctatgcaaaaaaaaaaaaa

SEQ ID NO: 11334 - DNA, 357 bp, Homo sapiens
gggatctcctaatatgcaatctcacttctaagaatctgtcttataagaataaaaacaccaggacataatgatattttcaaaaggatattattttaccatgtttcaagacaaggttttgctgtgtcacccaggctgggatgcagtggtgcaatcataaatcactgcaggcttgaactcctgggcttaagctgaagtgcaatggcataatctcggctcaccacaacctccgcctcccaggttcaagtgtttctcctgcctcagcctcctgagtagctgggattacaagcatgcgctaccatgcctggctagacaattttaaaaaaaataaaaactggagttctggcaaaaaaaaaaaaa

SEQ ID NO: 11335 - DNA, 954 bp, Homo sapiens
taaaaattttcttcgctctcccctccacatcaacttcaatactctggaaactatgtgaaagtcgccgtgaacttcagaaatgtacatgctctgcttgtcccactttatacacaggatgatgacatcatagcggccaaccgtcttctgaaacgtgtaatccttctactaacgtcctgactatcttatctctggcaaaccccctccttaaccgagaacattacttttacaacccgctaactgtcataacccccgagaaaaacgctatgataaggcaaccatagcgtctgactctaccccacaactgctctccccccccacggcactaacacaccacctagaggcgtgctcggccccaaccgcccccctgctaccttcccagctatgccacgagtaacaactcaaacacgctaccgcgggacatgcaccgccggccactccacgccatcgcccaccccccctttctcacactgcgcgagccgcagtgacacgccgaccccacgagctcgcgacccgccccctcagcgcatccgcgcagccccgcccatggcaggcgccacgaagagtaggaccccccgcggcctcaacgccacgtctcaatcgtccagccctaacatacccccacggtgtcccggccccaccccccgatcaccccgcaccgcccccccgcaccttcgcgttacgcccccgccatcgggcccgccccatctccttgcacccacagccgcacagtgaggcaaaacgaaacccgaccacacactcgcccacgccagggagcggcgcgagtcgccgctccgttagcgactcccggcgagggtcgacacccgccaccaccgatcgccctggctcgcactgacacacgcgaagcctctcgacacccggacgctcaagcaaacccgcctccacggatgtctcgcctccctgctcggcatgccgccataacacagccaacccacc

SEQ ID NO: 11336 - DNA, 1268 bp, Homo sapiens
  misc_feature (1)...(1268): n = A,T,C or G
ccctcatatcgcccacgatcaaacctctatcagccacagtaccgctttcaaaataacacggattccgtaatcgaccagattatatcttcctcattacctcactatacgttaccaccaaactccttcctgacatatctactattattcttctctgattcttgccgagatcacccacctctcgccctttctactatcatccagtatctacaactatgccctgcgaaccttcacacaacggctctaacacattgacacactcgcacgcaacactcgactattccatactatctttgctatccacataaaatctctaaacttaactcctcatttcgacactatatcataatcactactatccatctaacaatatcctcttcacatctatgtctctaacactatctaacatctcctccgaatactatcaacataacgcattcctctaactactatacaaatcatcactcatatatatctgtagtctcaacttcaactctcttaatctacaattaatagtgtacgtcagaataaaaccaaatcactacacatactacaagacaancgtgttcatacgaagtcgaggagaagaaagaaagtcacgatgcaaacttcngcctcacaccgtaccgtgctcctgccctgctctgctctctcccggcaacccgttccgaagccgccacacacatgtctcgcctcccgaaccacctcctactaccccgtccactacactacctaactcctcatccatgcattatnacatntcttccaccaaaccgtcctcccttcactatatcttataaaacaaacaaactcggtcccaccaataactcctctagatcgccaacatccaactctctttcaccacggacgtgctctatataaaaacctctattatntactctcgtctcctctcactactgcccgtactacccaacttgtctgaaccaccaatagcgatacatagagaacgtaataactataacatactatatattctcgttcgactacacttgtatgaaaatagtgtatactcttaccctattcaccctcacactcatgcttctgtccgcctccttcatcaccgccagacctccgtcaccccgacttcccctcatctgttcctatcatatttctatcgccttattacnctgttgtcccgnntntcncnctnactntctactntnttccnnnncncanntcnttttcntcnttcttnnttccccctcttcttnttnannnntntcctntcttatattnatttncctcttttc

SEQ ID NO: 11337 - DNA, 922 bp, Homo sapiens
ctctacccgacgatcacgacacaccaaaaaaaaaccctcgtgtgaacccataccaagctggtggagactcaaaagatgaagacaaagaaaacatacagaattgtaagccctgcctccccaaggcacagacagagtctcctccgtcttacttgagctccaccaaactcaggaagcgtgcaaatactttcatcctgccagcttcactctggaactttgctttcttggctactatggaagatctaactctagaagtctccatcattttttttggaatgattcatcgcttacctgcgacacccagaaaaaaacaactttcacaattttacacacaactcactgacatgcgtggaaagaaaatggaacacaaggcccaaacctgcgctctgtcattagactgtcggcgcataaagcccacctctgtcactaaccacaaatatctcgtcccgccaactcaagtaccacccctgcgctactacctacctacacgaataaacgcaccccacacccctccttcacgactcccacagccatgtatttgcccccccccctcccacccctcgacttgtctccttgcatcttgctccctcaccccccacccttcccccccacacgacacagaagcttagccacaaccacctcgttcaccaactcacttcgtctgcctagacaacctactaccgtccactttccaacgcctcttcttcacactactccactgaccatccagacatccatcccacaatcgtcaatgagctctccgcgattgctaacacaccgcccctgatccacacccatcccatataaccatcacactatctcaccgccctcatatctctctcctttgcctagcgctcttacacaaatcggacaccgcgcgcctctcctcatcagggacccagcgccccctctcctccgtcccctc

SEQ ID NO: 11338 - DNA, 1302 bp, Homo sapiens
  misc_feature (1)...(1302): n = A,T,C or G
ggatgcggtcgagtgaggagactagcgnggggacggatgcggnnngacgagcgggtagagggnaacaattcgctctgtggcacatggantatgagacgacgaggagaggaggttgggacgntagatgaagtagtganatgatactacgataattaggacatggggatagagatantatgtgtagatgtgngngaataacgactaggnnntaataatggcgtacgtgnagtgatangactcgcatgnagcagtacgaataatagtgaggaaatagtgctcagagcgcagcaggacgcaggcatcgttgganactgagtgtaagacatcgagatagagatgngngtactgatgcacacatatcattnctaaaagtgagcaatatagctctgagtgannagtagatgaagatatgnnacggatgtanatatagtatcgtctagatacaacattgagnnnaactgntagatggnatatganatgtagncatatgtcgtanaaatgaataganccgcgatctngcgcaagcttnnancgacgtgttaaagacgatatggcgancacacgctgancatgnnaatataatgacaaataacatgtnnnaaacgatatactatcatacactcgtgcatggnnnctttcatggaatggtanaactanacgatgtacaagaacacgtagnacattgtacacactaaaataanatgtataaaactaacaagaaggaacatgagtaggatgaataagttaaaactggacatgtaactatganacttaattactgctgttagtcattgnctgtttncctttagtgaacttaatataccgtatgnagnacacaatcatnaactcttcttctnactcttnccttttctncttcgtttcttcttatcttnnctctctnccgatcttttcncttctcctctcatanncccttattctcttncactgatctctatgtncatctantcatnatcgatcttatgtcatctcaatgatntcttaactatgtgtactgtatattctttcatctatatacttcttaacttcccttnnnncctgnttnncatctccccctctctttcctcctcctcccntcncnctctcgnctcgcttcnacttttnncccttctctcnctacctctnccgcttcatnncactctccttctcaccatttctttnccactctcncttncctctccttnctatcttccacatcntcacttccactctncctnncctttcactctctctcntctntctcnncccnctctcttcttcctnnncnncnnttncacactctcc

SEQ ID NO: 11339 - DNA, 953 bp, Homo sapiens
atgatagagagcaatgagaaggcactttgacctccggatttcgacctgcccgcccacaggcttataggaaatttggccttctcctacactctgcaatcagacacccatcctctgccttgtcaggaaggtcctgaattccagcaaaacagctgaacagctgatggcaagcagtttgaagacctccacagaggaaccaaatcagcatgagaatacagtttcttcatctccctcccccatgacttcaccctgcactcttccatcaatcagcagtatgcacactcttaaaaatcctagcccagaactccttggggagacagatttgaggctccctgttatctcctcattgggcagtcctataatggaacttgtttctctgctacaaaaagaaaaaagaaaattggcttcatttcgcctgagagggggtggtttgcggtcgcttaccttaacggagggggtccttgatgagccgtgattcactgactcggtgcgcctcggccgttacagctccggagaaggcgcgcacgatagttcagagggcggaatactgagctccccctaacgtcgctggttattctcccgtgcgctttatgacgaaaatggccccagcgggctcggagactacctaaggggcgggaggagtgagtctttccgataaggacctactgcgatggtacacacagcggtatgtgttagatacatcgatacggagccttgatagatatggtagagagccacggtctatgacttagaaacacgagagaccgtagcgagaaagctgctggggggaagcatcgacgcgtatcgggttggcctattaggaggcgctcgtccgtatgggatacgtcatgcgtgtgatcacagtgccggcacgagtcgccgcctgtcgtgtgtgtccccggcgtagtgccaacgggggctgctggattgctataaggtgcgacgtgccgtggggg

SEQ ID NO: 11340 - DNA, 751 bp, Homo sapiens
  misc_feature (1)...(751): n = A,T,C or G
ctataatcaagcatatatagagatattatggttgtgtgggtggggatatgggcgagagaaattagagacgtcttgggatcttgtaaagaggagaattttatgggatttaaatatatttgtatataattaaaataaataaatcttacatcagtacgttcagctgcattatgtttacataaaggagtggctctaacatctgcatattctaaaatttacaaaagtcgagaaacgacagacacagatgatctggtttatggggaggaggaggaggagggacgcggcaaataaaaaaaagattaggaataggactatgacacatggaaaaaagactggacgatacatttgatacagatgtgactaaaaataaataaaataatagaaataaaatgtataatattttaagtgaagtgggtaggcagaaaagaatatgggatgtgtattgtgtgttatttgtgaggtaatgatgcaggggtataggaaatattgttctgatataccctataaaganaatagggcgtggagtgtggtatcatatgtacgaaagcaatgcgtataataatggatctattacctctaatatatattaagtttaaaggttctcaaaaacatggtagtacccttctccttgctctgcggcctgtcatttcagccccgggttctcccttttgatgctctgaggtgtccttgccttttcagtgctattttatatttttgtcaataaaagaagtatgttaatataaaaaaaaaaaaa

SEQ ID NO: 11341 - DNA, 895 bp, Homo sapiens
ccgtcaatggaacatctgatggagtgttttaaacatcatactactggaactaaactaagagcaaaaaaaataaatatcttatgtgatgcttataattgaggtgctgacggatgactagatggattaatacatacgggggacatatatagtgctacatgtcctgctgggggtgagtatgatttgaggtgactagctagttattaatagttgtccccttctcctaccacttcaaacccacttcatccatctccttccaaatgctcaagagaagacttcacaacaaattcaaagttttcaaaatgattctggattgaaagttctgatgatgctctataaaccaagagtttgcaaactagagccaactcctgcttaccctctgattgcttatatgccccacctaagaatggcttttacattcataaaccccccgccaaatattacaataacaattgtactatttggatacacatcacaatccattatatttaaacttcctctttcttcagtaaacctcactcgaaactaaacatttcacttcattattacagacaaaatcatgttcctatttggcctatcctcgatgattcactctcatatcttcttttgtatagggctattcaatatactatgatatacccaattctactcgtacatctctttttctcaacctcgattcatattccaacacattaatcagtcacctataatcttagtcaaccttagaaagaacacaccccccttccctccctagctctccctatgtattgctttatttttgcactatatttatacaacacttcacaatacacccattgtctcttttataaatcccgtatatcatccccaattcacataacaacctcaaccgcatacacaacactccaataaaatacag

SEQ ID NO: 11342 - DNA, 1004 bp, Homo sapiens
  misc_feature (1)...(1004): n = A,T,C or G
ggcggaggatccccactaaccacactgaaccccngtcacgaggccacgacagcaataattctcaaacttcacagtgcaccagacttagcagtgaaactttctaaaattacggaaagaagcttcagctcctatcccacacctgcagagccagaatctctagggctggacccctgtcgcctgctccttcaataaaccatccacgttacaatcaatcactccacggtctcaacaagtgcccaaacccccgcccccatagacgccacccgattcttttacaactatcaacgctcatccacctcaaacaaggtcacgacaacatcagcccccacctagcaatctagactatctagccaatctcgcgcgacaccagggcgcacacccacccgccaccccaacccccagcccacgccccgcgcatatgacaccacgaacaccccacacacatccctatggagacctccccgacctctccgcagagcgacaccacgtccacataccttccgcatcgaccccccatctctgccctcaaacctatcccccgaccgccagagtcgttctctaccccaccactctccccgcgctcgccacacgcttaacagtgacgccccgaacgaagaaacctcaccctatcccacatccctcacagatagattatataccatagcccccccacgcgcgcgctccacgctagaaatcggcccgaacccctccgcaatcacccgccgcaaccagcgcgccgcctcagcctcacgagacatcattacatataaacaccgccccgcgaataaaactatatacgagacactcctagacgacagacaccgccggaccggcaaagtaactcgctacctctatctaacccgtcaaccctggtatgcgcgccaccgcgcgcaacggcgctgattcacctgcgcctatacggtgcagttgcgacgacacacaatcccgacacgagtatacacgacagacccgcgaccgccgaccgccacagaaaccgaagcccg

SEQ ID NO: 11343 - DNA, 1519 bp, Homo sapiens
  misc_feature (1)...(1519): n = A,T,C or G
acacaaacactatctacttatatctattatatgatgatgcactgtgacagacatgacactagcacagcnagagctgtgngcgatagttacggaggcgatgagcggacgcagtgtgaanagagctataattatcgactacattgagaacgcacgatagatctaaatactgacacatatanagacagataactagacagtcnacacgaggaatgatacgaaatnacttatcagaggatgtagacaggactagatgcagagagatagattcgtatacatgcggtgtgtgaagtcgttatattaatggtatacgtatttatctcttatataaatctcantataaagtcgaagtcgagatataatactatataaatacacggagtcataatcagtctaggacacagagaagatatagaagacgagatatactacagnataacttgagaggtataagacctgtatatgtagtcgcaccagtgtgaacggaagagagngagaatgttataaatgcactgtaggtggagatgtctaagtcgaataagagtagagacgatagacagggaatgcaagaccgtcgtgccactcgcgtcgtattggtntaggagggtcgagcggtgagagaagtgtacggcgtaggttctcagtatgtgccttgcatatacattcaataataatcaccactcatcataatatgaaacaaatataataaaactaaaaataaagngngaagagaagatgaacgggagtgcaactgacatgaaaatcaggataatatnatgtatatggtcaaatagaaggagagtacgctgagcgttgcgatggacggtgggtcaccgcagtgcgctcggcgtgagagcggccctcttctgatgtcggcttccctcatttggggnnngggctggcgactgtcccgagggttacatgggaatatcagatcgtaataatgtatgnaatattaggtgataagaaattaatttataaaatatgaattttcatacaacanncactacaatacaaaaatattatataatatctctctctttnatatgtnnnnaccctctcatacantcaaacccccaactacatactggtntatacacatactatctttatagttacactggtgcgtacataaagatacaaactatataacaactgcgcatccgagatgatatgtgngagcatacgtagcancagagagagggngctagantaatgtgagtnnaactctatatattnaatnngtcactcattnncactgttattatttnntnnnnnnacatcacactcttngtgnnnnnnncttcnctcttctnctcgtggtnnnnnnnncccattntanncataactctnaactcngnnnccttaatctatctnnncactaatactnncnnnnactctncnnnactatcncaacataactatctctatatananatattatacaatatcaaccaccncaattctnnnnaaatcttaatattcntncctattttntctccttnnaccnctaaaacacctc

SEQ ID NO: 11344 - DNA, 1091 bp, Homo sapiens
  misc_feature (1)...(1091): n = A,T,C or G
cggcgaccgccacctaccgcgcccggcggaggaggttcgntgtntaccgccccagcgnggtangngncgagaaccccgccatccgcagcacactaacgcaggaacagatttccagcgcacctgcatgacccccacgttataaggcgacgagccggaacgcagcacgaccacagtggacatatcgaagggggaacaacaccactcctggcggcactgtgagcgggcattggtagagcagtcaagcaagatcacgccaagcgggctcctcgggcactaagaccctggcgagatgtttggtaattcacgccagcagacacccacggccccaccgccgaccgcacggaacaagaccccgcccacccgggacacgcgcgacccagaagcacacgacacaacaggcccacgcgcacgagaagcagccccacgcacccaccccccacccaccgccccgcccccacgagcgccgcgcaggcagcggcaaggaagaaaccgacagaggcaccacccaagccccgacgaggagggaaaagacacaccgcaaccgacccccgaccaaccccccaacaacaccgcacgcaccggagacagcggccggcagcaaccaccgcgcacacgcncacacgcaagcgacggccaccgccgcgccagcccccacccgacgaacaccccgacacaaaaccgaacccgcaacacgccccacggccagagcgcagccaccgcccgcccgcccgccgaaccaagaaaggacgcgcacgccgagacccaagcacaccgccgcagaccgcgcacgcgacgagcggaagcgcaagcagaccgccggcgaaccgacccgcaacgaaagcaccgcagacaaggagaggaagcccgcgccggcagggccggaaagacagaggaagggacaacccaaggacgaaccaggcgacggcgagccgcgacgccgcacgcccacaaagccgagcacacgcacgccacggcaccgcacggcggggcgcgcggcggaggagccgcccgcagcgccggcgaccacgaacgacgaacacgcgaagcccccggcagcaccggcacgcgcaggcgcgaagcaagcacagcag

SEQ ID NO: 11345 - DNA, 1695 bp, Homo sapiens
  misc_feature (1)...(1695): n = A,T,C or G
cgtcgtgcgccgtgtgagagttattcgcntacgatgtcacctcagacttgtgtcggatgaaccctatgtctcacagattgtatcaagccgactcgcagtctcnaatacgtctgtgtctcgctagaaataattngacattgtgttacgatcttgcacgaatgccgtgtgtgtgtttcgtctcgtccgccccctctggcacaggtcgcgcgatagctgtgccgggttagtctgtctgactaactgcaggcgatgcgcgagcgacaagacgcataaaatcggtcactgcgttcgctctagcgtacagatgctgacggaggcctcatgctgtgtcatataatggtgtgagactgtgcgcgtgacaatagttgactactcgcaccacccaactcgtccgcgaagcgcacgatgagcttcgggttcggtacgggggcgtggggtgtgtgaatgtgagaggtgtcttcagggctgacattcaatgatgtgttctgcgcggtgtcggtcggtatgataatgcgatggacgttagtgttgggtgttaagtttattatgcaggtcttgcggcattagcctatgtgagtgtantgtgagaagtggtggttggtagcggagctggtgggatcatagacggctgtgacggcgtatcgttgncaatcagtgtgttctctatacgatganagcgatataccagtgtctatcagtgtcccattactctgcgcgcagattgaaggctatagcaagcgtgcgctgctgctgggcatgtgagttgtgtgggtagctcttcggtctggagtagtctacacgctggtgagcgtgcgtggtgagcaaggaccgtccgtcatgcgtgcgcgtcgcgtcgtgagacgataaacggcagcgtngatatgcgtgtcgtgcacgtgnatgtngcgatgtggcgtgagtcgcgtgtcatcntatctaaatacttcttgtgagnatcgatgcaggtgatgttgcggcagctccacgagtatgagaggacaggatacactcttattgctanagactacgatgcgtgacgncgaacnatganatgagtnatcgtncnctgctcactcaacacacatgatgtatanttgtgatgngctagatctagacgagagagctgcacagagcacctactatcatactngcgagtagatgcgccgtgtcacacatgtgtcgtnttgacgagacggcnccgagcgctgatatctcgtaccgcagagtcgatcgaacacgcacatacgcgactggcgnccaactcatagacttcacagacgagtatctcagacacagtctactggtanagctgtagcgtcgattatgtgtagggcgcancgtgtagcangcnccgacgacgcncgtctgcggctaagtactcgnctntnctgtgtgagaagcgattagtcgttcgtgtgagtgctgcgaagagatgtgtagcgatggctganganaatatcgcgtatatacttagagtcactcgcantcatctgagagagctgcgcgtgcgntgtgnatgngatagtgtgtgtgtgagcgcgtcnagnctgctagtagcgtgggactgtcntatagntcgttgtagctgatcgcgcagctctagtgtactagcncagaacgctgcgagatagtgagtgacagcagagcatnctgctgcnctggcatgnagactagctgtnagcggtgtcacgaagg

SEQ ID NO: 11346 - DNA, 818 bp, Homo sapiens
agaggggtgtatattttttcttccggtgttcttataaagagggctgttatattaccgccgcttaccgagttggtggtttaagaagcccactaagacacggcgtttgaaataccccaccaaatgtgttttttaccaccccctcgggagaaaaatccccgggggggaaccccacggaatttttttgcccaagaagagcccccccccaaagcttttttaaaggccccctcttcttttctccccccctataaacgccccttgtttattttttcccaaatcctaagcaaattgttccgggggaaagaaaaaaccaagggtgtgggtaaaaaacccccccttaagggggcgggttttttaagtgaatttaaaagagcccccccccccgtttttggaaaaaaaattttacggggggttttccccccaaccccctaccccggggcgcccccccagcccccaggggggggggggcctcaaaaacccccctttgtaatccccctagggggaaggggcccaaaaacccattggggtaaagggttttcccccccctttttggagggccccccccccttgggggtttgtgggcccccctaaaaagagaaccccttttccccgggggaaattggggggaaataaggtgaacctttttttgggccaaaaaggggttttcccccccccaaaaaaattggggttcccaaaaccaccccaaaaattttttttttttcccaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaa

SEQ ID NO: 11347 - DNA, 1411 bp, Homo sapiens
  misc_feature (1)...(1411): n = A,T,C or G
cgcgcgcgcgaggcgcgtgtgnggacctcgctgtagacatgcggagacgtcaanngacacgacacacgcgcgcgtggcacaacgactcacggccggngaacctctacnacactactgcgcgtagtcggatgngagcctggncggcgtgcgcgagtcgctcgtgagngactcagcctgcttcgtaggctngagcacgatagacangcatcatagcgtgcgcctggcgttggggtgagcgtcatgcgtgtnnggnagaaggtgcacgcgccgttgacgangtanagaccgccatgcgacgcaacgacatctatctagtatagggngagcacacgctaganagcnatatctgagntctgcgtggctgagatgggngntgcagtcgtgtgtgtggcancggagctgaccgngnngctgtgngggcngagacggcgtgacagtgacgagtactcggcgtgctctcgtnncacacgcgatatgtnnacagcatgctactattctgtngntcgtgcctagntgactcgcggctctgactagacgatatacggactgatatctnngagtactcgcgctctgtgtngcactatctacagctgcaccagcactggtgagagcgcantctaccagtgtgcgttctcgcgagagccgccggtggngtatctgcggcangncactacaccgcgctcgcngacggtgactctccacacgtgacactacgcacttcacgtctgcgtcgttgtnctcactgcagntcgcnagagcgcagcgacagagggngcactgacgagacgcgaggcgcaagacaagacacacataccctgtgngnacctccaaggcgccggcgcgtgtccctcgacgccacgggcgctggcgactcacaccaggtgaggcgagcgngccgctataatagagaccacatggggcttggcaggccgggagacataaggaagaaatcagagatatagtgctaatctgtggatcggattgggngaccacgcacgctacacccagtaacatgnaccgnnnacccttctatnnaccctaacttcatccatctgtcttccgctccaacgatnacactccctcccctcnncacacacgccgtcacatcactgtcttgtngctctgtcgtggcttagcgcacgaacgcactacagagncaacgccgaaccacatgcagtgctcgtggtctagtaactcactctntcctatctncctcggccgcgacctggcaagtttacatnccatagctacgcgtctagctttactcaactgtnacgtttaanccacgtcacngacttcctagctcaaatctcactccataatacgaaagtctgtctatcctgctactttcattcccnccctccctctctttcccatcttcctntctttctccttnnncctnnccacttct

SEQ ID NO: 11348 - DNA, 141 bp, Homo sapiens
ggaaactgagaggctaagatgctgagcagtggcggcggcaggctcctggggctggagagaaaaattggaatccagatcatgcgaaagagggaaatcctaattaaaccaccatgccttgtttggagaccaaaaaaaaaaaaa

SEQ ID NO: 11349 - DNA, 1386 bp, Homo sapiens
  misc_feature (1)...(1386): n = A,T,C or G
ttgggtgggagttaatgcncatgtattttctccatctgtatattttagagaaagaagggggacaaagaaagagagaaaattagaagggaaaccgcgcccccacctttcggcgcggcggagttcgctgcgctcatgatggccatccctggcgcggttactccatgagatagactcacagacagagaggtgcttttcttgagtcagacagttnttaggtaacattaggtcttgtgattgacctgagtcattgtnttaaacgacagcgccatacgacgcccaaagatctccattataatgaaacacaaacaccccacatcaacnccctgtgtgagagaaggggatagtgtcgctgtcggtacgagatagtatcacacactcacatatgcatagctagtagcgccagcacaattttccacataccataggcgtttgctagcgactgaccatgccactcttgccactnatagtatgttgtcatccacatatggtatccgattctacagtgattacaggggctagtcagagaggagggcaagagaacgtaattaatgagtgttanagagattatgtcatattgtagtnncacacatacataagctagcgtcattagtccnatgaccaacanacttngagtcacagtagattcatatgtatcacataaggnacgtggaaccgctaagactgtagtgtgtaggtcccacatgatctatatcatcnctcatgtcatattacaaccattcattctctcgtccaccctgtactccttcaggtctattcgtggtacactatgtcgtgacgacgtcgcgctcatgggtaaatcncggtctcgcatgatcatacgtctgcgcatacatcntgatgtatntncntatgagtagtcntcactgagcgagctcnncacaagaaagatgtnccatagtcgcngctgcgcgtcagactagatagcgccnntaagtaagaaatagcaacaggctccatagactncactgtcgtctagtacatggctgtatgagtgntcgattctaggantgtgtacactctaccagagcgccgcncgacgactgatacatgaagtcantcagagaggtccagagagttgtcacaatcgttctatcacatgtacgacatcattatagtncancgatgancgagtacgtagcnataggtgatnntcatngcagatgtgctgcntcatancagaagtacatatgggcntcngaatgtagtgtacctatacgagaacacncnatgagtgcgtcnatagtatatatgatactccatatatgatcttgcttaatcganagctgactttatagacgnnccacgttatgctgtcatctagtnattctatgacgttcgtatgctgtgattcctagagtggtgcat

SEQ ID NO: 11350 - DNA, 526 bp, Homo sapiens
  misc_feature (1)...(526): n = A,T,C or G
ttaaanaaatggnctgagatatttatggaanaaagnatgtatatctagggttagctttaaaatggcncagttgggtagggggttcggtgaatgaatcaagttaatttggggacaagttggtgctggaaacaaangggtgggacctgggntttttgatcgggggttttttactttcacaggggcatgggcagggcgcanatnatgtgtttaggcacagagctcaggctggctggtcactgtttttatcatatgacacaccagtgtttcccaagccagcgtcctttccccctcttgcagttatcttccatgacctaatggcttaagacttttcccacaagtctcctgtgtggcattgagccgttgacatctgggtgatagcccctcagcagtgctacaatgtgtcttatttgatgaaatgtttcgctgaaaacccactgagtttgtcaacacatggcacagagttcacaggctgctttgtaaaatagtaacacttgcttcataaagcctttaaanaaatcattctgaa

SEQ ID NO: 11351 - DNA, 534 bp, Homo sapiens
  misc_feature (1)...(534): n = A,T,C or G
ccccatgatgtaggtttttcnccntgtaaagaaaaaaannnagatgcttccaaaggaactgggttgggtaagatcctggcctggaacaaaaggtggtaccttagaaacccccaaaacatattttttntcttgtaaaaatatggcctctagtccaaggaaagatagcccttagaatgatttattaatatggcaaaatcttctattacggaaaaaatggtcctggattgaaatgcagcgggttctatttttccaactgctagatgacttgaggtgggacaagtcagcacatacatcagagttctgttctttgaaaggaaaatgataaatcctagactcctgtcaatgacagcattaagaacaaataagattaggaagaaacagatcttgccttgaacaccgaagtgttccaatcttctggcacctattgtgcccttttattgttaattatgtttttatgtgtttagttgtcaaaagtcagagttaagtcaaggatctttttcccccctaaaagactgataattacaccaagaaaat

SEQ ID NO: 11352 - DNA, 1087 bp, Homo sapiens
  misc_feature (1)...(1087): n = A,T,C or G
ttttattgtttgtnngcttcncgtcttgtttgtttcttttttgttctatggaaaatggnnttttttatttttttaaggcagacagccaangtcatngngaagnactgaggccccccccttttgagggggngcggaaacncggacggcgncngggaggaggggaggaaggcacgaacggacctttttaagcagaggggagcggacagcgaggggagagngaggccnggacagggacgagcncgagacgagggcccgccgggggcggaaaaggaaaacggcggggacaggagacacaaaaccaagacaccgcaagaaaaancaccgccagncgagacgccgggagccagaaccgaaaaacacagaacaagaatttttttgatgtcgttgggtatagtttttcgtcttctttttatttcgattctttttttttccgttttttttggttatcttttttcttgtgttntgtgttttgttgacattgtagttagatcaatgtcttacccccttttttttgtatttttcatttgtatattttttcttttcttatctccttttccacgttttcttatttcgtttaaacgttcntcgagtgtggtaaagtcgcatctacattagtgattttcttcttcattattttttgtttccttcctgttctcatnttagttcttttttttcctttttttcttggatgacnctattcagtttgctgtcatttttgtgcgnttgttcgtggtttttcgtctttatcttctatgtttactctcttatactgatctttgtatttatgtttttttttctctaatattgttttctattatttctctgttttttacttnttctatctgtgcagttgtctctatcagattgagctcattgttctcttgttcatgtgttcttatgatcatatttattttgctttatgttacnctagatattttcgttctttgtcattaattatttncttctaatatattttntttaattttccagttgtttctattgttcntatttttagttcttgattttctttatcatgcttatttccttatatatttcttttcttctctttcttatcatctctttattt

SEQ ID NO: 11353 - DNA, 528 bp, Homo sapiens
  misc_feature (1)...(528): n = A,T,C or G
ggtagtnaagtaatgtggaaggagcaccntcaagaacttattgacttgagnccnaaaagaanaaggaaggtaggaagctcccncaagacaagttgtgccnttcagtccagggacccaacttaaagtgcccttggacacaaaatatcctgcnngatcctccttcttcctttttntctcntgattgatgcctccaactggttgaacccaaccagaacccattccaagcaggtcagtgtccctgggcagacagcaaggtgaacagtagttgagaggggacatgaaggtacagacagaagcaatccaaagtgacataacacgtatatattctcggcaagcctacacatggcttatcagtgatattttgcatgttgcatttctctcctttttctttgttggcatgtttatttgttgtaaagcatcattgtaactaaagcctgttggtaaacttacacagattaaagcaaagtccagaatagtttggcactaaataaaaatcgcctatagagaaactaaaacttgggtgaaaat

SEQ ID NO: 11354 - DNA, 712 bp, Homo sapiens
  misc_feature (1)...(712): n = A,T,C or G
atactttatcnccgntcagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgctggaatctttagcatgtatgcttgtgaagaaggctttgccactggtgggcgagatgggtgtattcgactgtgggacactgatttcaaaccaataaccaaaattgatctcggggagacagaacaaggatacaaaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggctgtggagcctggctgatcatgccttgatcgcccgcttgtaacatggaaaaagcggttcgcaatgtaactttcaaccccgacggatctcanctggncctgggcatgaangacngctctttcattggtctccgagtcaganatatgacagaagtagttcacattnaaaa

SEQ ID NO: 11355 - DNA, 537 bp, Homo sapiens
  misc_feature (1)...(537): n = A,T,C or G
gggaatttggcccnaaaaacccctgaggttactgacatcnaactccagnggangcgaaattcnancagctccaggggctggngtcctgnaaaatgattttggacctggttaaaattgttnaaattcccttgttnncaaaaaagtaaggccaaaagagatgtttcattgcataaagatttactctaaacctgtatacagacaatnaaggctgatcttcctgctgtcnattccaatgcactgttaattttatctngnatattcttattacttttcancaattttaaatagaatgtgttgatgtcttctacttttgacatcttaagatatgtggttttgcaaatttaagaaagaatttgctaatagagttattaccatattgtgatttgtaagccttgtttcacatttcgaacaagtcatatttatgtaaatattcatagtttatatatagtccgttaaaatgttgtaactaaaattcttttatgattcagagctattgtgcttatacatggaaaagcaaaggaaatcctttcagacata

SEQ ID NO: 11356 - DNA, 737 bp, Homo sapiens
  misc_feature (1)...(737): n = A,T,C or G
atatntancnccgtacagttgggtttgcttgctgtctccaccgagctgacgtgtgatgtctgcagcgcgagtcaaagccacctcgcaaaggcagccgtgttccctgccttgacatctcatccctcgtccttactcagatctcgtcagcctacacggtctgctcctccaacagctaatagcgaaatgactgcggggaaggcaatgacagcaatcgctgttcagcatttattttacctttgattttttgctgcacataaaattccaggcctgagctgcggggcagacatagaggagagtgcgggggcttggaagaaggtgggactctgaaatctgcccctcctcccccttcagtacaacgtaatgtgagctgagtgggtctctggcaatgatttaatgcctcctttggacatttgccggttaacatagcaagattgacagtgtgcatcgtgagtttgtatgtagctaccaaggctcagaggctgtatatttccctatcctgcatgtcattcctgagacttttataaattcagaggcaggacagcaagctaggctcctaccatcaatctgtgttcttgcttctttattggcctcaagaaccaaatggatattcccacaagcaccntgnttcatacctggtttaatngccataataanggagaaaccagggtagggaaccacattctgccccaaggtggttttttccaaatagcnttgnggtcaaggnaaaaacaaaaang

SEQ ID NO: 11357 - DNA, 538 bp, Homo sapiens
  misc_feature (1)...(538): n = A,T,C or G
ttattgttntccaggtaccaaaatgatatttnccccaggcaccctggttcaaaatggnttaagngcccaaaaaaggaaacccgggtaaggaacnncattcttgccccaaagttttttccncaaaagttgggtcagnaaaacaaaagctttttttatggaaaatcagcacaatttatttttcatttttgaaaatgtacccaatagtatatctatttaattccatcttgaacattgcccaaaaaacagtagtgtatccctaccatgttctatattttacaaggagattttacaaaggaaaactttccacctccctataaacacatacacctttatttacttttatttgtggttttattgaatacgtctcaattcagagaacaatgtttttgagcaactactagataaaaagactatgtgtgtggtttaaaaatgtaaaggatgctgttattgctcttaaattaggtatattttaaaagcagtaatgattatttaagtaactgagaatcatccaggataaacttttgtgtgttgaagtaat

SEQ ID NO: 11358 - DNA, 520 bp, Homo sapiens
cttcagaatcacgagtctcactgtgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggacatcaagaggacgtcgggggaacatgccctggggaagagcacacaacagatgccggcacgctggcaggccactgaccagcagaatgccccggagtttggctggggtggtcggagaagagtcaggaaaaccatctcccttctggctcccccatctgctgggggagctcaataaaaccttgcactcattctccaaaaaaaaaaaaa

SEQ ID NO: 11359 - DNA, 179 bp, Homo sapiens
ctctagggagacgtaaagatgaaatttcccagtgaggacacagcaggaatgtggctgtctgcaagccaggaagagagccctagccggaaactgaagttgccagaacattgactatggacgtctagcctccagaactgagagaaaataaatgtctgttgtttaagccaaaaaaaaaaaaa

SEQ ID NO: 11360 - DNA, 332 bp, Homo sapiens
ctcaggttccacccaggatatcctttgcattttgtcatctcgccttgatttcttctggtctatgacagtttctgtctttccccagattttctgtctttccccagatattctgtctttctcaagccatgaccttgagttttgaggagtactagtgaagtattttgtgaatgtccctcaatttgtgtttgtctgtatttttttcatgattagctcaggtatgagcttgggaagagatgcccagaggtgtgtggagccctccgtagtccattaaatcaggaggtacatgagattcccatgattaaagtattaaccttaatataaaaaaaaaaaaa

SEQ ID NO: 11361 - DNA, 166 bp, Homo sapiens
tcagcgtcaaacatggagagcctgtgttgagatggtggaactacaagatgaaagcagcctgaatctctggttcaactgatagcagagagcctatgccaacccatgtctgtttttttcatgtgcaaaataaataaatatttattgttataagccaaaaaaaaaaaaa

SEQ ID NO: 11362 - DNA, 1234 bp, Homo sapiens
  misc_feature (1)...(1234): n = A,T,C or G
ttaacctgtcactttgtcctatcacacacacaccacacccaacgcgtcaattgngtngacngctagcacagagncnccgtcaaanaggcagcaaatcatcntccaatagtcggnntcacgttggtcttctcgttatatctcattttcaataaatgacataagtgcaacagtgtttgtcgtagtggttcttccttttatttgatcgtccttgtgctcctatcgcattccttcgatttctcatctanttctgttgcgtcgctgctagcgtccgcttctctatgtgcacctatggcacncccttattccagtatgttcctccgacctcacgtggtctggtgctggttagtttttttttacccattatgatctattgtgttnctccttcatgtgtatagtcctctgtttctacattttaatgatcttcccgttccttcactcttcccccaggaccttgtccatctttctcacgtgttcccattcccccactttaccttcttcttttttctcgatctctgtctgcttccntcatctcctgtctctattgtactccatctgacgccctctcgtacattacttctgccnccggttgtgagtcctatgttgttgatagtatggtcatctgctctcgcacatgctcgcctcagtgtgacgtttttacgtgtcttcnctcacttagtgcgattctgtgtgttnacttagcagatttctcttgttctccttctctctctgctagtatcactctattgtatctgtctgctgcagctgtcagttcaccattgtggattcatatcatattctccccgtgttctcttgcttcgtgcnatcgtggtgtctctcatagtgttgcatcgctctgtatgttnccggcttgtgtttttcgtagtctgtgtgcgtttctgtttatttctatgcgtatatgnctgtatatgttgttnntcntcgatgtgatgtcgtagtgtttcttcttcctgtgatcattcgtatgtntcttgatatgtgctcacgacgactagcactctgttggtncatagtcattgttgccacttctgttctagtcgttgagtttcctcaccgttgtccatcttgtcttccaaaattatattgtttacctccatcgttctctcattctatattttctaatcttngtttacttgggctttatattgatgttacatgtttggcgnctggatagttcgcctcgcgttgtcagttttttgattattatgttattctc

SEQ ID NO: 11363 - DNA, 2001 bp, Homo sapiens
  misc_feature (1)...(2001): n = A,T,C or G
cagcagacgtgagacggtcangcacgcanaggacgacgacaggaagcggagtgagagangcagcaangaagaagcggcctggcanngntnagaantnngaagccngaagacacagnagnaacgaggacgngcccctgcgacagagnnagctagagagactgagcccagagncgaccannanacngagagangaaanggnaaanagcgacgcggcgggccgacnagccgagcgcagagangacgtcgttcttgagcagacggcggagcgaganagcagaancacgacgccagacgcgancagcagagnacaagagaagacacgacagagacagagacacgcaacgacgcgagcggcacagcagcngaagcaagacngcagagacgagcagacagagangcaganacgagcgagcgcgcagagcacgacacgcgacgcagagcagcaacacancgacgagcgacgngcgcgcagcgangccggcgacagacgnagccacgnagangncangcccgacngcangcaganaggcgnagngnagcggcancagcgcacaagcganagacgaccgacgcgaggagacncaaaagagcacgacgcancgacgacagcgacacacgangcgacacaganacagcagccacgacagggancngtgttgtctctttcnctctgcagcagcgncggcgnancgaagcgngcacagcgagcgcagcgacgaccgagcaggancgacgcaggcgagacacnagcgcgcgcagagcgcgnggncgagngcacgcgcncngacgaccagcgnacgacnactcgacagacgctacgcagcgcgtacgcacgagacacgnagtccggcacgcagatccgacgacgcatacacgcancaaccgcgacagcacngcngcgcacggcagcgctgaaacgactcagacgggaggcaacgacggntcgacgnacgcncggcagcgcagagcgacngccacagcgacacgagcacacagcgcgacgatgacgacagagagaggcgcgcacgcagcgcacggacgacacgaccncacggacacacagcagcgngcgcgaactacgagagcagcacgngcgaagcaacancaacgtaacagcananagcggncacgcgngacacgcgagaaagacgagaggaggcggacagcagcgccgaacgcagcgacgcancacncaggacacacgcgcgtgataagacggcgcgcgccgcgagcgcgaacggaancngcagcgacggggcgcgatatcgcgcagccacacgcgcgagcggncgagcgcgancncgcacgcgcgagcgacaagagcgtccgaaggagcgggcgncacgacctccagcggacgtcacgcagcgcgcgctcgctacacatcaggacgcgcactcgggcagcgagcnagacgccgagacacagcaacgacgcgcgaggcatgacgcgtgcgcgcacgncagacgcacgngcaggaagagcagacagncgacagatcatgcgtcaacgccggcgcancgcaagagacgagaggcgagaacgcgcggcgagagcagagagacgggggacacgcagagcgcgaggcgcgtgccggacactgaacgcgctagccactgtctgcancggnaccacgccgacgagagangcaggacgcgcgagacaacagcggacgcggacgcatcgacgaananntgacaggagagacgtcagagacatgcagcacgcacgcacgcacgcgataagagaggcgaaaagagcgatcatcgagacagagagagcggcagcacgaaagagcgatcagcacctagcgacgcacgactagatacacggacacgcgcgcgcaccaacgctagcaacagcgcacgcgcgcgcacgacgcgagcgacgacacgagcganagcaanatgacagacacgccgcgactcgacgcgagacacgcgagcagagngacgacgctgtgacggcgagagccgacgcgagaggtcgccgcgcagcacg

SEQ ID NO: 11364 - DNA, 955 bp, Homo sapiens
  misc_feature (1)...(955): n = A,T,C or G
gttagagcgacgaatgggcaaggaaaggacacctctggtnactcccgaagggatgtttgaaaagaagacctccactctaataggatgaaaaaatgatcatttatttacatcattctgagtcgttttaattgcttcacggtccactataaagaggactggcctctgaccctaaagtccctcctctcttgcgccagttgcctgtcccctacagaacgcgcgggctcgcgtaaagtgcccaccagccccgtgacagcctaccaggcctgacgtcaagccggccggccgagactagcaccgagccaccgctcgaggcacagcaggccaccggggagaaggaccacgcacgcagccggcaccacgcgagctgagcgccgagtcgccgcctagcgggcgagggggttcatacgcgttcgccggtgcgcccctcggagcgcgtgtcacgcaagaacgtaggaggtccgggccggctgggagacgcgagagacaagcgagcatgcccatgggcgttggccgtattcccggcccagcgcgtcggaggccaacggggcgcgcgtgcccatcgactggactaggccaggtcgtaagggccggcgctctgggggcgatacgggtcctggccgagcgatgaccaaagctctcctattggcgctactgcgagctccgcgagcgccgccaaggcgggcgccggggtcgccactcaagtccgtcggtgcnctcgcggtgcacgcacggcccccagcgccacgtagcgccagcgggtacgcctgtgcgggatggctctcccgtagtcgggccgtcgacggcgatagcacggagcggtggccgagcggcgcccctacgggtgcgcccagtggcggactcaacagcgggcgagtgagccacgtgtggtcttacagactaggcatggacncgtctgcggactacgaccggaggagaggaactagcagcggggacc

SEQ ID NO: 11365 - DNA, 1096 bp, Homo sapiens
  misc_feature (1)...(1096): n = A,T,C or G
actcgcgggaacgagcagatacacaacaagatacaacaacacacagcagngngtcnattagatataactngcccgcgcgcaacccnnttcgcnagggtgagnacaacccccagcttngcgtgcagggagagcgtagaagcggatggaggcagcaccttagacggctcatggatgttatgatgctccagctctcgaacatacttatgctatccccgcgcatctcatgtatacaagctctcgaacgaacataagctcagaacgcgcatgctctgttaaggaaaggagnntacaggaacaaaatttatagctgtacccgatattttcttttcttacgttggcactgttctagtaaacatctagttttttttatagccgcncacagttggtggtactactcgttttccnccccgaacgatgagttatgtgacctgaagagtaaaagggctattggctcctatacagcgagcgatggcctatgtattgtcagcttaccgcgtggtagcccttatggatcttcgggtggcgtgctgaacgctgaatgtgttcgtgcccaagagagcccacggcgcaacgagcgcagactcgcgctggctgggtggtggagggttgggttaactgagctggtaacgaagaaggtaaatataaagggcatatgactctatttcgcgtctcccgtcatgtctactgtgagaaggaggtgcgtggtttatgggtcntctaggtatggtggtgagtctgttgtctttatggagggtttaagaaagagaccggatcagatagatacctatcaaggcttcttgttggtgttcgaggcctcgtttcccgcgggggggccacttcgtctcccgccaggcccgtagacgcgtggtgaggantacggttagtaggcccttgtcagcccaggtagcgttgtatcgctactgcgcagcctgcatcacccagcgagtcctatggagtgtccagggtagccaccacagtaattggggttaaagacaccagaggtatagaagttacagtagcatcagctgtggtgccttagttcttggtgcggctggcgtggggctggagcggagtgccccgggcggggccacacgcg

SEQ ID NO: 11366 - DNA, 1495 bp, Homo sapiens
  misc_feature (1)...(1495): n = A,T,C or G
ctagaccgtgtacgagttctatatctcacgcactagacgactagtgtatatntttggtatgactgacaagtanatattcagtattgnggtgacactcgctcagagatatggcacgacggtcgcaaacacgtctcgctactgcgctcgactgncngacgagcgancgnttgtgactgtacagtcgagcaagtagtcagcgcgtgctaccggcgacgtatctcagatagagactatcaananagagatnacgtcatnccagtgcacgatcgagtaaggatgagagatagcagtatgggtatatagtgtacatcgtggagagtagancgantagacactcagcagnacgatagacgcnatagagtanactnncctactgtatgtgctagtgtngtgcgcgctcantgagatcgngnagatgatatangcgtacgaccgtagatcgtaccatgtgaactgcatactcgatgaacaatgcaaaatgtntgatgacggtgcgcgcgtgcgtcgatggcggtgtcgtcgtgatcggctgttgttaatgcgtgctcgcactgacgcgctgttagtngtaggagttcttgtgaatatagtaaacgtgcattacgttgctcatgtcgacgtcgtgtgtgtactaattgtangatgtcttgtactacgngtgatatacgagtggcgtactaagatgtcgacggatagtgacgagtgtggacggtcatngggatcgagcgtcacacggctctctggctgtagagtgagctatcgtgcatagcgtagtatacgcgttgtgttattgtgactataccgtatagacactcgtcattgactactactcttatgcgacgtctctctcacagtgaccaattacatgaggattcgggatgtgagaacgcagggctctgatcatgggaggcggactcggctgtgctccgtcancatagatgtacgtgctgtggtatatattggtntacataggtaggactatgtatcgacgtgagcactgagtttcgatgtgcggagtataggtgaggcagagtactggtaatgagcgagctgcggagtctantgtagtagcggcagaatcatacgagtagcagcataggagttatgcgtacgggtgggagtattgggacgaaagaacacacacataagcagctagcagcatataggacataccatttcctatgtcgcgcactgagctaacgaggccgcgtgtagaggcgaaccagattgacgacgcctacgatagcggaggaactgctatagtaacagcaagcgagttggtcatattgtcacgcgagctgtcgtcagtcaacgccgcgnaacggatagagatagtggagcgtgtagggaagagaatataactaatgtcaaagacgataggccaanagcatcccagacaagctatctgattccgcagtgagagagtaatgtaagtacgatcacgtgaccagacattattatttatctcttagacgagcgccgcgctacggacgcc

SEQ ID NO: 11367 - DNA, 1211 bp, Homo sapiens
  misc_feature (1)...(1211): n = A,T,C or G
ggctgggcgcgcctggcgcgcgctgggctccgtcgggtgacccctccgcgccctgcctcgctgctcggcngccccggcgccggcgcggttcgggtggccggcgcctggttccgtcggctgtctcgtcctctccggcgggtcttgcgccgcctcggtgcgccgcgcggcgggccggcccctgtgnggcgcgggtgcgggtgtgtgtgtgcctggggtgtcgcctctctttcgatgctctgtggttgggtgcgtctgttcgggcctcggccccgccttccggtccccgtcttgcccgcgccccgcctgtctcctgncccccctggctcgcgctccgcaacctcgtcgcttctgttattcttccgctggtcctcccgtttccctgccccccctctcggccgcttcctcgcttctccccgccgccggatcccctcttgtctgctcgttgtgcgctcccctcccttgcccctcgtccctgcctgtcgaccctttgtgtttgcctcggtctcgggngctcgccagggtctcttcggactgcgtgcccctctcctgntgacctggcatgtttttcgtgtcctcgctggcgcgccttcgccgggcgtgtctgcgctccgtgcgcgcggtgggcctccgccgcggcccccctttgntcttcgcttgctcggccctctttgctggggtcctgggcctgtccggctcccccgcctcgccctgcggcgtgccccggccctcttccttcgccgctctcttnttcctttntcttcgntttcntccccgccccgtcctccctctcttccggcccgctgccctcctcgcctctctcgctcttcgcgttgncctctctcttgcttggtggncgcgcccgcctcctctgggcgcgcctcgtcgctgtcgccgtcgccgactctncgcgcggctcgcgtcggtgcgcgtcgtcgcgtnggctcgcgctgcgctgctgctctgcgcgtctgctcgccctctccctcntnnnctccctnggggtctctttcgttttcccttgccttgggagagantttcctgtcttgtccttgtctcttttggncttcttgttgtcgtcgtgtnggttttgttttcgctctcaaagggtgtgtgtnttctttgtttttcctctaaanttccgtttgtttccccttttnttnntttnctctcttctcctctttntnnttttcttttttnntntttttcccctc

SEQ ID NO: 11368 - DNA, 239 bp, Homo sapiens
caggtacaagggccgctgcttctgggtcacagcccaagggaggcatgccatgggctccctggcctgcttccattgcctgctggctaagcgatgcagagaactacagcagctgcctcagacccagaggctaagccaagtgttcaggatggcagagccattggaccagctgtggaccctatgcctctgaagatgtactcaagaaatgaactggattacgtttaaaaagaaaaaaaaaaaaa

SEQ ID NO: 11369 - DNA, 903 bp, Homo sapiens
  misc_feature (1)...(903): n = A,T,C or G
ctcagcatggccctggctgaagcaccatggcaatggagaaggtctgccagttttctccttcaaggtcctcctccatggtaggaagccaaaacagcccaccttttcctaaggatggaaagagagaacctcttctttattcttttataagaagaatgattgtatcataacaactgctatccaggaagagagagagaggaaggagaggaggaatcgatgctgagaggccaatcatatttcatcactcagctacttggaaaccagatattcttaaacaatcacgtgctccaagagatttgaggatgcaaaagaggagtggctctgccttttgtaaattattaacaggaacttttttcctgaccacgagtaaagatgtacagactacttatttaagaaaacagcaattaggtctgacatggaacataaaaatggacaagtcaacagcaagatctctgactgcagttctgtgctgacccctctgaatcaggacaacccggtgcagttagaatcaaagtgatatcaaactgggaatgaaggggcaccttctgaaggtctgaatgggccataactgcagcatcagcatctgcctctgatgaaaaatgtgtatttgctcctccccatctgagaactcacgatgggatatttggcgccctgagctggagtgaagccacctgcacacagttctcacattgcttctagatttcaaattgctgcttaacttnctccatggctttctttgggttcatccaaattggagattaacgcatctaccttaaagctatttgaaagtggccattcagtgctagatctttncagtaattaaacttgccagaaaagctgtccgacagctttaaaagcatttctttcctgccataacgagggcctagggatacttttttggtggat

SEQ ID NO: 11370 - DNA, 1540 bp, Homo sapiens
  misc_feature (1)...(1540): n = A,T,C or G
ccaagagcggaagacgacggaanaacaaagcgcaacacgaagacaacaagaagagngcgtcgagagagagagagaacaagagagagaaganannaaaggcgcgtggcagngagcgaacgaacagaccacccgagcacgcggccagcaacacgcnccgcgcagacacnannacacaagcagccctcgtgtcagcgcgtancacgcagcgatcgcgcacagccncacacagagatccncacagccccagcanagagagaggagggtagaggcgcacgcgcgcgctcggcgacacaggatacaaccgccacaacgagcgcacgacaagaagaacaagagaggaggagcatcacccaccaaggagctgcgaaccacccgcgcacgccgcgaacagcgccgcgccgaagcagnacagacgtcgtacgaagggcaagcgaacactcgcactcaacacgaaaacctctctttatgacacacacaggcgcagancatacgcgcggacgccgggcgccgagcgagactaggccacgcgcagcacgtgcgacnccaccggcgacggcaggcgacaggagcgcaaccggacccacgacggcgacagaaacgaagtncagccagcgagcgaaaagcgcgcggcaccacccaccaccgcaccatacctcaaccacgcagagcacacaaaacganacggagaggtacacgcaagacaccacgctcaacaggcgacagcgcgcgccacacgcaaccnncccgcgcgcccgacacagctcccaccggacacggcacacccaccgcaccgggcacccccacgccctcgcagcagccgacaacggcgccaccacacgccgacgcagcgantcaccggagacaacaccctatacacgccccaaggagcaaaagccccgcncagagcggagatcgcgcaggtctgcgcaggacgcgcgccacgccacgacgacggacgactcacgagcggacacacgagaagggacgnctcgcgagaacgcatgacgacagaggagtaacgagcgaacggagacggaaccgcagcgccaacgcgcacgacccacgcgctcctgccagcgcgggcgctgcgacgcacgcgccgaccgcgacagcaggacgccgncgcggaccgacatacgacgagcgactngaagagcatngcgacgacganancaacaagagacgaagccgcaaaacagggagaccacgcacatcagacagcgacancaacancacgcanagcggcggacgaccncacacnagtgaggacgngcacgccagacagagcgcagacacagtccccacgcagcgacgacgccanagacggagngatcgcgaangtatnanagcggagcgacgaccgccgcacgagacacncacgacactgacgaaaccagacgaggaaccatgcacgcgcacgccatacagcagcgcngtcatatcacgcgcgagncaccntcaccgagcgcgcacacacgacgccgacgcacngcacacacgcgacggacgcacagcagagcacgcgatcagacagcaaccg

SEQ ID NO: 11371 - DNA, 1694 bp, Homo sapiens
  misc_feature (1)...(1694): n = A,T,C or G
tacagaaatgtacgatgttgagtctgtgcagaggagagaccacaagtagncgaagcttcttcctagtcgtctcagaccccctncgncacagctatnacaatgttaataagtggtagcgaanatacttnntctcacataggtcgtgnctacagtagtgtgacgtagcttgtcgatcaatgtccacgagaatctgatacactagagccactggacgcgcccaacgactagtctgntactatagtagttcggcatattaacatgtaagncacacaagtaagatcataactgacgtantatctgaccgccaacatgagatacatttaatgcgacgatcgcaggtatcactggtcgatttacatgatgagcagcatactgcggtgcgtatactataataatgtccctatcattctataccagctcacacatactagcgtatgagcgttaacgtgtcaacgatactaacgtcgatagaactccagaggtactgtgctgcttatcgttctatatccattcgatgcgtcgagcgacactcatagtctntcgtagcaggcatatctgttgcggatgaagatatatatcgctgtccgtattctacgtgaggtcgcntatcaccgtgcctatacgacatcactctgatacatacaccaatgattctcacacgtgctacgtatatgtcacgatcatatcacgtgatacgtcatgtgacgatacgcacggtagactatgttacatgacgcttactcagtctgtatgtcgctgtagaacagcgcgcactgcagccataacgtaacgtgaggtnctatagtgatatcagatcagctctatctatgcgcatgagaagctactctatgtggncaatcgaagaatancatatagcagtcgacaataactagacgcactcaccacacgtaagacgatcacgggtatcantacaagtcattgtgantctatcgtcagtgagatntgcgctatagtagcgatgatcttagcttgctgactantggtacgtgcgtatcgtatagacactcatctctctcagtntcgaatgacgagtgtgtggacnagtatatgtgtgtcgtatatactactgtctgagagccgacgntgtgtacatcacgtactacnctcactatagactatatggtanaanatagatagatgagtactnctcactatgtagcgtgatatgatnatcctcncagtactgacagnagactntgcgngctcggcgtgtatatgactactgacgatgacctcgtgctacgtaatgatgccactcctantatgcaacgattaatcacatatgcgcgtanatacgaaagtgagtaagatattagaagagtcnatacagcataatagtgcgtactgatgggatatctatgtgctagtgtgctactgagctcgaagctgagtcgctgtagtgacaangnagtctaaatactgtgatanaantattattttagtcgtngagtattggagatgagtgttatgcatactcgcgcgatctacctgctcataggcgagagcgccacgaagacatagttggcatctnacgtctgctgacgcgcgactcacatacctgcagtgtatatattagatgttatatactatctcgatcnacgtatactgatggtatcnagnacgtgcgtcgattaatatgatatgttgcaccgcatctgctaatgagtcgtcgt

SEQ ID NO: 11372 - DNA, 939 bp, Homo sapiens
ttcagggagacttcacggaggcagagccccatcatcagaataaggaatgcctgttactatgcatctaacaaaggactaaaatccagaatctacaaggaactaaactcaacaagaaaaaataatctcattaacaagtggggaaaagataggaacagacatttctcaaacgaagatatacaagaggacaagaaacataaaataaaatgctcaatatcactaaccgtcagtgaaatgcaagttaaaaccacaatgagatgccacatcacaccggtcggaatggccattattaaaaagtcaaaaaaccacagatgtcgacaaagatgcagagaaaagggagcacttatacaccgttggtgcgaatatgaattagtacaacctctatggacaacagtatagagatttctcaaagaagtaaaaatagaaccaccattaggcccagcaatcccactactgggtatcctacccaagaaagagaaattgttatatatatatatctgcactcatatgtttatcactgcactagtcgcagtaacaaagtcatgggaatgaacctaagtttccattcaaagatgattggataaagagatgtggaataccctgaaatacttacccatcggagaaaaaaataatgtcttctggcacacattggaggaacctggaggcaaaatactcagaaacccacatcgaataccccatggtcttacttattaaaagggagacattgaccaaccgagaaaaaatgctcaggccgggactttaaagaggggcttgggaggaccttgaaagtcaaaaatttccctactgcaccaagggtcgtttgcaggaattaggaacttagaacccccatctccttttcccatttatcctggtgaaaatcgcttatccccctgatccttacaataaacaaataattaatacgtgtgtcacacttaataacaa

SEQ ID NO: 11373 - DNA, 1394 bp, Homo sapiens
  misc_feature (1)...(1394): n = A,T,C or G
ccagacaagtcaacacagaatcaaccagacaaaagacaaaaagaaagagagtgcctgcatgggaggggaccaggaaagagaangaagggcctcgatgaggcgagaaagaccgacgcagcccgagagggaagatcgacacagacgcacgcgccacacgacggcngttttaacaagagacggaagaccggcaaagagcacggaggaaacgcacgagcgacgcacaaaggcgcgcacgggcgagacgggaaagcgcaacaagcacacggtcacgccgcagcagagcagcgagcgaggacgacacatggcgcgcggcgccacatgcgcacaaacgaccggcgcagagagaggaagngtgcacaggagggacgcacgcgccgcgcactacagtggcagcgatacagcgaagnccgaggggagtacaaccgcttatctttatcgcagcgacgacgaggatgctcgcccaatcaagcgtgaggcgcagccaacgggctacgagcagggagcagcacacgaggagctataccacgcacgcgncgngcatgccgcaccgagacgacgaaaccaccagcaaccagacaggaatcgaggaacgacgatgagtggaggatgactagaacaacacgatggaaagacaccgatcggatagcgcgacgacgcagcggagacgagaccgacaagctgcgactccgaaacacagagctggacgtgtggcgccacgcacggacgtgagggcggcagcaaacggccgaacggcctcacacgaatgcgcgacgcgagcgcggcgggaccgcgaaagcccggcatcaagccgatgagaccacgacaagatcnttgcgacgagaggtagagagcaccggacgaggacgagccgactcgtcaggagtcagtaacaaggaggtgccgagcggcaacaacatatattgagcgaagaatacgcgagcttagctgcaagcgaccgcgatgcaatgacgaaatgtggacagcagacaacgacaagacaattagcaaagaccaatcccacaatccacgcagcaaccagaggtcagcgaaaaggacgcgcggcacaccacacgacgagaagagaagggaggggaggagaacaagagatgaggggaaaagaacgcgcaggagagaaagagcgaaacagaagacgcacacgccggaacaacgccacacgaacgaccgcaacgacaattgcgccacgacggcgcnctccgggctactccgcgcgagagatacatgactcagttgggagagacgagaagacggtcagggtaggaccaggagngacaccaccaccgacgcgacaacagaggtactgacatcacacnactctcgtcgccagagcgcacagccagagatggaagatagaacacagagaagagaaagacagc

SEQ ID NO: 11374 - DNA, 1013 bp, Homo sapiens
  misc_feature (1)...(1013): n = A,T,C or G
acacgaaacaaaaaaagcagaaaacaaacaaaacctcaagggacaacggcatgctgccaccttttgagcagaaactngtaagaaaggatcaaagtgaacggaaaagctggtaaccttggtggaggggcggcgaccatcaccagcaccagcaacaagaccccgcaccaagcaccagacgcccccagacaacccgcccgccgaacgccgcaccagcctaccacgcacaagaaggaacaagccgacacaaacaaaaaacaaaaacaaaaaattctttaccaacaaaaacgaagcccacacaagaacaccctcgcggaggcaaacacaccaccaacaaacaccccgacaccctcgaccccaccgcgagataacaaaaaaatgacaaaaaacagatccaaagccagacaccacacaaaaccatacaacccagctccccaccaccccccccgcacaaccacacccgcacacaacgaagcaacaacgaccacaccaaacacccccaaaaaacaaaccacaacaagcccaacggacgcgagaacagcggagcgccagcccaaagaagaacacacaaccactacgaatagaggtcacaagacaacggacgaaccaccgacaccccaaaacatcgcgcagcaccaacacaccaaacgagaccccacgcacaggagagcaccaagagaccacaaaagacacacccaacgccaacacagcgcaacccacccacacccgcgcgcacaaaagaacaagagagaccagacaaaacacccaaaagaagaacaagagagcccaccatgaccagcgcgaagcccaaaacacgcccccgagcacacacagaggaggccaaacgagaatgcaaaaaccaggaaccagaggacacaacgaactcaacaaaacaaccactaatgatgcaaccaagaagggaaacagaagagataaagagacggaagtcgagcagccaaacacgacacacagcccaccgacgcacgcggcccgcactaagcgcaaccactacaccc

SEQ ID NO: 11375 - DNA, 1801 bp, Homo sapiens
  misc_feature (1)...(1801): n = A,T,C or G
gtgttctcggcgtttgntgtgcgtgtgtgctttcgcgnttcttgtgtcgtgtggctcgcgggcgcgtttagcgcggcgtgtcgntgcgccgtctgtgtcgctccgccgcgtgtcngcgtgttcctgctctgcgctcgtgtgtgcgtcgccgtcgcggtgctctctcttcgcgctggtgtgtgcttgggtgngtgcgtggcggtgtcgtgttgcctttctctctcttgctcnccgttgtctcctctgctcctcctcgcgcgcgtcgtctctgtcggctgtccgccgttccttctctgcctccctggcgaggtcgggtcgtgtcgcggttttcttgcttgtgctgtctacgatcgttccgcgtcggtntggtgtgcgtccgtgtcggcgctattcgtcttcgcttcgcgtcgcgcacttgctcctgctccatctctccgtgtctccgttcgttgctcgttcttgtgtcgtgcggttctgctgttcgtctgcttgcgcccgtcgtgttgtgtgtgctttcgccctgtgcgcgcgctcatagccgctctggcggttgcgctctgctgacctgttgttctgtcttcgtntgtcgcttcgcgctgctggtcgcgtgttcnttcgctcntcgtcgagtgtgccgactgcgctctgtctgtccttctgctcatccgcgtctcgtncgcnncgcgtcgtgcgcgtgcgccgngcatcgngtgcngngntgcgcggcgctcgcgcgcgtcgctgcgtcgtatctgtgcgtgcgctgtctcgttcgatgcgtcctntgcgcggtgtcgttgatganttgcgctgctgatgtngtgtcgngcgcgtggtgtgcgtgcgctgtcgtatgcngaggtgttgtgtngttgntgngngtgtngtcgatgtcgctggatcgtcaccgtgtgtgccgtgtgtgtgggctgtgtnntcgtgtcgcgtgtcttcgcgctctccgctctcgttccgtccgcgcgncgcgctccttggtgnggttgctggccntcaccttgcgtntgtggccgtgtctgtgctcgcntatatgntatgntcgntgtntcgctcgcatctgtcttgttgtggtgcgtttatcgtntctatntngttatntatcaggaatntgttctatatgtgttatgtnatatnntnttntatatatgtcatcttnttccgtnagtganttctgataatantctgatatcntctangcactanttatttcanatcgcgtcttcnttacgattatcngctccgttcgctctctgncgtgcccgcggcctacgtgcngncgctgtgctgtctctccgcntnggttgtactagaagcgatntgtcgcgtanctcnttnntgtgtcttatngcaactctttttctatcgcggtgcgtcgntctgtgtttttctgtgtctgcgtgtgctctccccgctctccggctcggccnnnnttcctactcctgtacnctnctgtnttctattctgtttttatcctatctctctctctatagaatgttntctttttcttntnncgacgntctttacttgtcgctnnccctcntnntgtngttgctctncttcatntntggttgtttgcgctgctcttctttntcttcgaggcnttttcnntnnttnntnntntnttntggtttntnntcctccnannntnaaagggnttctttttttctttatnttctttctttatctttactcatatcttctcctcatctcgcacactccnnctctctattttctatctctctcctacttcttctcttctttctnttnttcttcccttttttta

SEQ ID NO: 11376 - DNA, 912 bp, Homo sapiens
  misc_feature (1)...(912): n = A,T,C or G
ttagagttatttctggtgaagattgtcatgatcaggtctgaatgcagaacaatataaaattaagaattaagtgcttcatcaagtttctgcacgtgagccaccagcagctttgcatgtactgtaagtgccagccaatgaggttaatgattcaaaaacccagagtacaaggagaatacaatgtgcaaaggaaatgggccccgccaccttgctcaagtgccgtgtgaagacatggatgctgaaaacaaaatctttcccgagagaaaacaaccatgcttgcactgtgttttcagaattgcgtcctcatgtaaattaactcaataaaattgggtcctttccttcttttttttaattattaatatggaaatatgttaaatatacaccaaagtagaagatgatgtcagggaggtaatcgccaggccactagtgcccagtggctattgcacnaagtaagagtccacggacggttctgagcagcgcagcagcgtgatctggcttatgtttaaaagggtcactccgactgctgcgtggaaagtcacctgccgatatgaatatataaaaaggaaaacgagctaagagggcattgccataatctaacgatgaaaagatgatggcttggattacttggtatcaggaggaggtaaatatccagtttttcgccttttgtaaaatataattctgacatattaaaattacagtcttatgagatttaagaacttcctttccattttcccttaagtgccccttgaacggtcttggggtatttaggagtgtcacatctncccgaacaatttttaagtgtgttcagcgcctccaatcttttcccctgtggttccttgtttttgcccttctacctgtggagtctaggtacagtgcctattggttccttgtgagactctttgcgcggcacacgtg

SEQ ID NO: 11377 - DNA, 823 bp, Homo sapiens
ccgcttccctctctccccaacagcaatcacaccaccactaccaccccctcacgacttcgtcccctctctccatcgcctctatcttatccactctaactcccatctccctccccacacgcagctgtctactgcctcgtacttaccccccgccaccctcgcaacccgcgcacaaacacacgccgcccggccacccaaccatcaacatctccattgaacatcagtccccacgccaatgcaacaccccacgcaggccacgatagcccagccgtaacactctctcgcacccccccaccccctaaagcaaaacgaatacatctaccaaaaactcgcaaccgttctccctcccccctgccactctctcctagcttcatcctctctccctctctaacatcttctgtctgccatcccaaccgatcttctgctcccccccgcctccccatgtctgctttttaacacgatcacacaaatcatacccccgggctccagtgttcgctttttaccaaggattcagccgcttcccactaattctcctccaccgaggtcgcccccactatgcaaccgcgccccacacaacgtatagattctcaccttccccccattctcccagtctccgagcaccccccttcaaaacagaaatttcccatcccatgtggaaacaattatcccccctgttctagttcttcacactgttaattttttttatccatgacattgttaacttcaaatatgtttaatgtgttcattggtggttctttgtcttatttttgaacccctttcctatattaaaagtataaacttttgatttgtaaaaaaaaaaaaaaaa

SEQ ID NO: 11378 - DNA, 699 bp, Homo sapiens
tgcacaatgaatcaatgtcaaggtgactgaaaaatagactcacatcaatgctggactatagatagttttatctccaaccacttgtgtcaatgtgttggcctctactctgatctgcaacacttcgtcaagaaagagctgcctggatcccagccatagatggagacatgggagaatccagcatatatagattcatcgctagaccgaacccttccatgtagcataatattttaaagtattactagtatttcttctaacagttctgacctcaaatgtcaatgttctctctttcaagtaggtgcagatcaagtatatttatcattcagcctctcaagtagtgattatttgcgtgtttctcttggccttcactgattaatcagtaatgattctatagcctgtctgtcgtacactcctccagtcaatatagctctattgggacatatttcacatatcatataattcacttatttcaagtgtacaatcaatacaaaagagtaaatgttccaagttgtgcaatcatcaatataaattagttttgtatttccccaataagatccctcatgcccatgaacttttaatatttgctccctcgctctgcctcaggcagacaatagtgtgtctctctgtctctatagatttgccttttatgcgccatttcatataaataaaatcacacattatgggtaaaaaaaaaaaaaaaaa

SEQ ID NO: 11379 - DNA, 1326 bp, Homo sapiens
  misc_feature (1)...(1326): n = A,T,C or G
gaaaaagagtagatcaaattattaaacacggtagagaggaaaangnnnttcgttttnngtttaacnncacgcgccannnaccccttgnaanagnanngnatcnnanatactgctncnggggacagcaanagganagggagaaaaggagctttgaaaggaannagaggcagaagcgcgtgancgcagcaaggaaaccggagagnacgcaagcgggacagacgcacaacgagaaaagacaccgaagaacgcaacacagcaagaaagcgggacggcaccacaaanaacacgagacaccnagcgaacagggtcttcgcgtggcgtctactacgtanagagcgatcacacaccgaagtacacaactcatagcgacaacaaanagagngaaaagcgntgcataattccnctgcatanaacaacncgagcgacgcncacaaacagcaagccacacaagaggcgacgcgacagacaagagaagaaaacaacgacagccgacaacacacgacgagaacgaaccagagcagaccaacacgagaaacaaagacgacgaaaggggaagggaggacacgaacacggagagacgagaganacagaacacaanacacgaagagaaagagaagaaacaacagagaaaagagcaggacccgcggcgagggcacggcagcagcgaagaagcaacacaaacacgagcacagaagaccacaagagagagagggaggaagaaaggaagcacaaggcagaacagaacgggaagagcacacgaccacgagacgagcacgagcaaagaccacacagaagcagcgagagagcacaacaacgcagcgagacgacagacaagaaaaagaaaagaagaaagagaagagaagaggagccaaagaaagacccacacagagaggcggccagacaacgaagagcgcgagacaagagaagagggnacacaacagaacgcaggaacgagaaccagagaaagaaagagcagcagaggcnaagagccgagacacgggagaacgagagacgcccgcaagagacaacgacaaaacagcagaaacacaacaaagacgaaaacacggacggaaccagcgacgcagagacagcagaacgaacaaagaggacagaganaagagagacgaagacagaaagaagcgcgcagcagacacgcacaacgagaggaacgaagaaagaggcggnaacacaaagagaaaggcacaagagaagaaaagaagagagagacgcacaaagcgaagaagcaagagagaggaaaacgaaggagaccacgcagaggaagcggagcgacgcagagagagagagccacgcagagagaaagacacg

SEQ ID NO: 11380 - DNA, 518 bp, Homo sapiens
gtgggtcagtgcggatacagatgaagctaactctcgcaactattaagaatctgaccgtcgcagaagacacccaccattctcctttaagaaagtaaagagtagggtgaaataaaagaaagcacgtcttcattgcatatggaaacaccttatagcgatcagaacccggcacaaggtgacgtcttcgcgtatcagccaagcgcagatgtgaacccgggttcgtagattcagtacttccaacactgaatattacgtcaaagaacatgtgtaattttgcaagggattctataggctaaaacttgactgaacgtaattgtcctcggcactatgtgttcgtggacgtatattataaaagactatgttgaggactccagtatgggtcattgtaaaactataggattgcatctcctcagaaaccgtcattgaccgctaacctcaactcagaaagtgagccactgcattgcttatttgctcatcccgaggtttttatacaagccttgaaaccaaaaaaaaaaaaaaaa

SEQ ID NO: 11381 - DNA, 937 bp, Homo sapiens
  misc_feature (1)...(937): n = A,T,C or G
ctcaggactcttgtcagctccaatgctgtgggtggtttgacccagagtgggtccaagaagccactgacatcaccatgatcaataccccgtggaaagttcctctctgccttagaagaaggagacagaggccctgatgtgtggaaggaagctggcccactcccactggacgctgctacagcctctgagctcacctgggagttacccgggagggaatgtccccaacagtctcatcagcatgaggatagaattttatcacaatgataaagcgtgatatgatcatttgtcctagggcactacttagaaactgtcactatcggccgggcgcagtggctcatgcctgtaatcccaacactttgggaggccgaggtgggcggatcacgaggtcaggagttggagaccagcctggccaatatggtgaaaccctatctctactaaaaatacaaaaattagccgggcgtggtggcaggcacctgtaatcccagctacttgggagcctgaggcaggggaatcacttgaacccaggaggcggcggttgcagtgagccgagatagccccactgcactctagcctgggcaacagagtgagatttcatctcanaaaaaaacaaagttcacgatctaagacttctgtcacttgagttctataaccattggataaatgatcagggatgcccagtcactggcatttacggctttgtgttctgcctaaatggtcctgcctaaatctggctctcttttctggaagaaatctccaacccaccccttgtcatcatcccaatcttttgtttcaagctgctataaaatagaatatcctaattccatattcccagccgggtcccaaatagtatggagaaatcattctgaggccgaaaaaaagaatggttgttgccaaattaagatataattaattacggaacacaaaaaatacaaatggcctt

SEQ ID NO: 11382 - DNA, 728 bp, Homo sapiens
agagaatgcgacgaaaagagataaataacaacaccaaatagttacttaatattactaagaagatatacctagaacaaatattgtgtaagagttaacaatatacgagtttaacataaaaatgatgattctgtgtgtaataatacaatgtggagtaagatgagaccaagagtagttgagagattagccatgacgagtggttgttgcgcttaaaatgtacgtatctggaaacccatataagttacaagaaagaaagatacgtcactacaattaggcatatgatatgttctaacgcaatgatcgtaaacgtcgatcatttagacattagagatcatagctccatgtaaatgctattttagaagcatctaagctacagtgtcagatgagtggttccctagggccagagataggaaaaggattctgttcgctaaacagtgtgagggaacttttggggatgatggaagtgtggtaatgattacatgacatgactatatgtatttggcaagactcatcaaactgtaccttaaaattggtgcattttattgtatttatagtgcaataaaggtgattaaaaaaataggcaccttaagattcttgcaaatatataatatgcaagtcttgtgtgaatctgttatttttcctgagtaaatatctatttgtaactatataaaattataaagttactggtgttactaataaagaacttgggatggcaaaaaaaaaaaaaaaaa

SEQ ID NO: 11383 - DNA, 276 bp, Homo sapiens
  misc_feature (1)...(276): n = A,T,C or G
ggctacantcgtgccgaccaggtacagaactcatccgcataataaaaggttgggatggggtggccaacttcttcacgctctgtgtaaatgacacacctgccccaaccaatcctctaaaccctgtgggaatcagacaccgcatcctcaagctcatctataaaaccaaccgcatctcgtcgcaccctgggagatacgctcggaacccctccctctgcacaagggagggtttctcctttgcctattaaacctctgttcttaaactcaaaaaaaaaaaaa

SEQ ID NO: 11384 - DNA, 914 bp, Homo sapiens
  misc_feature (1)...(914): n = A,T,C or G
ctcagcgtagctcacaatagctaattaacagaatcaatctaagtgtccatcaacagataaatagataaaggaaatgtggtgtatatacacaatggaatactgttccaccataaaaaagaagaaaatcctgtcatttgtgacaacatggatgaacctggaggacattatggatggtccctggcatgatatgttttggctggctgaataaatacatgaatttaagagagagggagaaaacattttcggtcatgttcaatgtctatgatcacttaccttaaactgaaaacaagacagttattggactttctctaaaggcagatgcagtaggagctttgccctcctcctctcaaccagaacaaactgaattttatggaagaaaattcttagctgactctttaagactgtaaaaggacatcggaaatagaatcatttgtgtatagtgattggctntacatattcagctttcatggagttaaggagactgttctaagaaataaaatttaacttgttatcagttgaatatttatccaaaagatgactagatgacatactcaatcctttaatgacctatacatctgggaaataaagataccaagaccaagaaaaacagaaacatcttttcaagtgatttgtgtccctccctcccaactcctatgagaacatatgtctgaaaacattagaanatcatgggaaaagataattaaatattcgaagctactctttaaaaaaaaacaaacaccaaanacacccaaaccgcagccccnaaccagcaacaaacgnacgagaccacccggggaacaaaannnnaaaggccccgtgcgctaaggggggattctcggcccttccctttaagggggtaaataaaaccccccaattaccccgggcccgggcgtcgctcggagggggttccttat

SEQ ID NO: 11385 - DNA, 1744 bp, Homo sapiens
  misc_feature (1)...(1744): n = A,T,C or G
agacgggatagggaggtnagaggggaagaggatggtatgcgtgacacgttgataggctggacatgggaggnncagagcggatgatgtctcgagggacaacaggatgggtggtcaggatggtgctcgcggcggagggtntgatatggtgccacattggttgtcattatgaggagtgagtcnctctnncctctactcgccctgataatgaggataggagaggtagtgtgtctcgatcgtgtgagttnattccgttgtacggtntaatgtattcattgaaggaagcgaacagatgtagggcaaaggcagcgagcgtgcgaccggtgtattnttcgatggtatantatctgtcatgtaccacgcagagtcaccaatctaatcgccacagtgcgcaccgagtgcgnnacgtgacagatggcgcatgtcgccgcacgtcgcncagatgtgtgncgacacgtgtggtgtnacgcgcgcactatgaggacnnctcgcgtcgtcgatgtcacgcacgcaccagagtagacagagcgtcgncncncgcgcgtcnacacgtcantcntcgcgctgctcngtatatgatatgctagtgatcgcagtacgtatggacaantaagagtatnncatgcagcgcagcgctacgacagtgagagtnggcgcgtcannctagcacgcgagcgtnctncacngcaccactacgacagagatgctancagtgacgantagangtatgcacatctgctagtagagcaccagcgtagagtcatagagtgtgagatgacatcangtagtanncncagatgcgtnggtacngaggncntaggtgtagtgtagtngatgaagcagtcctctgtaggtcacnnctcagaggagctgtacagtattgtgntaatatacgatggtgncggacgagacggctcactgatcgtcgtcagtactggtcccgctgagatggcacgtgcgtcggatcnacggcgccgncgcgagcgtgagtggtcncngatgtgatgagcgccgccacgtgtgcgncctccagcacatgcactcacttgttactncgcacgctgtctacatatatactggntcactncatcgtagtgncgtgtngctgatgtgacaganancantacgaggatagtctactgacgacgcncnctctgtatgacgtgcgctcgacagcgcgcgcgtcactgccgtgacagttgtatgctatgatgtctctcgctcganangtagcagcacatnctctatatcgttagtgtgatcgtcttantgcacaacgatagcacagtcgtagtntancgtctcgacagcctcacagagcatcgagctacatncgcgcatcgtactgtatgtgactatcatatgcgcgctgtgcttgcactaggcgatcatacgccancagacgtacgtgtagacgctcccgcacgcgctggtcgtctcatctgagtccgcgtgacactcgtgnnatttcttcgtaggtagagnttctatcgagatgtgtcatattntccnatactgctcatacgacactctctatctatgtactatcagtctgatnactacgagcagtcgactctaactgcagtacnctacgcatgcgagtagtgtgagtaacacttcaatatcgacagaggcnacgactatgttcgctctncgcgactactatgtagctgnatgtcggacagtgntgtgagatgcgntntgagagtgacgcgagnctagattgagcgcgtgcggaagacgtgcg

SEQ ID NO: 11386 - DNA, 1705 bp, Homo sapiens
  misc_feature (1)...(1705): n = A,T,C or G
gatcatgatcgctagacagcgtgacataantcgtacagcgtgcgtctgcgagtacatcgcgcctatccgngtctancncgtggctgtcgatcgcgctggtgctacgattctgcacgcgataccgtaaccatcatatctcatgacgcacatagtgacatgcgagttgtatcnacactagtgcgctcacacagtcgtancnatgacatagtcatcacgatcgacatccggagagntcnctnagcgcgcagaganntaagatcatcctgcgtcacgtatacgtatctgaagacagaccgcacgcagagtagnagcgcatgtgacgtgctcgcgcatcctgcccncagagcgctctgcnantagagaggcgtactctgangattagagtgcgtagtccaacgcagagcgagcncnactctcgagccggcgcngcacgtgagaatcgtagtcactgatagaggtacactacgcagctccgtcgacagactgcatgctagaagttctacgtctntagtcacacgaganctactatagaatcnctctgcgctgtcacagacgtcgcaacaatgcgcagngantacacgtatagccagtgagtgcgntaacgggtncaccaagcagcgcgagcgatctacggtcgcgcgcggcagacgctgntnggcataatgctancgtcacgctgatcgacgtaagtcgatacgacatggcactacaggagcgggtagaatgacatgagatgagatgtacacagacgtagcgcntgcgtgtgtgcttgagtccgtacgtgtacacgtgtnatatgtgatacacntgtgcactatcgatgcggtcgcacgctgacgtcctgcgcgactcgatgatatcntacactacacagagagtatcacgaatgacggcgtgacntactactagtgccnacacacactgtatcgcctctagacagtgancgagacggagatactacangaagcgcnacaccgncacgcgtcgagtgtcgcancgcgcttantgtgccccgacgactcgtctgcctctgtgcncgacaagtagagtgttctatgctatctgatcagcacgatagncatgtcttcactcgcntgtgtngctactgctgttagtatagtagactggacgaggtcgcantcatgagggatcagcgacagtagcgatcacagcngctgcacgacgacncatcccagcatagcggtactgagcactgtccatgtaatatacgcgnccatgtgtatgatatctgcctatacagtatgaggtccacgctctgatgtctgtacgcgcgaccgcagtgtgtctcaagcgtcgcttaggantcaggatggctcctcgtagattcgtgnnncgctactgtcntatctgtgagtgatccctcgctcgcggttncgcgggcgcgtacttcaccggacgggatacgacatgtgggagtagaagaagatgacgtntcatcgtaatattggttttctgtcgagtagtcctcactgatagtctacgttgatatagttacatgtatatagtgatagtctcgacaataggtgctgtgtaacagctttgtgtgtgagtacaaggaagactgatgtgatgaggaagaggtatcggcatacggttgcatgatggcgtattcgggtagcgcgcacatccgcttgtggacgcgaactcactggtgcgatggtagccggcgcagagagttgtacct

SEQ ID NO: 11387 - DNA, 935 bp, Homo sapiens
cacctcccccccacaacaacaaaaaccacacctttactgaaactattttcctcaataaaacctggtacgcagaggtgcagctctgacttcaacatcaccattaataactccatcaccgagcaattttaccttcttggagctgaaatgccacgcatcaccactcagtgtggagggactctctaccactccaaaactctactcgcactcgtctcaccaacaaccaacacaccacaccccaacaaacgccgaaacagaatataatctcgcctctttcaaccagccccaaaaaaccaaaaacaaaaacacaaatattacaacaaaaccacacacaccctccacaccaaccccccaccacacaaaacactccaccaaccctaaacccaccttccaacctcttaacacacacccattcgccaatcacaacaccccaccataccacacaaacgactcactcctccccgatatcccaaaaacccacatacaccccaaacctctacacaccccccccacaccaaaccacacccatagtaccctcaaccactaccaccccatacctctacaactacccacctaaaacgacccgcgaaccaaaaacaaccaactaccaaaagaaccccgccacaacagcccacaaacaccatcaacaacccctctcatgcaacacacccacatatcgcctcacactccagccattcaacctccatccaccacccctccaaccctaaatataatctcatccaccaccaacccactaagacccatcaatatacccccccacaccaagacaattacccccaacccacattcctccataactcacctatactctataacaatacaccacaaccactcccaacacacaaatcaaccttacaacgctaacgaaccatcccccccacatcgtcaaacattaatctccaccccccacatccccc

SEQ ID NO: 11388 - DNA, 848 bp, Homo sapiens
cctctattaccaactgcacgcgcctccagtgactaacgtccaattttctgcttccccttggccaatcggtcacataacgattctccagctacaaaatatttctcaacgcaatgcgttatcgggcccataccccaccgtgagtgcggctccacctgtacacaactatacaaagaccaccgtagcggtttataaacctccgcgccgcttggaacctgtaggataatgtgatggccaccacgttcctactccactcattaccactatcggtttcaaagaatcaggtggatagccaggaaatcgacccacagttttgttttcttaaaaggttccaatgtcttctcctcctggtgccgcttgtctctgggccatacaacttattttaaagacaagaacaattatatgcacttgagttaaatacacaaccccaagtgactatagcttgataagtggtctttggtaaatttatgagccaaaatctgtgtcataaattgatagcactccagctaacaaaagattgccaataaaacttactgtaaataaaaccatctaaatcttgagtatgaataaagtccattagtttgggttgtatttttattattgttgtttttgactcctgtgatgcatgtacattttcttttattcccccactgcaaaatcatacatttgcacatttaccagagaagggcaagaaaatataatcaagtgatattacttcttagaccttggaagatttggataggtgagaaaggtgaaagtcaacagccaaaaaagaaagagagagaaagaaagaaagaagaccgagcaccgaaagaaagaaaaaaaaaaaaaagaaaaaaaaaaaaaaaaaa

SEQ ID NO: 11389 - DNA, 1370 bp, Homo sapiens
  misc_feature (1)...(1370): n = A,T,C or G
gtgaaaatggcgccgatagagtgtgcttggcgttacctttctgtctggagggtgtgactggatacaagcgtaaacacgcatgtagacgagcaacacaagaagtgtatatctatgtttggtcaatcgcacagcaggatgtcgtggcacagcataggactaacaccttcatctcacttgagcacacctgattattggtcacgtaacgccggctctggaactatggaaacagcacagtcanagaacatctacacctagacatccttagtgcgcacgacagaatgaatgatcgtctccatcatctcgacaccgtgacgaacatacgcatcgccctccacacgaagccatcaacacccatgaccatctaccacctatatctgccacaattgccgcgctcgacgcctcacgacgcgtcgatacacaactctcaccatccacaacttctgccgccctcaccggcatgccctacatcttctctacgcgtcgtcatgcatccgccatagtacctaccgtgtcttacacgacctcnccacttcgctcgcgtaagggctcctgcgtacataccacctcacacgcgtatgcactcactcagcacacatcgaactaggtgcacatctcgcgctctctagatctncatagctcacatacggcactatatgtacttctgaccacgcagccgcgtagcagtcgtgcagtcgtctcagatcacgacagactgccctccgcgtccccgttcctctcacgccgctctacncacccaccgcgatcaccatgagacatcacgcatcgcgcgtgcagttcactatatantactctcangtctatgntgcgacattctcacaagacatcacatcctcaaccatcacagcnctactccactaatgctctatngtcacctccctatcactcgctcanctcacacactcactgctcttctccactgcacatctatatgatgcgctcctacactatacatgcttccagtcgcctatatgtgatacgtctactgtcgtatgcncatctcgacccntccgccgctgtctatacctcgcangctgctgccccgtctcagtacgtatattctcttcggcaactacncgcacagagagcgcgagcgtatcgttgtcctccgcacgtcgccccgatcttagantcatctgtcgcgtacggcactctcntgtacgcaccagagtcagagatagcncgtacctgagagcgcaccatgcagctgcctctcgcttgtnacatatnnactgtgggcttctcgtncatgantcacagacgatccccgatacgacacgagcgatatgtggagtgttataaantcaatacggaagttcacgctcacgcncacgcgcgacgtccgcagcgcg

SEQ ID NO: 11390 - DNA, 1205 bp, Homo sapiens
  misc_feature (1)...(1205): n = A,T,C or G
acaaaccactcaagtacaagaggagtcgtctactaagacgcacggtatganttgcccaacagctccgagcgcggcggaaatatactcatanctcaaacgagaagccctcgcatcctacgccccagctacctaccatcccactcgcacatacctcaccacgaaccctctcccacttaaaccgagtagatctcgcgtgggaatcggatacatcatccaagatcaaaacatgagatacacactacgccgccgccttcactccgcactctcactaccccgaccaatcaggcacgacctgaccaaacggtaggacctccagcacatcccacaccctctcaacctttctccacaaccgggggacggtcggcgccggcgagcgccagcatccatgacgcccaaataacaacgcaccgcgagaacgacccagccccgagccacagtcactaacacgtcgaacgcgcgtgcgtgctcaacaaactacagagggctaatctctccccccactcctctccaaatcaaacatctaacacaccagaccgccgcccccgcccccaccacccaccaatagccgcaccgcaccacccaccaactcacatcggaccaatccgaccaccaccgcgagagtgcagacgctagaggagagnatcgataaggaggtcatgaagtggagagtgagaggaggtatcgagaagagacggcaggtaaaagggggggacggtagcgcggccccgcgcccgcgtaactactaataaacaaccganggcgccccatcccccatcccatattgcacccctctctnnaccactatctatcatccctccacccacaaactatatanccaccaaacaagctcccccccgcgcccacgtggatacagcgaccctggcgatagagcatgagatcaccaccccacaccagtcctgtccacccctgtccgggtcccgcccaaccaccatcgtggcatagtccccacttgatcgttcgtgnttnggacacattncgtanctattgtannnnnttattcntctggtnnngngcttgtggtgtnntngtggggngcctcnnggactcttgctcttggtgcatcacnnncnttccctnattttnnnctcactaccttttttcctcaccccctcaatctttaaaaactatcatataacatccaaacacacaaatcaaaataatattnataaatacacccccccccc

SEQ ID NO: 11391 - DNA, 1154 bp, Homo sapiens
  misc_feature (1)...(1154): n = A,T,C or G
cccgggtagtaatgctataataaggatcgcatcagngcacagcgcgctcgctcgtgcgagatcacctacgtatttaggtagatcgcggcgccatgtcacgcgagcatcctcgcaatactcatcacatataataacgtacctatctgccgcgcactatcaccggtcggcgcttgtgcctctgtcgtactgcgacgantcgcaggactccgctgtacgctgcgcagcagagcgacgcgcgcnacatatacctgcgcaacgcacgtcgatgtacgcgcgtgtgacgaccatcagngcgcattcgctctctcctcactactcgctccgtacacatcatgaacaacactagcacggacacctcgtatcgccctgacgtacagcggcgccaagtgttcttctgcgccgatcgcgcagcggacccggccgcacactaatacaataccttgatttactactatcgtattcttacacaccacagtctacgcggcgacgccaaaaatcgactctaatcacgcctcaccctctcgaaacatcactaccctaatcaggcaccctacactctggaccacaaccgctctcacaactctcatccggtgaacgtccccgtactctttaccgacgggctcgtacgtcacaaatctccccgtcgtggcgccattattaaaattctggcgcgcgaccaccctctagctagcgtctctcacatctgctctctgggtgatctggtggtattctatccacgttcacgcatcaagagcgcgcgaactcacccatcgtcgcgccctccacccatctctatccaacatccccccgccacgtaatcatagcatcgcatactatgactcgcgccccctcccgaaaaaaaaaaaatgcacagtaacagcggtattgttctctagatacagcgccagcggccactgccctatcgagccactgtctcgcccccggcgatcgtcaccacttctcaccatcacggctatctcgatgtatctcttgtccaccatagtcttctccataaaatgccaccctaccccgccgtgaaagaacttgcatgtccaagaaccaaaaaaaaaaaaggcgtttgttggctccagcggtggagtcccttcgccagacaaaaatttttctcgttccttcgcccggcgcccgacgcccct

SEQ ID NO: 11392 - DNA, 940 bp, Homo sapiens
tctccattgccatctcaaaggacagaacaagacgcgccctccagggaaacattgaattctgaatatgaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcacgcgcagtgagtggagatcccgccactgctctccagcctgggtggtagagcgagaccctgcctcaaaaaattaactcaaacgaattgcttctcgcacttaaccatactcattacatgggtcctagtcattctttttcacatgtatgtcaattgggtccgcccctgcaccctcctcgctcttattttcgttttcttttccgcgaggatatataataatcgcgcctcctccagacaccaacagtccgagaccctacatcttattaccaccacgaaggattaatgttaatatcccccgatattgcatagtgccgccccgcctccccccccatcctctaagctgtcctcgcctccacatagacgcccctctcggctgctctcctccgcccctatactagtttattgtgcctcaccctccacgcaccctcacgcccatactccatcactatcttgcgcttacgtcctgtgagcctcttacttgttcacggtctcgtgttcaagggccgcgagtccctcggtacaggacagagcttcttaatataagttagatcaacccccatatacctatcacctctccccaaactcccccttgagcattgcgctcctgccacgccgggccgcccccccaaacgcccccacacccgcacccccttcctaccgccgtcccccccagtaaaaaacccttattgatatctccccacccattgaggcg

SEQ ID NO: 11393 - DNA, 609 bp, Homo sapiens
  misc_feature (1)...(609): n = A,T,C or G
cgcgtgcagcagagccgaggtagggcgcggccgcgccggcgcgcgccgcgcaggccgccggggtgcgtggcgcgcgcgcctgctccggcgtatgagaacgctcagccgcgcgccgccgcgtcagcggcgccgcgtgccgtnagttgctgccgcagccagcccgggcgccgcgcggcggcgcgcgacgccgcgggtcgcagcgcgagacgtacgaccgcgccgcaccacctcgcaccgcgcaagcgcgactccgaggctcgcactccgagccgccacgcggcgatcggccggtgcgcgggagcgggcgcggcagcgccgggcgtgcgcggcggagcggcgggcgcacgggcgcgcggaccgccggcacagcgccgacggccgacgcgccgccgcgcacgcgcctaccagagtcctatacgcgcgcgcgcgagtggcgcggctggtgcgcgagcgcgcgccgcgctgcgcgcgcgcgatcgacgccggcgcggagnaggcggagagcagcgagtggagcgcgtgcgggtgcagagggagagaggacggtgatagcacggagacaaggccgaganacnaggcgagcgcgcgcgacngncgcgactgccctng

SEQ ID NO: 11394 - DNA, 711 bp, Homo sapiens
  misc_feature (1)...(711): n = A,T,C or G
cttacttatctatcaccactcacctcctatccgcnacaccaacnacccaacccactcgctaacactaatacaccacacacatcatcgaccgtccatctgagcactacacgacaccacttctgccactctgtactctccccgcacctcggctcantattgtattattatatatgagagacgnacaccaactgtatacccgataatatatatattacagtaagcacgcctatatacatgcatcgtatcagacggtctcagattatcatagacgtcgcagcgtacagaacgagtatactacttgtcatgactacactgtagtcgttcaactactacccctctatcatnactacagtctcacgtactacgtctcatgctctctctagcactgactatcagatacaacgtgcgtntantcacaatcatgatctcaaactacgttgacgatacaacagcgtagcaccgtcgatatctcagcagagtgtatctatagagtcccactaacgtcacagtagtcgtcgaagccgactgttatgcgctacaatgtccacggcatccagcatagtgnancgttgacgtagtcccgtcgctgcaactggtgcacagtgctccnacttatgtcgagacacttcgagtctgcctaacgcgacgtcttatgtacaacagataatgtgtaggagcgcacgacagngcacacgcaggtaacgcgntcct

SEQ ID NO: 11395 - DNA, 860 bp, Homo sapiens
  misc_feature (1)...(860): n = A,T,C or G
cttcagatgaagaaaatgaatactagtacaggtagcttgctacggtcatagaacaagaaaacagaagaccaaagactgcaatttgtatcttctgacttctggtaccatccagcaaatacttcattcctccacactgccttgcaacagaagcaacatcggaaatgcctgccaactcacagaatgaaggaattatccacacagatatccccagtttgttataaagttttcaaagaacactgtacaccaaaaccagccttttatacctgtaatttctggggatcaacagctncatcagtaagctttaacttgtggcttttggcttaaagacatttaactaaccccctcacgtactgcaatttcctgggagcaagcttccacccccaatggctctgaaaccgtagtggccagatggggaaaggcaatcagacagatcagtcccttgcttgcctagctcagcaccagtttttccagaggctgcctttggatccggctagggaaagcactgatccaggcatccctagctagaccgaccccaaattgaccccagaagaacagaaccttctctgctaacacttttaaggtaaccccaaaaccaaaacaaaccacccagcaataaacaaccaaacaaaaggcttcaggacagaccatgaaggcccctggaaagcaacgtttccttccaaacttggtttccctagtctttgggacctaaatccctcttagaatcgtcgattaaatatcctcaaataccgagtgttttaagtgtaatcttttgccaggaagaacatcttacaagccgggaaagggtactttccgatttctcctcatagaggcttctgttcattcctaaccctataccgggg

SEQ ID NO: 11396 - DNA, 1227 bp, Homo sapiens
  misc_feature (1)...(1227): n = A,T,C or G
aggagacacactcgaggaagtgtatgtaggcatagatgacgctggaggagtcgtctcgtgtcgtgcatattcgcgaagccaatagaagaatgtagagaggcagacagagccaggctgcttctacgagcagagcgacggacgtgcataatcatacatatacataagaatcacgatcatgtggtagttttcatgaagttgaagagtgtaatcgatgagagcggttcttattagaaggagtcgcggtagcgtcgagcacgacaatgtaagcgaggtaagaagagcggtgaaaaggacgcgtaaaggaatagacagcagacgggcagagatgtatacatcactaggtgcgtgttactgnagnaaaatacacgaagaccaacatagtatgcgtgacgagaactagatatagagtganatgatatgttgtgaactatatgagaaaggagtaacataccgaaagcggcgaccgcactgattgtacagtgaagagaatataaaatgtaagagatgagacggtagaagagaagagtgatgttaagcggtcatcgaatatgtactcataagaatcgaagagctacgaacatacttttatcaacttcttctggacaagttgtacgcgataggagcgcggtacggcaatagacacggcacggtgtacggggtatagaagaagtgggtgggagtatgggtcgggtaggagagggggcgatattctaagagccatttatgttgatttattagagatctgatgaagtaggtntgtgtttctggggcgggcgactacgtgtggtaggtgcaaaaaaggaaacccggcgctctcctcaactattttngacttattataaaatattaattaattaacatttaaatatataatgnnaacaaaacaccactaagagaaggttatcatatgttcagattctgagatatgatgtggaangcgaataaaatagactcacgcactacacctcactcaagcgntctcaactactttccgcnnaccacacacccgggncgggggggagnnngggcgngggggatgtgagcgnnaggngagtaagcgtggggnnnggatgnggggggtgnnnggggggggacgnggtgcaaggggcggnnncacgcgaccannncccctntncnctgccctnncaaancancacccntnnaanaaaantantaaataaanaaaaaatntataaaacaaatnactatcaaaatccacccccccta

SEQ ID NO: 11397 - DNA, 831 bp, Homo sapiens
agcccctaaacgtttacgccatgttccaagaaaatgtttatttattttgttttggataagtccccgctcccccgcctgaatgcattgttgatctgtgctacatcaacctcaacctctcggtttccaatgattctcctgtgtcagcctttcaagtagctgtgtttcaggttgtgcccaaccaggcccagctagttttcgattcttggtaacgatggatctcaccatgttggacaggtggtctcaaactcctgacctcaagtgatccacccctctcggcctcccaaattgtgggggtacaggcatgagcactgcacatggcccgagaagttctttaatacagtgattgcttatgcattttgaattcaaatggttcccaacacagtgctttccctatagtaaacaatttttttttatgttttagcatactctattaaaattagtgagttctaagtttgataaatgtgtgtgaacagagtgaaaactgagaaatataaatcagagaaaaagggtttatgtagtaagtataaagctaacagtttaagaaaaataccaaagacttgaggaaaagacatttgcttttgaaaaattaaattaaaagtctaaaaacaaatgtaatttacattatcccctttttattacttcaatttataataattactatagatcatttttatgctttttttaaattactggatttttaatggtataactgaagaactgtgggcaatatgcaacacttctgagagatttgaatcaaaagatatgtctacctatctatgaatctgtccatctacctcaataagtatatcttaggagaaaaaaaaaaaaaaa

SEQ ID NO: 11398 - DNA, 896 bp, Homo sapiens
  misc_feature (1)...(896): n = A,T,C or G
gctagcgcatacacatcagatgcactcgatgccaagctgtaccacttccagagatgatgctacagtttcgtcattcagtaaagtgatctgagactacgttttcaaccctgtacagganccagctgaatattaggactcatgagtgaggacaaagttgatgggagttaggcatgcctagacctcaccagcagaggtcagaataagacaagaagtacaaaaagaaacgtgtctttttacagaacaccctgacattggaaagtctatcagtcatgtatcttgaataagatttcatactacattaaattaagatttttttgatataaataggttccagtatcctatacaccatgcaaaagattgcactacatgaaggtatagctgaatctttgataattcatagttttacatatctatccttgcttattaaaatcatcaatatactcaaagaaacaatattatccattattaatacacgtctctacagatgaaacattatgctttggttatgcgctctactgcctgtttggcgggaaaccaaagcccttagtaacacccatactaatgctcttaagagggaccgataccactctgcctattttaacagagaactgtcctcacgcaaacaacacactcggccacctggagggatagttggattacctgacttgccctagcgtctaattttaccccatgcgtcagcacctccctccagtgcttgtctttcaacacttgacaacacaagtttatctcctcccgttattactttaacaccgatctttcttaaaaatttcgggtaaagcaacgctcgcgcttgactattatccacaagcaacacaactcctctaactcgccacctcggcatcacttctactaaagctctcctcccggcgctgcgg

SEQ ID NO: 11399 - DNA, 852 bp, Homo sapiens
ccgctcgatgatctaacaacgggtatacctattattattcagttttgcccagcgtcaataaatgttcgatatgtctctagacccttttcggtgcaaccaaacgtattatttaacccaatactcatcctctttgggaagggcgtagcccctctcccctcttttcaacaagatattcccttatgtacaataatcttttgcaaactggcaaggaaagctgaaactacccgtctaggcattagaggcacaagtcttccacaaagagaaataagagcacgcccacggtgtatgctctataaagctgcagccccggcaaggcgatcccttttacactatattcctatttaaaaaagtaaactttttttaattcttttcctgaaaatggtaaaacttggctctagggactaggcagtccccacagaccacaagaacttaactcaaacttgaagaacttgggggaaatcctgataaactaaaaggcttccagccttaggctgttttgcatgtggctaagttctcattccactttaaagaaaccaaaactgtaaaaggcaagtcatgcaatatgagtgcagtttccgtaaaaaaggccttagggaaacccaatcaacagcctctgaatcctgtccccacccccaaataaaagacccccccatataaagttatatcttattttaaaataaattactaaggtacgcatagatcattttttagtgattccccattaaattaaactttctggagaaaacaatcaattaattataagcctaactgcattaagaggtcatttactatataggcacatctcttcccaaactaataaaaaattttgaaaaacaaaaaaaaaaaaaaaaa

SEQ ID NO: 11400 - DNA, 916 bp, Homo sapiens
cctccaaaccaccccaccaaaaccaccaacacaaccttcgagtttacccgcaaccgtaaaattataaggagaatctgcaaaaaagtagaaatatttgcttactacatgtcggaagtctcaaaccccaaagggacagaccggttgggagctgctggctcaagaacataatttgtaataatttcacattaatagtgtgcattgctcagtacccaattaatacttttataatttattaggcatggctttacttactctatgactcctgttaacttcataacgcagaggatgtaatgtcacctaaggaccactgtgataatagtgttaactgaacaaattgatggcaaaacgggcgtttgaccaatattaaatcaatgcaacttggaaataaacagagttacacaaattttgatggacaaagggaagacaaccaagaggtcagactgcctgtggggttgggaaaaagaagcatatccttctccttgcaaaaacctgtaaatggacgcgccttccgaagacaaatagccaattttttctcctatcccgattatcatcataactcccccgccaaccgaatctgctccttgcaggaagcctattcagattgacctgcacagactagcctcccctcatccgctacgtacgtagtcttcatcctattttccacaactatagcatcattatgttcgcatacctcctcacacattcgtcttcccaccgctcccctttattccccctcgtcttttattattctcaaacacaaataaaataatacgtcccccgtgactcttggcgcgtccactattacctttagatccttccttaacccatcatccttctcgcaccctccggacttaccaattaactccagacagcacaccagcaactttatataatattccccgcacagagaccctgc

SEQ ID NO: 11401 - DNA, 1958 bp, Homo sapiens
  misc_feature (1)...(1958): n = A,T,C or G
gnagtagagtgtgctattcatgtcatatgcttcngcantagtgtctgtatcggtgnggtgattggagtcgacgtagttcgattggtgccagctctccgtantncgtgtacgtgtatacttgtantgtgacgtattgtatatatgcatgagacatttaggtgagtgatctacgcgagtactctacaatgatagangcgtatcgtcgcggcgtgagtgtgatcatgcgnatgatncgtgatangacagagtgtagcttgcatagtaagatcgatcaagctnggtgcactcggtagagacgtgttcgcatgtacgcgaggtgaatgagcatatagatcggtgcagagttgcgtattgntatatngagtnatngtctatatcatcgcgtgtaatcgattgctacgctcggtgtgngtcacgttgcgncatgcacgcatgatacgtagncggngtatacatgtnacgcangactcatagtatataggtctgncagtgcagtactccgcgactagcgctatacacatcaatgtatcatctgaagacngatgatgcgacgcgtgcggtagtcgtggacgagtatagtcacttgaacgagtccgaatgatatcattctgantntattatgcntatatgcgtgattcagtgctgtgacngagatgtctanatatggagtgtgagacacangntgctctaagtatgacacgtatgcagtatttgtactcttcgtcgagtagcgacagcgtgcatntnctctangacgaatatgnctgtgattatcgnatatactntcagtctgactatatgtgtgactcacgtgcatgatggagctgcgtgtgcatcaatatgactntacgttgtgatantgtgaggctgtgtanttgtgagctagtacgcgtgagtgtcatatgcgnacatcattantcgtctcagtgaactacactgtagtgacatatgatantccgtgcagtcgtgtgcanatgtnctgtgagtaggtataggtgaggtggtgcgcagcgagagtnagtgatnagtcgaacgtntagacgtacgcgcgatcgtatgntcgatgtcgcgtactatacaatccgctgnaagganagtagtgagcatangtntgatacgtcanatacattcgcttcatgtggagagagtagcagtactgctacagagcagtgagacgttgtgctangacgactataatacacantnctcgtcgtctgtngntatagctacngcatgtgtagatctagacnttcgacgactgntagagtgcgtactgntngttagctcagtaggtntngtangtgagtcgttagttctcgatgtgagttaatngtagagctctagctgaggcgtgcgtcgtgcgcacccaccgctcacgattactagtatnantagaaataagaagaaagtcattgtgtgagntcatgatcatgtngctctgaacacagtgcgagtagcacttcntgntagcgcgtccgtcgatgatggtgatagacgcgtgnggtgatatatctattagntctcgcgtnttcatacgcgcataagantgaggatctacgtagtcacnagacagcgagttgctatanggcattagacaattacgnataactcaaaactcgggcgagcgatcttactatctgttacatgtctgtatgtagatatccttgtaacgcactcatcaactggagatctacntgtatatgtgtatactaggtaaccgccatctatctcccctgtcacgtgtcgtggagtggatgacaggtgttgtgtaacacttctgcgtagacatagcganacacagatatatataatatnatatcgtgtgtcttctcgtntgtgttccctncagcgcgcgtctcgtgcagntntctatggttcngctccacttgccaggcnttctcnttctctgtctgttttncgttgtcgttgcgcgcgcgcgtgcggagcagcagagctgc

SEQ ID NO: 11402 - DNA, 686 bp, Homo sapiens
ctccgcccgcggggggtttcccccgcgggggttaacccgccttttatttcgccgcagaacgcgcccgctaagaggtcctttgagccccccattaaatttccccccccttctctaaccggggggattggttatctcccccccggttttccgcggggaaaccagcccccggggcggcgtaaagggccctccagtgggcgccgggggccctccacgggggggaccaccggggtgttaattgcccccaggacccccctgcgggggcggggtttttcttttccaagggtggcgcccgggggccccccccaaggagacggggcccccgttcccgtcccccaaaaagggggccctcccaacgggggccccggggtttcctcccccccccaaaaacgggcggcggccgcggcgggtctcgtgttgtttttttgggggacaggccacccccttggggggggtgccccccccccccccccttcttcagatgtattaaaaagtgtttcccctgccccatgtaagggggggggcccccctgacgccccgtaagagtccccccctcgttttttttggaaaattttctaatcctccccgccccttctaaggggctggggggtttatttcccccccacccaaagaaggctttttgtttttcttttttctttttggttttacacaaaaaaaggaacagttat

SEQ ID NO: 11403 - DNA, 1318 bp, Homo sapiens
  misc_feature (1)...(1318): n = A,T,C or G
acttccgcgcctgtctctatccatacggcccctgccactgcanccctcctccttctggtgtgcgacgtcgcttcgctcttgactctgcgtcggatagcagagtcatgggtcaggcctccgaaacganactccctcctttggcgtcgcaactcccttgcgcctccgtgttggcgctaccttctaggngcacgcgggcgccgcttagtaganattcggagctctggctggtgtctctgggancgctctgccgccggtccctgtttactcctctctcacttgggcctgtccgtttcctcgtctctgctgagccccgctggtgcctcacagnatttctcacatccttattcagtacgtccttcctttgctactctttgtcncctgnatccttctacatatatactctacctgtacatcctgctacatatagntctccttattctctattatctccttcgtcctatctctgtactttatcaactcctcttactacttcttcgtataatactcntatcttttccactgactgtgcttaactannatctttacatcatctaanaccctacatagcgacctcangtacactgctcgaactatcangctctaatctaactgttagttttcgngtaatcttagatantaaattatgtctccctctcttgatatnatagattacatgcttaatctctctccctccctgcgtcttctcgcctctganacgaccttcccgctatcttttacattctgtctccttcttcatctgtactctgcatctgnccacgcgatccgcgctcttattttattactttattgacttattacatcttactantgcttctgttgcgtcttttatcgtgtgttntcttcttgtcctcacatctctttcccctatnactatcataaactaactatttttctcccatatctcctcttttccncctnaccattcccccactcttattctaccttctcgtttcctcctccttatttgtgcttccccttcttcctaacgtacaaaaactacctatctatccgtctcacaactcactcggcatacaaaagcgctctttcaatatcaccgcgacacacgcaccctatcnntnactctttnnggttatttaatntnattngcattctaaaaaannactcgtnngttgtgtctatcgtnanttataatntattatatnantgtgttgaanttttatactttttcaatnncttcttnggccccacactataaaaaatctacttntncttatcnntnntnncacctcctccctcttttcttnnnnnnctttttnntntnntncttnnacttctc

SEQ ID NO: 11404 - DNA, 883 bp, Homo sapiens
  misc_feature (1)...(883): n = A,T,C or G
ttccaatagcaaagtacctggaaccaacccaaatgtccaacaatgataaagtggattaagaaaatgtggcgaagatggccgaataggaacagctccggtctacagctnccagcgtgagcgacgcagaagacagttatctggcactggaactcaaatccagattggaacccttatctggcccttggacaaaacagtcaatcctttctgcatgcgtagaaacctttgtctgatcttcattagacttacttttttgggtatttggtggcgagttcaacttctggcctaacactgcgtagaaattcgcactgaggcatgccgaggaaatatagacttaatatggtcctggctggatgctataaggctgggttataacttcacgctgttttctaaagacctcccctgcgctgactgtaagacttcctggctccatgcttttcccgcgaactactctcaaactcctgtatagattgcacctccgaattcttgcgctataactggcttctataagaccttctctccccacacacctacctactttcgcgctcccctcatgacactctctttactaattgcgacattaatatcccagctcatctctcccgcatcattacaaactaagagacaatctgaactctcctggatccctataaatctaactcacccccacacatcacctcgcgccgcatctgccattatacaactgcactctactaagattagatctccacgccgccttatntgcctcccggcctcaatattaattatacaagcacgtccctcctacatccagactaattatagttcctctacttaacttcgcaatctacttacactacatcctgggacgatcaaaaacaaatacccccagtgcgctagaggactg

SEQ ID NO: 11405 - DNA, 909 bp, Homo sapiens
cacctcctgtaccgcactaccgaaacaacccaacaccctgaggtgctacgcaggcgggaagttttcagatcaggctctggaaggtaagggcgtctggtgaggggccagtctctgcttctaagatggcaccatttttgctgcgtcctccagagaagatgaatgttgtccacattggtggaagagatggaagggcaaatgtgatggaaggggcaaactctgtccctcaaacccttttataagggctctaatcccatccatgtgggtagagcttttatggccttatcatctcctaaaggtcccacctcataatactgttgactttgggattaagtttcagcatgaattttggagatgatacattcattctaaccatagtaagcctcccttctaccgaatctgttactttaacttttttctggtatgtcacattgttactgcataatcatattataccacaacttgttctaacaagatactattttactatttttcagaccaccgcgttagttgtaatgtgtattttccaatgtgggtctgatacctatctcatgtaggtacccctctattaaaaccgcctggttgtactgtattcccttttatagtacgaggacccaggcacttcttccagagcctatatcgtgcattgctccttagtacgtcttctcattatcggtatataaatgtagtattatggcggccatcgcattttatcttcgcatcgcactatttgccgcgccgcaatttttttggggcatggctacgtaagacttctctcgcacgatatggttgtgtctagttaaccatttactgaccagtgtatagtaattgttgcgattatttgagtttgtaacgcgttgaacaccaacacctcgctatcttttattatttgttccccgcccgcggtcgctg

SEQ ID NO: 11406 - DNA, 1599 bp, Homo sapiens
  misc_feature (1)...(1599): n = A,T,C or G
cgcgtggtctctgtcgtgcgtccgtcgtcgaatcgtctcgtcgtcccgtaccacagacctattccttgattagtatagtgagtagtcgacagcctcatcgtcgcgcgaatgaacatacaccttatatcgtcacgattgantcggttttcgatgtangagtcgagatctgatcgtagagcngctaatgctagtcgcgatgtgcgcataattagaatgagtggcgggtcgtggcgtaccgcgtccgcgatgtagtcataatcctgcaggttctagntgagcgtactcacccttcacacatatgattctacatcagctgtatgtagaacggcatcgatcacacgcatcgacgttatctatatcgtgtactnatataagttntcgctgcagttatctgtgtcgcgcagtttgcgcagcggagtntatatagaccgcaccgctagtctccgctgcgcatcccgcgtccggattatccgtaacatacgctagatcaactatatatacagagattactacatgtcgcgatctcnatcagcacacacgctcctagatactgtgctcgtcgcatccgctctgtcgtatcctgagttcgagatacgacacatgctaacggagtagctgtcatcgcatctctccggatggacgtctgagagcatcggcagatagtntctcgccgtgacgcgctcntcatacagacggcagctgtcagcgtgtacatagcacgacgatgtgcgcgtcataatcattactctatacgtacacgaccgcgttgtcagcacgataatgactctgcgatagcggcgtgcgtcgtcgtgacgatcgacgatctcgcgcgtcgaatcacttcgtgnagagcacgtacacctcacaacgtctcgtcgctatatagtgacgtcgngtcagatctatatactaatgtgagactgtcgtcttcttagtanccgcgactgagcgtgtaagtcacagtcacgtgcgatcgccgacgtctgctcatgcggagtctgcnagncacagctatcatctcgacatatctaccgacggtcaacgctctttantagctcgtctatntggtgtcgtatatagancttaaatgtgcgcgccgcacgcgcgctcacctatggcgtagagaataatatagagcatccatgctctcacgtcgtgcacagtnttcacgtatgtaggttcgagcgcgcgtgagtcggcgtaatgcgatactgctctcatctgctcgtgctacgcacctgacagcgtgatggccgcgtgcactacaaccattcagtacgcgcactactacgcgacgcgcgcattgtcgaccgcatctctatctacgtagcgtacataggcgtcgnaccgctcgtctgctatgatttatctgtctgtcgactccctcgcctctcccacgcgtgccttgatgcggcgactgcgcacgtgctttgcagtgcgcagcgtcgcaataaactattatatatatgagctaggcgtctcctgtcgtcgtctttncagcgctgtcttgtctacntcntttgttangccgcaatggcagcgcatnctgtctcttctgtnctctctcccgtcgctctccgttggcgagatactcacccc

SEQ ID NO: 11407 - DNA, 978 bp, Homo sapiens
  misc_feature (1)...(978): n = A,T,C or G
ctgcgatgtttgtgtaatatccgggtgtctctcttgctgacttaaagttggctgtaaattaagattttttgcttttaatatgatgtataatcgtactaatatcttcaataatgagtcatgcgtctgttgtcgtgatcttctcttactatgatttcctatgttgttgcacagcttcctggtgtcatgtctcaatagtcggaacatcggttcgttatgcattttacattctttgagtccgcttacgtatatgacatataatcgatttactacgcgtcgcctggagttgaaaattcggtgaatggcggtcctcgactccttacaattatattataatcatgatctctctgttcgttcacagtgctcttctacttcatacatccattctatttaatatgccaattagtatttaccgactacgcactcgtctcaacatcttctctagctctctctatatatctcgtcattgctggacttgtgttgttctttctcaatactcccttcctcgtatactaatattcgtgagcacgacgacatccctttgaatctctccattggctcgtgtttaggctgtctattgtggttcttgttgatttccttcggtctctcaccactaggcggcatgtcactatttttttatatctcctataactattttaccatttgacgacgacatactgctccccccccctctattataaaataggatactatcttcgattattttgttcttagggatacaggtgctgcggtcccgcttaactacgggcgtcgacagcaacctattacaaccatcggggcgacaacagatatcactaagaagtaatgtacgttgtaattgtgcggcccccttcccccattttatcgagcgttaatctcatctaagaaaaatctaaaagaggcgttttgttggcctcaggcggtggagcttcgtccgccatgcaggancacctccttccggtcgcctctcccgctgtcccc

SEQ ID NO: 11408 - DNA, 760 bp, Homo sapiens
cttttcgttgtggcgtcgttggtgctctagtgggcccccgcgcgcgtttgtgtcattccctttctggctcgcgcgtgtgggggtgcgcgcgctggttcgaggtggtggtttgggtggtcggggttgcgcggggcgccggtgttttctctccgggcggttttttgtggcgcgcgggtgcgaacgggggcggtggggggggggtcggttgtggttgggtgtgtgggcggcacgggcccgtcctgagcggctgtttgtggtgcgcccggtgggctcgttctcccccccgtgctggtcgggcgtgtgtttggggtccggggggcctgttccgcggttccgggtgtgggggtgccgcgcccggttttccggcgccgttgcctggctctttggggtctttggcgcgccgggtctgtgttggtccggtccgtgggtggtggggcgggggcggggggggcgggttttgggccgtccccttgtggggggggtgttcggcctggtttcctccctcttcttcctggggttacggggggtggcccgtcgtcctttggccgtggcgcctctttggggttgtcttccccctgccctgttttcccttttttgcggttcgttgttccctcccctcctcccgcctttttgtggtgggcttttttgtgggtgggggcggctttgtgggggtttttttgtgtgcttcggggaggcccaccccccccccgccttttttttcggggttttttttttgggtttttgagtgtttttgtgattt

SEQ ID NO: 11409 - DNA, 1329 bp, Homo sapiens
  misc_feature (1)...(1329): n = A,T,C or G
aaaagaagaacatcaagacaaaaaagaaaaaagaggcttctaggggaacgaaaacgagaaaccctgacggggagaaaaacaaaccaaggaacggaggacgcacacacgagaagagaantcttttagacagagcgagagaaaacccccagcacgagcagacgacgacagaacgcacgaagagcccgccgacagcggcacacaaacgacgccccgagcaagaagacaaacaggaggcagcggaacaaggggggagacgaagagaggacaaggaggaccaggaggagggcgacacgaggaggacgggcaacgcaggcaggagcagggacgcgaagacgatcttctcacagaggaagcgccagccggcgacgagcgcgggaggcagggcccacggcgcacgcggggaggggaggacgaaagaggagagaggggaacagcaaacacgagacgacagcgacgccngcacacgtgcaaacacggaagaagcgctagcacggagccgcgagaacgacgaaacgaggagcaaagaagcggagacaaaggagaacacacgagcatacacgaacagaagccgcgaagagcacgacagcacagcagcaggacgaaaaaagaagagtagaggcaacgggcagcaccgaaccccaccgagaagtgacgcggacgaggaacgaggagaaaagagaacggcgcacgagacaacaaacagacagcgaggaaggnagacgagagaagagcagatacgaaggcgcacacaccacgcgagacaagacacaacgaggaagcagaagaagacaacacccggcaaacagagacgccaaggggtgcacgaggaagcggaggagggagacggcgacaggcacaagagaggacagaacgaggcngtcagaacgacacgcacccaccacgcgcgacagagagcccacccgactacacaccgacaagctacgaaagataagnacgaaggacagacgagagcagcacacaaagcaagcacagcaagaangaacgacgagagcgatccgcgacgtgcagaaccacgcacgcgcagaaggcagagagagccacgcgaacgagtacgagcaaccgacacgaacacctgcgcgagcgcaacgtccggagacgccaccaaaccaaccaccactcaaagtatatacaagagtagacagaagangaagagacaacagcacagagcagcagcgacataccgacacaagacagaaggcacacncgcgacgccgatgaaggaggaatacgacgaaagagagcaggnaccaaccagcgacgacgccacgtgcacaggacggcnaccgagaacacgaagaagcagacgcg

SEQ ID NO: 11410 - DNA, 869 bp, Homo sapiens
aagaggagtgaatgtggagttgagataggaggaaggtgaaagtatttgatctgagggaagggggggaataatataatgtatagggaaaagagaggtggaaagtgggaggtttgagagagggttagtgtaggtaatgaatgagggagagatgtagtgaagtagtaggaggtagaaaaagagagtagagtatgggaggtagatagacgatgggaaaaaaaaagataaagaatatatagaagaaaatacttataagaaaagagaggggatgaggttgggagattagttggtggtggatgtttattatagaggggttagagagaatagtataagaaataaataaaatattggtgagttgtaggaaataaggaggatgaggtattatgggttgagaatataaaattttggttttattagtgaagataagtgagtttttaaaggtagaaggaaaaaagttgatatagggggtggagggattgtgttattgaatagagaaggggggattgtgaaggagtgtaagtttataagggaataaggaaagtggaggtaagtgagtataagtggatagggtttttttttaggggaagaaagagagaattttggtggggaaattgagaattttttttggggggaaaggggaagaaagataaatagagcccccttatttttgaaaaagtaaattagtatatggggttaagggttggaatttaaaaataaatgttaaggaggatggttgtttggaaggtttttttttaaaatgattgagaggaaagtgaagaaaaaggattatagggttttggttaatatttgttagaagtggggtgcccccaagggatgaaaaaatttggaagagataaaaaaaaaaaaaaaaa

SEQ ID NO: 11411 - DNA, 1181 bp, Homo sapiens
  misc_feature (1)...(1181): n = A,T,C or G
gtgtatactgtctgaacgcagaacgcaagagacaggagcttgtaggggcaccacgcagggcggcttgagcgacagaaacaaggaggcgcgagcgcacctctggccagaccccaaacttttcgacctgagaccggagcgtcaagggtataattattctatttttatatctgtgtattactatatgttattgcctcatccggtatttttgtctgtatattgtattgtattatctcttataatatcttctatatctctataatagttgtgtctgtgactgatattatgtgttcatgtctatattatcgctaaatataggtagaattgtttctttttcaacctacttctcagtactccagttgcgtcgcccacagccgtctgtanttgccgtttctcttgatccgggtctgctcactagtttctctcactcatggtgactgttataacgctgatactccgtcngttctgcacaacatgacactatagtgaatacagtcaccgtcaccatatcgattattggtctactgtttggtattctttggttgtgcgtgtctgatgtataagtaatggctatagtgtgattgagtatcagtatttgtttgtgttttgcgtgtggtgtattagtgatgatttcacttggaatatccgtgctctatacaatcaccttatcgtgtgctacaacggcagttgtatggtcagtagtatgatactacttgatccgtgtacttagcatgtgcatgttgttggatcttgatgagatatggctagtttgtgtaggttgaagtgtcattagttgtgtggtggattgcctcgtttaccagcgacttatctcacgctctgtcctcgacgtgcgtcatcttactgtaagtttcaattaaacatcattttatattgattgtgtataataatatatatagatttagaccgcgtgatgtctctccgtgtcgtactcatatttattccgcttctcatgctatgtgtcgttgtagagcatattccgcttttaatgatatactactcttcgtactcctctgtgtacgcgacgctcacatactacgggtctctttctattgaaggtctttcgtagttgatgtatagcactgtttaacattctaatagcatctagcatattctatcgctttcttatcaatactcgttcaccgcacttactagtcgttctcaag

SEQ ID NO: 11412 - DNA, 1365 bp, Homo sapiens
  misc_feature (1)...(1365): n = A,T,C or G
agatgtagaggaccgtggagagagagganacagggganagagagaaaaagggttcgttaatgtatgactngcaaacacaanangccctcgcangaggannnnaaccnanccagcgcgaacgaacaaacagagacnaagggacacgaagagacagctctanaaagacgagcgaccgagagagcccgcacgcacaagacacagaacacagagagaaaccaggagagcgagaggagaggcgcacagaaggagcggcagagcaccgagaagcgacgacgagcggagcgagccnaagcacgcagaccgaacgagnacgagagcgggaaaagaagacagcagcgccacgaggagaaaacgagggaggaaaaaaacaatttttttgaagcgagagaacagccagaaaacacaagaacgaagagacagagacagatgaacagacagagaccaacacgggcacacaacggaatcgcancaagcgagaggagagacgcagcagagcgacgagagctaggcgagcagcggagagcgngacgacgacatgagcgcggaagagcacagacaacagaganagacacgacagacgcaagacgacancgcggncacgcgacaacagcgacaacacgcgcgactcacgaaggtcaagacgagcgcgcacgagaagacgacaggcagcagaggacnagagacanagnacgacgagtagacaacgagaagaagacagcacagcaaacaacggatacgcggatgagagaagagagagagcagacgaacacgaagcgacgagcacgaccagaccgaagctcgaagacgaacagagaagcgcgaagcaggtaacaaccagaggagagcgaaagagaggcacgggcgaaagcgagacggagaggagagagagagcacagcagcgacgagaagaacgcgacaggacgcgcgagaggggaaccaacaagcagacacgcgtagatgacacaacaaggacaagacggcacacagagcgcgcgaagacgaggccgcaccgcgacggacgcgcaacagcgccagcagggccagaaagcaaagcgaagggcgaggagcgggacggaacgacagagagacacgacacgagggcaagacagaggcggcgcaacgagaaagagacagaacgaagacagacaggagcgaggcccaacacacaganagaagagatccgcacnccacagaggacaggagaacacggagagagaagacagaaccagcggagagaggaggtcgagaaaggacgaccagagagcgaagcgaaaagcacaggacaagnacgacgagcntccacctgagngtagcgacagaagcgagccggagtagagacgcgccgcacaagagcagaagacgaag

SEQ ID NO: 11413 - DNA, 1075 bp, Homo sapiens
  misc_feature (1)...(1075): n = A,T,C or G
gcccccaactaccaacaccccaacacaacaataacagcacaaagaaagaaaccttantaggaaacctnagctgccaattttcgagcagntaaccgtaagaaaggatcaaagtgaacggaaaagctgggaaccttggcggaggggcggtgaccatccaaaggagcaagagcaacatcaccagcgaccaaccgacgagcctctcctcgaaaaggtacctcgaactatctcccccacacaacacccagaacgaacaaaaaagtaacaccgacccgcccgagccgcaggcagcccaccccttttttacagcacacgacaacacaccccctcaccaacaccaccccaggcaccatccacagatgacgcgaccacccaggcacgccaatatccgccacactcgcccaaataaaagcgaagagccccccaaaccaacaccaaagctacacccaaaccgacagcgcaaaagcccgcacaccccactccaacacaccacagcagtaccacccacacagtgaacaccaagaaacacccgcccacgcaccacgccacaccacccccaacacaacaagcacaacagcgacacgcgagcccgccacgctcatcctcgtcccacttgccgcggcatactatccataccgaccatcactgcancgtacacgcacaccgcacagagcgatanagagacgccaccgcgcccacccacagcacactccgcacgccccccacgtcgcaatccagagccaccccaccacgagagcacaaccacccagtccggctccaccgccagatccgtcgccgaccgaggaagcacgcgataaccgtcaccaaatcncaccacgataggaacttaccgtcaacacacacaaacacactacaacgaacccactccaccaaccacacccatatcatagtagcggcgcgcacgccacacgataagcaccgactcgccctcgcgcgctcacgcactatcatcnaacacgaaccacaccaacccgaaaggtattgagcagcgcacatacagacccgtgcacgagccacantcatcgncccagaccagcacgagtacagacagcagatg

SEQ ID NO: 11414 - DNA, 978 bp, Homo sapiens
  misc_feature (1)...(978): n = A,T,C or G
atcaggactcaacctgcttgttattggaagactagatgaaaccaaaaatcatgatttccacccagaaagtccggcttctatgaagcgccggggctgtcttgcaaacaaagtctcctgctagcagatacagatttttgtcttcagagtacccgggtgcgcgcgaactttctttttctctgtctgcgggggatccttcaatgtgtaaattctttcactctataccttggttagccaacttgctgccccttagggaagtgaggcggagaaacttcccttccacataaggtggataaatatctttaatacttaacgaactttctcatccgcaagagcttgcgttcctatggcatctcgcatttacatgatgcgggcttcttcggaatgcacggtacccggaatttcattaaatacagcctaccatatctcgcaatctatttttttcttgcgaaaggcaaatagaacctcacnaggcactttcgccgccacacatctactcgctccgctccagccgccctgagcacgcgccacactgcagcccgccttctcgcggctccagaggggcctgtatccggcccgtcattccggaggaatccctacagagcgctcgccgaacaacgacgtgcgcgcctttgccggtacgagccgagcgggttgcctgcgcgtctgcccgagccgtccgtgacnatccggcagcgagaacaccgcgcccgcagccctggcccacacacgccgcgctcgccagcgcaccggcttcgcgcctgcgcccccgcgccacgtgccacgccgcgtctcaccacgccccccgtcgctactacccgcatgagactgccgcgagcccgcgcctgcaccgcgcgcagcccgcctcggcgctcctacgcaggccgctcgccgacgagccgaccgaccccccgccgcctgaggtaggagcggaccacgcccgccgccggatcggtcgcccgcccaccgcgcgcccgccgg

SEQ ID NO: 11415 - DNA, 797 bp, Homo sapiens
aaccgcgtcttttttgttgttcacggcggcgctcctccacgatgttttttttgggcccaatagggcgttttcgcccccggatttggggggcgggtggtttttttttctcccccctcctacgtaagctagccggggggggtattacccgcctggggtggtgggggtcccgcccgccccaataaggggcgggggggggggtgaagaggcggggattaaaacccccgggggtgtttggaagaagggttttggggggctctctttttttttccccaagggggggtggggggggccttgttgcctccacctttgagaggggggcgcgttttttttcccccctttttttgggaggggaaaaatttgagcccccccccggggggcgggggggtctttttttttccccccccaatgttttggggggcccctttattttttaaaaaagggggttgggggctcttttatgggcgcctttttccgctttggggtttccccccccttttttttttccagagttccccttttcccccgggggggtttgccggaggttccatttttggaaaacctttttttttttgggaaaaacccaaaatttttttttgggggggggggaaaaaacaattttttttttttcggggccaaaaattttttttttttccccccggcggggggttcccctttttggggggggggccaaaaaaaaaaaaaaaaaaaaaaaggaaaaaaaaaaaaaaaaaaaaaaaaaaaaaaaaaaaaaaaaaaaaaaaaaaaaaaaaaaaaaaaatcaacaaaaaaaaaaaaaa

SEQ ID NO: 11416 - DNA, 1670 bp, Homo sapiens
  misc_feature (1)...(1670): n = A,T,C or G
ctggtgtttcgtcggtgttttcgttggtgtgttgtcgttgagcggtgttggtgcgtcgcgggtcgtatgtgtgtgcgtccgttngggtgcgtgtcggctttgcggtgtgggtgcggtgctcgtgggtctacgtgctcgtgtgggtcgttgctttctgttggttttttggtgtggtgttgtggttgtgtttcgtttgtcgtgcggttgattcgtgctggtggcgttgtggtgcgtctgcgtgtgagtgtgttcgttgcctctgtgtgcgggtgcgttgcggtgncgtggcgcgtgggtccgccgtctggtggttgtnctcgtgttgcttcgttctgtcgccatcttgtatcttcttctccntctcgtgcgtgcntcgccactacgcctcnctcncnttatcgcgtctcgaacatgtacactcacgtcgttctctcacttgcncnctgctatcgtanntctcgtcaccactcatntcaccancctctcncctcgcttcgtctcgtttcgcttctctactctactagtctctcntcgtttcctcttctcctnctactcctctctcntctagctcatctcgtctctgtctctgtctcttcatcgcttctcctcgcctacacgncgctgtctanctcgcgcgtcattgtgnttgtntccatctgtcgtctcgacgacttctctncctacgtcntctantccgcttctcgtctcgacgtccgtatcgtgcgcggctcttcagtcaannngttgctctgtcntcgcgctgtcattttgtctctctcctctgtcgctcgcttgngngtcgcggtgtngctgtgtcgtcgcagctcctgcgcgctcgtgtgttgcgntngtcgtgatgtctcgacncgtgctaacnctccctatctgcgacgctgttactgctcgtcactgtgctctctcttcgtcantctgcnntnctatgtcactgtagtcttactngtgaagaagttatgcttnttctncttctgtctgttcgtgtatgcatgctnctgtcatctacttccttctcctcncntcctatctacntanctnatataataagtgactctttttttcacttctgctntctcaccctcaatctctcactngtgtattctntgcgtgtgttgggtattatcanccttcgcgcgacttagcttagatccacttcgtccngangnttcncgctcgtgtnagggatgtagtgtgtcgtgctacttggctgtgtcagtgntgtcgtctcttgntgtgcgcgtgacatcgatgtagtgggctggtgcttgttgtgagtgtcattgtatgtctcgctcgccgcttgtctcgtggtggctgtgtctgcgcgcattcgcgcggagagtngncgccgtgtgttatgtcgtcgcgcgtcctctattgtggaaaagacgtgganggcgangtgatgtntggttgcccgttccgtcgcgtacggccgatgtcgcnngtatncnggggggtctatcttctgcgctgcnctggaaggggggtgttgtcgcgtgtcgtctntgggctctgactncgctgcgctaaggcngttgtctctgctcgatnnnntctnnnttgtcccacannnnnnnnnncanannnnncnnnncannnttttntnttcttcttcttctcttttttcctttcctntttctccatccctcctc

SEQ ID NO: 11417 - DNA, 891 bp, Homo sapiens
  misc_feature (1)...(891): n = A,T,C or G
tcggtttgatcatccacggcatggngtgcacggaggtactaagccctgaagcagcgaaataagcatgaagcattgttactggggtttcctaatagattctggcatggcgcttaagatccggaaaataatcacgatgaggagtaccattgctatttgatatcctgctagagatgtcgatgagatgtatgatgaactaaaatctacctggagagtggcgggaccataaggtgacaagattcggtgactatccagaaattcatggggcaactcctgggtacctttggctaaatatggtcgaggggaccaatagagaaatagtgataacctgttgacctatggacttatagaaagagacaaatgtcttgggtacaagggaatgggagaggagggataatggtctacccgtgccacacctttggagcttgtgcacacacacgacacatatgagggaggaggctcgacattgccttacctgaacttttcccgcgcgaggcattgcacgcgctagcctggttttcgcattcctaggaaatgacggagccaccactaaatcgcgtcgaatgcccgccagaccctcgcgcacaacgcccgccagcggttcacactctaatcgcccctacaccgacagacagaccggcgccccccaagggaacatcactcatctccgactcctcccgacgcgcggactcgtcaccgtacatctatatcagcgcttccaagacagcgagacggtcgtcgctccctccgcgcgcagcacccacagccgccgcctattatatcgacgccgccggttcaggagtcctggaggtacaggccccgaccgcccccatccactgggtggtcgcctcttcgacgcacgccgttcctcaccgttcaaaccgccgtcgcacg

SEQ ID NO: 11418 - DNA, 848 bp, Homo sapiens
  misc_feature (1)...(848): n = A,T,C or G
cgtctgctggcgacgcgcgctcgcgcancacaagcggagnanagangnggcgacgcgcnngngcacagagcgcgcgagcagcagagangcagcagacaccgancgngnanagagacacnaaangagacgaaacacaagcganaacacacanangaagcananagcaaggagangacgcggcgcgcgnaagcacancanaacgagagcgcnagcgccgngcgagnacaancgaacggagcgcgcagagaggnnnggagagagagcgagngngnggcgcgaggagcgcggcnggcggcgacganaacacaagcagcgcgagacggaagccgacggacagcgagnggacgncggagngncaagggangaacagcgcgaagancnggangnaccgacgcgacaccagcaaagacnaaganaccacaacacgccgaggacagaaacaaccacggacagacgacaaacacgaagaaacgaacagaaaaacaagacanaaaacacgcacagaacacnacaacganaagaagacacagacgcgacgangcagcgcaggaaacgcacacgaaagcgcgacaagaacacacacgacagaagcaaacgngacacaanaccanacgagagaaacacaagaaagnccgagcgaggcaaacgggnggccacaacgcacagacgaagagaacgacaaggacagccacagcaaggacggcggcccgccgaggacaaagacaagagcgaggaagcgcaagaggagggagacgggcgagcgggggccagaacacaagcaggccacacgacagggcacgcgccccagacgggagcacnnannaggaggacgaaaaaaaaaaaaaaaa

SEQ ID NO: 11419 - DNA, 556 bp, Homo sapiens
ttcaggtcacactaattcactgttaagagtgcgcctggatacttttatgctgagactaaatacagcagagtttatgtgaaaatgagaaatgggggacacgatttaaggctgatgacctgatcattgataatattttaatctgatcttgggagatgctgaaaaaacatgagattacttatagaaattgatgaagaaacatttgaggagatatataactaaaattaaacggactattataatgctttttgtgcggggtgatagagttgtcctggatgcccctacactgagagttggctgtaacaaagaattagacctgtatggaaaacgggagactttgtacagtggtctctctaaatgtactttacattagtaagagaaatctgtctacattttgatattaagagataattccggggattcttccactcctgaaatgagttgatttgcagaaacttacaacttgtttaagtaaaaggtatttgaatttctctcagcactatcatagatatgaccacccagatgcgcaaaaaaaaaaaatgggcctcattggctctaa

SEQ ID NO: 11420 - DNA, 1293 bp, Homo sapiens
  misc_feature (1)...(1293): n = A,T,C or G
gcgcgagaagggcagagacaccgggggaagaagnnagggngganncctcgtatgttncactncatcagggatgtgtgggaaaaggagcactctccacctgctaagtaggaatagagaaagaatgatgcacttggatttgacatggatgtcgtgagggtggcggtaaatctgcgtncaacaatcacacctatgaagggaagaatgtcgagcgcgtggacgcctaagaagggaaccaagattggtagagcgccgactgtgcgatgctagagcatagagaacaggggcggcggaaggagagtaggatacggcggagtcatgaaagaagcattcagagagcgcgcgagcggatggcttaatggtgcacgaagggggcggggggaggtagacacaacggagataagcgtgccatgaggcagagaccacggggcgacagggaggatcaagcgcggcgggctggcacgagggtacgcctggggtagggacggaggggcgcaagagccgagagcgcgtggacggcgcagggcagataggtttggcatgaaggaaggacggacagccacagaaccgactagggcactaccgcgacgaaaccgtggggcgagacgagacggccgggctgcggcgggtggcggcacggggtaaagagtcgagagaagcnatgcgagagaggaggacggcagcggagacagcgnccagtgaagcacgagcatagagggcggtnaaggtnacgagggagagatacgcaggacgtgaggtcagggtgaggtctggggcgatgagtcatagagcaggagccagaaggacggaacgaggcgacgggctggcaggacaggggagacgacgtagtatggtgaggtgacgagtggggagagacggcatcatgggatagatgatcaggcgatagctacaaagcacgcgagaacgagcgcaggcgagcaccgtacggcggcagcagcaaagtaagagctccgctggaccatcgcgagacgtagaggctcagcgcgtgatgcgtagtggatatggaggagtgaatgagtgagtcagagcagaagaaagagagacggcntaggcgtcatcagcgacgacgcgagagncatagagaggaccggggaaccgcgagcgccgaccgtgaggacggggcgancctcgcgtcggctangagtgactagtaggtggtctacactggctaacgccgcgggcgacggatcgcggagtgcagacggccggtggaggacagtaagatgcgcgaggaaagtaaggccgaggtggtaatagggaaggaagcagatgagg

SEQ ID NO: 11421 - DNA, 290 bp, Homo sapiens
ctatattgtcttcgtatcaatgacatatccgagataaaaaaacaaccaagatgtattctaaacaggatacaagctattggaaatgaacgcgcagatatgtctttgtaggatgttgcccaatacatgcttaattacagtactagtcgttaacatagcactatatgaacatccaaatgaaatttatagaaacaaaacagatcaggcaataataaaaatcagaaaaaaataatatagataacccaatagtgaaaaaaggacaggttattacaagaaacaaagccacatcaaaa

SEQ ID NO: 11422 - DNA, 1069 bp, Homo sapiens
  misc_feature (1)...(1069): n = A,T,C or G
cgccgttcatagacgactgacgcaaaagaaggaaaagtccaagacacactggcccgcttaggaactgggnacagataggccactggagtacctggcttcaaatcaccctgcacgttttctctttggagggggaggggcgtggagaaccatcttccttaccttccagcagaaatgggagacaaattcaaggacatctaatgaatggccccgaggtggacacgcatttatcgccaaggtctcaagcagagagaagtttttcaagagggggggtggcctcacctacgccagaaaatctacaaaaaaatcgaagcgtggggggggggtatctcaccgtggtgccttaaatacaaagcaacccgctcccaatttaatcgggatttgagaacttgcatgtggtctttcagcttcatctggactactttacgtatatgcggaaccactcggcaccaaactaaggggaaggaacgattgcggcgaaaacaaagagggggcgggcctgctggtccattacaatacacccgtagactgaaagcgcccgcctgggggccgggtccggatgcggtaactaacagcggctcccgcacgcgacctcagaggccgcggagtggcgaacacgcggagggatcctcacgcgtgagcagcggtcgcgaggcgcggttaggatagagggacgctgcgacagcggcgaaggtagacgagtcgacgcacgtgggcggcgcgcggtgcgccggaagaggggaggaggaaggaggccgctctcgtggggcggggggggggagtgggcggctgcggaccgcatcgagggcgatctgaggctgcgcgcgggggaactgggtgactctacttagtgatccactagatgatgcgccagaccgcgggtggcaatggaaagagaggtgagggcgatgtagcggtgaggcagcacgttagagcggcgtcagtgccggcctcgcgtccgcacttacggcctggactctgcgagaacatggacggtcgcgcgtgccggagtcactagcgattgagaggcgaccggttctgtgcggcactcacaagccgcgcacgccgcccc

SEQ ID NO: 11423 - DNA, 1026 bp, Homo sapiens
  misc_feature (1)...(1026): n = A,T,C or G
actgatagctgtacagagttatatctgtagcgcggagcgtcacggaggtttcgctccgtgtactgtctctgtccagtagagtacgttcgcgacgagtcatgctcccagcgtggnctactcactatatctcatttacattcgataatacctaacgtacgaccgtataatctgtctcctgagatgaaggaatgttttttccaatttcatgagctggtagatctctgctcgcccttcacattacactccgcactccttcattcatcatgacgtcctcaagcgttctttgtcttttgtatccagctcgctaggggtctgtcgaggagacgttcagtgcttgatcacgtgtagataatgatggtgcgacgggtcgcgtggtgtctgtgtcgctctatattttctgtcggcggttggtagcgttagtcggcagaacacaccgaggacggtggggagtttctacaactacggaacttaacgatatataagaaaatggactatgaacctaacatcacataaaaacacataccataaaccgccagctttcctcaaccacccctcgacgggagtgatcttcttctagtcctcgtggttggcgcgtggtggggcggggtgggtgggaacccgagcggcggcggtttcgcttgccgttgcttcttcctgtgcgtcttgtcttttgtttggttcctccgcctacattaaattctgaagaagttgcttatattctatttaatatatttcttttatatttattaatttatcaataatcttattattatnnatcttatattgctctcgctgtccttgggggagcgggtctcggcgtggtgtgtgcgatggttttgtttgtgggtgggttgggaggtgtgtaggtggctggttggggttcctgtcggtggctcgtcctnngnnnctttgtttnntggggggtggcggnggatgggtcgtggtggccttcgcgcttgccggncctttnccccaatctccccctctttttttaatcatttttattttccctcctctccccccttt

SEQ ID NO: 11424 - DNA, 1902 bp, Homo sapiens
  misc_feature (1)...(1902): n = A,T,C or G
catatagtcgtatacatatcacgctgttcacgaaatgtatnaactacactgagcaatagactaantgancacttactctatagacactagaccacagcacactacgcgtnaacagcgtgcttatatagtctatagcacgagctcaccactacgaatataagcttncaattcgagtgtactacgtatagtcgatcatcatagattcgtnctaatgtatgtgagtcacacgagcaagagagatagctacagcctnaatcagtccgtcacgtgccgcatcgtagttatgnactatgttacggctacacgtccgctgtagcactcactcantcgaggtcacgtcacatgagcagcacacacccccgaccgatctctgtcgagcatctaatcatatgcgatagtcgcgcacgcaatgctgtttccatgactgactaagttgtgtcacatacactcaataagctcntcgtcatacagattgttagatactcctccatcgactcctntctgacgtagcgacgaatactactacaacacacncagcgcgcctcgttatatatattnacataccncataagtgctcnccaccntgcttctcacgcantctaaccnatatanatagacacgcacaggntacgcacaaccgatactattagcatcaccataaggcacagcgtcgantatgcactgctggntactgatcgcagaactagtgtagtaggatatgnnnacnttaggtacgagtnagtacaccntatatatctcagcccacgatgcgctcacgctagtcgacnatagtatacacaaaggtctctaatacagctgtgtagcacactntagtgtaatacacagcgatagacgacgttcantnccgctctacgcaagtgcgagacagtaattctgtacagtcntcntncnatatgtatancatntgactgtctcnagtcatcagcaacgctcatcgattgagctcgtctatncttacatgatgatctcgtcacgacagagttatatcncctgatactcacgtatactccgatacnaganagctacgacanacgtatcgatactcactcatattagtactgcacgtcatatcatcgactcanagctctntnatctgcagaacgtnatctataacttacgacttctgatacatcacgacntctnacagacataccactangtgtcntccnnctctcacacagtataccttatcgtcgctgtctatcnatcgtgacgcgtactgcntcaccgagtanatgtccgcacnacatccanatagcatgatatcacgctaanatcntcacacgaaacttcatacatcgtagatctnnantaagacatatangatatngtgtctcanctcagcatacagcatcgttactgagctctatagatcgtcgagtcncncacattgatnagnacgantatgacgccgtgancangagtgcanatactnctacaatgtactagannncagcagcaagacataanacagccnctatatatagagttattctatntataccataaantgatntntatgcatagatctattaccaagtcacaagtgtctaccntcttcaatcacgctagtgctcagacgtaaagtaatacgagatgagcgtcatgtcacnctcgtctcatgatgntacacatatagagatagtacactctacaaggtatcncatgctagctacgatatactcatcagangcattatatacacaatagnacgancgnaatntatatctcacacagcgtatcttactctncttntcgtagtgagtgtctattncactgatctatgtatnctgatctctataccacagttatcatgtattctctctananacttaacgatctgtctcatcgtcatttctcgtagtcagtatcgcaagtctg

SEQ ID NO: 11425 - DNA, 1013 bp, Homo sapiens
  misc_feature (1)...(1013): n = A,T,C or G
cgatgggtaatctattctgtgcctgtagcctgggaccagccttcatctctgtccgatgagaagccggtgtctgtaccagttcagccaactgccagaatggaatggacttctttcccttcaaatatgaccttgaaggtctggatgcatattggcaagggcatggaagtgattcaagaaatggaggaaaangtgtatgtgagattcctcgtccctcctccctagccatcacctgatggttgcctgacattccttggcaggggtgagggggtctcctgccctgctcatgtctgcctagctacctgcaataagagactgaccagcttcagggtggggctggtcaccatagacagaggcatgattagagggttgggacttagctccaccaccaaccctaccaagaggggagagaagctgaagcttaagtttgatcaccaatggccaatgacttactcaatcatgccttatataatgaagcctccataaaaaccccaagtggcncggggttcacaagagtttccataccaccttacagggtccttgggggggtggtatgccccgaggagagccatggaagcctcttggcgcccccttccccccatacccttggcccttgggtatccggctccttaattcttatcccttttgtactatggcttttatcgaacctgggcacaaggggacaaaaaaaaaacagaatacacaacaaaacaaccaaaataacgcatatcacaacaaaataacacacatgaaatatcaatagacgaccaataaccaagacctacaagataagaaacatacgacatcaaccgctccccgctctctccgttcgagaagcgntcgcgccgccgctncttcctgttgaagaagggcctataatnatagatccctctctgcacatacctctctcgctcgcgcgcnggcttctcntcaccgcggaagccgcanctctcgcctcagaagagtatccgagcgtctcatccnacacagagcgcgacaatcgacccaccagacat

SEQ ID NO: 11426 - DNA, 1254 bp, Homo sapiens
  misc_feature (1)...(1254): n = A,T,C or G
atnaatacgtggatatctgaactcgtgccccgcggttgtaccctagtnagncagagccggccctacggcgcacacctgtagaatctcgtgaatcaggaggggatctgccactgtgagcaatagatctgccttggcacgtgcgcagcaccttcagttaatacggagcgtggatctagatagcgtcgaaatgctgcaggctgagggggttacgcacagctgttcagctgtgctccntatcacgttgnctcgctcctactgtgtctccgcacagcggccctcataagccatcancncacctcgcttccgtcctacgncgccaccgtcagcgcgccgtgtgtgcctctatacagtagagtaccactgaggcatgcgangacatccgtaaaatacacgaaagagngatgcgcctctgcgcccctgttnnttgcatgcgatggcaggcgaggtgtgcgcagtgcagatgcgtagtctagacgcattatgcgtagttgagggtgtgtataggagccgccatcttggccactttggcctcaatcccgcctgtagcgtgctggcacgcctctcgggggcgtgganncggaagagaaggacgtatctctttgtacgtgctcttgatctgtgagctagtctttccttgcctatacgtgtngggtcttcggatgtagcgagcgccaaggacgacgcggcgcggcgggggacgcgcgacacgggcggacgtgcccgtaggtactggatactggtggcggggggtgggggggcgggaggcgttaatttaggggcgacagagagctgatactaatcggaacatgatggttcgcggaagncgcttctgcttagcacatccagctcatctagctgtgtgccggatgtngcntctctgatacatacgaagaanccgtcggtgccgggtaggcctatcctacaggaggnagcacctgtccttgggtggnncacatagaatcgcagagtgagnatgtctctccatgctgagactggcactgagcgcgagcgagtctataggcgctgggtagtggcgagacgtagatatgcacaaactcttgagcaaactggggagcgcgggcgagcaaaattaatagcaaacaaaaataaaaactaataatatgtcacaattgcataaataataaacagaaagacgtgatggccctcagttggcctactagcggtggagcttctacgcgccagatttttcagnacctccctctatatccctctacatacttaacactgcttcac

SEQ ID NO: 11427 - DNA, 877 bp, Homo sapiens
  misc_feature (1)...(877): n = A,T,C or G
aagaacgttgtaccatgtaatgcaggggagaaaaaagttcaggaacttgaataggatgttggaaaagaagacctctcacattaataggacgaaaaaatgatcattcatctacagtattctgatttctttgaattgcttgcaatccactataaagaagattcgctctgaccctaaattttctacttatgttcccacttttctctcacataaatgaggggtttcattctttttccctccttattattatatttacacccataagtgtngttggcacagaagggtggaagaaatagccctgttctctgttttaatgctctgtatgtttttgttccttttagtggggaatcagttttaattattcctttaaggagatgccacttttctcaatctttccctagaatctaacaaacctcgtttaataaagtatttgctgttccttatacaataagtgaaatgggactgctccttaagggattgagctggtccctttaaatcatccatggcaacctttaaggattgaggtcaccttcctatggagtctatttcgatccatccgcgcgacactgttttttccccaataaaatccattttgacactccagaaattggctttggaataaaaaacaaacaaacaagggccgtttttggcctccgccgcgtgatatttcgcaccccttgcccttggggagggacaatcaatcgagccccacgcantcgatcctttcgcgctaggccggtccggcccgggcgacgcgggatcaagtcactcctaggggcgcatcctcatatcctcaataactggtatacccaccaaacacttggaccaacgcgcgttacgcgccgaatcgcataggcccgggacggcgtctccctgatcc

SEQ ID NO: 11428 - DNA, 862 bp, Homo sapiens
gtgggtcccgatagtccaacgtaccacgccacccaccccactcatatgccttcatttgagagctagagttcaacctgtttcgaaacaacttgtggaaaggaaacagtacttttccccacaaaaagggacaccacctccggttccccagaaaacatgtttagaaacaaagtttaccttcaacgcacccagtctttttatggtgaacattttttgcctccataattctggcccccccttttcgggttcagcagtatttgtggtaattctttgtccctccctgccaccgtgaccccatttttgttatcgaattatatttgtggtttcccaagaaattggagggattcacatagacaaaagtctgttttactttatgaaagcagttttttattcaaaatatcgaacaaaggttgaaaataaaggtgttattcccagtctcatgtcagagactcaccagtcccaaacccagctggacctgctctggattacggcaacgtcattaccaaggttatggctgtctttggcgcaagtcttcacagtgggatccgtgagctcacggcagaaggtaagtctggagttctcctacatatgatgcatatctaggagatatgaatgggctgcatagagcccctctgcagttgcctgaaaataaaatgtacagttaatgcaattcctcaccttagacttcattcctaagactatatggaaagacataagaactgatttttggtgttgccatcagcagcggagggtgctgcattagggggttgtggaaggaaaattctcatgcacttctcttacaagttctagatactcagcaacataaatagtgtgtattctttctgaacaaaaaaaaaaaaaaaaa

SEQ ID NO: 11429 - DNA, 852 bp, Homo sapiens
  misc_feature (1)...(852): n = A,T,C or G
gttactcttcttattctctcagaccggttgtcgcgttggggttgtgggttcgttgagcgctacggtggtagtaatggtgacgtcttcgtactgtccaacatcgcgcggggggtcgggtctacgcggggcggtcgggagcgattataatcgggggtggtcgagatcgggcgcgcgggtggaggaggggggtgggggaggtcagagtggtagactggcgaggcgatgtgggggcggcgtggtagtagtgtgggcgggtgggccacgcctggtgcgcgggtttgatgaagcggttgcgatctctcgcgggggagggcgccgggcagcggtcagagggtgccggtcgaagttcgatcgcttgatgattgcagccgtaaggaggttagattagcgctgcggaggggcgcgggggcgctcggcgtggagggcctgggagtagtgtggatggagggggggggggggggggggggggggggaggatggggaggggggggggggggtagcgatagggggagttcgtctcttgcctgcggcttctttttgtcgttgtttcttgctacttcggcgacgggggtgctgtatgtgaggtatgaagagtaagttttttttaaggagcggagggggggcgaaggggagcagtggaggggcaacgtgggctggggtccgaggggacctgtgcctctccggacgcgaatgttgctgggttccgatgatttctcataataatcccagtattccctgtagtcccagcactttgggagaaatgaggcaggagggtagcttgagtccaagagttcaggtgccagcctgggaagcatagtgagaccccttntagttgcctcttaatagaacctc

SEQ ID NO: 11430 - DNA, 1062 bp, Homo sapiens
  misc_feature (1)...(1062): n = A,T,C or G
ctcgcctctagggacttgggacagaatagccactgtactaccttgctctcataatcaaccccttgacaccgttaactcttctattaggtaaaagatagaggcaccctgcgagaaactaatcctccgatcacctttccagcactatcatggtacacttcatacaagaacactctaacacatgcccgccaggacggctcaatcagctgaatgcaactggtctctacccacaacgaaagancccaacagaatgcgccgccgtctctacttagctccttactccaccaaacacactccgcatcccatgcactctttcactctcccacctcgctatctcatactctccaacgacccactccccttatatccaaccgccccattgcaaccctcgctcatgtctcttaaccccttcctctcacctcactcactctccacctcaatcatccgacctccacactctccgcaaatacaactgctgggcacatcaccgttctcgcccgtcatcccccctcctgagcctgccgcccacatcgtactaacgtcccttcctcactctcctcccctctctacatacccgtgctcccccctatcaccattctttactatcacatgtctccctacctcgctccccgacatctctcaccactcctttaatctcccatactcggcatctacaggccctcacttgataccttcatcccacactcatcttatcccaccctcctcctctgtatctccagcttttttaatatagttacgacacccgacaccacccgcacacatacacgcttctgcattttcaatgcccatcccgaactatactcctatctctaacaccctccccatttttttctacgccccgtatcacctccaccgtcctctcctccccttctccatcacgctcactacacaccacatccatttcgtcccttccttacgttcttttccatccatctctacacttatactatctgtctctacccatctctccacccctactctaatatatctcaatccttctataacctaatcaatattcactccttcctctagcgcctcattaca

SEQ ID NO: 11431 - DNA, 1247 bp, Homo sapiens
  misc_feature (1)...(1247): n = A,T,C or G
gttccttgcgtggtttagtctgcggtgcgtccgctcgggctgctctcctcctgtggcgctnctctcgccgcgttgttctggtcgctgggtttctttgtgaggtcgttgtcggcgtgggctctattagctctgctctttgccgtcctcggtcttcctcttcgctccctcttggggtctgcgcgcgggggcgctcggcgtgccggctcctatttctctgtcctgtgctctctctctgttccgttcttcctcggtccggtgtcgctcgtgccgcggcggctgggccgtcggcgcttgctcttgtcgtgcgggtcgcggcgcgtagtccggtgctcttctgtcttcttcttctnccctcttgttctcctttttttgtctctnttctctactccttcccttcgctgttcgcttccgtgtgtctctctcttccgctccccccttcctcgtctcgtccgtctctagcctactctctctgctctctctnacctttccgtttcgatgtgtcgtgctgtcctgaccgttgctccttgccgccgacctacgcccgttgatgtccttcttttcgttctctccttttgtgtcttgcctgcctgcgcttgtccttctctgctccttccggcgctggcgcctcctgtgccgtgcggttgcgttggtcctgccgcgcggtcgcgcccgccgcgcctctgcctgctcgccctgcgtctgccgcctcctcctccccgctccctctcccctgcgcccctcggcccttccttcctcgcgctcttcgcctcttctctggtgtcctgctgtcctttcttgtgttccttctctcccttcttcctccctctccctcccctctccgtcctcttcttttttctgcgccttgctcctctttctccactcttcggctctccgccccctgtccgctgcttcctccgttttggttgtgttagtgtngcgcttctgtgcggacggggcttgcggggcgtcctgcgtcgccctgcgatcggcgtcgggtcgctacccncctctcncnnnncccccctccctcgcccccgcctcttcccttccctgtccccgtaaaagctccctcgctcttcctccctctctcccccttccctcccccntctccnggtttttctttctctttaaacctcttttttttttttntgttttttttttcttaggactcttcctttctttccttctncctccnctccctttctcttcttccccnctctctttttnttctcttcttcncccccctc

SEQ ID NO: 11432 - DNA, 931 bp, Homo sapiens
  misc_feature (1)...(931): n = A,T,C or G
tactcttgtttcctagctggagtgcaagggcgtgatctctgctcactgcttcctccgccttccaggatcagagagattctgctgactcactctctccagatgttgggattacaagacagagactgctatatcgagagagacagacgcatacacagagagactccctgcatggacttgcagttagtgctgctncacccatgccacataacagaggccaggagagaggcttggaatagatcctgccccaggatcctcaaagggaacatgggcctgctgactccttgatctaggacttctggtacctccttacgtgggagataatagaatggctgatgctttaagcccatgatatatgaaataaaggcctcgttggccttaggcggcgtgagcttgcagccccttacctttattgagggtaaagtaatgaccctgttctctgacttgccgagcttgggctccggccttggctagcggtttcttgtactcaaaggggtagcatgggtttcacctagatcgggggaacggcgaccgatcaaaattccaagccacggggcggtcgatggcctctatcggcagaagggcacggcagctggcgcgtgtgcatcccgttnttcaccactgaggagccgtcgcgacagatcacgtctgaagcgtgatggtgaacacacgccccaagtgctagtccgtgggccgccaggcccgcctgatgttttcacgtcttcggtcgcctcttcgtaccttgttcgtccgctcctcagcccgtcgagcttcctatgaagttcgcgtctcttgggaggcgtttttgtacggttgatacgtgcatcagtagattccgtcgtacgcattgtccgtcggtcatccgatcgccgctccgcagcgcttacactccgctatcgtaaacccacgcgtgcctctcccgcccgctctatat

SEQ ID NO: 11433 - DNA, 1253 bp, Homo sapiens
  misc_feature (1)...(1253): n = A,T,C or G
acgctcggtactggcgtgtatgtgctctgntgtcgactcatcngcaattcggctcttgtcgncgtcaccacctacatgattactcaactantgacacagctgagcagacgtaaacgggccgcgtccatgacgacaacgtacagcacctcaatactctgattatcgtcgagtgtgtgtgcgcgtgtcggcgtgtactggttcttcttaagagttacgcgaggacaatacccacataatacaagaganctagtcaaactgccgtgcaaggggtgcggatgcgaatacgaacgatacgganancacatcgtgaatctatcgtaatgcatgaattcgttctngaacttcgcgtcacaactctgtagtctgtctcatnattctctgctatacacaaccaatagtcacctccttcatacacaagacactactataaatatatctctcatactcacctcaaaatctcctaactttcatactctcctctactagttataacacactactgcaacacaacaaacacaccatgccatcctgctaatcaccccttctatntctactcataccttctactactatatcatagatactactaaactaacaaaacaacacacccaataagtacacaactaacaccaataaacaactctcatccactaccggctacgttatcatcgtttcccatatcctatctgtcattaaccgcgcgaccacgacaagacatatgagtcgatataccagccaggtctcttctttcccacctccctcctcactcccttcctcattcattaatctatcactgcttctctatcatctcccaatgtagacatatactcaatatctcactaacataacatcactctccataacacacacctacaaataacatcatcacttaatcataactatcaatccacttatctacttctaacactccatctctacatatccccatatcaattacactacctatctattacggtatatgcagacaaatcttcattagattacatacctgatctcnccccatatacactgnactcactcgcctgctatgctccctctctctctcttaaaagccttcctgcgccccctctcctctntcctctctctctctctctctcatcgttctntcctcttcttntaacacttcctttctnttntggttctcctnctctagattctnctcttctnctcactncnttcctctcttccttctctcactcctccctcatcttacntccctccttcccttccct

SEQ ID NO: 11434 - DNA, 917 bp, Homo sapiens
  misc_feature (1)...(917): n = A,T,C or G
tccccaactccccactccaaatccccccataaatctcnaggcccaccctcatgccaactactacccttgaaggattcttctacttaccaggactacaggcgggcagtctcttatgttatgaccaggacaatccaaactcctacagaggactgtccccgcgcgaccctggctccgcctcctttatcgggatatgccgaaacaccccaccggcccgccaccacaacattccttcagacttgctgaccgctctgcccaccacccctctttactccggcacttccccggcctcccctccaaaccccccacaccaaacccgccacgaccaccctccggggcacgcacactcctacaaacaatccgcactcgacagcatgtgctgaaacatatccctacattgcccccacccgctcgcttcacccctttccacccccctccgcacgcccctaccccaccacaccactaagcccgcggtacaaccgaaaccgcgagttaaccgcaagcgctcctcccatattatattcacacagcgctcaccgtcgccatccatcaccccgactcgctcatctctaccacccactccccccctccacgtcccccccccggagtcgtcaccacacctccacccgcactcacccacattatcatccctccgtgccaccccacacccccacccgccctccgcctttctaccgccgcgcgctcccccccgcttacgccacgtccccaatttcccccctcccctccccatgtcagacccaaccatcccacaacctaccacgtacataccttctcctcacaccacaccaactatctctactgcaccgcccccgaccatatcccctttccccctcgctcgccacacactaccccgcgcaaataatcactgaaacataacccccacacccccacccagttgg

SEQ ID NO: 11435 - DNA, 1196 bp, Homo sapiens
  misc_feature (1)...(1196): n = A,T,C or G
cggtggagaagcggtatacgagaagaggagagagtgatgtcaagagaagaagagcaagactaanacgagtggaatagtagatggatnagtgagatgaagatcatgctagtcgaagagctgataataattactatacgtgggaagtgacgtggtatcgcaggacagggacatgaaagagaggagaggagtaaagcgaggagatagaagaggagtgtggaacaggagaaggagcgagtggcggaggagaaggaagagtgagagggagaggcacaggaggagtgaagtgtcgagagtaggaggagaagtggagcgtggggctgagataggacatgaggaaataatttagagtctaagagtgatggaggagagaatgttgttggggtaagtagagtatgagtagtatgaaggggaggagagggagggagagtganaatgatgtataaataagataaataagactcataaatggagactagtgaggagtaaagagtggaagtggcagaggatatgagagagagatgagggagcaggaggtcggaggatggggtgcaggaggaatgtgagaagtgataaagtggtgacacagcatgagnagagagagagatgagtatgacaataataaagaaaagagaagagaggaattgtggatacgatgaagtaagtgggganagaaagaataatgaaaagcgggtggaggtaatggaggaggagagagggtgtgagaaggacgaggagacggaaaagtgaagaggagaaggaagacatggagagcagagagtgtataagaaaggagggaagggggataaggacaggaggggtggcgcagatgagagaggagagggagacatagataagtaatatgagagagtgttatttttgttgtgaaggaagtacacacgaacaagagnggtggtccccacacaccccctcntgataaaaaaaaaaaatgtgtggtgtgattaatgaacttgtgatggagagtgcagaagagatagatttgataggagagacgaagagtggggggtaattggtgggtatatggagaagacagagtaggtgaggtggggtgnaggaaaggaggtggaggccgggggcaagaaataaagatatgagagggaagaagcgcggggtgtgttttgtgttttgagaagccccccccagacccgcggtatagtgggaaaagagtgtgtgtgtgg

SEQ ID NO: 11436 - DNA, 798 bp, Homo sapiens
agggtcggagaggcaggttttgctggcggagcacgcttccagcagaaaggtgttagctcaaacaaaagttctatgaaaataaaagacccggcatatttacccctcagcgtgatgaaagaacgccccgggacctaacaagaccaaggcaagggttacagtagtcacaaaaaggagacggaccctgcgctgagcacaaaagaaacaaacaggggagagatacattccccgtacgagccagaccagggggggcagtcctattttggtaaacactaggccggacccgggatcccaacacaaggatgaatcccaagatatcccaagattggattcagtaaagggtatagagaaaccacctccaaacgcgtacacaccgaagaatcaatagttggtgctgtgggcatgacataaggaccgccattccatagggaggtgcgggtaataaacacaaggcctccggcatcgaggctacctcgagcgcacttatgtggaagggagcgcctccagctcatctgccctcctgcccggtcctgaacgatatccctctgttgaccaaagccgtaagactttgccttttgaaaacattagtgtaggttctcccctccacctgccagttagaatggaacatccatgatcgcagggtgatcatgggggagggtctgttatgtcctctgccacccattcgcggtgtctcaagaaatcaccagcggtaaacaaattcctccaacagccccagcatgagtaaaaaagatcataacgcaatcatcctaaatgtttccgttctaaaaaaaaaaaaaaaaa

SEQ ID NO: 11437 - DNA, 1034 bp, Homo sapiens
  misc_feature (1)...(1034): n = A,T,C or G
acagttctacactccgcaccatgcatttttcccatcagccacaagcatgaccttncggcataccacacactccttaccatgcaatgcaagggaaaaaaaagttcaggtactccaataggatgtcggaaaagaagacttccactctcacccgacgaaaacccgatcattccattaacatccattcccactccctttcaatcagctccacaatcgcactatcaagaagactccccctcccaccctatatttcccctactcttctctccccaccttcccccctcaccataaatcaccgcgtctccatctccttttacctcccttatctaattccatcttacccccatctctcgagcaccagacccagcaaacggagcaccccccaaccgnacctgcacgtcatcgcctctccaccgctctccgctcctacacacgtcacccgtctcatggcccgatccccccttcccccatccaatccataaacgcccgtccccctcctcctagccgtacctcctccactcgagcgcccaccctcccccctctcacccacgaccacgacccccgcaactctcgcgccacacacaccaccctcgaaccacctcatgtcgacctgacccgtctgttccnccgcacccgcctccgcaccattgtccccttctccaccacccattcaccacaccgccccccccgcccacaccaaccctatattcccacccttctcacgcgccgccatccccgccaacgctccctctctctacccactctcccccctctctcccttgtacccacccccactcccctgttttccctccccccccacgctccgcccccacaccacccactcccccccagccactcccccgcgtgcgaacttccatcgctcacaccctcccacatcacttctacttccctactaccctcctcaccacatacacactcctcctatacctcactccttaaccccgtcaccactccctccccgaccacattcattcctctactacactctcccacccccccctcgcccacctatacag

SEQ ID NO: 11438 - DNA, 1374 bp, Homo sapiens
  misc_feature (1)...(1374): n = A,T,C or G
cgtctgcgcncctgctcatctccgctcccctgtccgttgtgcggatgngcgcgncgcgcgtgtcgcgcgcgcnggcgtccntccgggcgcgcgtgcgtgccgtgccnggcgctctagctgcgcgcgtgcttntcgcgcgctgggcgtgcgccgatcttctatcnctcncgtctcgctcgcgcggcggcctgtcgacggccgcngtagcgcgtgcgttgctcgcgcggcgtgtctgcgtcgngcgngtctctgcgtctnctcccgcgccgtgctcttcgcgcgtgctgccgctgctgccgtcggcgtgcgtgcgccgtcgacgcgcgtgaacgcgctcgccgtnctctcgccgcgcggctcgctcgcatctctcgcgcgtcgcgntcgctgtncagcgcgcgcgggcgcgtgattngcggcgtcgccgccgtacttctcgtgtcatgctctctgtctcgtcgcgctgcgctcgcctctgctgtgcgtccgctcgtcctcgcgtcaccngcttcgtctgcgtccatgcctcgcgtcnacctctctctgctagtgcactgtcacgcgcggccgcttctccactctctctgtgtcgncctctctgctcgcccgtctctcatctcccctccctcactcgtcgctctcccctcctgtactgttggctctgcgttnttgctgtaatcagctgcgctgcgtcttgcgtctcctgctgctttgcgccctgtctgctnctctgcgncgcgcgcggctcccgtccccgcggcgtcgcccctgccctgtcgtgccgttgcgctgctttccggcgtcgcgcgtgctntgcgtgctgtgccgcgctggtcgcgtgcgctcctgctgcgtcgctgctgcgcggcgtcgtccctggctcctcttcgttccgtttggcgcgtctgacgcggtgnttgtcgactttgtccgcggcggctgctcgggccgcgcttgctggcggcgcggtgcggcctcctctctctctcctctattcaacactctccgcctcttctcctcttgtctgccccgcccnccgtctgttnttccgccctggtccgctcgtctncnctcgtcttcgggctcccccgcgcgccttctctccttctctgctcttctctcgncgcgtcctggcctcgccttgtcgcgcgctctggcgcggctgccggggcgctctctgtctgcgctgctccttccgcgtcctccccgcncgctcnnnngtctctcntttctcgctctgctccccgcgtcccgccntttaagcgtcgttcttcctgtccttctctctccctccgcctcctcnctgttcggtttcnccccccnnncagcgcccctctcttttttgttttcttttttaggttttcttctttcctt

SEQ ID NO: 11439 - DNA, 285 bp, Homo sapiens
  misc_feature (1)...(285): n = A,T,C or G
attcaatccaatgtggacattttagatgcattgtagatcggaggcacttctcctgagtacggatattagaaaagcctgaagaaagggtactgatttttattggatttttaaaaagccctttaaatctgttggtgggttgagtaaaaagaacaaagggagagaattagaatccgagaaaaatattttgtcgggagacggngagtagtgtcatacgctggaaaacccagaggataattagtcgctaaaagatgtgaagcaaataaattattatttactacttatcat

SEQ ID NO: 11440 - DNA, 360 bp, Homo sapiens
  misc_feature (1)...(360): n = A,T,C or G
gtgtatctgcttgtataccaacttgatacnaagagtnaggagatgaaacggggatagcaatctattgcgtactctctaactgggaaaggagctaccttgtactttcacatactagttctctgctgaccggaatacatgtgatctgcacattaaatgactaaattcggtgtgtaatcacttaagtctagacaatgtattatcctataatatgttaaattttattgtgccagctatcctattgtcatgttcccttttgattaacttgtatttcttaaaaatatttaataatagaagaaaaaagaaacaaaaatgggccttctgttgggccctcagtnggggggagcctcttggcggcgcgat

SEQ ID NO: 11441 - DNA, 923 bp, Homo sapiens
  misc_feature (1)...(923): n = A,T,C or G
ctcacttaatcccacagcccgcngaacccggcnannnattttccangactcttcagtatggaatgtttggaaaagaagactaacactgaaataggcaggaaacaatgatacatttatatccttcattgctgagggaatttaatgtgcttgacaatccactatgaagaagataaactctaaccctattttctactatgatttcccacttttctcttacataaattaggtgtttcattctttttcctccttattattatatttacaccattctgtgatgagcaacagaaaggtggaagtatatagccctgttctatgtttataatgctctgtatatttttgtttccttatctgtggaatcacattttcattatccttatcaaggagatggccgattattcttaatctttgcttaaaatctaactagcttttttactaagtgatttctgttccttatagaatagtgaatgtgactgttcttagggtattgaactggtcctttacatcggcattggaacttttaggtattagttaactttcatatggattgtatttcatatatcattgggaacgtattttttgccaagaatgaaatacttatttgccttaaaaaaataaaggggatcaaaaacatttatattactcgaaaataatattaaataaaacggcctccttggcctaaacggtgagactttgggcccgttccctttagggggggtatataaagaccccgttccgtactccttgccctaggcgtgcggttggggcagcggatatactcccgtaaggcgggaatacggtttcccaaatcgggggaacccagaaagacattgacaaaggcccaaaggcccaacccaaaaaggccgtgtgggttttcatagaccccccctgaaactaaaaatgacctaaagcaaggggaaccccag

SEQ ID NO: 11442 - DNA, 1824 bp, Homo sapiens
  misc_feature (1)...(1824): n = A,T,C or G
ccgcgctgctctcgtgctcgtcttctcttgtctctcgccctgcgctccgcgtctctncgtcgctgtctctgcccatgctgctcgctcgccgcctctctctctcntcgcgnccctcgtccgcatcgctcngtccntcctctctgcttctgctcgtgctactctcgtncactccgtctgctgcctanctctcgttgtntccattantgtgctcntnctcgccgtgtcgtccctgcgctcntatcacgtcngctggtctcgctgctgctctctcgtctcgtcctnntgtgctctgtactgtccacagcatctctaagctgatcnttgctgtcctgctctnctctcgacctcgncntttcctatcncctcttcttgctctctgtctgtcgcnctctctctnnccgccgctgtctctcgtctctgctctcgtcttctccntctctccgtgcccgctgctctgtncgctctctcgtgnctgntcnctgctctctgtgcttcctctcccgtcgctctctgcttcgtcgtctgctctccnttgctgcctangctgtngctcngctcgtcgnctccgtctcgtctcgtnctccgactctcttccctgctctctccgtcctcctgtgncctctcgttgctcnncctacgtctcntgcgtgtcctcgctatctcntctacgtctctgcgtctctctctntgctctgcncgctntcgtctcgcgtgctctgctactctccccttcctctctcactnctcncccgtcctgctctctcttcgctnccgtnctatcgtctctctcgctcttgctaccctctcgctctngcttcatgtgctngcttaacgatctgccgactcncntcctcgcgtctcctcgctcctctctctcctctcctncctcgttcnctcctctcctcctctcctgctgttctcgtctcactgctcctctctcgtctgcgctcttcctcctctcctcgcctcgcgcctcgtaccgcttctcctcaccgtccctccgagctcctgctctctntgtgttgtctctcggtctctctcttctcttctttccttcgttctcgtcntctcttctttctgttgttgtatctctcctcgctcttttgttgcgcgtttgcctgtctgcgtcgncgttcatcgccggtgcttcgcctctctcgcctcgttctcncctccnctccctctcttcctccttcctcctcttcttccgcttgctctccgtctgcttcttcgcctgccctttctcttccacgtcttctcactctcctccttctttatcctatcgcttttactgatgtgtttttttgctgctctatatatctctatttccttctgtttctgtttcngcgntccttctcctctcctccttatctcctgctnccttctctcgtcgtctccttcttcctctcttctctcttcctcgctccttctccctctcctcctcctctcctctctctccgctctcgctccctctccccccgccttctccctcctcctctctccgttttcgtctcttcctcttctcgccttcncttttcttctcctctccctncnctcgcttctccttnttgggtgtttctttcttcntttctgtcctccttttttagaagattctctctctctcctctttctcttctttttttctcctctgttctctcttcgtttctcgtggttttcttctcnctctcttcacggtttntcntctttnntnntgtttctnccttcntcagggtttttnntncgattgtgtntcttntcntctntccccctnatcccccnacccnnttttttttttttttttctnnnttcctttntcttctttct

SEQ ID NO: 11443 - DNA, 745 bp, Homo sapiens
atagggcatttgtaaaagcaaactttatccctgggatatcctcctgatagttccattgtaatctcccagctgcattctctcaaggggtttgaaggtgtatttgcagcgattagtggtatactaggtggcctcactgtgattactgcaacaactgcaagatgaccaaaggaatgtgtcttcacaaggttgacattgtggcttatgagtttcatgttaagacaaagacaaccctgccatgatgatgactgacagtagtgctgatgccataaatttttatcaaatccctcagtacaggttgagtctgatcaaaaggggaaagctgttcagtaaaatatgtgggaggtcattgttttggattaagctcctgcactaggccccaacagaccagatcaaaccagaatggagtcactcatgccagatgccacattgtcaaactgaatgtaaaaataggtcacttgttcaaaaaaaaaaggagattcacagtaaccaattgaaaggggccctgtcaacctaagctcacatgataaggaagtctcctctagtttaacgtatgcaaggaaagtagctttgaaatcaccagtccactttttgtttcttctttctgctttcttcagccttttccattataaagcccacacatctgctcagctcagtagggcacctttctatttcatagatggaatgtcacttgattcatgaatcattaataaaagccaatttgatgtttaaaaaaaaaaaaaaaaaa

SEQ ID NO: 11444 - DNA, 905 bp, Homo sapiens
  misc_feature (1)...(905): n = A,T,C or G
tcaggcacatagtacaaatgaacagtcaccttctcctgcgtgttcagcactagtgcaaacaacgggcactttcagcaccccgttgatgcaggactccatggggcccccttggctcagagctgggcacatccacagaagctctaccaaaaggcacccattagggagaaaagagacattaccgttctaagctaaaatcctcttccatgtgcataaagtggggagatgacggggaaatgggaacaggcttaaattaatagatattctacctactaaaacagaaagaatgcatgtaatttcttaaattgcctctgaaacactaaatatacctatctttgttagacaatgccatgttgctctgccctgcaggggtcccggctcctgatcacctggggtgcacataggttacacagtgacaagaggccccagggcccaaggactgcccccacaatcgggtggcacccgcaacccggggataagtggtccggttttcctgctaggcaggggagtataagccatccttcaattttaacagcgctatttcatcttgggctcaggcctgagatttttaaagtataacaaccggaatgttccaagacccaacaacaaggggaaatggccaagttaaactttggggcagagcgcctccaacgggcccatctactgaaagggaccgattatcgtagttactaataccccgccccctgcataaaaataaaaaaccgcccttactcgtgaggggcaacccccgagatccaaaaatacggagttctccccccgggaacttctcgtaactctctcgaaagccctaaatttaaagagcccgtaccgggtttctttacgaaacggggcntatagcctccacatttaagctcaaatagagggcgcacccgcccaactcctattcg

SEQ ID NO: 11445 - DNA, 1136 bp, Homo sapiens
  misc_feature (1)...(1136): n = A,T,C or G
ctaaaacagaantnaacgcnaccgggggggccgcagggaggcagaaataaaaaaccgcacggcacaagaaaaggcacaaattttacggcgaacaggcccccccccnttgcggcggggnggaaaccgcagacccgcgcagaggaaagagaggncccgccgagggaaacgccgctgggagcaagggagggccgagaccagagcnagccgcacgcgggccaaggagncccacccgccaggaacacgcgagangaaaccaaaaaagcnacagcgcgacggcgcccggaggccaccgagggccaaggagggcaaaggaaaggcgacnncccggccagcccnggaggncgcccgcgacggagcgcgcacaaagagagccagagagaacagcgcgcagaggtgttggcncaacgcccacagcgcagcgccgacgaccacgaagggccaccgaacacggacacagaaccaaacgacgacgcagccccaggggaaagagggaaaggggcggaaggacggcagggaggccagagccccacagaagaacgcaccagcgaaggagaggnacccggcgcgcgcgcgccacggcccccgcacccccgcccccccgcgcacagagacaagagagaaaggagnnaccgaggaagagagagagactccaacagcagacaccaaaccaaagggngacgaggagagagaggccacgcggagagagcgnataacgagaacaaaaaaggacgcggcggccaacgggaaaggagccacagcaaagagcgcncgacaccgcagagtgcaaaacggcaccgccacggggcccacgggcgaggcacgcacggcgggccaccgccggcggnccaccagaggcgcacccccagcgctccagggtcagcggccgaccgcagacacaaggngcaccaaccacgagccggccacggccaaggaacaacaggaccagcgaaccccacgcggcgcgggcggagagaggcccgagagaagggcaaaagcgccccaacgaagccacaagcgacggacgggcnacccgcgatgcgagcaggacgcagcggnccgcgaggacggacccggcgccgcgccggcccgaagaccaaaagaagncgaggggccccagccaccgccaacagcagaaa

SEQ ID NO: 11446 - DNA, 388 bp, Homo sapiens
  misc_feature (1)...(388): n = A,T,C or G
gtttgggnatgtaccaacttcttccctccaaccagtcttttttgtccctccaactagtatcttcttttaagcatctcatattccnggtcttttaaaaaaagccaatatatatataagctaaatacttaattttctaaagtaattcactcaaaatatctagttaataggatgctagcgaatggtggtcttttacaaaaagtaagttccttagcaagcaggacttggtcttgntcaagnttgcacccatcctgcctcagcaaccccagcnccntgngcaatttttcatgngcccannaaggtgcaacnaanaccnatgaanaaancncgangcggncccccccccggggnggcccgccnttgncccctangangggagctggggagggaa

SEQ ID NO: 11447 - DNA, 1124 bp, Homo sapiens
  misc_feature (1)...(1124): n = A,T,C or G
attaaaaagagaagggagaggagtngnagcacgaggctgggccnaccacaaagcggcgcacaagaagagaaaacttcacgggagaccggagcccccccttttagtgcgacggaacaccgaaaagacacaagatggcacaaagaaggaccaagacactttagaagaataggcgtgaacagcagagcaagatgctgtcctgacgacaggcaccagcgnaacaacgtagaaacgtgacncgcgagaggaacgagaaggtaaacaagcgggcgagaaaagagaacgagttcaaggagagacgaacgagacacccccccacccaccacccacgccaccgccgcacagcacacacggccacgacccgccacccgcaccgagagagacaagaanacagagaagagcagcagacgagagagatgagcaaggaagaggaaagagaaaataagggaagggacgcgnaagggaggaagaganagaggagggagagagccgccaggggagaggggagcgagccaagagagctacacgccaggccggcagacgcaccccacgaacgcacgacgcacagcgcgcacgaagagccccacacacaagagcacgccacgaacaagagagaccaagcagtncacaggaacggcagagcacaccacacgaacacagccaagagacacacgggnagagggagacaagagagggcgaggagacgaagtaggagccccacaacaacccacaacgctaggccaagaagcgcaggccgaaaaacgaaaagagacaaggtagaagaggcataagaagagncaaaagagagaaaagacaggtacgcggaagagagncacccaggagcacagctacgaggtccagaccacacgaccacggcgccccaagtccgccacgagacgaggcccgaggacaaagagacatacaggcacaagaccaggaaagacgaacagaaaagaagacccacaggcagaggcggaagcagagagtagaagaggcgaaagagaaaagagcnaagaagaggnagaagacagagaagaaggttagaagagaataaaagacaggcaagagagaataagaaggagaaaagaagaagagagagaaagaaagggaaagagaagagaaaaaag

SEQ ID NO: 11448 - DNA, 553 bp, Homo sapiens
  misc_feature (1)...(553): n = A,T,C or G
acanaaatnaactannanaaantaaaanagaanagttnangagnganagacancaatagagnganacnnanaangnataagganagnnnagntaaaaatgaaaaannagnttnngggnganncanaaaanntagnnggaaaaaaancagagaantnaganacnnaagnggaacanananantanagnaaaaaaganaannttcctttttttcaatattattgaagcattgttttgtgtatgtacnaactttcttccctccaaccagatcttttttgttccctccaactagatcttnttttaagcatctcatattcctggtcttttaaaaaaagacaatatatatataagctaaatactaattttctaaagtaattcactcaaaatatctagttaataggatgctagcgaatgctggtcctttacaaaaagctaagttccttagcaagcaggacttggtcttgctcatgcttgcacccatcctgcctcagcaaccccagcaccctgcacaattcttcatgcacctagcaagtctgcaacaaatacctatgaaat

SEQ ID NO: 11449 - DNA, 578 bp, Homo sapiens
  misc_feature (1)...(578): n = A,T,C or G
accccaaggnaaacngttgtttcaaacccnattngggcttccnnttgtggccntnngcaaaggttattgncccnccaaggggttttttnccgggttgcccnaaaaaaaagcgaaaccgcccaaaggaagaanggcccaaagggnctttgcccnaccntttcaaaagncaattgactttcccttcaattaaagggccaaaaacttgcatgttggaanagaagagtaaaaagacctttcttgaagaaattaaagcgggacgttgagttgacttactctaggaccttcacataagaggaagcaancagccaagcgaggtggctcatgcctgtaatcccagcactttgggaggctgaggtgggcggatcttctgaggtcaggagtttgagaccagcctgaccaacatggagaaacccagtctctactgaaaatacaaaattagccgggcatggtggtgcacgcctgtaatcccagctacttgggaggctgaggcaagagatcgcttgaacccaggaggcggaggtgcggtgaccctccagcttgggcaacatgttatgaatnaaactccntctcnaaaaatt

SEQ ID NO: 11450 - DNA, 493 bp, Homo sapiens
  misc_feature (1)...(493): n = A,T,C or G
tttgtcttgccctggacacacaatattgatagttgaaaacaggcctgtaaaataaaaagtgtttctagagaaactaattgagatataatcatgtcaacaaacccttccaagcatttcaaagcgaataccaagcacacagggtgttgccagaaaaaaggaagctatgagggatcacatcatttcagaggaatgaaaggctcacgaaactgccaaaataactctatactgtgacatgggatattgctgccacaacactcgattactgnaaatgttccctgagcacttccttcaccagaaacagactaagaagaaacaaaacaagggttagaatcttcagaacctgcaaaaagtccttnttggaacacaagcaagtttccactgcattttaactgngtttcaatgtcgcctgttctttttcaaatttaccgagagggccggattggagttattacancttgaaagcggcangggttcaaaagatgccattttttat

SEQ ID NO: 11451 - DNA, 570 bp, Homo sapiens
  misc_feature (1)...(570): n = A,T,C or G
cccttcccncaaaaaaaaaaaaggtttgttngggggggngtttnttgnntcaacttnaccaaggaaatgcccccccggnaaanangantnntatggggccccanangtnnagncaagaaacaaggggnttccccnctttttaaatttganngtttaaccggaaccggtgcccccggttangccannttaaaaataaaattcantggcttggttntaganccccaaaacaagnccnggcacctttaaaggcnaacgcaagnggggangggattaaagccaacgcggcacttaacattggttccccaacnaaaaagacttccactaatataatctgtttttccccccgtnaatctcgacaccgggggagcacaatgcgtggttggaaaaagccagcagaacaatccccggttgtcaaacaaacaaaaaggaggaaccggcaacacgacaggaacacgcggtatctgatattaaaaagcagccactaatagcaacaactttttactcccaggtgcaacccccacccccctttcctttcaggagagaaagcctttgaccgtttacaatgggcga

SEQ ID NO: 11452 - DNA, 1200 bp, Homo sapiens
  misc_feature (1)...(1200): n = A,T,C or G
ctgtaaagcaacgagatgantaaaggagttccctcgacgctggtgcgcggagagaggagggggggcggaacgaggaaaggagaacagatttcatcgcggagaacacgagacccccaccacttttaggcgcgcacgcgaccaggagccacagagatcagcggcccgtcacagcgcgcacatccactatccccagactgtcgaccacacaacccgatccacgggccggaaggagggagaagcaaagatctcagaccagaagggtngcaagcagagcgccaaagagagaagtaacgcacacaggccacggaaatccgcgagcgcccacgggcggagaggagacacccgagcaccccacacaaccgacgcccgagctcagcgcgcgcccgcgaaagcgccacccccgcccagacccagtccggacggccgacgcccgccgccccgaccgcgcacgcgaccacgaggcccacgacccccacgcacgagcggtcccgtgacgcgccacagccaaccagcagaaaggcgcgcgacgcaagcagagagaacagagggaggngaagagagagaagcagaaggccagcggagcaaggcgacatccggctcacacacacaccagccccgccgcagccacgccccccgcgacccgcaggcctaccgacgaggaggcgcggcacccgacgccgtacggccccacaagagacncactcaggagcggcgcgcaggcaacagccggcaggncaaagacaccacagagcgcgcgcaccaccaccaacacccccgcaccgcgcacagtcgacgcagccgcccgacgacagcagaggccgcagacgggcgcaagcgcgaggcntacacgtcacggcgccagatcaaggaaacccacgccgcgcgagagccacacgcaggcgagcagaggcagaaggtcncgcacgncgcaaggcaccacgggcagaccagcactcaccaccccaccgaggcgcaacgaggtcagagaggccaacagcgccggaagggcacccgaccgacacaacagagccaagagcccccaccaagaaggcaaaaacgcntaacaaagaggtaggaacaaacacaggcncacagacggcaccccaacaccgacagaccaccaacaggagcggtcacgccccgcgtcccccacgcgacgccgccaggcccgccgaccgatgacggaacgcccgacacaac

SEQ ID NO: 11453 - DNA, 551 bp, Homo sapiens
  misc_feature (1)...(551): n = A,T,C or G
anncccctttntttttaaaagactgttaacncccctcccccagagnggncccggggtttnncntttngnaagnagngngggntcccaaaaccccccctnggaangggaccccatttttngncnnccncnttttttngnnccnaaanggccanaaaaaaaaantngtnanaantangaaaggggnaaccnntnnaanataggannccaannnaaaacccntacctgaagcnccttttnaaaaagtttnnaaggaananaaaaagaaaggtgcaacaaaaanggttattacttttagcttttatctaagtggggttttctttttccctgaaaacgactgcagcctgtttaaacaggaaggaatctgtggaaatagaatagtcgagggcacaggaaaggggcatgaagatagttgaatagagatttctgaggaagccaggcagaggtatcagattgatctcagaggcagggaaagacacctcttctagtttaacaggacaaaagaagcaaatttgcccatatgttgtaattgggaagtgagataatatttgaat

SEQ ID NO: 11454 - DNA, 887 bp, Homo sapiens
cctttgaatcttctccacgcaccccacacccccccttttttcagcatggcattaattttgccactattatggcttctcgaagagcaagaaagaatggaagggaaaaaggataactgacaatggagcagagggggcgggcaggccatgggaaaggagggagagtgcgttgcgggtattaaatgtgatgatccttgccaagtactgagccaatctctggcctatagtaagtgctcagaccatatcacccactatattcattggctcacagagcctataacctgggggggcgaacctactatgcgcacttgccataaagaagggactgctctatgggcttatcccctaggactgccttcactatccccgtcctttttcatattacggccgccccttggaccggccattaaattatcggtccatcatatatttgtgcggtataatctcccccgcgacgacatcttctcacctgatacatcccgtctatgccctcccgtcgtcatcgcgcgttagttttgtagaatattggcgccggtcggcgccgttatgctggggatcccagtccctccgtcttcgcccaacattagccgccgttagtactgcgaggtcttctgagccagagctcgtgaaacgaccacctttttcctatgatattgaccttcgccccctctatgaccgcgatatctttctgtccgcccccgcgcctcctcatgctcctcgtcgtggcctcccttcatcactctgcggtctcgttgacctgcctgtactcgcccccccccggcagaccgtcccgcactcgcgggatctatcttgcccatacactggcctccttggccctgactagtcggcactcgcttgtggccgcgctctctcgccccggcgcctccggt

SEQ ID NO: 11455 - DNA, 1369 bp, Homo sapiens
  misc_feature (1)...(1369): n = A,T,C or G
cacanacatgagtacatgatctatganacacgtacacactagagtagtaggcgtactaacagtcgcgnagctcacaacggagnaactactctcacgctgaccttatcatcatgtgcgtcacacttncgccacacacagcagnngntcaccatatatgggacgctgtgtcanggcagatgacgagagcacttggtcgtcacgagaatgngtcatcacatacgagagcactagatgaggtgtcgcnaaagagcgnnaagagagactacagngcagatgaactagagatacactcatagagnggcagatgtactaggcgctacacacgaaaatatactattgaacgcgatctacagangaaacatatagaaactaatacantaacaatattcaaatacacatggatacacatanacactaactagtgngatcagttatatgatagaagaaaacttcaatgtgatcccacaacgacgagcacatcgaacaaacagcacgctaatgagaaatacgaataagacatcaactatatatatcacataaagggaatggagntattctaacgttcatacacggtgacaggacggctcagtgtctgagggtgaggnatgaaccatcacatcaacactataacacatctgcacgatagtcatgtaccatcgcgcctaaaagatagaacaacaaacgtcaaggagaaacgattatagagacagaagagaggaattatatacgctttggatcaactagaagaccagagtcctcaagagatgtgacagacataccgagggttatgatggaggatatgtggatttggaggaggcctatacgaataaatagaccaatattagactatagaggagccatgcccccgatgttactataggagctatgggaacggtgattacttctggctgaatgagtaaatattacatanacaacataacaatagtatagagagatgaatagttgataacgcatcatgcgccacatattgagagtgggtatatagggattccgcgccacactatcatgagatcaacgttcacccttctgtgggcgacacaacatagaatgctgcagtccatagatcgaagcctcctgtattgcatatacgattcctgcaatgagtactcgaggcgctacatacatacgcactactacaccagcagacatcaagtattgcgaatatatagatctagcggatatanaaataggcaggngattacaacaganaaaataggacatgctgnatggtctctccgtctgtacgaaaatgtcgcgttcgagttgtttccccgtatcgaccggcatatatcagtataaatagttatgtgtattagtatagaaatatatgtaagttagtatattgata

SEQ ID NO: 11456 - DNA, 776 bp, Homo sapiens
  misc_feature (1)...(776): n = A,T,C or G
ttgttatttgccggggcataaagaggtcaacttctgggccaaagctttggccaaggtttcctacaggggaaacaacccccattttttttgggtgggctttacggcttgttgggggagccttgccccaatagtgttccctactggtttcttgtgaaatgcttttggcctatgtagcagctttttattccctgcataccttagggtgggggcccaaatcctttcccttgtttataacatgaaaggttttttagggcacatacttagttagagcagtgtttagaagtcggggaaaatgggtttctacttttagaacaaggctgggcatcagcacctgcccagctctacttgtgtgatgtttcaggaactcaccccctttttctgcctaggataaggagctgaaagattaacttggatcttctaatggtccaaatcttttggtcncaataaagagtctccaaattagagactgcatgttagttctggatggatttggtggcctgacatgataccctgccagctgtgaggggaccccgtttttaagatgcatggccaagctctctgcaaatggaaacgcccccactgggtgttggggatgtttgctacctcctgctatttttgtggttttggttctcccactatggtaggacccctggccagcattgtggcttgtcatgtcagccccattgactaccttctcatgctctgaggtactactgcctctgcagccccaatccctatttctgccaataaaaggagatgaaaaaaaaaaaaaaaaa

SEQ ID NO: 11457 - DNA, 806 bp, Homo sapiens
  misc_feature (1)...(806): n = A,T,C or G
ttngcaaacccaagaaacttatgnccnttnacatccnctttatgataaaatatttncccagcctcccccgattaatggttggtttgggctaataaaagaaggcancgggcaagccntttnaacccaggtngaggcnccatngtatggaagacccttcccaggtcnngggtttccatggttgaaangaaaaaccaaggtggaccccnatttggaaaaaattccaccccctttccattncttgggcccnaccccaaccctttnccccaaatgggtggtttcccaaggntttcccaaccccccnaatgggccaaggggcccaattggncttgaaagggggttggaattggaaaagaaaaaaanttncccattttggaaaggacccttggttttggccaagaaaaagggaaagggggggggaaangaaaaccctttgggnaaggntttccaanaaatgggnaatncctttcccnttaatttttttnccttggaaaaattttgggtaacnaaagcctgggtccatttcccnacccaanntagaaattatggacttacccncanggccnctttcnnccantngtnaatgaaagagangcattaaantctatccntaantaatgggtgtnaattttnaangaattaacccaaaaganggtgccnttggcccatatccacaaaataaccngttntnntanaaggactaaaggttnaccntnaaaaaanaangtcccccccaccctccttgtnantaatcgcgatcgccgccccnggggagctcagcnttngtcctttngaggtatcggctggga

SEQ ID NO: 11458 - DNA, 661 bp, Homo sapiens
  misc_feature (1)...(661): n = A,T,C or G
tgctggaggggtgcaccatgggcctgggataggctgttgtcagtggagcagaggtgtcgcccagccagaagggtaagggagctcagatccagtccaggtgttcgggtcctgctccctggcgagaaggaagtatgtgtgagagagtatttcagatcctcctctcctgtggctctggaatcctgctcatctgccatccggcgtctccagccctgctgtgcttgagaagtcttcatttctcactagcagcctccattatctccacttcctccattatccccacttcctacattttcagggcacttggcctctgctgtaccctcagcccccaatcctaagggcatgtgctctgtgaagtgggggacttggggttgtgcgcccctgtgccctgcagtgcctgacgcatgagtgttgtgctgaccctccctcagtgtcgttcagcagtgagcctctctaaagcaagttcaccatttacacggtggacttgtttcctgtgtttgtgttcttatttcctaaaaccgaactgcaaactcctgagggcaggatctnttttttcttttttaaaataagctctcatttgtatttatacttggctattttcaaacgctattcgggtgggacagggctcatgcacattttacaagctgagaaacagcatacagag

SEQ ID NO: 11459 - DNA, 554 bp, Homo sapiens
  misc_feature (1)...(554): n = A,T,C or G
agtagccctgaacttttaacccaggttnttccagttcttgttcaangaatgatcttttctggaacccnagaaccagcttgagtatttggnangtccctccagtaacccgttttnatnaggtaaaaaaaatatggggntaagggattttgtgaggnacacgngcaanaaaaaaaaaanttttatgtgcttaaaaaaatttcttttgccnagcctctttcanttngaaaaggattttcaaggttcatatatgcattgtttgttgcatgttactttctttggaaatgactagtgaggacagataacttagaaatatttgcatgttacatcagaagagagttaatagtactggttactgttaatactagtggtattagctgttccagcaaaaggtactgcttattacgctacttccgtacaaacgtcagtagccaggagtgtatacgaacagtaccacttagcccattttcattgtatgtccacagaggcaaaaagctgaaggagtatcaataaaaattgagcaatctcatgctatcttctgatagttttcttataat

SEQ ID NO: 11460 - DNA, 1132 bp, Homo sapiens
  misc_feature (1)...(1132): n = A,T,C or G
cgggaaggggatnaagnnnaggngcngcgccgggagcaagggtaaagaaaaagaaaaacaaaaaaaaacganatcctgggggaacaagaccccacacctcaccccgacggaacccacccgcaaaacggggaggcccccccccaagaacgctccccacacaaaaggaagaacaaaaggccgaccaaagagagagggaggnncaagaaacgaagggcccgccaaggcacgacaccaaccccaaagcccagcagagcacgcacgccaaccccagagggcacaagcaaganaaccccaaagcaagcccggaaagccaggaggcagagagcagagagagagagaaagaacacgggccggccggacgaggagcaagaaagcgggaaagagggaagacgccgacagaaggcaagcacacccgagacccagcaccccgncacagacgaaggagacanacaaagagcgaacaagcgaaggnagaggcagnaacagaagcaggggagaaagagaaaaaacgaagcgagagaaccccagaagacgacgcgaccgcccaccccgaccaaaagagaggaagaagagaagacgacgcaccggaggcgcacgggaagagcggcacgaaccacacgaagcgcgcacacaaataacaaanatcatacaaaacaagagagccaacccaancaacagagtacacaaagaacgacaacgtaacaagacgacgangagcagcagcgacnacgccggaagagcaataaagagcggacccgaagagagcaacggaccacacagaagccgagaagaagacacncaaaaaggagaagccggcgagaagcacccccagacgccgagaccncnaacagagagcagcacaacgcacacgcgcggacgagnaaagcgaccagcaacgaacagacagcacgacaaaaggaacacccagcaagaaacccacaagnacgaacggtacaaacaggcccgcaaagaaaagaccaacgaaacaaaggcaggagnccgaggcaagcacccccaccaaaacgcccaagacgaacgacgcacgaccacgacgcnaagaacacgaagacccccaccgagaacacaagggagcgccgaggagacaagcccgacacacggacaaccaagaaag

SEQ ID NO: 11461 - DNA, 495 bp, Homo sapiens
  misc_feature (1)...(495): n = A,T,C or G
ccagacggtnacatggctcntggatccaaganactnaggttatcggttcnaaaaagcannnacaagaaaggcaagccttgccaacatnaananaatgcntcctcaannaaaggcaaaactgcnatgtgganagaagagtaaaaagaacttcctgagaaactgaaagcgggacggttgagttgactactctaggaactttcacataagaggaagcaaacagccaagcgaggtggctcatgcctgtaatcccagcactttgggaggctgaggtgggcggatctttttnaggtcaggagtttgagaccagcctgaccaacatggagaaacccagtctctactgaaaatacaaaattagccgggcatggtggtgcacgcctgtaatcccagctacttgggaggctgaggcaagagaatcgcttgaacccaggaggcggaggttgcggtgaccctccagcttgggcaacatgttatgaatgaaactccatctcaaaaaat

SEQ ID NO: 11462 - DNA, 1390 bp, Homo sapiens
  misc_feature (1)...(1390): n = A,T,C or G
gggagaggggagaanattctnntatttatannngcaccacaanccgcccacaccacaaaaacagaaaaacaaaacaaaaggccggaacctgccngnggganggacccagggcgggagaggncctgnnngggggnggnggaacccncgccgncgccgcgggcgcgcgcgcccaccncgacgacagagagaacagcctaacaagaaagacgcgccgggccccgcccgcacgcgccgacgccncgacgaagcgaggcggacgggcnggggacccgcgccgggcnagcggcgcgggagcgcacgaaaaaacncnacagcagggaagaaggcagcagaaggacgacgagggacggagagggaacgcagcaacgacgcacccgcgcccgccccgacccgcgcgccagccaccccgccccacgacgcgccccgccgcccacacacccgcttacacgagccaacccccagagcacccagcccgccgcccaacngcgagggacagaagaagaaagaacacacgccacncacgagaacgcgggangagaaagaacggggaggggagagagacgacaaagcncgcgacgcgaaagacacggagcgaccaccgcgccgcccgacgcgcgccgcagcaggccnccngcggacgggcgaacgccaggccagagacaacccaccgacacgcgcgcgacgaggagccgaggcacacacgccnccacacgcagcgcacacagacccncgaccgcgagcacccagccgcgagacgccgaccacacagccccgcccacgcacaccgcccacgacccaccagcgcgcacccagacgacgggagacacacgcncgacgcncaacgcgcgngcccgcgacagcaagagaccagcncgcgaggcggcagcgcncaccagagagacgncgcgcggacccgcgngnnccgcagacagagcacaccagccgcgcaccgacnccaacgcacagagtggacnagcgcaacgaaagacacagcagcacggagcagncacgcgagcgncaggagacgcgaccagcacgagaaccanacagacacgagcgacaganacacacacgcgcgaccaaccgcgcaatanggnganatccgagtcncagcacaacgcncnacacgcaacanccgccacaccccaccgactactcgcncngagacagatgancgcacatcaacagcgccacgagacgatgaaacnnncaccacagacagatcaagcaagtncgcaacgacgagcgcaccacatcagcgncaggagacagantcagaggcgcagaacgagcggagcgccgccgagagacgacgcagancaaggcacggcccagcaatatgatgaganaagaanagcagaagcangagaagcgacacgangagacacag

SEQ ID NO: 11463 - DNA, 792 bp, Homo sapiens
  misc_feature (1)...(792): n = A,T,C or G
cctgaggggtatggaatcccnacggggttcgtgctttttgccanantgctatggaggtcnattcccnatnttacnactaancttgaaaaaaggccgggccntgaaatccccnttttttnnacncnagntaaccnnaaaccttaaangaaaccccgggnccaatgcccccaaagggaaanaaaaaaaaaaccctgccnagggcccaatttaaaantggttccccnaaaaaangggggntggggntaattttttcccccaaaaccnatttttttngggaaagggnaaaaaccctgggggttttgggtnccccaangccccnttncctgggttttgggggtaantcccaaggntcccaaggttggccttnccttggaaccttccnttgggccaaaaccctggaaaaaccttggtttccggaaggccattttcttgaaaaaaattaagantgaattggtgggttaaaaccnacctccggattaatnctgggaanaaancttgacctaagccacccattnattgatcccccnagtaattgngggctgggaaaaggaaaagaaagatccncccttggtggtcccctggttggaaaaaattatttcccttctgaaatttctgggcttggtncttccaggtngcnccttgcctnnangtggaatgaaacnaattaaatgaaaaaataaaanttgggttncaaangcnannttnnctccccccctncggtattnnnanctttgaaaaaaaaancccaancgcccccncgggagctcagnttntccntanagtatcacanga

SEQ ID NO: 11464 - DNA, 484 bp, Homo sapiens
  misc_feature (1)...(484): n = A,T,C or G
aaacgatctcactctgctgcccaggctggaatgcagtggcgtgatcacaactcactgcagcctcaatctcctgggctcagctcatcctcccaccttggcctcccacgtagctgggactacagctcatcaaattctacaaaataaacaaataaaagcaatactgttcagatgatgatggaaacttcactgaatttattgagtgtcactggggttcgtgtaaggacagttgtgatctatataataataaatcttcaatttcatttattttgagtgtattttatggcatttaaaaatctttataattttcttttttaaaaacatattttgttacatttattctacactttaatttttgntcctattacaaattgnaaactctgttttgagttatattttataattgcaagctggttggtattttaanaatgctattaattatttgtgcatttatcttggttctggcatcactggataaactcataaa

SEQ ID NO: 11465 - DNA, 538 bp, Homo sapiens
  misc_feature (1)...(538): n = A,T,C or G
aggngganggtttttttttttttttaaaaaanaaaggcttaaancaggtaaggccagatttccccaattctggggggggcacccagattngtancaaaatgggtgtttaaagtttggcaaaaaaaattaattttgaancnnnttttttccccaaattcattaancggtgattttntttcccctaaagtggtccanagngttttcctaatgcctttaaaagataaagatatattangtggcttncctaagaagacatcnactnggttcngatgggttttaaaatatatatctataccagttttattcttaggtttgtgccaaattttattngaatcnangataagagggagattgattaataacttttctttcttaatggcttgcctagtttggtattaaggttattttgcctcataaaaatagtagaaancaagatctgattttctatctgatgtgtaacagtttgtaaaatactgggattataatattccttaaactttttattaaagaattataatattccttaagacatttaaat

SEQ ID NO: 11466 - DNA, 781 bp, Homo sapiens
  misc_feature (1)...(781): n = A,T,C or G
cggctgccaancaactgannaatntatattcaaaaatgtgtaacagtagatatgcagtctccctgaaaggctgtntcccagggtnaagaaangtcantgcaaatgccagggnatgtnaaagctgccagncattatnatntctactctggacattcagccttgctgcngagaagaaaactatgaactcagagcattganttgnctgctgatgcagccaatcccttnccaatncaagcatatcncgccnggntcttgtttagccatatgccaactatantncggcccttcatggtaccaggttaaatggcttgaccatccacccctttcccccaggtttttaaaccagggcntngggtattttnattttttttaataaaaggtggaaggggaaaaaaaattaaattccccattttttaaaaaaaaaagggtggaaggnaaattttaaaaaacctttaaaanccccaaaatttggttggaaggaaaaattaaaacccttccccaaaaaaaacccaaaatttggaagggtttnccctcccnattttttggttgggaagggggaaaaatttttttttttgggttttccctttccccttttggnttttgggaaaccctggggnattttcctttggaaaaaaaaaaaatttaaaaaaaatttcccaaaggaattggccgggggccccccgggccccnancccccaggcgggggtggggaagggcctttcccccnaggnccnccnccttttggtatgtcccccncngnttgtatgtttganagtggngt

SEQ ID NO: 11467 - DNA, 839 bp, Homo sapiens
  misc_feature (1)...(839): n = A,T,C or G
ctcgtttttcctcctgcttctcgttctgactttctctcccgtcggtgcgtgtgatctcgtggtgtgtgtctctctggttcgttttcgcattctgcttctttacgtcctctcgcgccggtgtgttgcagcggtgggtgcgtgcggcggtggtcttgattggtgtcctggcgcgggcgcggttccatctatgtcgtcggttcccctgtgttttcatgtgcgctgttcgtgtctgttcctcctgggatgttcctattttttgtgcgtgtggggcggtcggcggttattgtttctggaagtccggccggctctcgctcagcttgnctctactcgcatgtttgctgtctcctcctctggttcggtctgtttcggttcgctcctctcccgcttacttcttgctcgtctcctccgaattgtcgctcgcgtgtctctcccccttggcgtatgttcgagttgacttggtcggtctttctcggtcgcgttttttttttcttttggtgttgtgggcttggggtggtcgcgtcctctgtttccacagtatctaaggtttttttttgcgtgccccttctggctttttacttagggggggtgtttttgtaggggtcgtcttgtaggtgtgggagcctgtgcatgtggggtgggcctttctcctggggggggggtcttttgcccccccctttttaaaaaaattttttcggtggggtttttcgggcgtttgttggggctttccagttatgtgcgctggttgcggtggcgccgttctttggtttttgggtgccctcttgttaaaattataaaatgaaaaggcaaaaataaaattagctataaccaccccctccccc

SEQ ID NO: 11468 - DNA, 1645 bp, Homo sapiens
  misc_feature (1)...(1645): n = A,T,C or G
cgtgccgctctgtagtcgcgcgcgttggtagctgcgcgttgagcgctgtngcgtgcgtagtcgcgcgtggtgtgcgtcgtcggtgtgccgtgttgagcggcgtctctngnagtccgccgctctgtatgtacggccgtagccctgtcttcatctcgtgtgcagctcgcgtannctgtgtgcgttggtctctttgtcttcttgcgtctgtgcgcntncgcgtgtggtgttgtcgatcgtgagtgttctcgtggtgcgcggcgtgctgcggccgtgcgcgcgtcggtgntctctgtgcgntgctctcgttttcgttatattgctgtgggtnctcgtcgcgtcgtcgtggcgctgctggcgtcgtcgtgcgcgctcgcgctctcnncgcgggtctctcgctctcgccngtcgtgcgcctatccgttgtgctgggcgtcgtgcgtggcgcgccgtgtgtgttgttctgttccctcctgtgtcgcgcctcgcgttcttccgtcttctgcgtgcctgccgttgcctgccntatcgctccgctctcctcatctccgccntntctcctcgcgacgtggtcgtctgcccgcttgtgtgggtcngtagtgacgtgctcgatcgctcgcgctctcgccgcgcgtcgcgctctcctacagtgcgtgcgagccgctgctgaggtgcggcgtgggtacccgtcgcgaggcgtcgtggcgtnttcttgtgtgtcctctgtggtcgccgcgcgtcggttgtgngtgtcgtggcgtangncggctgcgtgncgctgccgctctcgtctctatttcactgctctcgcgctctccgctctgtgtcgcccttctccgcctcgtcccttgtggcctctcgccctctcgtctctctctcggtangcgtgttgctccgtntcctagcggctctgctgtcctanagcgctgngcgtgccgtctgcgtctctgagtcgctctggtggccgtgaggtggtgncctgtgtnggcgcgtgngggcctgtggtctgtctccttcttcangctgtctgtggtgcctgtggtcgttcgtgtccgccnacgtggtgtgtgctggctcgtgtcgccgcctgccgtcgctgccgtgtcgcctgttcctgcggtgcgtcatctgcgtcttcgatgnngtgcggtgtccgctctggtagtggtcagttcgctgctactttctttgtgcctgttcgagncatctgttccactctttcgtgngagggctgtgtgggtcgctgcgggcgctcttcctctcacggttgtgtgcttgtctgttgcgctccgtntgccatctancttcgtgcgtgcgcgctngcgttctcctgctgatgctctccttcttggnttgcgtgtgggtgtctgggtgttcgccgtcttctcgcgcgtggnttctctctngatcgctctcgcctcgtgcgcgcctgttctctgtcgttgtctgctctgcgccgcttctcgctgcctgtgtcgtgcgttngcgtcgtgtcttctggctgtctgcgcgctctgaccaggcctgtgttgcgcgtgnntntgttcggccgccctcttggaaagcgtctgtcgtggtctctctcgcgtcttgtgttgagactcttgctgtcgcttcctgctgntntagtgctctgtgctgtgttgtg

SEQ ID NO: 11469 - DNA, 1615 bp, Homo sapiens
  misc_feature (1)...(1615): n = A,T,C or G
gtgttacacntcngcacngtcgaatgacactcagttcaagatacaagagggatgaaggagtgacgagatgagaggagagttcagacagaacacgtaatcangtagtacgagacgatcggacatcagacaataggctccgatatgaggagagacanacagcgagcagagatgtcactcgcagtcacgntagcgnagatgagagcggagtatgcatatctaacagcttgcgtcaggtcagtatgacatgagttcgtntagctatatgcgattattngattactgagtgtgttgtctatctggtaatctagtgtagatcntctgtaactgacggagcatagtaatagtcgatcngatgtgntaatatgagatatngtagncaagctgcgagactagtaatatatgcttncatgctctctccgcaccatctctgtagatcgagtatagagagtacgnagactggacgagacggcgatgagacatatagtgacacactgcgntctacagacgacgacaggtctactagattgatgactgcgtagtgcgtgtcgtcatatagacatacgcgcatcgtgcacnattcgactcggngcgcgncacnctgcgtcagcganatcaccgacataactgntattatatgtgntctgtagtgattaatagctttgttcatagtatctacctacacntgcacgatgtacgtcacatcttgacatcgtgtctggacgacacgcgcanaagagacaganatcgcacaacacgtcagagcgcatcactntgatgtacgtactctcgcggcgttgcatccgtcagagtacatcttgaatcatatcattcgatagatatggcgatagcatcgatacgaagagcaancanaagcaacggctacgtgcaatacagtagacgcagnacgangaaccagagacgatgtacctgctgacgtgaaggtgacgancnttcgacaatgnaccaccacgctgcgtcancagatcagcaccaggttagtagntagaacagaaatangactcgtagctagtactatgtaaganttgaggaacagacggngtatctagntgcggcaggataagacgagtgacggagacagcgacgaacatagggagagagcgagtctcagcgtactgcgctgtgagngctgacgtcgtagngcagagacgcgcatagaaggctaggaactaacgctttactcgatcgtgagtgaatacactaatattactatcgattatttgtatgtgacatagaccgcgtgaagagtgtagaagtcatgtacgatgagagcagagtgttatgattattatctantacnacgcgacatactatatgcagataacagcnatcacctgtatagagacagcgacacagcatatgacgtcatacaagatagtctgcgacggatatgcgcttacatactctcgtgcgagaacaagtagaaggagcngagcgataggnacgagtgtagagtgactcaagtgtgtctgtgtaggtgtaagtatacgagngngtcggagagatggagtagatgacacgtatgtcgatctgcgtntcgttgtcntatcgtataacgcgtcgacgtatacaatgggaantgtcagcgctagcgcag

SEQ ID NO: 11470 - DNA, 1582 bp, Homo sapiens
  misc_feature (1)...(1582): n = A,T,C or G
cgcacccttccacttcctcaccccgccccatgcgacccgcccccctcaactagctacgtnanatagatacagtctcactcagccacactcaaagagtcgcccaatctcatgctacaagcgcgtaagcacntcctagtcgccacgctcttcgagacctctcggcaagaacgaatcatcactgagctcagaccataccgtcnataaanggcatcagctagctcagcgcacgccacatgtacatctccggcctacctcagactccgacgctgcactctacatactcgtccacacgcacatgacntcacagctctncgccacgagcatgccactcactctcacgatcctcctcttcgcagccacactccncncncgctgcgtcgccatatccgtccatagcctacctcgcagcgcgtacgcactctaacgcgacgactcagcgcgctctcatgctatctctcttctcacacgagctgttcacacgcgcacctaacacgccactacagtctacgctcctcatatctgctcccgacacgtccgctcccttctaccccctcaccaccgccccacgactccccgcttactcggcactcaccaccaagacccactgacactctccgcattccgactactcgccccagccgccacacggacacacgcgctcctccgactctacacacacacgtcctcccatccacttcctacatcttatgctcacacactcccacacagtccccatcgctcgcacaccgcacgccgaccgacatccttccagcggtcactccctctctcgctctcgtactcatgcctcacgcctcctgccccctctcngatgtaccatgatcccctcctcagctactcaatcaccacaccatatgatcaccgcactctctctgcgacgctccngcttacacctgtcacctacacagcgacaaccaccactctgttcgcactcgcatcgtcaccgcatcatcaccgacacatacactctccactcctgtgtcgccgctacatcacgtgcactctccactntgcgcgcctctcatgtgtctcccgcacgccacacgcgcgaccagcgtcctccgctctatnatcgtccgctgcgtctgcgtatcgcctacctntcntctctctccgcgtcnacgctcccnacngctccncatgcgacgtggctcgacgagccgtcttngcatcgtccgatcattcccgtcntacacaccactctgccgcgccggcgcctctacacctctactcacctctcgtcacgtcacgcctcacctcgatctcanacgcaatccgcgcgaccgtctcactnatcagggcatacgacctctcgcgcgcatctctgctctcgancctcagcatcntactcctcagctcgtctcgcgntccgtcctcatcctcgcactctgcgtacacgttctcatctccgctactatagtagctctcgcacacgcacgcnacgtcactccctcacttctcactcatccactccactaatctcctccactcgcgctgccagactcctatcctacccctccctctacgactattgcatcgccacgcccccgcgcctccccgccct

SEQ ID NO: 11471 - DNA, 714 bp, Homo sapiens
  misc_feature (1)...(714): n = A,T,C or G
cgcgcccgggtccgatttactttggtgggggcttgtgttgcgcagagagggggggcgtgcccctctctggggccgagacacgccagaggggtgcgagtcctcccccgccgggctgactatttgaggcatactttccagccgccaggctctccctccccggtcggggtttcaacatagtagcctctcgcctgccaccccccatcttctcgttgctaggcggcattgtgctgcccggcggggcacaccgggcaagtagtggggccagggatggctcgcgcccgaccggaccagtgggtcacgnccgcgtgagaggcgggcgcagacttcatgttcatacaggccggtgagataggccgcaccaggcgggggggggccagggttagagtcgagcgtctctctcgacggcgtgtattgctttttagggagggtcgagccggctcttcctgtgggtttgggtggtgtggggggccacggtggcagtggncgcccccccgtgggggcgggatactcgttggggcggggcgccggggtgacattaacgcgcgcccgggctgcgccacagagggggcggttcgcttgtggaagctccctgttttttttttcgctttagcatgcccgtttgttcgggcgcaggtttgaagagcccctttccctgcccgattcttgctggtgtcgagacaatgtttctttcagggtgatgaaaagaaggaactc

SEQ ID NO: 11472 - DNA, 937 bp, Homo sapiens
  misc_feature (1)...(937): n = A,T,C or G
tcagacattcttattcaaaagaaagacaccgaaattgaccttaccctgacaatatgatggctgaaggatttatgatcacttgtagcgggggaaattgaggcggaacctgaacaataagactctggggaaaggtcctatttatgcttttgatgtctttcacttggacatttaccacatgcctattggtagggttggtacatacggcacttaaaggggatacaagaataaataaaacactatggggtatgcttgaatatcatttatttatgcgggacaatcacaagattcctattttacataaatctgttcatacatagtgacaaggagtggggtttaatcgtttaagacagaaatattacgaatgacgcggcggaggatggagagcgagcgcccgcatcacaacgcgcaggaccagctccacttcacggggcgggggaggggagaaagcaggccctgagcgtgacggcccttcaccagatcgaagtgtaggcgccggggtccccttcaccgccaacgaaccacgcggaggacagtggggagctgcgagggcgatcagagcccagcgcacgcctccgactaccagacgtacgtgctcgacaagccgccaagcatgccgctccgcggctgaccaggcgaggagactacaagaggggagaggcgggggatngggcgaaagatgggagaggtcgggatcgcggtctgtcgcgagcgtccgacccctccggtgcgagcccggccggcatcggagccggccgacctagtccgacgcggccgacgcactngtcccggctaagacgtgcacgacgcgtcgcgcatcaggcgcggcagacgagacgcacatacccacaaggcgcaggcggcgacgagacgatgaacaacggcacgcgacacagaccagggacagtgactacgtacacaggcggggcgtggagagctg

SEQ ID NO: 11473 - DNA, 756 bp, Homo sapiens
  misc_feature (1)...(756): n = A,T,C or G
aatttttataaagtaaaattagttttttaatattttccgaatttatccaatatatgtaaagattgaaagcaaggtagtatgaacggaaaagatattttaattaaggtatttggacctgggattaatattttggctttggtctttattagctgagtgaccttgagaaagttcctcttcttaaaaaagaacaaagattataatttcttcatgagattgctgtaaaaacacatacnaagtatatccagactcaacagtgtatgctcaanaatgcagatccttttccccttacctgcaaatanagtcttacagtaatacagtgggggtaaaggtttaaactggtggattcaagaagggctatagaaagaggtagcatcttaataggggaaggagaggatccaagaaatcagatccattttctacaaaaagaaatgggaagacagataattcaagaagaaaagtttacatgattaaagacccgaagttagaaatagtgatgtgtctcaatagtaagttaggaattggggtggacacaattgttggaagaaggatggtttcagcaaaggcccaagttaggtgacaatttcaagtgtttgtgaagatatatgaacaaaattataaagtagttagggtataagaaatagggaggagggaatgaattaacatttatggagtgtcttgcatgttccaagcactgtactacttgccttataaacctttcttcaataaacgcctacaacaatcaaaaaaaaaaaaaaa

SEQ ID NO: 11474 - DNA, 846 bp, Homo sapiens
tcagggttcttctttgtacagagtgatgaagaaatccatgtgcacagattggacttctcccttgggccgcggagatgttcccgggtgtctcccggacatttccagctcagagtcaacagatgattggagagttatctcatctgctacatatttacttagtcacatctcctaactgctccaatcacccaagagcagaatctaacagtctgccttaatagttcttatcaatgcataaccattcacgaggatgtgcatgcgcttatccatacacttcatcaatccatgccacgagaccgcgattgcaccaccgatccattcttcctaaccatcctttcgtccctcccttccacccccccccgcctccacaacacactcatcaataaagacggcgctctccctaccaactcccaataccacctcactcatgaccccgcacgccccgagatcgcaccagccactctccgccctcagcccgacccccccaacccgccacccaaccctccactctcaccaacagccctccgccctcatgccccacccgacccacacgccctcggccgcacgccgcgatcgccctcccctccccataccacgccacaaaaacacttatccgagccacccaccaccgcgcaggctccacgctcccgcctcctaactagccacctaataaccaccctgacttcaacgctccacccacccctcgatccacccaatcgtgaacgcgtcggcgacgtggcgcacctcactctcgccgacaccgtacccacacatccccacccaagacccccccaaccaccacccttcaacacccgccccaacacccatgccacactccaccgccatact

SEQ ID NO: 11475 - DNA, 848 bp, Homo sapiens
ccggacttgaagaaagtggattcatatgtagggcacgatcctctcccacatactcgtaaattcttcccccgccgaacccagaaattgtcaagcattgaattattattagcttcgttccactacgcaggctgcttaagaagtaattcttatgaatcctagacgaaagaacacttaaatcgaaaactcaggggggacatacatgaactaatggtggcatgaggaaaaacacctaaggaagtgtcgcaatggttagtccaacgtaaggactctcaagagttggagcaactatggctgccgtccaaagcccgaagctgccagcgagccccgttcccagtccccagatatgtcatccctcatagcctgtgctcaggggctctataggcaagggaggtttttcaacccgcaggaataaataatctggtttgattggaatatcagttttcccaacaatttaagtaaagcttacttttatattaagacaaaagaatttattctggattccaaggtaaaattcatattagtttttaagcaaaaatgtgaagccttaaagatattttgtgcttgctacagccaccagacatcctgaggatgcacacccattctcttctgctattaggaggacatcagcggaaaagtttgagaagcgccagcctagggcaactgtatacactgatgtcactaattataacctctgggattgtatacgagtcttgagttacacaatctgataccttctactcaataacacctaaggaagcatacagcaaactatggcccacggccatatctgggcctatgcctatttttgtaaataaagttttaccggaacacaggcaaaaaaaaaaaaa

SEQ ID NO: 11476 - DNA, 1700 bp, Homo sapiens
  misc_feature (1)...(1700): n = A,T,C or G
ctgtgtcgctagcactctctgactattgaagtcgtgtggaggtgtatagtgtaggagagaggaggacgagtcagagagagagtacagagngttgatatagagtatgcacttacgtgaacatcacatagagaaatttgtgacagtgaactagcgaagcacgagcggagtgcgtgactctagagctcatatttgagcagagtgtgtgcctggttgtctcggatgatagtaganagtcacatagagttatgtactctaccccncgtcncgacntaatcgtgcgcacaatgtgacgngctcactggctgagtgatgccagtgtggacaatnatgatgatgtaatgatgtagcgcaactcagcggtgcatgatagtcgcagattacgcggctacatcaagcacgactaggtcngagtgcgtcggagtagtcgcgantgcgcgtgcgcatgtgacgacacaagaagcaggatatgataagcgtagtgaagtacatgcagacacgcgcggtgagcgacgttcacgcgcgactatactttaantacttaccgtatacaacggctccacgctcgctacgatagctacatgtctatctgactactgtcgatgatncagtcggatgcgcagtagcgggtgagtggtgtacgaatgaacgcggancgatgatgatgtatcgacgtgtcgctgcgntcgcgactgcctagagcgcacanacggcgcattgaagatatggcagtcacacactagagtgtcgtgnacgtgtgatacgcggctaacctgactctacagactcatctagtgtcgcantgntgctgtcacttattgattactcgcgtacgtgaatgatacacgagcnaatgcnagtgcncgactctgtgtgttctacggtcnctcgtggtctgagtgttgttctgtctctcgtcgtcggncgcggacgcgctgntcacatcggcgtatgcgngttggaacngacgtgcgatanatagagcgcgacagcgagcgtcgactcacagactcgatagtcaagttacgcgtgttncacacatcgcgcatgcacgagtcgcganagcnacngtcctacacgcagagactactgnattatcacgtgtgtgtggcgncggngngatatgtggnagatgacgcgacgggcgctcgtatggcgcgtgtacgacacgtggtagatgangatagtgtcacgccggtcancacactactcgccgtngtcctacagctcataataaaatacagcgacgtgtagcatacgcacagcgtacaccagcatgtctactcgttacggtcgcagcactgcgcgngtcggtatgatgtggatgatatagacgttaaggtagtggtagtgttacgacgcgncgtgccgantagtgtagtgacgatctgtgagagcgtgcgcctgatgagttctatgcgtcgtgtcgggtagagacgtgcntgtgtacaccgtatatacgngcatcgtgcaagtantcacggcgtgatcgaagcgncgacgntccgctntatcgntctactgtcgccgcgcgctgtctttgtantgtcgtattacgagacgcagactagtctgntagatatattagcagacagcgcgcgtctctcgagtcaatagcgcgaatccgcacatcacctcacgtcgtctcatctcgcgcgttcagtgntcangagtcgactaatcagacagagagagaanagacg

SEQ ID NO: 11477 - DNA, 1124 bp, Homo sapiens
  misc_feature (1)...(1124): n = A,T,C or G
ccgacccatgcttctgctcgaccgcggacgcaaacgcacgccacngccgctcgnaggtcttacgcatgctcagcagnacaagtactggaccgggatgttctaacacccacaccctgaaaaagaaaaagcaagctggtcgcgctgaataaaatctgtaagacgtgtggccggcgtcatncagtgtaacactatatgtactactaacgccacaactagcctacccacgtcctcttgccagcacatacttccaatccgaactcgccgtctcaccatgggtctcgtacaccacacaatactcacaccgcgtcatacagtaactgcttcgagcacaattcggcgactcacctcggcacaccacactcggcgtccactctataactcgtctagggtgggcggcgctttactaaccagaggcacgcaacgaccagcaaataacacactgccccacgctcgttgtctctagctggcgtgtcactgagcgcagcccacatcccgctttccgcgaggcgccactgcccggtcattcccccgacctgccgcccccgaccccttccatccctccccaccacactctcgctctccgctagccaccgacgcctcgccctttcaatgctcaccccaatgcgcaccgcccatcatactctcccaatgtgagcgcagacctccacccctagtccccggacgcgccttctcccacccgcacactggtttctattgtagcgtatcgaccgaccacccgctcgacccgctgcgaccctgacggccgactgacaccgccccatgacacacctcctcactacctcatcacctacgcgctatcgcagcgacatccgcctcgcccgcgtcggcgtcgcccgcggccctcacgattttctcccatcgcacctgccccacgtccgctgcccacggccggtagagatcagacacaccaatacagacagcatcatcgcaccctacacctcacactcgaccgttcgccgtgcagcgcagccgccagcacacggccgaagcacggggccacacagtacccatcacctctcaacactcgcactgtatcccgaccgcacacgcccgcaccaccgccgctcactacgtcttccgacagtgcggccgccccctgctcc

SEQ ID NO: 11478 - DNA, 1327 bp, Homo sapiens
  misc_feature (1)...(1327): n = A,T,C or G
cgtgcgcgcgtgcgagcggcatggcgcggcgtgcggtcgtccgcgcagggactgcttctcgctgagtcgcgccgtgcacgcgagctcacgtgcggcgagaggcgcgcgtgcgagcggctcgcangncngagtgagcgcgtcgcgcgcgtncggctcgagtggacgacgagcattgntgcacggcgcgcggcgtcgacnacgcggcgagacgtcagacgacgatctgcgttcatcggactcgacactgcgccgctcggcgcgagcgcgtcctncagcgcgactcggccatctncgcgtatgcactcgactagtccagcgctgtcgacgncggcgcagcgagccggcgcgcacgactagctggtcggagtgcaagcgagcgcgtacgaggcgcgggtgcgtgatgcggcagtagcaccaacggtctgacgtcgactacactccacgtcacatgtccgatcacctaatatccgtcggccgctgcccctatcactaccatcactacttacatcatataccctcacaccaccacatacactcccactgcctctgcacacccaccacacaacctcaaccctcatactcctctccacctaatacacatctcaactctccggcactctccaagcctcctaccacctccaacctctcgccgcccaaacgagcgcacaaccgagcacatattgtcccctcgagacgtcctcgcgcccttccctttggcacgggtgctgcccggcgggcggcggggcggcgctggcgcccgcggggtcccgtacctatcccgccgcttccttactgtgtggctatctctctgagtgtctcgagcttcacctcgctctcgtgtcgttccgcggctctcgctgcgttccctcctcctcgctgctcctcttcacaccaacacttatatatacatcctantcattaatacacacactcacccagctccacgtcaccccgcgctctagctcccactccgttatcacgtcgttcctcggttgctctctcacactccgagacgcgaagggcagtccggagtaccgactggcgggctctcgcgccggtcgcggacgcacgggcgggccggcagccacacatcaccgtctcagccancggagcgacgtctgtggtagcaggtcttatcaaagttgtagtgctgccggtcccacttccactttccttcctcagagtcgtgtgtttgaaatatnccataagagtacttctctctgttagtgctnaantcccaagctcctntcattcctnttctctccttctatcctcgccatcctccactcacatntccnacttttatctctcttctttctatacactc

SEQ ID NO: 11479 - DNA, 746 bp, Homo sapiens
aatttttggtaaactaggaaggaaccaccaatcgagacaagaaaagtaaatatcggtagtgcatcagggccagtgaaaaaaggttcagtatcttaaagagggtttcaaggttaaatattaagggatatagaaaattatgattcctaatcttcatcagaagtagtgcaattattctgtatagtcttagggctgtccattaaaaatggttgagaccccttaaagaataaatttctaagatcaagtccaagcttagattaaaaggattcgatccattgatagtttaccttattctgtgacttggaaatagtattatgaaactgatatcctcccactactgaagaaactaatctcacagggattctgaatcacaaacgaattttgctaatttatttaaaagcaaatgatttggttttcataatttcatttagaaattcagagacaatgaaatggattaaattctactgacttgaatgcaattgttttataaaagagcagcatctttccaagctatattactcatctaaaatatgtatattcttaattactatatatggaccatgctatttctctcatgcagaatataaaatgtgagaggacacatgaaaccttagttttaaaaacatccggatattttctcccattgatcagtttcttttcagatgtcagaccacaaaaaaaatgtaataaagtcaatataattcatgattaaaactcaaatgttttaaaaaaaaacaaaaaaaaaaaaa

SEQ ID NO: 11480 - DNA, 921 bp, Homo sapiens
taaaaggcgccaattctctaaagggtagactctgtgccgcgttgaagcctggaagacaatacctaccaacatgtcaaagccacagcggagcatttctgctatgatgaagatgaaatatcacgaataacacggtacgggataacatttgattcgctgacaacagcaccgagattgcaaccacaactgaggtagtgaacaaaacactcactccaagactgccagcagaagaaaaatcaccgtagtagcttacgacaacacaatctccatagaagcgtgctatgtattcacagggcctgccgcgctgccatgaatgcgacattcagcgtttgacacgacccccatgattcgagccagcacagtaattcaaacccgcaccacaaattactctggtgacacccctgaacgtatcggcacggcaccatacttacagtccatacagtgatcccccgcgcagtttgatgtcgatacccatcctcccgtataaagcggccctgtagtcgaagcgcttgcacacacccccccggcgagcacagaccaatatttatggcacgtgccgatacagtcccgcgcacacgcgttccctcgaccactaccgtcagcctacccacatccccacccggccagcaaccttagcgcaacgccccgccacgtagtgagcagcacggcggagaagcctactgacggcacggcacctgagcgggcgtatccttccgcctaccaccagcgacttgagcgtaacaccccacgacaagctccccgctctccactgcaacaggactgcgcaccattccgcatagcacagtgcaccagagcaagtaggagacgcgcgatggaatagacgcgagaaagaagccagtgcatggtcatagatgcagatggagtactgccgagttgtcgcgtccaatactaacaagcgacacg

SEQ ID NO: 11481 - DNA, 937 bp, Homo sapiens
ccccccactcatatccattccccccccccccatataatttccaggtcactcacctccatcttcttcaagtacgatcggaaagcaccactggccgcatgtagttaatagcaccctcgactcagacacagaactgcagccagggcccatctgttcccatcactcctactggccactttacaaccagaactaaagtgcttcatgcatctacgtccgctcacgacccactacatcaggatcctgcccaccaccactttccacactcatatttgtaccagtctactacttcaccgccgtaacttagcaccagccttttatccttgccttctagtcccacttgccaccatataatatccgactcgccctgccctcgtatacggcccaattctcaaatccccaccctactctctccccacccctccattatattccccctcccatccgcacgaacaatcatctttccctctccatgtatcacgcacccataccgtgtacgtttagttcgccccgctgacccgacacattaccccactactatactccccccccccctttttactacccctcccgcccaccctcccttctccgatgcactgtcctatttacttatcttccctctccctttacctgcgccatacccccaaccgacgacttccccacccccgcccctcccctccctatttcttactcctcccccacaacataccctaccctactaccatcgtggcccaaccatccacactaccttactttatttacaccaccccaaccaaatctccaattacatcttcttagcggcgaccgcgtaccactccccacttcttgtctcttatcatagtacttttccccacgcatcgcacccacgccatttatagacccgcgatccatctaattcttaacctgttataccgagccagtcgaccccttgtagtactgcccg

SEQ ID NO: 11482 - DNA, 1063 bp, Homo sapiens
  misc_feature (1)...(1063): n = A,T,C or G
gcccccccacacaaatcattaaacacccaccagataatttctctattcgccttacccgcacagtattgtcgcgattctaaaccacacctaaaagataagaagcggtggcgaataaactagtaaactctccgaactcatcatgtccatatattacacgagccacatcactagccctcgtgggagattattcacctgcacgcctctacatgtacggcccccacgatttgaatcgcaataagcaagctcgccaccatcgccattcccgccactctcccttgccccgccacccgacaccagcgtatcccaccctatgccgtcccccccgccttcctcatcatcccacaccgtccgcccacaactaccctcatctgcccacctcccccccaccaccccctctccgcccctccctgacctctaccgccacccgtcgccaccctgcacccctattcgttttcctatccgccctcctccncgctcatcgaaaactcatctccccctccccacacgcacaactcgccccccatctgagcagcgctgagggatactaccccccgcgccgcgcgcctttccatattcacccggccctcacgtcgtacacaacccccgtaaatgcatacccccaccacgtgcgtacgccacctcagttaacgtgccacactctcctgaccaaacccccctcctccccgcgccgaattcagacaccccccctctctcacggatcaccccccgacccctcccccgccccgatgtatgttgaccgtgcccgcccaataatactcctaacccacaactccatccccactcttgcgacgcttggcctccacatcccatatagtcgccgcgcccatngcagcgttagcccaactcgccctccactacttcccctcccaccgcacttttgcctctcgagtccagcagctcgccagtgccacatccgccttctgcccctcatcccgccaatcgcgtcgccgcatcgtatcgtacggctgtacgaagccccaccacaaacgctcgtgcaccatacagcccgaaatcgcgcccttcactatatacactcagcccg

SEQ ID NO: 11483 - DNA, 926 bp, Homo sapiens
  misc_feature (1)...(926): n = A,T,C or G
gggggggctgggagggtcgtggcggcggggagcgggcgcggaggaggaaggggggagaacagcgcgcgacggacgaagaggggggggggggggggaagcatgaaagagggcgggcggatagtgacggagggggcgagccggtgggaggcgcgtgcgggcgcactggcggagaggggggcgggcgaggggagcgggagaacgacgcgagctcgatccggcggcacgcacagcacggcgggagagggaagaagaggcgaagtgggagcgagcgaagagagacgtggggggaggacgcaagccgctcgggccgaaagaaggcagagccaacgcacggaaggcgaagaaccgccacacaaaccataaccgcagcgccagaccacaagcgcacacaacgatagagagcagacacaacagcagccgcgcgggcggacgacgtcacggggtcggcgacgcccacgcgtaacgcagctgcgggggaagccgtacggggtaacggaccgcgggggcggccgggcagcggcgcggggtgccggcgtgaggaaggcagggggacagagcgggacgncgcgaattaggcgcacgcgcgaccacggacaaaaaacaaagaggccgtcctgcgccgccggccgcgcnggccgcgcgctgccccaagagaagaaatattttttcttttttctctcttaaccgcagcgcacgggaagtgatcgcnacgcagcgcgggacgacgaggaacaaccaacaccacgaggcaccgttcccgcagcggaagcgtatgcgagaagacgggtgggtgagccgaaagcgcctctgaaagaagcgagcagagagaagggttgtggagccccangtaagagttgagcaggcctaatgatgactctcggtttgtgtttggagcgcggaggcntcctgatgnggtcnccgcgaag

SEQ ID NO: 11484 - DNA, 1042 bp, Homo sapiens
  misc_feature (1)...(1042): n = A,T,C or G
tttcaggaatgcatgcgttcaggagtgtttaagtcaaatgcatgccaacattccaaatttttaagaagggacaaaaggcgggagaattgtctggagccaataaggaaaagcttgaagcctccattaatgaatcaccctaatcatgcatttcagaaaaatatcacacccatcgcatatcaccaacacgtaataacttgaaatataccaccctgcgcactttatcaaccacatgtccttcactcacgcctactgcccagtcagtccgacctttacctgtccccaccctccccaaaaaactgaatctactttcccataactctacttccctatatcactctccccccccccccacttcctctctctccctcttatttcactttttaccccatccaatatcccatccccccccactgtatatagacccccgctccccaccacccgcttattgatctccgactacaatatatagtaccctcccatgtatcatgctataaaacatcccgcccccctctctctacctccctcattacctacccgcccatctctccacctccccctttatctctttcgcgccaccgcattatctcacaccctatgatattactatccgctcgtccatagtcacaatatactcctgagtaccccgacaccaatagccctcgcccccccggctccgaatacatactcgacacctacacaccacccagccatcagagagatgtatcgtctcgccaccccctccaattatttatatcgcccactcctacacatataactcgcaacactcccatgccacatgcaataaacgtatacgccagaccaccacnttcgtattatacacatctaaccaacgatctcgatctcacccacttccgccttaaccagtcgaatacacccaactcaacgatacatccatcttatatcaacccactacctactcacacgcggcatatacagtctcctgctactcgctcaactcacatcattacagctctctcgcccagctccactattaatgaccactcattctagcgacaccacg

SEQ ID NO: 11485 - DNA, 1106 bp, Homo sapiens
  misc_feature (1)...(1106): n = A,T,C or G
ccccccacccacatattttcttacttctccgcccctacatctatttctaccttcccgccttaccagcaaagttttgacggtattccaaaccccacactacaaagcaaaagtacactggtcggctcacatactattgtatcactactctctaacctcatcatcgcaatatcttattatcatcacgcccatctctcttaccacgcccccgcgataatttcctantcgacatgccctcttaaatagacttgtccgcgctacctcctattattccgtctcccttaactgtcccgcacgaatctttatccgcctgtcatttatttaccctcccgtgcattgccgcttaattgcccccgcgatcctcttacgcgccccgctagttcatacgcttcctccattaccgtgtcccaacccagtctactcacatttacttgccacatcgcccccccccgccccatagctcgtacgtcacttgttctacttttatataccctttccatccctcccctgccctcaattctcttacccactcccctcacccaccgtcatattgctttacctaacctcaaagtttcctctctctccaactgtactatctacaccctgcggccgcccaccccgctacctctctccacactccctctacgcttctatttctcgcccccccttaatcttttcctcacctcacctctcgcctctctcgttgtttctacattgcgacactttctatctctccgtccgttcctttctccactctaccctccttcccccctccccatctcattatcgtctcataccaccgtccctcctccgcccgccgattatctcattagccctccccccccacatttctctcccctctccctcatctcccatgctttcctcccacattcgctcatgtgtggtctcccgtctctcccaactcaattgtccacgtcgatccatnctactatccaacggcgctcgccgttccctaatatccctcatttttcatctcccattcctccaacacctttcacctatctcgacttacctgtgaccttcatccatctagtcacactccttcaatcgtgctctcccatgtctcacccgtcgatgcagccgccccg

SEQ ID NO: 11486 - DNA, 1319 bp, Homo sapiens
  misc_feature (1)...(1319): n = A,T,C or G
ttgctagaggatgacttgactcaccaaaggagtttaagggcaatatgacatgctccaccattaacagaaaagtataacgaagggcacaataaggttggtgggacatctcctcagcagatcnatgctagatataattatacaaagccaaattactagactagccttcggagcaatagttcacactgaactgccattctacatcgttctatcaagtcaccatcataacatttgccatccaccaatcgtatgctagaagacactgctacatctatgtcgtcgacacataatctcgacgcttgcaacagtatgctctctttcttaccatgacaccgctcgtccgcccctcagctaaccgccgttaccaccagaccacacaccaaccgagtacaaagactcaacaacagaccgcgcaaactggagcaanacaccatacagagaacactaccaagataccaccccaccactccactacgtcactatccaccgacatatagtccgcctctatcacaccacacccagnaccatgcgcacctcggcgtctccgccctcgtgttctcaaatcccgcccgtactccctctagccccctctctnctgtcgacctgtccgctctcacgcgcgtatgtatttacgcgctcaccgccnctatgcactacattgcnatgccgaacgtcgacgccccgcagcctaccttacgctatatcaccatatcgccacacacaccgatcatcactccaactctcctcgcccctatcttagatcgaatattccacgccacccataanccacgcaccactgcctcacgttgctntcgagagtcaaccgagtgtccacccgttagccacgcgtctcgatcttcagatgaccgcgtgcccacacgtatccctcactcgccgtcgctctcacacgctatgactgctttactcgcgccacnccacccgcgcacagcgcgcaccagtgtcatatatttagtcccncgctcgccttcagtaaacatgtcacatacatcgcgatctctacctcactcgtctctcaccatctccatcctatctctctctcctgctccctcctatcacacccatgcatcaccacgcacgattactcgctccatccacccgctctccctcacccatccccccactaccatatccagctcatttctgctatcaacatacctcgaacgtcacctcccgccgctccctcgtcgctgatacccgcggcatccacccgccctcctccaccgtcacccctcgtcacatccgctctaacataacgccactgccacaccctctatacgctcatcgtcaatccatgcccaccc

SEQ ID NO: 11487 - DNA, 1124 bp, Homo sapiens
  misc_feature (1)...(1124): n = A,T,C or G
ccntcgggctcctacctgcttgtgtctgctagtcgttgcttctggtctgtgcgtgcgtctggtgtgcgtctgctcgtgtctgtggcgcggagatcctcgcgtctcgccgtcagtgcgctgcgctccgngcgtcgncgtgcgttcgacttctatctccactatctccgcctcgcgctagtgcgtgtacgccactgtcgctgctgtgccgctacgggtacgtctgatatgtcggtgcgcgggtgtgcgttccgtgctcggcgcgcgcgggtgctcgtgtgtttcgtgtccgctatgcgcgactgctcnctcgtcgtctctctagctagtccgcgctcgtcccgcgtcgcgttcgccggctcggccttctgctcgctgagaggcgtccctctctcctgcgttctcgcgctcgtgttctccctctgctcgccctgctggctccgcaacgcccgtgctgcgcatctttccttttctcttgcctacacgcgctccacgtcttcctagccgctctctcactcccctcctgtcccgttccctgctgcccgtcccgtctctcnccccctcgctcgttgcactcgcctctcggcctgcgctcgctctcctcccggtgcgtctccaatcgctcgctgtgcccgcgctcgcactcgtccgctgcgtttcgttggcgggcgatcgtgtctagcgggcgcctctcgccggtctcctcacgtagtacctctttttccaccccctctcctgtgtcgttggcggctctggtcggtctcgctcgctatggtggggtttggtgttctttcgtttgcgtttgtgcttggccgctcctcacttnttactatgtctgagtatctctctttctttttacttctttgttcgcttctcgctcgggagcgtccccgtcatgggcctgtctctcgtctctcctctcgcctctctccgcccctcgccgcccctggcttgtcgcggcggcgcgtcctgcgctgcttgcggttcttctctggcggtccggcgcactcccattcggcggggtgttcacttggcctttagaaagccccgcgcgcgcctgtttttttttatcttcttttggtggggttgctgttngtagaccgttnaattattttgtttctttcaag

SEQ ID NO: 11488 - DNA, 905 bp, Homo sapiens
  misc_feature (1)...(905): n = A,T,C or G
ctcaggaaacgactcactggtgtgtccgcaggtggagagcaattgttagatcttgagctgattgcggcctccacctcccaggatcaagtgattcttctgcgctcaacctcctgagtagctgggattacaagcatgcaccaccatgcccggctaatttttgtatttttaggagagacggtgtttcaccatattgaccaggctgggctcaaactcctgacctcgggtgatccgcctaccttggcctcccaaatagattgcattttctggaattttgtgtnaatggaatgctataatgtatgggatttcagcatctggcttatttcattcagcatgtttatttggagagccatgcatgttggacatgcatccgcagttgattgccattattgagtcgcattccattgcacggatataccacatatattgtttatccattgactgggaggttaacgncttgtggctggccccaatcnctgactgtcagagaatacagacgttatggaactgcgcgccggataagaagactctcggtcctcactcgccctaatggagtgaggaatcgggacggttcctgtccttgagggccatcggtaatgctaacgcactcgctctgctactgcagcccccgacgatcagtcggtccgtatgtggattattcttcgcgcgctatcaggggatcgcccaggtacagggagagtggtgtacttaatatccagatacgtatatagtggcctccaaacgttaacgacacacccggtgatagtccccccgctctagaccaggccgtgccatcactcggctggaggagaagccggggcaaggcgggggcggcgtaatggtgcgctgagcttctcggcgttgaggcttcgagtgtagtgccgaggttggccctgacagggcgcccg

SEQ ID NO: 11489 - DNA, 1233 bp, Homo sapiens
  misc_feature (1)...(1233): n = A,T,C or G
gcgggggaggtgctcggnagcaataatgnaatagtcacaggnagtattatcgcaanatgtggtataaatgcgtcgtagnattcaggagcactgtagataatgtgagagttcgcggttgatggtcataaanataatctatctgaacgnggaaggggcaggtactgagcgactgtgtgagnggaacacacatcaannnnagaggtaggaggcgcggggggaatgatagtgagcaggactgggagaagcaggaggggaaagagtgacacactatccaaatacgttcactacattgnngacgtgagtgagaactgattctacgcgnggcggagtagtggcgcttcatgtagggacaggtacggcgagnancaacatgtgaggnngcctgatgtaggagggggcagtatggtacatcgaggtggaggatgatagagcgataatgngagggaatactaggtaggcaggaggtgtgtggctagtcgtggtgtagtgtgtagtgggcgtagtgggacggaatgggntgtgggagagtaaagaagagttgactggaacggagatagattnggcatcgcatagacagtatgtgtanacattgtggagacgtagacgtgagcgaggnaactcgtaccaatgggtgggaggaaaagaagaagctagggcatggaggaacttaatagtcgcagtatggnacactcggtccttgnaagtcacatagagtgatgacggtcgcaacctgctcatacgtcnnctgtctctancccaggacaacaaactgaaatacacaaaaagaaacacanacaggaatanngacactaaataagaatgtataggcagttaaacgaacaagtgacaaaggngtntggaatatttggtacgagggggtggtgtgggtgagggggtaggctgggtgcttttcctctggttaggcttgtacgtnttgtatattaagggagtaatggatgagaactagcgacagagagtcgccgttgttggcaagtgtggaagtagtgcagtacagaaaaaccaggcctcgcacagnngcctgcgagttctacaggttttgtgcgctcacgaggacgccgggcagttcccgctgngatgtgatccttgtagncctaattnctattacgaggatgggggtgctgccaaatnatagcttngaagattccttaatggattctctcnnacnctcttatactccccctnncnntccccctctnnnnncctcccacccta

SEQ ID NO: 11490 - DNA, 1633 bp, Homo sapiens
  misc_feature (1)...(1633): n = A,T,C or G
canctggacagactcgtanagagagacatactatgatgtcacgctcgccgtggnnnccacgctgcttctgcgcggtgngagacgtgtgctagctggcggaatctcataacatcttgctgtatattgaatctngaatcgtatctcgcgcagatcacaacacgtcgtgngatgctgcatatcttctcactcgggancatatcacggtagagctctcngtctatcatacgctattcgnngntataatacgtgctgatannngngctctgtagggctgcactgtgggatgatnnnagcgcctaagaggcgccgcgccacgctctgcacgtngtggnnactcagattagatcacagaatagcgatgngctagtatggtacatgtgtngagaccgtgtgcgcgtcgaatgtatactccgtgtgngcgtatgtgtattgnaacatcctcacagttnacacctgtccntacgcgctctaannacacttcttctcncgnctctcacacatatctaatcgntncccactgaataatcataaatactatatatcaacacatatcaactaatannnanaccatganaactnnnanaccatggtatatncatcatatcagctcntncntncactctcactacttgcgtctacacttgacngtacatcgtanaatgatatatatatactagctncatacatcatacctgnctcgttctcacgctctatnanaaccacgcatctactcagctatagtatnnnatactacatnantcacaaacgactctatctctctactattnnctcgtctagtntcantctgttcatcgtancganactacagtatcattacttannnaaatccacaacgcctctnncacctcgcatcgctgacgcgcagtaaanccatatggnnaaacaactcatactctatgtngtnacgctctnnnngatctgatcatcgcttagacctactctacaannnacttcatcttctaccgctctcaacaccctcgaccgaannnaatcctctnncactcctccttccactcacattcactcttcctctatcatactnttnntatcttccatcctctncnatctaactcntcctaannnnttnnctnnncatcacccatctnnntaatcattcctccttatctccttcntnnnnantcccttacactcacctacttnncatnttccatcgtactcatnnnccacttcgctcctactctnctcatacactacacattannactccatttaccatnntacttatcactactgataatagcctgtttctgtanncagctcctttnnnacaagactcnacatacaccacactcaccaatcaaaactatccttctnnnnctacattnnntcttcctatcccttcncccttctctctcccttaatcnncccttcttttcaatctattctcttattnnattttatcttttcatattcctncccctccctnnccctcctcattacaccttatanacttncccttctcttttcttnccttattcttnactttcttatactatttnncctttccttcttctntnncatctnccattcctcttcttctcnctctnnnctccctcactctnttcttnnnnnnccttnncaccactatctc

SEQ ID NO: 11491 - DNA, 901 bp, Homo sapiens
  misc_feature (1)...(901): n = A,T,C or G
cgcgcgactggcgggggctgcttgggccggcgcggnnggcgcggggatgggncgcttgtcgcgtggctcggtgcatcgcgtgttgctggaacttgcgtcgtgtggctgtgggcctctctgttgaggccgcggtgctcttccgtgggggngtgcgtggagnnacagtggggggggggggtaagcgcgtcgcgcggcgcgttaggcgggggcgggtgtccgtggtcaacgggggggtaggggcgtgtgtgcgtagccgggcaggcggtctcgtgtcggtatagtatagtcagctttnngccgtatggntgttacaaattagtcggtgctctgtacgcttttgcccatgtctggngnatgtcgtaagacctaatcgagaccttcgagatgttttataccgctctctacctttngctctttatactcgcgtattgccgcgatctcttnaagtttactgccgggaacgtgtctcgctctctttgtgtggactttgtagttcctggtagtatggctcgtgtggaagtggatgtttacaggacggtgccggcgccggaccgttgtgctgcggtcgtgaccttgcaggggcctctgggctcgagggctgtccttactttacctgataggttgcccttgttgcctatgtcacctcgctgttactacttctctttattatatttcatnccctgatctttactttctcctatcgcttattcaccctcgtttatctgtgtgtcactcatcatgtaaacagcattccttggaatagtgaccaggtgcgtggagtaattgcgcttgtataatacatcttcatcatgggttcggagagtctccaaattactcgccaccgcttcttttcttttaggtgtggtttaaatccgtcaatctttctgttaggcaatctagc

SEQ ID NO: 11492 - DNA, 1040 bp, Homo sapiens
  misc_feature (1)...(1040): n = A,T,C or G
cgatcgtgttgtgtcactctgggtgctcttgtnnactttgttgggtttacattcttgtaatattggcttaaaactaatgngttgaacgcgggacacagagaaacgaatggaagnaatgaacatatctaattcacgggggaacgtgtgggaacgctgggcggcgttcagcagttcgcaggcgacgcctgccgtgncccctgggtctaatctaaacccgcgacagtgaactccgacgaatttatgaggggatatgatntgcccaccaaccttagcatttcgnactattactngtctcatttctctccctttctatatctttactattttactatttnnnactaacattaacttctgtctttatcttctnatataaacaaaatatctgcactatttnacacacctttttgctccctctncacctccctcttacatcctctccttttatncactcancaatatctcctcgcttnccctcactatccccatttcttctctccactccanggcctgaattataagtaaaatacaacactcgaaataaatctctcccccacaatagctaaacctctctcgcaactaacccttnaccccatccgttcacccccctatacgnncactcttactttcataccaccaaccgacccaactgganaaccaccgtcanctccacactcactttcactnnccctcacttncctctactccctctctcttcccactccttccctcttttattccttccttnaacattctatctttccttctataattttcctcttcttacactcccaccaacacctcttccgcacccctttaannactaataactatcctataatcttnactaattttaccttttnctcctcactncttctatctattaattntttctcctcccttattttcctttctctcccacttttactttatncctctcttntaacttactcactattccttccctctccaatcctccttacttctcctactnccttccttttcctcttttcttcttcccttttntnncncctncccctctc

SEQ ID NO: 11493 - DNA, 301 bp, Homo sapiens
  misc_feature (1)...(301): n = A,T,C or G
ccccacccccacaacacaacacccccacaacaaaanggtccagtactcctattacaccnaaaggtggnacggcatacccaaccacacctaaaagaaaagaagtggcggcgaatcaatcgtagactctcacaactcatcatgcccatatatcatacaagccagattactacccacccttgcagaatattcactgaatgcctttacatcgtaggcaagcaccatctcaatctgcctcacgaaaggctgtgcagatcgccccctctctgcacaccactacctactaatattcacctccacaccg

SEQ ID NO: 11494 - DNA, 1032 bp, Homo sapiens
  misc_feature (1)...(1032): n = A,T,C or G
gtgctggcgggcgttcgccctctgccgacccgctgnactcctgtcttcgctgccctgctgtgccggccgccggcctccccgcggtctgtgggcgtcggccgccgcctgcgtcttgnctcgtctccttcctgtggtcgggcngttcccggccgcgctcggggggcccgccgccctgnncccggtgggcggccggtggggtgtctggtggggcgtcggctgtcggtggggccgcgcggtgcgtccgcgcaccgcgtcccgcnnngccctccgcttctcctcttttgcgcggcgttcctctcgcctgttgccgtctccgtgcctgacccctgcttnccccctccagcttccccttttgctgactcctgctcgcgcttctcgcggccgtcgcctcgtcgacctcttctcttccctctctngttgctccttggtctttcttccctcttnntctcctcgctcctcctcgtgcggtcgtggcgcccggaaccctcgcctcctctctatnatcctctgtgcgggcccgtcgtggtggccgctagggccgctccgtgcgttgtccgcccgtttnnntcgccgtgccgtacccggtcctgtggctccggttcggggcgctccgtcgcgcgcggcgggggggcccctgcctgtaccgctcgtncccgccgcgcccgtccctgtgttcttgtcgcgtncccgtttgctctctgctttccctcgttggggctccttcccttctctctcgcacctntctctttccccctcctgttcgcctggcgctccgcgtgctttctcctctctctcctcgtccctccctcntcctctccccccttcccgctgctctnnctctccttcgtcctttctcttcgcggccgggctgcccctctgtnccccggctcccggcccgccgccgcccccccctnccctcccggctcccctncctccgcctcaaatccttccgctcccccccgnccccccttccttttnggttttnccccccaaccttcttcctcttggtnccttcaacctcctcctccttcc

SEQ ID NO: 11495 - DNA, 1258 bp, Homo sapiens
  misc_feature (1)...(1258): n = A,T,C or G
cgagctaccacgcggttccaccaccaggcgcgcacaaaaaaaagggtcgctgccctcacgaccncggagagcggcngtgangagaccagaagacaacaattccagttggacatgtaatggaagtgtggaaaatcgatcggataggactcggtggagggggggaagaattaggaacaaatactcctggacacattaatcacaaccggattgctgccaacgtagctattaaacctagacgccccgcgaactacgcacctgcctcgacccatcaaactagcgtagaagtgcactcggggacgcacacggtccgtcggtaccatcgtaaacagatacattttctttaaaacgccgtcggtggatcgcgccatcagcgcctgacagcggcttaccgatctccatcacacccatatcgctcccccgactctcctccacccgcgtacactccactcgcccgcaccaccccgctatgctggtaccatgccctccgctagagcttgtgcccatcgctaataattgaattaacgtgcactcgcagacaatgatgcacaccacacgccccnctcgcgcgaaacagcacactgcacgcgacaaaccccaccgcgcaacgacgatccgtgcaagtacagatccacgcgcagcaccaccgccgactgcacgtcgaanagaccagtgatacacgcactacgccaccacatcccaacggagccactcacgctccgatgtcatgacgacgatcacgcgagccgccgcacacgcggacaccggacaggaccacgctcgcacgctagccctgccatatgccaccacagtcactcctgttttctgtccaccaactagtactgcgctatagacgcagccgcctattctcccgacgcaattccagcgcagacaccggcatgcagaaatccgcacgacgcgctgcgatatggctacccatccgccgtcgcatggcgttgcgcacgcggatagcctcgcccgctctcggtcggatgtagaggcgacgctctctagcgcacgacgtaaatcggcggcgtcagaggcacgcatgcaaacgnacacaccgaggaaagaccagcnacgccacatcgcgcatcccacccagcaaactcgcgcctcctctgcactcccacacctgcctacaatcctccgcaacagccaaaaccgacgcacacacaccgcacacctcagcatagtcgacgaggacgccacacgtacgcaccgcataccagcacatcgcattcactccacgacgccatcg

SEQ ID NO: 11496 - DNA, 401 bp, Homo sapiens
  misc_feature (1)...(401): n = A,T,C or G
ttttaggcaccacaataaagcaagtctttgagtacactaaaatttctacccgcagtgctgctcttaagcatcactcctttacctgagtaaatggtcgatatactcattctatactcacacacggagctgcgtaggccgaacgtggtgatctttctaactagcgtatacatttagaaattcgaaataatacgctataatcgtctgcccatctaatcagatatctcactatcacaggctcattctcgcgcctcctagcatccacatccgcccaatccttngtgtcttgcacaacacgcaattcgttccttctctccaccatcctcacacgcgtacaccatcaacatacaactataccactctcctacgccttatctccatccacacctcgcccccgctccttc

SEQ ID NO: 11497 - DNA, 877 bp, Homo sapiens
  misc_feature (1)...(877): n = A,T,C or G
gtcagataacgaactaaggccctcagaanaaaagcgaagtggtcaaggtcattcagctaaaggacaagagggacatttgacaatacccagacacatttttgatcatcacaaccagagggacccctggagagaaatggggacaaggggcttcctctggctagaagctagcggccaaggatgccgttaaccagccaagaacagccctgcacaacaaagaatgatctaggagcaataattgccgcagagcggagtctgagaaacccagctctgcaggatacacacggcttcgcaattcctgagttataaatgcgcccactccacatttccacactagcacgacttctgcttgccacctcccccaatacctccaccaccactcgtttcccctacctcatacttccatattatatcccacatatccctaccgcccgcctacccaactatatctccacgaccacttacctaccttccattcacctgaatatatacacctacatccttgagccccggacccgctatactaacgctacaacaccaccctacgtcgaatgcactttaacagtactcctcctctgcctcctcccaccccgcatcaatcgccccacccccccacatcccccccatttgatacgaatcaccacactacgctcaacttcgcccagcgaacgctttggtcgcccacctcccccaaaacgccacctaatcacacccccgcacaacaacagacgacacctcattcatattatatacgctacatttccccgcccccccccgcgccctcctccacatatcatacccccactcaaccccacaattctatacaatcatatagagtacctcccacgccctcatatccccacaaatttatctccccccg

SEQ ID NO: 11498 - DNA, 972 bp, Homo sapiens
  misc_feature (1)...(972): n = A,T,C or G
gtttcagggtacattatctgatggctttagtcactggctgggatcttagagaggaccaaggtttcatgtggtcaagtcttgttgcagctatctggcgctagaccaagatgaagtgatgtttgcacaatgggcagagccacgagaaaaatagaagagctgatgacagcatgtaagagagtcgaaattctgactttagaactgcatgcaggaatcctacatgaatccaggatgatttatcccacatggcctagctatgtctaaagacctcttattttgatcttcaacgcattctactaacgtgaacaatacttggaagaacctactgaatataaagaagcgcgtcttgtactggattcagcgaaggtagaatcctgaaactttcctcgtatggggtggtatttgcattaaatcctggggtccattgtacatgtcttatttctgacccctgctatgtgctcccccacctgagcatgccctccgcccacttcgacacatttatatctccttggcgctattccctccgtcttcattctcgccctatgcaacagaaaaaggatccatggttctccttttcctcccttgtaggtcctctcccccctcttctctttccgcgcgctactctccctccaccccttttatttccccctgtcgccccggcccctccgttgcctctcccgcgctcccccactctcccagcgccgtccccccgtcgtcatcctctcccaccctcctattgccgcgccgcctctgcttctccgccctgcctcctttgcctcgttttanttgtgtccgcgcccacacgcgttctgcccgctccgcttcttcctgcgcgccccacaccgcgccctccagccgctcgtccaacgcgttcgctcccccccttcttgtgtnatgaagcttcagtgattattattacagcgctcggctgctccacacctgctatccgactcntgattcttctttcatcgcctg

SEQ ID NO: 11499 - DNA, 1062 bp, Homo sapiens
  misc_feature (1)...(1062): n = A,T,C or G
cgcgccactcaagcgtccgacacgctctgagtccgaactctgcgttctgcaccaccagcctccgccatcgtcagtcgcttcatctagttanaggcgcgctcgactcggcgtcagtcactgcanaccagntcnatttactccgagctcgcgtcccgtgctcacgcgacagcgcgcgctggtcgcaacaccggcacatacagtgacacgatccaccatcacatacggcccgccactacttcatgtacccgctccccgccgacgtatctaacacagtctcctagcacgcttcggtcatggacgccggcccgctgtactttgagctgtcatcctccgcccggcgatccctctcctgtcgctcgacaatcatgcatcatcatatgtttnatacctgcccgggcctctgcctagcattatacgattcacaattattatgctaagccgtgggcctgtgtggtatcactcgcctcgtagtctcaccgacgcccacatctgtgtcacacccctccgcgtctcatgattgctcgctactacccacgagcaggccactcgccaatccttgcgagcgcgctgccagcggtctcgcgtcgcagggccgaatcagaacctctgcgctctcttcactgtgccgcctgtccgctagcgcttctcgtcctcctcgtaacacctccaaccttttggtgactacactcccttccccgcttagcaccacatcctnccgcgccgccagctgttctcgggccgctgcgaccgtagtcagcagggcttctgctgctctattcttctcagatacttatggcatgcaatatcttccttcccccacgcgcgcgttttatataaaatcctcatctcccaatcattaatgccaaacccccattacttcctcaccccaccgacgcatgccaacaggcaactcagcgagcccctcttcgataccctccctcgataaaatacagcctccgccccttcattttctcatcccttttaacgcttatagataattagtgcgccgccattcccccacgtaaaagcatgatgtttgaaatatcacaaaaaaaaaaaaaa

SEQ ID NO: 11500 - DNA, 1262 bp, Homo sapiens
  misc_feature (1)...(1262): n = A,T,C or G
agggggagggcangcacccgtcncacacggngaaggaaaactcaaacgaacggaacggcacgggatggaaggagagagatggaaagacaacgagagtgctatagggtgcgcacgaagaaatccacaaatatatctagaagagattaagaaggagggaccannaatctcctcacttaaatattaaatacgctaagcgggatgagcaacgctcgacttatcctgagccaccatacgcgcttcgccatgttatgagtttcatccgttccgccaccacccacatcagaagggtgatagttgtagagtcgagtacatccacataataaccaacgatgagcgtaaataatcacacactaacacatcaatgctttagacaagaggataagatttcggtaggttaagtagtctactttttaatggcgaactcctaggaacacgccaaccacccggtaccttttttcatcaccacacccccccgaatctccaagagcttaaaagccatcactagtcccaaggctgacatagacacgagttatcacacaaataatgcacccaaaaatcacaagccacaaaaaaagaatagagcgcagataattaaatatataatctaaatcgactatctctcccgaaccgagtgccgattacattccagtgtcacatgatagtttttctcgttctcgcttcttcactacgctcctcatatccctcgagtactatctcattctctcagacgacggatcgcaaggtggtcatgnttagatcgtgcgtagaatagtctataagattgtcaagaaatcaccaatcaaaaagcagagtatcgtagatcgagctctagcagatgagatatagaaggatctnttgatattcatgtggactgcagcggcatgtcgaactgacttcctacgaccgcctcaagagacgagcatcaggacgagccgaaccggtcacaagagatcagacgccgtgatcactcccattcatacatacagataagagacgacatatgataggttcacccaccatgtgagtcgccgctagagctcgtcgagagacgacgagaagaacnacacaggcgagagagcgcgtgtataatgtcagcangatccacgctatactcatccnctcntacatntgaatactnccacagatagagtgacgttcaacagatagtagagantacagaggataagcgagagagtcgcgcagaggaggtgcatncncnactgatgcagcagacncgtcacgttccgcaccaggagcattcc

SEQ ID NO: 11501 - DNA, 758 bp, Homo sapiens
aagaaaacattcttcagaaaaatgggacccctttcttcaagtaaggggatggggaaagtgccatcttcctcccagtaaggcaaaaagatgataaaattgacctaaggtgttcacaatgggaatgaaaagaaacaaccccattcagaagatatttttgggtccataggactttgtgacctcttgagcacagtggcgaagaaaagacagatttaaggtttctagtctacattcatatatggatagtgatgactacaacccatgggaaacatggagaaagtttcattaaaaaaggacaggtccaaaggcagtctacaaacttcaggggagtacatgctctggtcaataaatgtgtagttattcaaaatgcaaggttcgataaacataagaaaatgtgccaaattcattagtcatcagggaaatgcaaagtaaaagcccaatgccatactagaatggctaaattttaaaggaccaatgataccaagtattgatgaagacgtggaggaactcattcaacgcaggtgggagtgtaaattgatacactactttggaaaaatgtttggtagtatttatcaaggctaaaataagttagcaattcctctcctggctatatgaatagtctccaaaaatatatgtatgaaaatgttcagttattcccaaaaactggtaacaagctaaataatgttttaaatgtagaatgaataaattgcagtgtgctcataaaaaaaaaaaaaaaaaaaaaaaaaaaaaaaaaaaaaaaa

SEQ ID NO: 11502 - DNA, 856 bp, Homo sapiens
  misc_feature (1)...(856): n = A,T,C or G
cgaattttaacaacgctcccatgagtcgcgcccgcccgccggccgagttgntattaactatgtacagcaccctgcaaggctctctttatacatcgaatatagaacctgcttctggatctaccatctgaaacagggatcagcccatgccagaaaagtgttgctaaatcattcgaactgaaaatgtcaattcatcgtatccacttcactgtgctgacataagtaacattgagtcaggctcatcaactcaattttactaacttttatgtgatccttgtgtaaacattgtaaacatcatatgtaatcagaatacctctggactgtttgaggcaatagataccttatccaatggagcgttatatttttacttatttgtatttgtattataaattgacacagtataaacgtatatatgtatatatgagtataaaatgatgatgagatgaatgctaattaacatattcttaatgacaaatgcttaatactttttggggtgagaacatgtggattatactcaatgattgggaaatacgccttacataattaatcgggatattcaccatgctgtgccatatatgccaaagggaaccaaaaggcttatccctctgtataaggcccgtgccgggcgtttttcataaggctccccccccttgacatacatcccagaggacaaacttcaaggaactgggcccaatggcctaaggggtggaatatagcgggcgttccttttgggagggtaattaacgacccccggtaccaaccccgtggttacggatattgtccgcctttccctttcaacacccagagggttgttataggtatcccgaagatacgaattccgccgaaaaacttgttccaa

SEQ ID NO: 11503 - DNA, 738 bp, Homo sapiens
agagtgatgtgcagacggtcgtaataacttcgacgtaagagagtataaggttttaaattcaggttaaaaggatatgcaaagaattatataaaacaacataagtgacaaatgagataattacacaagggtaattaacattaatgattactatggttcataacctagaaaatatttatataacgaaataggagtaaatttttatatgtaataaaaaaccaactgtttcaatatttagtacacagtagaagtgattttccatggcatactctaaaggccaatttgccatagccaagattagggggtacaccaaataattagttgaaatacctttgaaaaaaataaaacgttcagggttggggacgctttcacttattctatagggttttctgaaaagttatcaggattcgtacatgtttttttgcttctcaaattgcagccccattagcaaaatgaactgtgtcctcgatacgaaactcacatagattctgtttaagacgaattaattttcctttaatagaaatcatattagttgttgtctcatccagtcgttggggaatactgacagagagcaggagagaatgttttggggcaatggaactattctgtgtctagactggagtggagggtaaacaagtatatacatttgtcaaaactcatcagactgtacactttaaatgaatacattttattgtatgtaagttatacattaaaaactccgaaagaaaaaaaaaaaaaaaa

SEQ ID NO: 11504 - DNA, 1514 bp, Homo sapiens
  misc_feature (1)...(1514): n = A,T,C or G
ttgggggtgggggaggttnttttnctctcggtttggtttgtgtaacgaccaatactgtatctccttccaatatcttactcatcactttaccgtgcaccggctggccaccgagacatacataattgtagtcgagcacgcgtccttcagccactccacttatattgtctgcattactccaatattatttacatccatacaaagaacaacaaaacacaaggagcaaaggacaatgagaaaccgcgatcgagccgataagattaggtgnacatgtacaacaaagataaaaattataaaataaactcataacgatttttgaactaatatcttcagaacggaaggatggtaatacaccaccnctcagtgtggtagcgtgcgggggtagcgacgcgagtcactttctttcccccgttcctcactacccaccatcacaaccctgccacactgtcaaggcgcggtgcgggccgctgtgcgcgtgcgcgcgtcgccgtcgcgtgcggcacgcgagccgggcccgcggagtagttcggttgtgcatgtgtgcgtgcgttgtgctttcaatttacacataatagaaccacgatatacacacccatcccccgttcgaagagtagttgcccgagggaaccggtgtggacacggttacggtctgcgttcgactggtgtcccggcgccatcatcgttcttccccgccctactttcgccctggtgaattcgcggatatcgtgtcgtcacttgattcagatttcgttctctgcactccgataactgtaactaattgttgacgcgattgtacgaccgtgtcgtcggaatgtttgtcgtgtgttggacagtaggtaagtcagtgtatcgcgtcgtctggttgcgagagtacgacagcccacgcgcccattcagcctatctccggtcgacgcaatagcgttatatcgatcaccacctaccagcacgccacgcgacgatgtatgccaggaccgaggcgcggccggaacttagatttgatgtgctggaagcactttacgacggcaacgaccgaacagtggagantaaggagcggatcattgcgattacgtgcagatccgcaggggacgtcgaangcgcgcatatgcaggtcctggtccgcacggcgacgccggacgcgcgagcagaggcaccgaactgttctctggtaccggttcgtgtatgtaaccgtcccntagtatgcgcccgtcgtctcggtcggactagggtggtccgctagtgcgacaaaatgcgaatacgacgcgagtcgcggaacaaccgattgtntaaagcacagtntataagaagtgggagtcacatatgtatgatantgtactcgatgaaggtgtgcaatttacggtanantatttactgttcatcgcagcgcgcacggcacgtatatcgaancaccgcaggccggatgccttagaagtatcgctgcgagatcgacgcagcttcgaatatgcttgattcaccgacaatacataatacatcgtncgacacatgtcgcataacgagtg

SEQ ID NO: 11505 - DNA, 587 bp, Homo sapiens
ctcaggggaggactggactggctggttgattgtcgaagatttaagtgacatcagggggtcttacatccaatgtattgtttggaaatggatatgcaagagaacaaaaacctcagaccatgtatcctgctcagagcattttcttacagctcctgacaatagcttcttatagcagacagaatttcattcattgagttacaacggcatgcctctaggagaaggatttggaaaagaagatctcatgatatagatgccaacaacttgcttagatatcctctcacagaaaattgaaaagctatgttctcttactttaagttaaaatatgaatattttatcatattactataagttgaaatatctctagataatataacttggattttttgtaaatgttgacatttacaaaatgttgaaacacaacttcttaaaatgcatgttataaaatttatataatagttatttgacacccaaaattgtataataattataaatatatttgtatatatatatcaccctatcatacttttctataatgaaaatatttttatcaattaaaataattggtcaaatttcctgtaaaaaaaaaaaaa

SEQ ID NO: 11506 - DNA, 779 bp, Homo sapiens
ctggttaagtgattctcctgtctcagcctcccgagtagctggggactacagatgcgcaccaccatgcccggctaatttttgtatttttcggcggagacagggttttaccgtgttgcccagctggtctcaaacttctgacctcaagtgatttgcctgccttggcctcccagaatgctggcattacaggtgtgagccaccgctccaggactatattatcaatctctatccggtaattgcttccctgggaagagagaaagccaactaaaatcagatcgaacgaaaaggaaagaagattggatatgaaaacctacagagcccaacattccaggacatcggagaagccactgaagacaatttagaaggaatgatagaaaggcaaccactttttctcttcaaatcaaaccaaggctttggcatactagaaatgaaaagcagagttcctcctttgtaagtgcagcttgaccagatcagagattcgactttcctgggggactttgtttctagagatcagtgtctctcttctgctgtattagagatatttttctcctcctattgagttccggttgaaatgtgaacctctgacacattagttccctgtagcatggtcaagacaaggttattagatttccataagacattcttaaattcagcagcttttttcaacctatcccccagtcaacagtaataacatgatgggtgatatacactagggccacagaagtaaaaagcaactataggtacacagattaaaatagattggtaaacctatgttacatgct

SEQ ID NO: 11507 - DNA, 1713 bp, Homo sapiens
  misc_feature (1)...(1713): n = A,T,C or G
cggtncatgcgtgcggcgctctgttgtcgcgttgctgtcgcgctcgctccgcgtgtcttctcgccacgctgcactcctgcgtcgtcttcttagctgctgcctcctctcgctattctgtcgccttccacgcatcgtntctctctctngtgtctctcgctcttcttatccccgctggcgtgtgtgctctacgcgtcgcctgcgcatacggagtatactgatgcgtgtcggatcctattcgcgccctactgtgcggcgtggcaccttctcccacatctgttgcgcgcggttgttgntatanactgngcgtctcgctccgactatatagcctgttttcnctccgngcgtaccgcttcgcgtctctcgcatcgtgtgtggtcctctctgtgtgganctccgttcattgctacgcgcgcgccgactactcgttctgtgatatgctggctctatgcggtgtcagacgagcgcgtgcgcgtcgctagtgctacatctcgcacatgacgactcggtaccgcgcgcgtctgtctgctgtctcgcttgctgcgcncgcgttcatcgactnggcgtctgcgtnacatcgtagcgcacgcgcgcgacacagntctcgagggtgcgcggcnactacacttccgatctgtgaatacgtttgtgtanctctccngtgtcngctgcgtcgctattgcgtcggattatgtgtctgcggcgacgcgcatcgcncattgatcctgtcgctcggggcgatcgntatgtacatcctgtgtctcgtgtccggctggcgctgcttcctgnctttgtgattagcttgcgntcgctcgcgctctcggtgggtgtggtgtgtcgtgtggattctgtgtgcgtctcggcgcgcggctcgtgatgtgttctctgttattctcgctaactggcgcgctgcggcgcgggtgttgcttatgcatgatcgcgcgtcgtgggtccggcggagcatcgtcgttctatgcgtctttcgtgtgtgtcgttgcgcgtccctgctacgcgcgtacttctgactattcgtgntgtgctgtgtctcgcctgtgtcttgtgctgtgcgtcgtgttgcngtctgtcgtgcgatcctgcttctctctcgctgtagntacgtgtccttgtgtcggcggtggcgtgtgcgtcgtngcattnttgcgctgtcggtcgctctcgttgtcgtcctctccctgtgttgcttctctgatgtcgcgtcgtatatgtcgctcgtgctcgcaccacaggcgatctagtaatctcgctctcaccctcatcgtgcgtcanattctctggcatctcntgcctctgtcntcgtcgtgcgcgcgggcgntctacgagtgctctgttctgacgtggcgcacgttcttcctcgcatctactggtgctcgcctgcgcggtacgttctcttctcctcgtcgcgctcgcncgcgtgcctgtcgttccgcgtactctctcgcgaatcagcttgcgctctcgcgctcctcccttctgctcttcccatctctcctgcgcgccgcttcttcgtctgggtgtgctgtgctcgcccgcgtgtcgtacagacgcgtcttgtatttcgtntggtgtgtttcctctctctgtgtncacgctctttcgtcacgtaccctcgtcgctctctctcctctctgcctatgtcatcttgcggccggactgctctgtctgctcgcattcttctctgtctactactcctcgctt

SEQ ID NO: 11508 - DNA, 280 bp, Homo sapiens
acaaacccgtagtgctgatgaaccaatgacaacatttgttgtctgtaatgaatgtggaaatcgatggaaggtatggactctcttggattcatattatatactcacttaaaatagaaagatttcttctggtcttttcataggtctgcctagatatctaaatatatacagatatgctcacactatacagtactcttgtactccctgactactcgtaatggaatataccatcttgttaccctactagaaataaagagtattaacttgaaaaaaaaaaaaaaaa

SEQ ID NO: 11509 - DNA, 922 bp, Homo sapiens
  misc_feature (1)...(922): n = A,T,C or G
tctttgggagaccttggagatcntctttaagcgtctttacgaaaatggagagacctcacaagagatgctaatggtcagctgaccctgctccctgctccatcacaggttgtagagtattaattcccaagttacccagacatttagttctgaatgtgcaaaaatggtttaggttcaaatgttttcaactactgacaagctcaagaattcagaggaggtagtactaagggaaatgcctcctatatataatatcaaaacttaagcatagcactataacacctaattcttgatgatgtcaaatacttaaagctctccctttttattttctggtgaaaggtgcgaagcttacaaacctctactaacttcttgggcttctgaataaggaaagactacctaatgactgcactagtcgactgtcaacaatttcgcaattattaaaatggttcattcgccttcataccaccacccattttctctatgcaatcccctatgtccctcccccttcccccccccgctgcgtctccatcacccacccctctctccttcctatttcccagcccctcctcctcccccaccacgtccacccccaccgccccatacccctcactacatatatcattgcacaccctctcatgactccgtcactccctcctttccctctctcctcactccttcacatcctactatcctaattatgcaatgctccctgcagcttccttttatcttcagtatccccccctcccactgcgctagactatccccctactactcgctcctaacctccatttctccaatacaaacacacaagcactctttgtcttatcatctctattatgtcatcttccttccttataacacataccacaactataccactacttctcaacactctcattactgagtctcaccttaaagacactaatct

SEQ ID NO: 11510 - DNA, 734 bp, Homo sapiens
catgagccgcaaaagtcatagtcagtagacaattaaagtcaattttgtaatgattattcccactgtaataacgtaaagatacctcaatatttagattaaaaagaagatattattttaataacgatttactaacatatagtcggatgacctagtatggacaatacaacgagctaaatttttgcattcacataattaaccctgtgaagaagtcctcataaaacaaaaaatgatgattagtacccaagcctaactaggtcccatgtcctttacctgcgcacacaatgtaagagatatgtgtcatctttaatctcactctctgcagccctatacaagccttcaaagccttttagccccagctaatatttttgccgaaatatattaaaacatatgaagcagaatgctccgactaaagaaatatccaatttttgaccctcagaaattcgtgtaagataaataatttttttccgttttaatatgctaaggactaggtatgtgtgtaactccaaattagacaagctaattcaggatgcaatatagactcacaaacaggtctactcttttgcttctttatgcctgggcagagtgaatagagtgatggatccccattattattgcacacagggtacactggtatgggtttagaatgtcatgtgctttttcatccttctgttcccacatttatcgagtagtatgtatattaaacactcttcagtaacccaaaaaaaaaaaaaaaa

SEQ ID NO: 11511 - DNA, 674 bp, Homo sapiens
ctcaggttacagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacatttaaactcataattattttggtgaccattttgttaaaatctacttttcaaaaaaaaaaaaa

SEQ ID NO: 11512 - DNA, 1803 bp, Homo sapiens
  misc_feature (1)...(1803): n = A,T,C or G
actctcntatatcnccactcgactgcacacgctgtcgacgtggacacgttccgtacgacctcgtcattcaactagtaagnagtcgcacatagtctaatgttcagcacgctncctcggtgcacggcnatgatncnacatcgttccgtctcagcatctntacgtatngctcgtanacgnctctgcagtctcacntgtcgcgtgcgtgcgtcggtagcactcngctgctaccgcatgaagcgcgcgcacacacactcgactgtgtntcgttgtcntcgatngntataacgtacggtnnncctgcccacgctcgcgcctctatcgctcaacgcacgtcgcgtagcatntgcgnagtactantcngnctctcngtncaacgcgcgacgtngacgcactctngtcgtccgagcgtcgncgacgtgcagcngagccgcgncccgcgngcagacgcgtgcatgacacgatctctaggatctagtgagtagagtatgagctgggangcnttcgcgatctacgagctgagctgatctgctgtcgcgtgtatacgntncntctctgcntncgcgcacgcgctactggtgagcaaacgagcgtancctccactcactcacaacnanacacncntcagnacatcngnttgtacactacncgatatactgatganagcacatggcacccgtgatnatcacatgcgactaccgcagcgtctcgttcgacgctgantcggacgtcgtcctctagcgcatcgtctccgtgnntagcgtggcgctgcgcgcactatccgactatctgactggcgcgcgcgnctctantacccagtcgagcgnatgacacgangtgtaccacatgctgtgcgcgtacacacatgagcttctganttgntcgcatgtagtgttgtaacgtgtatagagtgtgatagcngacgagtntgtgttgatgtngcgtgttgtaggaatgcgcgtgtgtctcgcgtngtgtagacatgtcggctcgtcgatcgagacgnccgcgcgcctgtcgntgcgcgtgcgcacgccgcctcgccacgcccgtcattctctnctcgcgcgtntctcccaccacctnctcctacctncctcncctnganctcgctcgcgtgcggttgtntntatgtctgcgctgctgtctcgcgtccgctctcacgacgtctnngtcgtgctcgcgcgcggcgcggtgggacaccgcgcgcgcccatctctcgcgagagtacgctggcgagcaacaccgacnangcnagcgccctcctacgagcgcggtgaaggcgtaagcgcgcgcgctcaccctaggcagcgcgcgactacgatgcaatgcgcggcagcgcacgcaaccgctcctctgcatgctaccnacgggctcaccactcgccgctgcgaccaggcgtgcactcggcgatgatgggcaggatngtncggtcggcagcatgttaagatggtgagtagacatatatcgggtcgtgctgttgtcctcgcgcgcggcctcctgcgcacggcngcgatcggcgatcgcgcgcgtcctgcgcacagcgcgacntcttctgctcatttcgctgtcgctggtcgcttctccgnttgtgtctcccacgacaaacatttatattatctgcacatctctcgttctatctccatcactttatacaacagtatnaataaacactatagtgttgccgctacngtnttgncacaaagatatgttgtgtgttgngtagtntgtntctcccgcttctntaaggattannntnnnnnntnctnttccntcctctctaccnnnnnnnnncnnnnnncctnc

SEQ ID NO: 11513 - DNA, 904 bp, Homo sapiens
gtctgacacaacgtcccgcaccgcccccttcagtcctcgctactgttggtattactacaccaccttgtctgtaagaccccagtggtgccagctggtctgaaggataccactgactgagctgatctgagggtccccaccacaagtggactcactaaagaatgcagtttctatatcgcgattatatcaccctccttgccctgaccaatcaacaaccccaatttttcaatccttcaccctcaatgatccccttaaaaatcccagccaagagggggggggaggagatgggtttgaggataccctcccatatccttgccttgggcccctgaaaaaatataaactctgcctctcgcctcccaaaaaaccaaaaaatagcctccttgggccccatcggtagaacccccccccccctcacctttaccgaaggcgtattcatcactcctccctcaccccacgctgccctccccgcccccccctccccccacccacccgaccttgcccccaacggcctatcccttgcctccgctcactatactgtccacgcctttacgtccccttccacccccctcccttgtaattagcccactaccccccaccccgcggcgcagtccgcccccagtatcatggcgtagtgtcctaagccgcgagcggcgatcgccgcccgcatgtcgtcggtgccgacgtctataggctcagaatatcgatcggcgaacgcagtggatccgtcgcccacacacgtatggcgctcagcgatgaccctgtgtttaaacttaatcgaccccttggtgggtgtgctcgcttgtcacgagcgctggcgctccccttcaccgccacccctcatgacgtctaccagccgccgccctcgccgcccgggcattacgcacgtcgcgtatgacctacagacacg

SEQ ID NO: 11514 - DNA, 859 bp, Homo sapiens
gcctctacaatctcacaccccccgcgccttcagggacaccttctgtgatttgtcctatggccagccagcttggggaggaattgatgtcttctatcaggaaccatgagagtgagcgtagaagcggaacctgccccctcagtgaatccttgcggctccaagtgacagcttgactgcaacatcatctgagaccctaagaaggagccaccttgcttggccagtcctggatccctgaaccctcggaaactgtgagataataaatgattatcgtgttaaaacaccacctgccaccacaacattccattctcctcctcaactctattaccgctatggacacacatctgttctcttctcaaacctctcccaccctctactcgatcggttttccggtcccccacgcggaccctctctccctcctctccctttaccccgggctaatttaagaagctccttgatacataacggcccactcaattaccgtgtcaacaccctcacactctcccctcaccgcgctatacccactgatgggcatcgcgacagcccgcccccagccaaaccctctataccgcccttacatagccacaacacacgcaacggcgccttttgaaataccatcaccaccccgactgcctccccccagcacggacccaagccctcatctccaactactcaatatacgactctcaggccgcttagtcaccctcaccccacccccccacctccacccttcctaatcctcgcccccactatcgactacgcggctcaccccagccggtacaagcgcccaatatgaacaccctattaacttttacccatctctcaccgcaggcaccagatctactcacggcctcatcggtcaccg

SEQ ID NO: 11515 - DNA, 1668 bp, Homo sapiens
  misc_feature (1)...(1668): n = A,T,C or G
gcgcgcgcgctggcnggtcgtgntgcncgctccgtctctgagtcatcnctcgacgcgcgctcngnacgctctcgtcgctcttgtcattgtgccgcgtcatgtctntctgtgtcgcattctcgtcgtngngcccgtttctgctcgacgtcatcgncgagcgtgcacntcggtcgcgctgncgtcgtgggtcttgcgnnatcgctcgcgtacgtcgtctcggntacgtcgtctgngtnggtntncgtcgtgctgcgtctcgctcggcntgtngcngctcgctctcttcgctcnnnnngngcgtgctcgtgatcactcctcgctctcntatnntgcnctgcncgcngcgcgcgctcgctcgagctntcgcgtcgtgcgngcgtctgacagcgtctcgcgctcgctcgcgtgctnncctccgcgctgcntntntgtntgnccgtcgctgcncctctcnctcgtcgtgcnctccgcgctngcggtctcgacgcgcgagcgcgcgtcgtngcnttgtcntctactcnctctctcncancgttcgntcctctctcgcntattcnttacntctcatacttgacgctcgttgtctctcgccgtntcgtcangtctcgatctctcctntgcntncatctctctcnctatcgtnngcnctctgctnctctctctatgtcctgctgtctctcnttctgtcncctgctcctctntntctcgcgctngcccttatcatactctctgtcgtggtgctcgctntgtnacacctcctctctctctcctgctctctcctccgctcgtccttactcctcgccgctcntgctccctgtcttcgctctctcctctactctngtctcctgctantcgcctctcnctctctctccctgttgtgnaattcgcgcgcgacgcgcccagtccttcgttcttnttgcgtctccgcttcgctcgtgngtgncctcttggtccgcggcgttnaccgtgctactgctctcctagcctactcgtatgctccggtgcgctcgcgttctctcctcgcggctctctcctcgtncgccttctcctctcttctgncctgcgtccttctttgctctctntctcttgngtctcgcgctctctctctgcgttgcgnccaccgctcgccccctcccgtaccctgnctgcgtccctcgtcgtactgtcgcgcgnnctccgtctccgttcnttccctcccttcatttttgattcttnnnttcttttttttncctcctctccgcttctcctgttgngtttgccttgctcctttctttctctttgttctcctcgcttantcccctgtcggcctccgccccctctctcctggtgcggctctgcttcctgantcttgcctcgctgtatcttgtctttgtgttgggtctctctgcgngcctcgtctgtcctgtactctggggtcctctctctgctgttcttgtanctccttggtgcctcctctctcttnctttcttccgtaaaagtaatntctgtgtgctctcgtnctttgtattgcgcgtattgagcgtggtgtgggctttattanactctctctccagatttttatnantctttggtgatttatcttctaaactctgttttcctttctcttttttnttnntctccttctcttttttnttnnntcttttcttttnttnntnctttacctctctc

SEQ ID NO: 11516 - DNA, 173 bp, Homo sapiens
  misc_feature (1)...(173): n = A,T,C or G
cctcagnagtgatcccagtgcaggnacctctganaagcccaccaggagaagaagaatccctaaagtgagagaaacctgggcccttgagtgactgcatggagaagagccccatcattgactcatgttagactgtgactgaaaaataaacctcttttgtgttaaaaaaaaaaaaa

SEQ ID NO: 11517 - DNA, 344 bp, Homo sapiens
cccgtatcgaataactcatatttgccgcagattaagaccttatcctagcccgtaagacttagggagctgacacacacttccaagacacggagacatcaaagggatctgagagtccacagcggcagcaaaacaggtgctgcttcacatgccctttgctaagagtcctggagtttgaagtctccacggccgatctaaaagcaagttcctgaggaaggagccggaaagttctctgagaccagtagtggaagctagtctctaataaaacaaaatgttaccacgcttctggaaagattccacacatcaaacattgaataaaaaggacaattcgattaaaaaaaaaaaaa

SEQ ID NO: 11518 - DNA, 416 bp, Homo sapiens
  misc_feature (1)...(416): n = A,T,C or G
atcactcctcactaacataccagacgaagaaacaacaaaaaaccctgnggggaactctcaggattcttttttgtactatctagcatcatccgcgcacagcaagacatcaaaaggtgctcacctctgagtctttggcctgctgattacgaatgactatcaaattgtacagggttctgtcgtcgtctgcctctgtgtgggacacatcatggggcatactccataaattcttctcatcatccctcaccagagttgctccaaatgaggaatatgttttgttatcactagttgtataaaaaaaggaaagattggggttctataatatacataaaatgttatatgtcatatgcatgcaacatacaatatcaactaaaacttatactatgtaatatataaatatattgccaaaaaaaaaaaaa

SEQ ID NO: 11519 - DNA, 821 bp, Homo sapiens
  misc_feature (1)...(821): n = A,T,C or G
gctgttacngacctttcactctagctanctgaaaaaggaaccaactcctgctaaatcttgagaattgacacattgaagccttatcttcagactctgaaaaaggctggaagcttatcatgggcctggatcttgtgctattcaaatgttttcaccgatgcctacaactgtatttggcacatagaagcttgagtgcaatggcgcggtctcggctcactgcaacctctgccttctgggttcaagcgattctcctgcctcagcctcccaagtagctgggattacaggtgcccaccaccacacacagctaatttttgtattttctgtagagatggggtttcaccatgttggccaggctggtctcgaacttgtgatctgcccgcctcggcctcccaaagtggtgggattacagacttgagccactgcacctgacatcaagatgtcttgatgcacatttttatgtactgctaataaaatagtgggattatttataaggggtctttgtttaatgccaaatctttatgttaatcaggtaaatttaatgttttaaatgctaaaaaatgtcagacttcagcactatatgattcattcacgtaacccaaaacacttggacccaaagctattgaaaaataatatttgcaatttactgctactcatttaaactcagtgcctggaagataggaaaataaaatgcctaggggacaggttattcttggatatctctagattcaagtagttatggcacaaccaaataaacttatcctggaaatggatttttcttatacctttattatggattatatatatttgaaattatagtcgtaaag

SEQ ID NO: 11520 - DNA, 109 bp, Homo sapiens
cctcaggttactcaatgtgaagatgtcaacaagggtgaagactttaatgatgatccacttccacttaaaaaataataaatatattttctcctccttaaaaaaaaaaaaa

SEQ ID NO: 11521 - DNA, 743 bp, Homo sapiens
ttttttttttatataacatgattttcaaaaaaggcaagatggaaatcaaaaaaacaagggacagaaggaacatagaatccgacaaccaaaattaaatttaataagtctaatatttaaaatcattttaaatgaaaatagcgtaacacagaaattaacagcaaatgagcaaaaaatatataaaatgtgattgtatactaaaaagagacctttgactatttgaaggtaagaattattagaatcaaaaagtaataattataaattaatgtgaggaataataaaataaatatatttcatatattaagaggaccaataaaataaaatgatacaataaaagaaataataaagtaattgaataatcaattcaagaggaacaaatgtataatctcaagcatgtatgcaactagtaacatagctgcaatataagttaagaaaatcccacacaatgaaagggagaaatacacccactgtcaataatctagaaggtttttaacacctttatcctgccttacagaacaaacaaacaaccgaaacaaatcagtaagatacaacaataactaaccatatttggatactgagttaaattgtgtatataaaatactacaccaaaagaccacagagtgcatatttactaaaggaattacaaaatacagatagaagtcttaacaacagactagatcaagaagagggaaaaattttcagagctcaaagactttgaaccaacccagtcaaaaaaaaaaaaaaaa

SEQ ID NO: 11522 - DNA, 768 bp, Homo sapiens
catgttgctcctagaatttctaatacgtcaatcgagggcgtatcaccactcgtgtgttgttcggccctacatcacgcccccatgcgggcccctcttccatgaccccctactcgggccacccaacgtagtcacgcatgctttgtctgcaccgcctcagtttaataccacccacacgcgccccgtccgcactcgggatagccccccccgaaccccgcgctccacacacgctccccctctttatgggcacccaaacagtatgtctcgacgaaccggtcacatggccggccctaccacacgctcccacccggggtctcagtagtacaagacagcagctcggctccacatcccccacctgtgttgtttttgcgccttcttttagacatcgaaggactgcgctgtgtcccgaccgcgcggcatgttacagggcatcaggccgcgcatgccaatcgtggcaacgccccgaatgtcattcaccgcccctctagccgagggccattcgaaagcccaatggctaggacgccgcacccacaccttgggcgaaacccaccgtttcctgttcgataactggacattttcacggtggttcttgggcactcttcccccgccggcaggataaaaaccgcgttgttgcccagaagtttttgtctctccgataatctatttggttttgcactaatgaaggtacttttccttaaaaaatggcttttcctattaagggcccagggggttcctcttttttcccccttccccttttcaattccccgtttt

SEQ ID NO: 11523 - DNA, 1165 bp, Homo sapiens
  misc_feature (1)...(1165): n = A,T,C or G
aatccgggtgggcgtggatagctggagagctgtagggcagggagggcgcgaccgctgtcgggtggtgtagatctgagtgctggctggcgccggacacggtgctcggctagtgcatcactaggataaggatcgcgcgtcgccgctgggcggctcgcgtctctggggaggcgactaggcgggaccggcccacctgacacaacctgactccgactgcgtaatacacactggagcaaagaatcggagagtgtgatagattcgactatttggtatagggtctggggttggtggcntcgccgcgggtaccnaccagcacatgactcacaaagcaacctctaaaggaacgttggagggtgggtcggttgtcccctccgccttgtctccctgtacagcatctagtggcggcgacgcgcgcgctgacatgactaatcatgcagataatacacgacgacggacgccggcggaacgacgccgagttggtcgacgcagagaggcgcgagacgcngggacacgactagacatatgcgggagcctcgcgataggttaatgaattacatcgataatgattaagtcanggagtgttaggcgatgcgtgagtcgcggatcattatacgctgacgtgcgctggtcaatgatagacgcgaacctaggatcggcggtgagcgccgaccaaccggtacgcgcctgcaggtcgggagcggcggctgatcgcgcggcccacgcctcgctggtagagcgccatgcggggtgatggatatgtgccgtcgtcgggggggagtatgattatatataatgtaagtcagcgaattaattttataatttctctcatctnttatttattactatatantcttgctccttacttctctcttgctctcccgtcacgtcacaaaataccgaacgacggcggcgcggggcaccgcccttgatggccatactttgcgtgatcaacaatcattcttctcctcctccccgccgattgccgtaaccttgctccacgaagagctcgcgcagcacgccccgccccccctcacgacacacctcgtggggcccgcgccggcgctcggccaaccacgccgtgtgacgcgccgggaggaacgacccacacttcccccccacctcaccaaatacccacccactacacaattaataccccaattaccancaa

SEQ ID NO: 11524 - DNA, 604 bp, Homo sapiens
  misc_feature (1)...(604): n = A,T,C or G
ggcgctgacaccgggttgccattcatttaataaaaaaaaagctggcgtgacnagccactgtttagggngaaacctcagcatccctgtggagaggccccatggcacagaaatggctctcacccaaaccaacaaagaaccaaggcctcaagccagcagccatgggaatgggaatgtgccatcttggaagccaatcctgcagccccagtcaagccttcagatgacagtagccccagccaatatcttcactggatcttacttttatactatgtgccagcatgaccctactaaacaactctcaaatttctgaccctcagaaattgtgtgagataataattgttttttgttttaatatgctaagctttaggtttgtttgttactccaaattagacaactaattcagaatgcaatatatacactcagccaggtcaactcctctgcttcttgatgcctggggagagtggagagagtgatggatccccattattattgcacccacggtacactggtctgggtttagaaggacttgcgcttataaaccctctgttaccacatttctcagtagtatgtatattaaactctctccagtaacccaaaaaaaaaaaaa

SEQ ID NO: 11525 - DNA, 855 bp, Homo sapiens
  misc_feature (1)...(855): n = A,T,C or G
ggtggggcgcggaagacagtggacgtgtgagaaaactgggaggcgtgcctgacgccggagaggtaggccaccgcgcgaaaaaaaggggcgagaatatatagtaacgaacaggttactatataaaattatatggagagctaccagcaggctgtggtggcggctactcagcgcgaaccctcagttccagagactctatactctgagacgctctaagaggaaacacaagcaagagacggggcggaatggacgcacggaggacgagctcgatggcagtatngcgatcttaatatgactaagggagatagacagaccacaatggnatcttgtaataactattagataaatataacagaacaggaagaacacaaggtcgcaactaacaagacgacgacccacaacggggacaatgccgacaccnaacacgctcaacaccacactaggtcggttagcggaaanaacaaggcccgcgagagcccggcaggagcgcgacatttgcgtggggcggagccagcgcgtagggcaggggccaacaggaaatatctaganacgaggggcttgctcatctcaggggatttgctatgcgcccaagaaactcccagagacacataaatactcagaaatttnacatatataattcaacaacaatgaacgtgagaatacagcaaacagacaaactatacatttagtatcattaactagaaaataattgccggtgctcatgattccgtcctcgtccccgactcaggtcgatgtaactaaaanaattggatacattcactattaaaaatnaccttccttactcattacacattcaataggttttcncaataaacttnnntcttcgtctnatctaac

SEQ ID NO: 11526 - DNA, 737 bp, Homo sapiens
tcaatacaagaaagcaaggaaatgcacttataggaatgcttttatttgaagaagaaaaagaaattggagaaaaagaatagaaagaggaagaataacataaaatcttgtgacaaggcttgcaaacttctacttctatgagcacacaggaagaagctatgtcatactcaaaacatttggaagtttctacgaaaggacacacacaggcctggatcacatccattgtctacaccttgaaccaatgtcattgttggagaagtggcactttttcacctctgtgacagagatgagatattatgaatggacggctgatgtgtgattgcaggtaactggtgagtcaaaaataatatcgcaggttcttcatgccctagtaacagaaaatacctgactagggcatatgtcaaacagctgagtttgaaatttcctctgaaaatatgcgtggctaatttctacgttttaatcaggaataacatttatatacagattggtaattgcaattaaataacatataacaccattagcattatgaatgcctaggctagctttattatggagccatggactccaacttgatgcttttttaaatatgcacatgcactgtttttttaaagaaaccgttattatttcatacaaagcgtctatgggcattaccaactatgcaaccctgcggatcaggtttgcccagggaactaagactcctggagatttccgaaaaggaaccttgggtgaaaaggttctcg

SEQ ID NO: 11527 - DNA, 738 bp, Homo sapiens
aatacacacaataatcaaaataaatgccataggctagattcattaatgagccaaattactccaacctgaatttttattatattaatgcacaatgcaatgtttcttcaataagaaaacgtttaattaattagaaacaaatgtcatctataggtcattaccaggcaaatgcgatccactgatgattcagttttgtccaaggcaacttaatactcctctgggatttccaggaaaatgtcacctttgagtcaaaaagttcttctgcagctgaaggatttcagaaaagaaaaataaatctccaaatcctaaactttttcatatggagtaactcttgtcttaaccaagtgataaatacaacttttttcagacacacatatgtgaagatctcctgttagtcatataaagtaattaggtgtttgaattaaagcatgttcttgaacaagaaaatatttgtcttttccaatatttaaaatgtcattcttcttcaggagaagaaatattatcaaattcatatttggaccaccacatcatcatggcaaaataatccttcacaaattttggttatgttcacccacaaatgtattaaacataaagtaatttatcacttgataacttggggaatacctgttaaatatgtattattttaagtcaaaaacttattttaagtaacaaaatagtagtacttcaagtgaatgattgaaagtggaataaaaattgttgtaacaaaaaaaaaaaaaaaaa

SEQ ID NO: 11528 - DNA, 1127 bp, Homo sapiens
  misc_feature (1)...(1127): n = A,T,C or G
gccggccgtgtgaccgtcccttagccacacgagccccgtgatgcactaaccccttctggagcacaaacggcaggcgattctattactcgggcgaaccgccaccgtgcagcgggtcggaactcccgcactcgagctccaccaaactaccagggacgggtggaacctggatcaactcatccttagataaaccggcagcgatgcatggacctagcaacagcggtgcccgtggcagctacgcgtctctactgtctcgctaggaatgagcgcctacctctgggccactggacctacagcgcgtccctcaagactacgcccactactcgtgtcctctcgttgctcggcccacgacccgcgtgcgcggccaacgggaacagctacacatctgcatcacctaggcgagggagcggggccgcgccggacacgcncgcccccatcccctcaccgtgccttacgacgtgatctaaacacgacccgacacatgagcagcgaagggtgcggtccatcactggagcacacgaaagactcaagcaggccgcgcgccccgcgccccacccctcccccccactccctcgacgaactccccccacgcccactggcgcgtggggccgacgggctcgcgggagcgcggcacgccacacacgccaacgcacgaccctaccgtaccccaacccccagcgatcgcccgctgaccgggcagcggacgctggcgctcgtgacgcctcgcgcgtcgtcggacgcacgcaacgcaagaacagcgagacgaactcacgcagcggcgcgtgaagtaacgcccactgcactcctgccccgccccntggtctcgcttagcagacggcgcgctcagaccgcgcacncactaccaccgcggccgccgccacgcgccgccaacacgccgtgataagcacaccaccaacgacgcgtacgcgtaccaccactacaacgcgaccaagtccgactgtatctatgtcgaacttgacccacagtctaccatagtatctcccctccctcttacacaccacactaatcaccgattccaaggcgtaacacatccgatccaaccccgttcaccgacctcgctaccccacctctctcacgtctgctccgccacgtcccaccacnacgcacgc

SEQ ID NO: 11529 - DNA, 863 bp, Homo sapiens
  misc_feature (1)...(863): n = A,T,C or G
gggagtnaagtagtcgaacgattacagaggaaaagaanaaaaactcacatacgtgnactcttggcccgcatcccaccgagcaaccccaactcctcatgggagttcatggaagccacggccacccagcattgccacagcaagaaggctcaggaggtgcataactgatctgcagatgaacccagcacctactcaggaatggctggagccgcagcagctaccttatgaccgtgggatacaagccaagagaatcacagagatgccatcttccacagagcagagctgctaagtgaacacttctaattccctccagacttaacatatgagaattcggctgttacccaaccagccaaatgtatgcttgcccggctaacttaaagtgctgaggtaaggacgaagggctgctaaacgtattgtatggaaaaaaaacagtcaactaaagatgcggctacaaacaagaacatgggcctcttggccccaacggtgaacccctggggccgctgccctttagggggggggaatgcaggatcctcggtcacttactctttgggcggggaatttcggatagcgccggcgaggttcctcgtcctcgaaggcggtctatcgggaggcacaggatccacggactacccaggcgataaactttggatcaacaggccacgcggtgcccggacccgcacaccgccccacagatcgcggtcaccactacgccccccccccctgccgcttcgtgaaggttaagtatagcttaagtgcgtgtaaaccacaaggaagatgtagatcacggcgggtgccctaaaagaacccccatgccnttgggaccgcccctcagtgaagccacagcgcacgcactaccagtggggagg

SEQ ID NO: 11530 - DNA, 790 bp, Homo sapiens
tttcctgtctcttataaccaaagaagtcctgatgaatatcgacagatacagactttgtctatcatttgtgtttgggatgctgacctgtctggcaattgaatgactacagatactgaagaaaggtcataaaaccactgacagtttaggatcccataagggaccctggataagttggccttagatggcctttcagattctgagaatctgttccggactcatctgtgagtgctgcttctcctctttctaaaacatcttgtcccctttgcaaagctcccttccctttggggcatctcacattctaccctgggccggagctcctgatgccacctactgtctcccccattagatcatgaccattttgagtaaatgtgatggtaagttgtgcttctcagctcaattaggggtaacaaaaggatgggagggaggaaagaacagaaaggatcaaaagctcaacgacaaggatcgcacaaattttctttttatggggattaaagcgctaattggggaggcttgatccaggttaatgacctcctggttcatattccctcctggaggggttagttccttcagaggccaggtggctctatttcttaaacgcagggctgtgggggatacgggtcttcagcagaacgccagatttctgaggcggccggggaagggcggaacggaagagcttcgtggcctcggcgcccccagcggggtacttcctgctcttccgctttggaggggatcggggtccccgtcctgatgacccaggcgcccaagggaggggtgggaggggtggaggccc

SEQ ID NO: 11531 - DNA, 1386 bp, Homo sapiens
  misc_feature (1)...(1386): n = A,T,C or G
gcttgcgtgcgcgtctcagtcgtgcggcgctcgcgcgttcgcgcctcgcgacgggtcgccgtctcgtgtgtgcacgggtctantgtggttgtgtcgttntcgttggcgcttgcgagtgtctgctccagcgtcgtgctgtgaggctctggtgggttgtctcgtgggtgtgtgtcgctgctcggtgcggcgtgcggtcgtgtgcctcgcttacgtccgcctgccgtgttcgcattcgcgtcttcgctacgcgcttgtcttctgtgttcgtcggctcgctttgttctcgtgttgtcttctctcgggcgttcgcngtcgcctcgcttgccatcgtntctgcgtgtccgtcgcgctcgcgtntgttgtgcgcgctctattgctcttcgcnctgtgcgtccgtcttctgtagtgcgtgtgtgntgggcggctctgttcgcgctctgccgctcttctccgcgtgggtcgtgtcctggcggttggcgctgcgcttcgtgcgctagggtggttcgttgtgcgggttagcgtcgcgcggcgtctcgcttgcttgcgtgcgcgggcgcgcgtcgtgcgcgtctctctcagtctngctcgcgctcgcgcggtcgcgtttgcggcaggctcgcgcgtttcgtcgtcgtgtcgggtctctatgcgcgcgtgcgccgttcgtgcgcggcgtgtgtgtctctctacgtgtcgtcgtggcgcgcggtcgcgctcgtctggcgcgcgcggcgagctcttgctcgcttcgcgcgcggtcgtctctgcgcttgtgttntcgngcgcgcgttgtctgcgctccgccgcgtcgccgctcgcgtctntcgtgtcgtctttgtctgcggcttgtcgtgtggtgcgcgcgtcggcgctgtctgtcgcgctcctgtgtgcggcggcgcgctgcggtcgtctgcgctgggggctcttgcttcctgcggcctgcgtgctcggtcgtccttgcttgtcgcgcgttcgctctctccgtccgtgttctgggggggcgtttggccccgccgcggtccttcctcgcgcccgccggggtcttttggggtgtgtggggtgcggtgtggttttggtttcgtctgcgtcctgtcttgtgttttcgtccgccccgcggcgtctgcgctccccgtcccccgccgtctgccggccttcgccctcggcggtccgtgggcggcgctccgcttctccggcgcgtgcttccgctctgtcgttttgttgggggtgtcgtctcgcgcgctggaacgtttcctgtcgttcctctcgcgctcctggtgggtgggttccttcccccccgcagcttctcgtccttgtttccccgcgacagcccgttgttcgtcgggtggctgtgtgctctcgttgtgccctctgttcctgtgctcg

SEQ ID NO: 11532 - DNA, 805 bp, Homo sapiens
gtagagcatactccttctacttacataaaaagtcaactgtaaaacagcctcaggcaggtctttcaggagatattccagaaggggttgtggtcatacaaaatgatagctccatgagtatcattttccctgaagaccagtgggacaagatgaggagatggaagacagtgatatggatgatcctgaacctgagactgtataggcctaggctaatgcatgtgtttgtgtcttcgtttttaactgggggcttaaaaaggaagaaaaataaaaataaaacatttgaaaatacaaaaatcatatagaaataaggacataagaatattttcgaacagctgtacaatgtatgtgtattttaagctaaatgttattgcaaaagagccaaaagtttttttaaaaagtttataaaaacttacaataagctaagattaatttattaatgaagaaataatctttgtatataagtttagtgtagcctaggtgtacagtgtttataaatctacagtaatgtcccagaccttcacattcactcatcactcactcactgactcactcagagcaacttccactcctgcaagctccatccattggaagtgccttataaatgtgtaccactttttatcttttatacttgattttactgtaccctttctatggttggttagatacacaaataccactgggtaacaattgcctacaggattcagtacccacatatgggggacggatgtgtagcctaggaacaatagggctatacccatatacctaagggtgtttgggttggggtaacctacttcccattgcttgcagc

SEQ ID NO: 11533 - DNA, 903 bp, Homo sapiens
  misc_feature (1)...(903): n = A,T,C or G
tatatcattntcaatacatacaagnngngnggcccacccnnnnnnnnnnnnncctcgcccgcgcacccncccccctaaaattgatatgatggctaccaaactgcgaaggagggtngttggcttctctnccaancccannnaannanagggcggcctacgcataagacacaattaatnnannttnncntnnncctccctnaaccatcannnatttaccnncccctccanaantgtgttaaaaataanatcttctgctgtccctgaanaaaanaaaannaaaaaaatggccctcctttcccctcaaccggtgaaaactcttccggccccttccctttantgagggggggattcataatccctcctccctaactcaataaactccaacattccncttncnccaacccntatctcctcactcaaaagcctttaatccccnttttcccacaaaacccnnacatacccccaaaaaaaacctttctacccaaactccaccaaaaccccaatacccctaaaaacccccctttcttcctttttttccttaccctcccccccccttaccaacttcccaaaattcacctctcattcaaaattccccaacccccaccaaactttaaaaatcccatccctttccccctcaaaaccttcttntccccctcttctttccccaccttccctttaccaaatcccttccccccttttccctttaaaaaacccttccctttttataacctccctttaaattctcacttccctttcatcccctccctccaactcttatctttttcccccacccccccttacaccactccctttcttctttcactctacttttatntctaaaccccccccccaaacacccctttttctccccctctcccntccttatatatcatttaacattcc

SEQ ID NO: 11534 - DNA, 1197 bp, Homo sapiens
  misc_feature (1)...(1197): n = A,T,C or G
cggtgtcgcgcgagttccatcttgtaatcgtctcgttgacatcctcgttgcgagtccactaactcgtgctagaatgggacggttcgtgnctacgtgacttcgagccgtgtgtgatggatatttagccatggagtcgtcctcgacactaccgtatccattgactgtggtgctcatcgacggggnaggtaggggaggacttggcgtaaattctatgtgcacanacgtaactcgttctcatgacctcctttctctcgtcttgctgagccgtgatgagcgaaaggcgtcgttgtgtgacctcgtaatttgtggngttcacttgatancatcacatcaatacatatacgctataattatattctccataccaccgtctccaatatatacatctctcgtgaatacatacgcctttacgaacataatatgnnatcatattgatctatctgtctttttcttcatactttatccttaacttaaagctatctacggtatattangccactctcgtatattactctgtatgtactatcgatctacgnatacgacaacacagacttctgacttttatattcttctgactccacacaggctttacacagatctgctcatatattcactattgtctcttgtagaacacantacgtancctatgtcttctcgctcncgggctgngctctcttgctgttgggcgtcgcngacatctcttactngccctcatttggnctgtctatggccgtntatatcaaataannaatgcaactttctaggctgtctcattgtgtactcattgatcngcatatttcatatctttctatctcantattannaccacatacttccattatcatccttcactttctcacttcctatctattatcacctctcccttactacttctctttcttacacctcttacctactaacaacatacataaaatcaacaactacaacactaccgtaaaactcaacaaatcctataaacacaacaaataaaaactcttctnnattattnnntctcttctctcactttcctccttatntatctttcctctctacctctncctatatcttctattttatcattntnccttatttcatatnnntnactttnnantnnatttntnattctctacttnncctacnttntnnnncttntttcttttnnnnntnnnnnnnttnntnnnnnnnnnnnntttttct

SEQ ID NO: 11535 - DNA, 1395 bp, Homo sapiens
  misc_feature (1)...(1395): n = A,T,C or G
tataaaataataaaataccattctacacaaaccagacaaaaagaaaaaataaaagaacaccttcaaaataacacatctntaaggttctaaactctttgcnctacaccgccatcacccgcactgcctaggaagcccctgggcgcactatgaccccatacaaaaaanaaactctancactggggtgctgggcgtgcctctcaatctaaacacttaaccnntcctataaccccctacaanaacacanncccttngacattactcttacctcctngcccaaacgcttcgctcaccaaagaaagaccgctttgaccctacctaaaacctctccctgacacgacatccctcaacattttacaccctctggccaacctttccacttgcccaaaaaaggaagccaactcacctggggcgctgggcgctcataangccccaaaccccacttnnctaccccaataactaccaaaccacaaaacactctttttcgtacntgcttcacccccccactcacacaatcaccatttacaacaatatcgcacacctctgttcaaaacacctctttaaanagaaaaaaataaaataacaatcacctgtcctcattcacacttacaataaaataacaaaaacacaaaacatatcagcactctcctctttcgcccctcccatactatggatcacatatcctttctaccgacaccacctcttcttccccttttaaaataagaaccgcgtcaacacttcactcaacttctcttcaccttacaatctacacctccacacttcacacctctcaanctaccaatcacatctcatacaactatcagacacgcatatacttacanacctccactctccacaaacgccaccatataactatcactctctatacatcacacctcacatatcacgagagtcgatcatacacccacaaatacacataacactctttcttactcgcacaacatactcccctcatacaatagtccgcacccgcatacacctcatgagacgcanatcaaccctccactaatccnacagataatatcactatcttacgtataacaacaacactactacactatctccactcaccaccccactcctacactatagaacgtacagactcatcttgatcaagtcctactcaccatacgcctccaactatcttctctcaacacatgacnacctcttctatacaaacaatatctacctncatctcatatgcacacccctcatgactatctctaattctttcactactcacttaatttaactacntccatacacacctacatcctcaatgtgacacaactataatgcacacacctacaacatatcntcntctacctcatcatcacacacacacataacacacacttactcacacacncatctaca

SEQ ID NO: 11536 - DNA, 132 bp, Homo sapiens
  misc_feature (1)...(132): n = A,T,C or G
tcttctttttcttcctncnctcnnncntngttcccccccccaacnncnccncnccgtttcccccccaacctccccanngnntttttttttncccccacnnncccnnanncccntnnnnnccccttccaacta

SEQ ID NO: 11537 - DNA, 769 bp, Homo sapiens
atgaaggtactcgtaacctgagcatacccagatgaaccaagcatgcagcgatgagcaggcataggtgcttggaccaagaaacaggggccaaattaagatgcagaaggcaaatggcaggatcaaggattcaatcagatcaagccctggtgtcaccccattgtagaagccagtcaaattagacctcccggcatcacctcattgcaagatccaatcaggtgggtgcctcattatcctctgactataaaatctgccctgaaccccagctccagatttgagtcaggcactgatctctttgctcaacagccttgccacaaacttttctctgtacaaaaacctagcgcttcagtgtttggctttcaattgtgtactggcaaatggacccagttcagttcagtgacagtaagagtttttagtttcaggttttacatttaggtccgggatcccttttgagttaatttttgtgtataatatcaggggttctttcatatcccattgtaacaccaccattttttgaaatgagtatctttcctccttgaattggctctggtatttagtcaagatcagggtgaccccatatgggtagttctatttctggactctatattccggactgctgatctattgggctatttttatgccaggactcatcggaccttagatactataagactaaaagttatgagggagggggagcccttcactttccccttgctaaagtacttaaggtgggtgcatttcattaaacttgtaaaactagcttgtcaattct

SEQ ID NO: 11538 - DNA, 745 bp, Homo sapiens
aatttacttcatatagctaattacgtacattttggttaaaaccttcgcatcgtttcgtatcacattatctagctgcgtttcctactcttgattccttcacatagtgtacctgctcctagcgtacttacttcctcgctcgcctctactctacctagactgttccaacccatagtcatcccgttcggtcgcccacgcccgcacccgttcgccacttcgacaatcccacacccgttcaggctgcgatcttcgcatccagatggtcaccacacgcttttttgctctcgcattctcctgtatcgtatcatgccaacattcctctggattgtcctagccaatttcagcgtatttcagcagtatcgcagaaaccagctactgcccccataaaacataatctttccgtaactgattaggtcttctttaaggccaatcaccttacattttcaagctcccttacgcacaggtctcgcgcttcatcgtccatatatcatccctccctatttcatcgatgatcaggggtttagtcctgttatccaataatattcatttacactcaaaaatccgcattatctgttgcttagtaaataataatgccatcttaattgtatattgatcttgtatcctgcacacctgctaactcacttattcattctagtcccttttttgtagagtccataccattgtccacatacatgatctatgaataaaaactaataaactacttctgttctaaaaaaaaaaaaaaaaa

SEQ ID NO: 11539 - DNA, 129 bp, Homo sapiens
  misc_feature (1)...(129): n = A,T,C or G
ctgaaagaaagaacttggctcctcttgaccccgtggtctgctgaattaaccaaccctagantgggaggcagctttggactttctgctatgtaagagattaaaattcctttgtgcttaaaaaaaaaaaaa

SEQ ID NO: 11540 - DNA, 828 bp, Homo sapiens
  misc_feature (1)...(828): n = A,T,C or G
catagactaagcgtctgtactaggaaacacaacgctacagacaaatatggacttcctctcctcttaccttcgggcctggggggctctacaaaacacacattcaaacaaaggctataaatgcatcctgctgtttacacatttccaaagcacgaccgtggaatccattccccctcactggaataagatctccatggtgactctgacttcaaggagcttgtccattttctgaggggggcctacgcaaggatattttctttacaaaagagccctcttcaaacgaaacaggggatatctctgcacccctggatgcatttaaagccccagaattcattgtgtctttatcaggggttttccattgcatcagagacgccaaaatcttttgctggcatccatgtaaatattattttttaagcaagatgatatcccatcacagaaggaaaaacgaggtcgttctttccatctattgggaaaaaataaaaaaaaaagtgcgcctctttggccttaaggggtgaagctctgggggctcctttccctttagttgaggggttattgcatgaacgctgggtnacttgactcccttcacctggggcgtgtcggttgtggcgagcaggttcggggtcattcaagggcggagttccggttttcccccgcattctgtgggtcacccccggaaaaaacctcggagacccaaaggccctgtaaaaggcccggaaccggaaaaggggcgcgtttctggggtttctcatctagtccccgccccctgaccacgattggcataatggcggcctcaaggcggggggtggggaaccctcccgggtttattaaatc

SEQ ID NO: 11541 - DNA, 1283 bp, Homo sapiens
  misc_feature (1)...(1283): n = A,T,C or G
tnagagacggtgtgattatgactagtgcccaacaatatctcanganagaggatggtcgacaggagcagacagtgtctctgtgattgagagattgctggcgcgactantgcataacagcgatcgcgcagacgtggctagtacggagctactccaagtgtacgcgcacaagctctgggacgatgtcaccagatagagcggtacggcaggtgactttctctcgaagcgcatgcgccgacatgtcatccacagctctgatcggagatatatgcaacacgcacacggtgtcagaagacaatatatacatatacgacagtacgaatgcttgtacgatgagtggcgacgaaccagaggcagttcgggtacaggtatatagtgcgagctctcgtcctgaccgagattgagatacgctatgattggtagcgcttcgacgtagacgcgcatatctacgacaagtcagagtaggagcagcggttgtactgcggtgggaggatggttgcagtacgaacgatagagggagtgtgtgcttgctattcacaagagcactatcaccgacccaggcagacaatgaggcgcggattacgccggatagagcgctagtagatatgagcgtgaggtccagttgatatactcaccagcataagacatatgggcgcgcgatagccactatatatgacaccgacccataacgtgccagggacgctttagacggatgggtcgttatgtgcgcgcgagcggcgcttagagagctactaatgagtcgttacgttcttattgttacgccgacgttccaatcgagcctgacggtggtcctgtactcatacagcggcacatatccgtacggaatgtcgcggcgcggattaactcgatgagcgaaacgcctcctatgtacagcgcgctttttcgccctactacgcacttacgcgcgatgcacgcgttccatcgagcgtgatgtagcgtaaagatcgtagcgagcgacgacgagttagcgtctcgttgtcgtcggcggtattgcctcggaataagactatggcgtccttatgcgtctcattcccgctctactgaataccgcgctttgttcagaatcgatgatattagctactccgcgtcgcaacactgcgtatatatgcggcgataggtagcatgtgagaggtgcacctcctcatcaccgcggtcctatgcgtcatggccgacgtcgatacaatcatgcgctatatacctgccgaaatcataacttgagctctctgctgcaccggaatttactttcgcaaagcgctcgcacaaca

SEQ ID NO: 11542 - DNA, 977 bp, Homo sapiens
  misc_feature (1)...(977): n = A,T,C or G
cccccggcccgaaaccccctcgcccgcggggaatccgcgttgggcgatgcccgcgtgtatcctgaccccgcgaacagcggggntcgctcgggtcgtctatgcatcgtgtgtgacttagtaacagtccgcggtctcggctccgtgatnactgggcgcgggggggacaagatgcggatggcattgagcgttcgccgtcgggcgtcgctgtctggcctctgggcccccggccgctcccgtcggcgtctgcttcctctattccactgccactcatacctctatgtctcctcccaccccaccctcctcccctcatcaacacactccccacgctcccgtttcctcctctctacacttattacacttactccacctacccgtnccccccacctccctcccctctttactccccgcacccctcacactctctatagatatctacttatttctaattgagttttttatctattcttttttatttcacgtagatacctctccttgctctcccgcgccgtgccccgctgtctcgctctgtccgttctttcctcgcccctcaccgctgtactttactcctcgctttaactttttttctatttatgtctcttctcttttttctttggtccttcctcctcactcttttctcctcttctatcactcccttcccactccttcctctcccctctctctcttaactctcctccttgtttcccctcttgttgagtcttctctctggcttatttattcgactcgcacgcggcgggcagctgggcccgtcgtgcctcccttccgtgttgtccctttccttattncctttttccttggtctcctttagctatttcaaaggtcgttggtatctccttttttttcttcaccgttggggttttcctcgttaaacatcttatttttntggttttctttcaagactctcctttcttttttttcctttcttcctctttttnttttttttttttttttttccccct

SEQ ID NO: 11543 - DNA, 714 bp, Homo sapiens
cgttcaggtcctttactcttactgtaaaatctccacagtcctggatgatgatctcagtctgggagagcctatgaagccatagccaaggtcctgcagagccaagcagagatctcgtaagcaattaaatgcttgaaaaaatttgtgaaaattgcaagaaataattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatacagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcatttaacatcaaagcaagaagaaatccatcatgtcaccttagacttcaatacttgtaataggagcatgttacagataatatagagttataataaaacggaaaaaagaaaaaaaaaaatggcctcgttggcatcagcggtggagctctcggccag

SEQ ID NO: 11544 - DNA, 158 bp, Homo sapiens
cttgggagacttggcaaaagtcatcatcaggaacaagaggaacagatgacctgctttacccgatctgaagccctgcagaggtggactttcttcaccccaaaataactctcatctttagcttgataataaaatgaaactttagaacaaaaaaaaaaaaa

SEQ ID NO: 11545 - DNA, 107 bp, Homo sapiens
cctttgattgacctcaaagcatgctgccttgaacgtctaaacaaaataccattattcccaggatttagaatggtcaataaaaggcaaagatgataaaaaaaaaaaaa

SEQ ID NO: 11546 - DNA, 177 bp, Homo sapiens
caggtgaccaccgatcagatcaagaaacagaacacccagaagcttttttcctcatccttccagtaacttctccacctcaaccaggagtaaacaccatcttgacttcctacattacagattagttttgcctgattttgaacctgaaataaataatagtatacactaaaaaaaaaaaaa

SEQ ID NO: 11547 - DNA, 206 bp, Homo sapiens
  misc_feature (1)...(206): n = A,T,C or G
aatacagtaatgtttgatagttagatgtaaaaaaacaagaaaagaaccttangagtgtacagtatcacccctttcctgagctttacactatcaagtgccatgtaccgaagtcactccaggatccctccaatatttcctcaccctgacttctcagattatactcctaaagaagacagtaaactcccttaaggtgaaaaaaaaaaaaa

SEQ ID NO: 11548 - DNA, 1208 bp, Homo sapiens
  misc_feature (1)...(1208): n = A,T,C or G
cgctgtggggtggcgtccgccgcgcctctcggccgtcgtggccggtgcgctctgtgtcggcgcgtcgttcccggggcgcgtgctgggtgaggcttggtccgcccttcgcgctgtacgtgcgcttcgctccgttctgcgcggcggtctgcgttgcgttcgcgcgcgcgctgctctgcgccggttcctctcctctctgtgcgccttggtcggcgggcggttctggctctcggttgcttgcggcgttgctgggcgtatcgcgccggtcgtgtgcggtgcgtgtgccgcgcgggcgtcttgcgcgcggacggtccgctcgattgttggctgggggtgttggccgggcgttgccggcgccgcgtccctctgccgtgcgtccgcggtctccgccgcggtggccgtgcggtcggcgtctccgtggcgtccgccctgggtgttcgggggctttttgtcgcgtgtttttggtctcgcggtcgtgcgggggtcttgcggttggtcttcgcgcttcgcgccgccgtggtttgcgtcggtttgcccgcggcgggggttgcgttgctggggtcgcggtcgcggcggcgtcttcctgtggttgtttctggcctgggcgggttttccttcgtccggcgcgggcgttctgcatcgtcggggggcgcgtctgggtggcgggtggtgtttcttagttgggtggtgtgtcttggtttggggctgcggtgttagtcttggtggggcctgttgcgttgtcgttgggctcggctcgtgtgtcgaaacaccgctctcctccttgcttcggggccgggcgcgtgggcgcgggcctggttggtcgcttgctncgctttcctctgggctcgcggtccctcttggtcgccctcccgtgtcttgcgtctgctggctgtctcgtgctcttgggtgtcggctcgtgggctcgcgcgtcggctcggccgcgtccgcttccctcctcgtctcctgcttgcgtgtgtcgtgcgtcttccgtctcgtgtttctctgtctaaagagttggttcggcgctgtggcgtgcggtcgctcncgccccgtngtntctngtgtgttgtttgttcccctcgttctgacccctgtgtnggcggtgggcncgttnttggctcgcggcgaannggttgttgtnttgtgctgtgctggcgcggcggctagcggtggtggctgtgggtccgcttgcgctggtcggctcgttgcgg

SEQ ID NO: 11549 - DNA, 726 bp, Homo sapiens
aaacgtagatgggtcacaaagatcaacgcggagtaagggaacaagaaaaacaaagtaaaactataccgaagggacagcgatcaatactacaaatgatgcaagagattctctgaagcattgcaaacgcgtcgtactggggacacaacagattaaaagtgatgactgacttatccaaaagcgaaaaggaaaagcatgtattgccacaaatcacaccaaagagttaaatattaaaagtatctgcatgatgtaaggtgacagaaaagaccgggcaatagtaatataatctactatagggtgccagcgtccatagaaagcatcgttgtggagccctcaggacacatacaatcatggcagaagaagaagggaagcaggcacatcatacgtggttggagaaggaggaacagagagcagaggaaggtgctacacatttttaaacaaccggatctcatgagaactcactcactatcacaagaacagcagggaaatccacccccatgattctatcacctcccactagccctctcctccttcaacactggggattacaactccacataaggtttgggcagggacacacatccaaaccatatcatcactaattaatgtttttgaaagctagagttacattacaaccacctgaggagcttttagaaaattacagatccctgagcttccatctagattgattaaataaaaatatctgggcttgaaaaaaaaaaaaaaaaa

SEQ ID NO: 11550 - DNA, 322 bp, Homo sapiens
  misc_feature (1)...(322): n = A,T,C or G
aaaattaatattttttcaaaaatttgtaaaaaaanaaacaccctagactgagacgccaaaccttctttgaccgagcactgccctcagggagcctgaccaagactactttactttcaaatggcagtacgcaccctcttcgccgagctcgacaactaccccgcacctgctcggcaccgaaaaatccggacctgcacatcgagcgcttaaccgagctgctgagctgtcgctcacgttcatcgaggtgcacgaatgaccctcacctgtgctgactgcgctgcccggtgcctgtggcgcgaccgacatcatgtaactcccaggcggt

SEQ ID NO: 11551 - DNA, 1256 bp, Homo sapiens
  misc_feature (1)...(1256): n = A,T,C or G
tccgttcgtgctcgtgtggctctggtggtgcagcgcccccgcgttgcngcggcgggtcgcgcggtgacgtcgcagttgtctcgcgcngtgcgtgnggcgcggcgccgcgtgngcgctcggccgncgcccgcgcgccgtggcgctctcctcctctccgtgccgcgtctcgcgcggcggttcgggtccgtgggtcgcggcttgtgccggcggttgttcggcgcggctcggtctccctctctctctcttntcgctgtctcgttgtgcgttctgtgtttggtcccttgtgcttttggtcgcggctttcggcgttgtgtttcgtgctgttgtcgttgttctgctgcggcgtgcgttctgtgcgtcgggtgtgccgcgctcttcgccttcccgctactcgcgcgtgcgttttctgcgcgctctcccgcccccttccgcctcgcggcggcggcggtcggccgggcccccccttcctccccccctggggtgccctgcttcgtgcgcgttgcccctgcccgggctgttttctgccgggcctgcggtttcggctgcggcgcccctcggtgcggtgcgctgggctcctctacgccttgcccccgctgcgtttctcggctgcggttcgttgggcgtctggtcggtctttccgcgccgcgccctgctcttctctccgctccccctttctcctcggctttttctgtcgtcctgtggcggggtcgctccggtcgatttcgccgccgcgctcctcctccggccttctcgcgccgtgtgtcgggccctggagcgcggtgtttgggtcgtgtcggcgccggctgcttgcggcgcgggcccggtccgctctgtcctggggtggtcgtgttcncgcgccgcggtcgcgtggtgttcgccgtcgtccccctgtccgctctcccctccctcggtccgcgtcgcgtcgnctccgggcggggtgtgcttgcgggggcgctgcgtcggctcgtgtcgtcgcngccgtccccggctgtgcgtcttcgttccttgccgcgtgtcgttgctggcgtgccgcggtcgccggctcgtcnggtggccggcgggcccccgtggccggcggggtgctgtcctcnctcncttctcgtctngcntntgggctttgtgtccctccgcgtncaaacngncttgtggnntnggcaggttncntcctgccgccacgggggttgttggngtggtcgtggtgtggcgccggcgccgttctcgttttgggtcgccgccgtcctgctgtcgcttgtccc

SEQ ID NO: 11552 - DNA, 477 bp, Homo sapiens
gctgcgttggtatatagtagaagagggagggcgtatgtggaggaaggaatgagagggaatagaacgagagagatgaaagatgtgggagtgaggaggtaagattgcgggcaggtgatatacgcgagagacgctgagtaacatgggccgtggatgagtatgggtagtattaaaggagtcgatacgtaagaacaaaataaattgtagtaatgataatcatatgagaataagaacaaagtgaacaaaaatatatgaaaactggatcttactgaataaaaatataaaagcattatgctacagaaaatcaatccagcccatatctaataaaaatctgcaaacaagagaaaaacaagaccataccagatatcaaaatagaacaaatctagcaagatagtcaggaggggtgatcctatggtaatacctatagtaagtcggtcttactcaaggcatggtcctgtctgttgccggttcgctcacaca

SEQ ID NO: 11553 - DNA, 633 bp, Homo sapiens
ttaaggagccaagggatttagcagggcagatgccaggccctggggaggcaaaatttacagggggctcaaaatggcaaagggcccaacgggaaccgaaggcccagaaacagcactcggtggagctgtgggtgcagttcaaccacgcgatggacgccctgctcttccacctctacctgcttttcatggcctcctccatcatcaccgtcatatgcctttggaacacctaggcaggtgctcacctgccaacttcagtttggagttctttttgccaaagaatttcagaaaccagtcaggctttcatgtcagtccaaatttcagccttgtggccctgtcaaccgcctcatttttaacccagtcctctgggtagtttcagaccagacctaaatagtttcctatgccctccaaaagtcgggtccttgttcctgcatgccatcagccccactcagccctcccatacctccctggctcctcaggattcaggttcttagggtacgtccttgatttaatcaccccaatatgcccctttgcagaaagtattggcttttccctgaattctgttatggtaaaaaaaattttgggattgagagtttttttgcagaaacttttcagccaaagtaaaaaggattttttttt

SEQ ID NO: 11554 - DNA, 255 bp, Homo sapiens
  misc_feature (1)...(255): n = A,T,C or G
cctagaccggaacttgcatacctacctcngccgagcctaccccaggaagccttgcctcctcaactctcctgccctgncctggcatttcaactgcccactgtcactgccagaggaggcaccactgacctgcctcatggcccagccactgcacccatctccaaccagacccttggtgtgttccccacccaatccatcacaagccactttcaagctttagggaagtgaaatgtttttctgccctcaaaaaaaaaaaaa

SEQ ID NO: 11555 - DNA, 932 bp, Homo sapiens
  misc_feature (1)...(932): n = A,T,C or G
agatggagatactgagactcatagagtttacccaagatcacctatatagtacgtggaagagtacgaattcaaactcagaaagactcctccagaagctacatctttaattgctgggcaatactgccttaaaatggactgaggtgtttttgatcaatcagggtgtttgatacatcttaataaggtagcataagactgtgttcaataacaaatgcttcttttgatcgggggaataaattcccaaaaaaatatgattttatggtcatattggcagtattaatgtataaaaggtaccattgattcttcaatgttttgtctacaaacctaccaaaagccaccaaggaaggatggggacttagatcttttccaatagagaaaaatgaaagctggctataagacccaaaaatctattaatatacataaataggtcacatataaatatatactaatcaagatgaaagaaataatacttaaggtttgtttcaaaccttcctggctatacctgaactgttataaatcacttgtcanaacactgacttcctattctcaagaaagtttttgctctatgtcanccagcatgcttccagatcttgaagtctctaggtcctgattatctgaagtagttaaaatgtgcacaattgttacaaaaatgttgcatagattagcaaaaagtgtcattgtacaagcgttgtacattctaatgatgtgaacaagcagcttttaaagtctttgcanggactgggccnattttcttgngaacattgtgagatcattctanataagagaatagttaatacttatatttttaaaatctggagtttacaaggccattgggtacataaccactttaatgtgcattaaatcaaatctgtgctattgcatggtcacctgagacttctctggacaccgaggtgatgactattgacatcgcccaa

SEQ ID NO: 11556 - DNA, 523 bp, Homo sapiens
  misc_feature (1)...(523): n = A,T,C or G
tgttttattttatatgatagtttnttttgagtaggacccaatccgattatcatctcataatcataatctctctagtagattctgtagggcttaaaaatggaaattgactctttttttttttttttttttggtatatttgtgtttgaaagcttgaagaagatacccaaagtggtattattaatgcatcttgaaaactcacatcgtctgactcatcctaattttcatactggatctcctatgaagagacatgtgaccaaaaaacctgtaaatagagttacaacgtgagactttgaaaatgaaataatgtcatctaattatagatagaaaactgtgtgagtgatgaaaatgagtctcatgggaacaactgtttcaagaacacatcatctgtgaaatttccttggggcctaaaccaccctcattaattgtagagttaagtactcgaaatagcactgtttgtctatgttgagattcatatgaacttgtcacatggaaaataaaaaagatagagataaaaaaaaaaaaa

SEQ ID NO: 11557 - DNA, 592 bp, Homo sapiens
cagaaaccaagatccccatcgatggagaatgctgaccactgtcaggtagacctcaggcaaaaagaaactgaagactgaactcaggctgttttaaatttcttcccaaggagcctggagacagtcacacctgcaggcgaccaatcttgctagactcgtcacactgacccagtctgttgtgacttgctctcatgacttgactctggcatagcaccacttgatgattaatagttttccttatcttaacaaataaatgttaacaccaagccttaacatacctttctgctgaccccaaggttttagacaaaggcttgttcccttagccagttgcaaatcagagaatctctaaatccacctgggacctgttagcccctgcttcaagatatcctccctttgcagaacaagtcaatgtataacctccacgtattgatttatgagtttgcctattacttctgttttcctgaaatgtacccctgtctttaaaaacgcttgtaagccactggggaggttgggtcttaagtgttagctacctgttcttcttacttggtgccctgcaataaatgtccttctttctcttcctgcaaaaaaaaaaaaa

SEQ ID NO: 11558 - DNA, 932 bp, Homo sapiens
  misc_feature (1)...(932): n = A,T,C or G
gcctangagttactaccatcctgcctgtgctgctgaacacacactcaagctagaaacacagagccccgaacttaggacagtgatctgaccggccactgcctagcaagactatcatctcaggaaacccagaccatgaaggcgagtaccttctaagagccagcactgcagctgatcaccaaattggctagcttttgtgccttttgcacttgctttagtgccaacaggatacatttgtcaaggacaaaatctaaatgtttatttacgtggggatgagtcaggaagtagactttattttactgggctcagggccaacaacctcattcagtggcctccaaaactaaacactttgttgagggagaagagaaatcgctccacaagaggtatagaaaggactggaatctccgcttacagagctgtggactgcccagaacttacagcagggtcagcaaattttttctgtaaaaggtaaaatagtaactttatggtctctgtggcaactactcagctctgtgattgtagcatgaaagcaactatagacaatacctaaacaaatgagcgtggctgtgcttcaatcagatcttacatacaaaagcaggcaacaggccagctttggtccacaggctgtagtctggtgaactcctagttagagtactgttactggcacatcacaggcacancatanacatcaagtatatgattcaatgtacagtggccagagaacnaactgtcatgctaaaatcatttcaaccttaaaaataattcagcctttcctatcttttattgttactgattacagggatgggattcaagtgaacactctgccatttaggatatcatttagccttaacctgtgcagctaatggancttctttacaccacacaagcatctttgactatttcaactggtaatgattcatgttcgcagcctcttg

SEQ ID NO: 11559 - DNA, 919 bp, Homo sapiens
  misc_feature (1)...(919): n = A,T,C or G
aagggaacactttagacgtcagggaaaagtttttagttaacnnacccccngtttgcaagtggaacntccccagacatgnggaactagatggggcctccctacattgcccaggctggtcttgaactcccgggctcaagaattcctcctgccttggcctcccaatctgctgggattacagggcaaatgggaatccatagctatgggtataatacgaagggcgaccgcctctcgggacgtggggacagaactcagagctcctcttttcangccatctcaagaaggactgcgncaccacctgccagaggatgccaacnactgagttttaaggacactccaggaaccctgtggagaagcccatgtggcagcctcctgtcaatagccagtgatggacagaagactccaggcaacagctgagctgatgaaggaactgaagtatatggaatttttataattttcactgcatagctagcaagtagaaaattaagcttgtctgccttcagaggtcagcaaactatactgcctctatttaagcaaacaagcagcatttattaagtgtctctgtggccaccatgtgctattatgggatgaaaagaactctctgctcttcagcacctatactcttgctggaaagacatccacataccaagtggaagaaggaggggaaagactggatgtgatgagttcaaactaaccattaaagcaaaatggcctaatttaaagatgacaaactgaggagctcaagtcaaaaaaaccttcaagtaaagggcccccggattttaagctagccggatgtctgcttgaattgtgggtgaggaacgccgaaaaacccgctgagggagggggctttaagatccctttccccaccctgcacaaaaataaaatcgccgtaaagtaccccggcttcaaaatattcacgtta

SEQ ID NO: 11560 - DNA, 912 bp, Homo sapiens
  misc_feature (1)...(912): n = A,T,C or G
cttcagagaaacactgatcgaacccttatgaaggcctggcagagcatctcttacctgtaatctcagcactttgggaggctgaggtgggcggatccctcgagcccaggagtttgagaccagcctgggtaacatggtgaaacacggtctccacaaaaaaaatacaaaaaattagccaggcatggtggacaacctccttgtagtccaagctacttggaggatgaggtgggagccgtcacctgagcccgggaagtcaaagctgcagtgagccatgattgcattaccgttctccagaggctgcagtgagacatgattgtaccactgtactccagcctgaatgactgagaccctgcctcaaaaataagaaagaagaaacttatgaaaatggtcatctactgtacatgtactagtagagaaagagaattttactcttctgccttctgatattattggacactgtaataaattaagcacagattttagtctttatcatctacagataatttccattttattctgatgtttgcctaaacactctactgtaagcaacaggccagcatgtgtgtcttcaaaagcacaatctcagagcttcatggaaagattatactgggtacttttatccattatctcaattgtgctccaagctgactttgcttaacaagcttatatttacagtgaacaaggtctggtttncaaaaattaactcatggtctgaagcagacagcctgggtaaaacaggatgttaactattacctttctgttaacaaaaattggaagaattagtttatttaccatgacaaaaaaaattaggagctccacttttgccttaaattaatttgaggtttatccttgtatttaacatcttcttatggataatgaaaaatccttattttttttaacaacctaccctaattg

SEQ ID NO: 11561 - DNA, 259 bp, Homo sapiens
cttagcggagaggagaagacagactcctgagggagaaggccatgtggtgatggaggcagagattgaagtgctgcagcttcaagtcaaggagtgccaaggattgctgtgaaccaccaaaagcaagaaagacacaaaggaggattctatcctacagattagagaggagagtatggacctgctgacaccttgattttgaatttttagactccagaattgtgagataataaatttccattgttttaagccaaaaaaaaaaaaa

SEQ ID NO: 11562 - DNA, 899 bp, Homo sapiens
ttcaattcccctcattcaccaatccctcacgctttcagtctcaccagatgctggtctatggaattaaaatagaggtctcctatgaaagaagaagaatcagactggcatcagatgatccagaaaaaatggagggagaagacaacagagcaagatcttgaaagttatgaacggactactatatccggtcaaactgtcaattaaataagaaaaccaaaataacctattttgagacatgtgaaaactgcagaggcctacctctcatgctacccttttcataaatttcttcgaggatatactccactcaaatacacaggcacacccatattgtacaaacatgatattactaccattatggaaataagatgcctctagaaacccctcatccccatatatctcgacatttccattatccccccctcataactagacccccactccatccgcattacactgcattctcgcttctctaacccacaacctccccgcaccctctatcccgcccaactgttatcacacgcccacatcattacccaccatattctctactaaacacgaaccccccgaaatctcctacttaagccacatcccaccgacaattacccagcccacacccataattaattcgagagtttgtttgtcctcttgcaactcgttaaccgacatccactccacacgcacaatctcccaagttggcctctcacagatatacttaatacacctccactaccacatacaaacaaccatcccacacgactcaccccctccccacaactaaatcacccattaacacacatttcgtccgccgccgaacaccgaacagccagaacaactcttacaatcaatacccacacaaatctacctacctcgcttcatagtctcatagaaccccaacacattca

SEQ ID NO: 11563 - DNA, 712 bp, Homo sapiens
  misc_feature (1)...(712): n = A,T,C or G
atagtgcgagtgcggcggtgtgcatntgtgataggcagagtgtgctgtcagccaccgagcgactcatcaccagagtcgtacatctactacaattcacgtctatgcttacctctnctaagctgccngcgtacacgtagaagtgcgcagcgagaagcacgtccctgaagtagttgagtatagtgtatgccacagagcgctgatgcgcagtcgcgnacgatacgtcaatatatatctctcacgcgtgcagttaacgcacgcaccgtgtcgntctcgtcgcgtgngtgagtgcgcgcggcgtacgctgcatgggatgtaccaagatccgcagtgagtcgatggcgtatattgtatgatcgaatggacacatagctcgacgcagtccacgaccgggnccggcatcgaggcagcgcatgggtcagtgagcgggacagagtaggntatcagtcgatnctaagactacgaagataangtgactataacgtacatactgagntacaactctcgtgtctcaactctacatacagactactactcaccatgcctcgacgcgtntcttaccttctcacgtgtgtcatagacgtacgatctcgccacctagcgtgatatcacagcacatctgatatgtggagtgtctgcagcaggttatctaacaactatacgaaggatacagttatacgatgaacatacccacaccacacaatctagagccagt

SEQ ID NO: 11564 - DNA, 791 bp, Homo sapiens
  misc_feature (1)...(791): n = A,T,C or G
gcgtgacgtaagtaacactgatatgcaacnactaacacattcttacagcgtcacatcagcacagagtcgcgcacagcgtcagccatgctcagcatgatatgctcatgctcatgaatatgtgtaaatgtatgagtttgagttgagttgagctgtcttaatcgtcctcgtactacacgtgatgcagatgtatgatatcncgacacngaccgcatgtgcacataacacactatgcgacagtgcgctgctattgagtcatagtggcatctcgcgcagatcctaancngatcacgccgtcccgcacgtactgtagagctgtcatatcagagntactgatagtctgatgtgcggagatatagtacgcggagtacgagtgttacgtctgtcatatgcttgtgcttgagtgctgcgcgagtccgacagagatatcatactccgcgcatgagatgtgtcgatggaacaatgcgacaatcgaggtgcgttgcgctcgagagctggngcgtcgatgtgtgttgtcntnagatctgtgtaatcagattcgcttatctagaaactgataagtagtatgccagaaatatattaatgtacaatgcagtccagtcaatatcatgccacgcgatcgcanacaccacctgccncacacacccctagataccatctctatcatttattgcacgtgtcanagcacacacgcacatgagaganatgatgattatcatggtgtgtctgcctacgttcatngtgangtgacgcgctagacgatcgtgccgcagcgactgagtcgacttanagag

SEQ ID NO: 11565 - DNA, 621 bp, Homo sapiens
  misc_feature (1)...(621): n = A,T,C or G
gagtagctatacaagtgacgaacgcatacctatacagcgagccgatacaggaccatgcacctcgcatcgacgatgagatcgtacagcaacgnactgatgttaatagagcagcgcgagatcagcaaccccaacaccaggccaggacgcacgacgtagccgaccacatagtctaatggtttataatacgatgtcgcctagagcgcgcacaacacaactaatcacacacctgatgacatacatataggagcagcagcatgagctcgagacacccgcaangagcgacaacaaatcagcaccgcgaccggagacgcgatcgaccgaccanccacacgcgtcgccacctattccctacgatctttccagagatgaccaatgtaatacagtacagcagaatgaacaggtctcagatcacgatatgtcatccgtagtccatgacatcctcaacagctgatagatcacacgctatacactgtcctcgctgtgttaccgatgtacgcacgctcggcacgagcctgaggccctgctcgcgtgagtacaagattgaacaaccacaaaggattgtcgaagaacgtgactaattcgtgttctaaaatgtaaggaggatcaggaggagagtacggg

SEQ ID NO: 11566 - DNA, 945 bp, Homo sapiens
ttaggacccgactgattctttttcctgagagtctataagtgagcacatgtcaactgaaaacatgtgtttagaaactgtgagatcggcacaccataaaacactctttgatgagatttaacactctcaaaagatactttgatgttcactagactcatgattctatttatttctttataacgaaaaaggagaattttcagttaccacacgctattaccgtataccacaatttacctccatgcgcagtgaaccgaaccccttgtgcaaaatggattccacatcgcctccacgaccccattcgcatgaccaccactgccgcacccttctcacaccattcctgcgcgcggcctatcattacatcgagccgcgcgaccactttttgctagcctacgccccaccttattcgcagcacttcacccccatccccacttccatccgaccccccgtcccacctcgtcccgccaaccactctcaacacccatcccttccaaacactctccttgcacccccgcctccccccttgcccccaacaacacgcctgccgccccctcccccacactcgcacctcaccccccccccgcccgtgcaccacctctccgactcacccccccccgctcctgctcctcacccacgtgcccgcctccgccacatctccccccccaaccacctccgacccacccaatctagcacacattctgtgcacctcccgccacccctcccccacctccccgcccctccccactgccccagtgcacagacgccgagaccccgaccctcctcatcccctcccccctacaatcaccgcgcccgaacctcctcctctgactcggatccgcacctatccatgtcgacataccgcgaccagactcgcgtcgcccacccctgcacgtccaccccatattaacctcgcgccacattgcggccgagtgtaccactcgcgccgctgcc

SEQ ID NO: 11567 - DNA, 351 bp, Homo sapiens
cagaccaaaagcaagatggcagcaacagatcatcgcacctctgcagtctgtctgctagtggctacagccacctcctacttccacagatcccactcaaggattctcaaagttgcaggagtaagatttctttccagctcccttcctggtcgtggttcctcatgtcagcttcttgaagtctggggtaactattttcctgtagtaaaatttcctgtgatagtctttcctttattgcctctcttatgtataaaatggcagtattaaaattccttatactgaatgtactgtcaattttcaaagttatttacatggtaaaataaaaatatattctttaaatatgcaaaaaaaaaaaaa

SEQ ID NO: 11568 - DNA, 1011 bp, Homo sapiens
  misc_feature (1)...(1011): n = A,T,C or G
cgtctantaactctcccacacctctcnngttaggcgtactcctcacagacctcanttntagctccgtacctcaaaacctggtaagggggggcgtaaataaacttcctcatnaaacctaccatcaaatcggcgtcccaccaangaccaacgtggggcatcgtattcggtatggtggacaagcataacctttctacctcatgagcggggggggagattgcgcgtgggaactgttggtcttcttcgaacccctttgttatcgggggggggggggtcnaccgcgccgccnctcccctaccggaacacaaactcctgggaagggcggttttctgtgtgcctggaactgcatgtgtcagagagccaccctgcgggtcctgggctgccagcggacaagtgggacgcttcaacgtaaaccgaggggctcccgcggcgaatacccggggnttgctagggggggccctgccggcgtgtctggggcggtagaggatgctcggcgctcaaagtcgcgtcgtcgccgggcgaaacgccgtcaggggggcggcgcgagttcggcaggggccgtggcgcgcgtgggcggcgctgaggcccgcacccgcgggggggtcccgagcgggcctcagcccgcgctcgggcggggggagaagaccacgaagagcggagcggggggcagcggcncgggcctcgccggggggcgggcgcgcccgacgcggcgcgcgtgcgccctgtgcacgggccgggggggcggctgcgggcggcaccgtccggctccgccgggcgggaggcgggccgcccgagccgcgccccgggtgacgcggcgggtgcgtgggccgcccggacgtgtgcgagggcggcggcgggttcgcgcggacgacgcccgacgcgccaggcgcgccggcgcgcgcgcgacgagacgccgtcgcggctccaaggggcgggcggcggcgcacgccgcgcgcggacncgcnagcggcggagcgacgcgggcgcgtgcagggcggncacgccggcgcggcg

SEQ ID NO: 11569 - DNA, 1516 bp, Homo sapiens
  misc_feature (1)...(1516): n = A,T,C or G
atatatgaattaatggcgaggagggcgggacaagagagagacagaaagaaaggtttttatgacccgcgcacgaagcgagccagagagattttttaaatggtgcggcgcgcgcggcgctgtggagcaccaggaggagagctgggcgtgacgttgatgtggacagagtccagtttatgtggctttcacccgttgccgtgcgatggtcggttgccggcctggtactgtaatcactatacttaacaatcagattatgtcaccgtgtccctcgttacggttccctctccgttccgcgtcttttcccgtacccgtgcgcactttgcaagacggcgtttgttcccagtcgcattccgtgccgtgttttttcccgccgtcccccccctcttgttttgccgcccccctgagttgtcaatatagataataaaacaaacatatcagttcaaataaatcgcactaataataccccatatatcaccagccactaatacgcacgggtgaagacagttcactgtgagcgtctccgtgctttgtggttgctcaggtttgtcccgctggttaccgaccacggcacccagatattcgttgccgcccactgccgcttttgtgttgcgatacagagctggttagaacacgcgcacgttggcgcagatgaaaaccttcagagtagtaaggtgttacgcaaaacgtgtgcacacatcgcagaaaaaggagatcggtaccttttgtcacgattttattattctgtttcggtcccaacatatgtgaccgtctacgagatacggttctgataaccagcgtaagcccagtttgctgtgcaccggggcaacactccactgggcgtagtggtacaagagtatggaactgagggtgtgggtctgacgtcacaaagccgatgtaggtagacgccgacgcggtgggctatcaccaccaattgttttattcacacacgccggtgtctggtgttatagtggccctgtattataccgtccgtaatttagtctccactattttgttccaccggcggcgcgcgtaatgacgagatagctagcgtcgcttactcaccgcggttggtccgagtccgtggtctgcgtgttcgcgagctcgtggttgttgtcttgtcccgaaccaccattactacgccgcgcactgtgcggtggtccgatcacggcaccactcatatttcgcgcatgtataacacacggcggcgaatgttggcgcacgcggtggtggacgaggcgcgcgcaagcgatttgtcgcaccacgtgtgggatgacgtatagggatgtgtatgaggacgggngtggtgtggtcggcggtgtgttgtcgattcgtcgctgcctcacacggccggcgttgtatatccgatactccaactacgctggatgtgttttgtgcttntgaccatcgcacctggtagtcacttttcgatatccaccactccgcccgcgtcgttcgctntctccgcgcgtacatttccactaacgccgtcacgtgtagatctcgttatctataccatgac

SEQ ID NO: 11570 - DNA, 953 bp, Homo sapiens
  misc_feature (1)...(953): n = A,T,C or G
tcagatcacgcatgacttcccgtacgcagacctcaccctggctcgagtgatactcactgactgatacggcgactgactccctcggtatccctgaatggaaagctcatgcaagccctgcgcgtatctcaagggcgggactcagtttccctcactgccttacccacctctctcgtcatcttaatcaaccgacactattttactgctgctggcagctcattgtaatgtgatgttagctcaagtgtattgcccaatcaattatttcactttcaccccatgaatgcctaatccatgactatatgagcgatagaataaaggggacatgccgctattaataggcgcttacaacccaaaatgactaatcgtgtcagttgcgccttcccttaagggacactggctttctctaggcggtgaggacaagatatcactttatgcactatgtcctcctatccttaatgtggcgctgaggacactatggatatagaacaccagggctaatcatagcctgtgtccactttttgataaatagtcgcaggctgtgacagaacangagagaactacctcggagaagcagcaacggttgacaattgcactggcaacatctctcaggtctcgcctctatcttatacagatgctttcggagagggaacatagtcgtacaaacgctattgccccgggctctccactttccctatatggtatacaaacctttagcagagggtacattattgaaataaatattgtcccgggccataatgtccaggaaaagtgcaacaattcttaaccaatataaatatttctggctagcacaatccgggccaanataggtccantattttggaagcacgtctcaacggcttcaattttatgtttgaagccacaaccctcccaaaattctatatttcttgtctaggagaattactgatttcatccacggttacacaaatcctttagag

SEQ ID NO: 11571 - DNA, 940 bp, Homo sapiens
  misc_feature (1)...(940): n = A,T,C or G
cctgtcagaagtacaacgagatgatagcgaactggctgagagctgtccttctttacacattccaatataatacactgctctgtggctcgtaccatttgaaaaatggacaagccctatgccaaataagtggttgggtaagaacattatgaactgtgaagtctacgaattgtgggattaactggactatgcatgacaaaagtatcatggaagaagagatgtcaactttattttactaagtactatgcaatccttgtttaaatattttaaacaacatgatgtaatgcagaataccagtggactgcgtgagacaatagatacattctccagttgtgcattatatttctacttatttgtatttgcattataaattgacgggaataaatgtgtatatgtttatctgagtataaaaatgatgatgatatgaatgcaaataacatattcttcatctcacatgtcttatactttatgtggagagaaactgtggactttactagatgattgggaaatacgctttacattattacatggctttatatcccatgttgcgcaatatatctcaaagagagacaaaaccttattcgcccctcgtataaagaaaaaacaaaagataggcctcctacgactaaaacgcgggccctctcgaggccgtgcgcctttggtaggaggtacgtcctagatccccggtcactgagcccctcaaatccatacaataagatgccgaaagaccgagaactcatattccataggcggaacttaccggctaaccggacgatccggggtgatttacgtagtacgaacactttcaacgaagatgccgcaaaagccgccgtactgtntctaaaagacgcaagagcagccattatgcaatacgacctcgcccccacgtacgcgtccccatcacactcctcctatctgcacactgcaatatccacgcgcactc

SEQ ID NO: 11572 - DNA, 844 bp, Homo sapiens
  misc_feature (1)...(844): n = A,T,C or G
ggccgtcgctactcccatagctctcgccatctcagggtgtctttctcatatcgatctatcttcggctagtgatgtgtggggggacgatgtcaagcagcgcggccgcgcagacagccttgcggatctggcgccctaccgtcgacgtgtgacggcagttgagacaagagcggaggcgtgtggggagttagcgcgaatgaaggtgctgtaatcattcgaaccacgctcgtgggtcatctctagagacccgtctctatctatacacatatgacccctaactataactcgcttacctccaatatctccaatataatcacttgtcacgcccccctcacccaaccatccccgctcgcacgccgactccctgctccttcctccttccccctgttcacttactgatgcgatgcgcgaagattcatgataggatctattggatatataagaaaagtgttgttgtctgtgtttgtccgtgcgctgggctctggtcgcggatcgctcgttggatattggcgactttacgaacatcgtgaggtctcgccgagtgactccgcgccctcttgacggctcattctcatcattgggccacctcatgttactctataaataagaatttattaaactaatcaacttangccagacaacgaaaactcatgtatacctcatagggacactcctcgccgctcctctcatgcccgcacagtctgcctccaataccatattttctcccgaacgggatctgcgcaagacggggtttattttctgagggagcagggacaggttgtaaatgagattgtagttgtgagtggaggcgtntgtaaccgttncctnctnccgagtaatccctagg

SEQ ID NO: 11573 - DNA, 1081 bp, Homo sapiens
ttttttattgtgtctttatattagcattattaaacattttcagataccggtaccctgttttgaaacatctcccaagccatgctgaatgctgtggaccgggatgtagtgtcaggcatgggagacactgtcctcattatcgagaaggacaaaatcaccaccagtactcttgaatgctcttaataggactaaccctgttgtccatagccatacttttattttctcttctttcaaaatataatattcggttccttcataaaaaaccaaccaaatattaagacaaataatctaactaattttaatattaataaacgcccacaatacctatacattactaatttatcgcatatctcttttcccctttttatatattttttactttactcttccttttttgtcaaacaagattgtggtatacatattctattacctttcaccttcataattactatctatccatttcgtcctctttcttcatatcatcatttctaaccatgttttttactcagcccattttacctgtctacagtttcatcattgattccacattcttatttacttttctactatcatattcttattactcgaataagtatctcaattgatatatgtattatcattagagacatcactctaatggcaaacacatgttacagtatgcttctcactctatattttccatatagattaaccctgtatactatctcatgtaaccttattattttctcataatttactacctgactttattacgccacgtcctcctttatgctatcctgctgtttattacttagtgatccattcacgctccgtccttttatattttctttccaaattttatcatctttattttcatcctctcatctctcctcatatcctatatttcatgcctatactctttctaccattagttcgctccaatttttattttttatcgcacggtttctgtttatactggatacactttgttattattaagctgtctatatatatcatgtcacatatgtcatgtttcccttgtactatatttatttatgtttcagacacatcccacataataaatttctttttacttttatatcgt

SEQ ID NO: 11574 - DNA, 980 bp, Homo sapiens
caactactaattgcggaaaattgataaaataaatcctcagcgtacaccaatgcgaaaaatgtcaagggaggaagacgattatgatgatccacttgcacttagtaaatagtctgtatggagatgacaaagtctggactcgaggctggagcggagcagcacaggacggccacgcaatagcaccactgagcaactgtgcagcagctacaaccagcaagagaatccccttcctacggacctgtatgccctctactgaatatggatagcattctgttcactgtacaaaaagaatgcttatacatgcccagtccaatatcactagctgctgctagagaggcacgatgtgccgccgaacaaatataaattattactggtccacgaacacatgcatatttacagtgcataaccggcaatagtgataatgacaataataacgaaacctctttgacacgagcgatcttacatactataattacccccatacagcagcgcatatccacccgcgatacacgataaaaatataagccaaccaatagtgaaaattgtgaagatgcagcaagacaaaggctaaaccaagaaggagaggagcggaataatgtgacaaccagtgacgctgtagctgcaactacatactccagaatacaagccggctgagagtgacagcaaatacatgaagtctctaattcaccggacgacctttatcgtaaacaaaagtgacataaaaaccctcgcaaacgccgacagaatacatcagcccgaaatagccatcagtaccgacccaccatatgccgacccgttaatcctcgacgaaaggttgcacgataagagaacacgcacatgttaatttgtgccctgcaaacgctaagtgagccgggctaagaataaaacgacacctctaaggtcatactaaatagtctgcaccctatctaccagtaaataccatcccgagcgccgcagacattcaacatatcattacgactggc

SEQ ID NO: 11575 - DNA, 928 bp, Homo sapiens
  misc_feature (1)...(928): n = A,T,C or G
agtgcgcgagtgcgcgttcttcagagcagcatacacacatnttattgcgcccgtctcctcatcgatcgtgcgcggtcatcggatctgcgtgcgtgtaagtcgatgcggaggccaagagatnctacgtcccttattcggcgtcacgactccggtgccgtcccgctcgtggctacgcccgacgtgcgcggtagtcgccggcggtnatcagagcgctctctcgatgtctactgatcccggtgctgcacttgtgatccctatctactgttcgcgatgggtggatgaggatgccgagacggatggggcgtagctgcggtaaccaccgtgccattctcgcgtctccctcccgaccatcaccccctcgcgtcttctccacctcacagtcgccactcccaagatatcatacctcagtcgtacattgacaccagccgtaagcttccttatccgtttttcaactgcctgtacacgagcctcgctcgctagtccgcccgcgccagcgggcccccccccggcccccgcatgggtgtgttggggttgtgggggtctgggtttggcgtttctaggggcgtgctcgtggttttagtttttagtgttgttattattgtaacagcaaaaggcgcacgggtgccttcgacggagatactaatatattaattttaatatatttacattttatagtataggtgtagtatgttctcttcgtattttttctcatttcttgatgctctttcgctcactactgcctttgtgtgcttgtggggggatcttttgtttccgatgatcattcgatcactacggcgtagggcgccgcgcaaacggacgcgtcgccgatgtctgctcgatcaagagagaaactcctcaaatatctacactgntaaaaaaatttantcatttcttctccgtcctcctctttctcttttattttttctct

SEQ ID NO: 11576 - DNA, 1011 bp, Homo sapiens
  misc_feature (1)...(1011): n = A,T,C or G
ctgttagtatgaccgacgctgaagcaagaaaaaaccttcaccttcgacttnacaccacatctcaacctcctggcaggccagccttaagcccagcagtcccaccatgcatctaagctgcgttctcagcggacccaacttcaattataaataactgagatgatgccggaggccagaatncctgagaacccacaccgctgccatcaccatggctgaaacaaggcgcttggcatctagaaaagatgatactgtcggaaatatccaggcggacgcccctcgtttctaagtgcaccaatgcacaagtatcatccaggcacacaacacccacatcacaaccccgaatggcccggtaggatatcacgacaccgcgtctatagaatacgccacctctgcctaacccgccgtacgcagcgcgaacgcgcaacagacaaaaacactcgcgatgacacgtgcctcagcccccatcgaccacagaccacagcgccccctagtagccataccagccaagaatctcgcgtccccctgtacaacaccacggcggcgcaaataggtagcccacacgctcccctgcacaccacgacacaacatgatcataaggagctagccagcaaaccctccagtcgcgcatgaagtcgatgacaactgcgtcgctacagtcccgccccccacaccgctcaggaagataccccaccgccggcacccactaccactctcaccgcccaccgtcgatcgctgctcccgccgccccaccccgcaaccacactccaccgcgcgccgccgcaatagtagcccccccgcgactcgcccacaccgtagaacagcatgtaaaccgtcgagccagctctgcggccccaggaatcgcagctgcaccccccgtagcagggtggtccagagcaccgacgctcacgaatagaccagcgagaagcaaacgtcactttgacaaacgacgcgcagccaaggaaactccagaccgctacgactcattcaaagaccaatatatagctccgacaagcc

SEQ ID NO: 11577 - DNA, 966 bp, Homo sapiens
  misc_feature (1)...(966): n = A,T,C or G
gcatggagcagataatcccacatccatggcgtaatctacgtgagtggtgcacagggcagtgaataacagacataagaaccacgcgctagtatcaaaaaacaatacatagggagacgggaacaaacgacggagaggacgaaacatgggaggagcgcgctgggaaagaggcgcgacggcgggacggagacgtgccaacaactcaaacgaaagagcgaacaagcggagagacacgaggacggccgaacgaaaaaaggaataagagctatcaaacacctcagtatatacaacatatataacaaacgaaccaacaatgaaaactatacttacataactctccctcaacattaatccctatatccacatatgccaactcagtccctcgatacataactacctaacatcacacacaccacgaaaaaacacaccgaaaacgcccagtcgacgccccaaccacgaccacaaaaagagcgagaagtcgacgcagaagataacgaagaagagggggatgaaggggcgctagggaagggagtgttcaagtatggaatgcttcctccgtgtctcgcagtcgtccccatgtattaataatatagctcgctacttggttaccaacatcggacttacttacaatattatacaaaactaatatattataaataactataaaaatacaatgatataacacatacaactataaactaaattntaaagtgttcgtgttttaaactcactggcgtaaacaatggttgtatgagggttgaggacggggagaggggcacgacccgcatacaatctcacgcgcaagaagaaaatgggggttgggcgccacacgaaaaagcgagtgttagagtggcatggatggcacctgcgtgggccttaaggtatgagcctngtccaggttgtggtgccaagagggtgtgggcctagcatttgcccaatggcagatagccaaacnccnccacnacatac

SEQ ID NO: 11578 - DNA, 1146 bp, Homo sapiens
ccgtctcacactccccaattatgtggaaagatttaactctatcctccacctcccttgcactttttctgcatggagaagaagcagccctcgaggcacctcacacatatactagctcgccagaatcttcggatcttatcatgttctgcagaacacataagccaaataacaccgtgcttcttcttggatagcaaacagaaagcaacatctatcggctctgcgtccggctctcagcggaggggccgctcatgcgggaccgatctccctcttagtcgtagggaccagccccgtgactctctctcttgactggactccgatagtaaattgcatcgacaaacatagagcatgaccacgccaaacacctcacgtacaccacacgaccacccaacagctacaaactcttgccccctcatcacactcatagacaacctcctctgttatagccaacgctatttccacattcccagtaccttatccacaacgacataagaacatataccacacgtaccaacttctcgctcactcttctccgatcgcttacattgcaccacctcatcccaccccctcaatcacagtcgcagtcacaagagcacgcgcggaggaattcatgcttcccttcctccacctcacattacttaatagcaattaacttcgtcaaacagcttagctcggcgaccgccgcaaactcacaccatcccgccttgcgcctaccaattacgccatattaaatcattattacaccgcacctataccatacccgccaccgatatactcgctctccaaaggcagatatgcaccagacaccccgtcgcaggtcacccagccgtcccacgtacataaatcatcaacacacacctattcgcaattgtcgataccacacctatctatcacctcttttcacgtcgcacatctaataacctgctacactgttttcatccgcctcgcgctccctgccccacatcgtcacccgcaccctctattcctatcacctcaccacctgcctagtcagccatactcacgcgccctcctttcaagtcgtcttcatcaactgtacattactcacactattctcaacaccaccctatgctagcaatcccgacaaccacatactcctcatccaaatacatattcactaccacacgcggcgcg

SEQ ID NO: 11579 - DNA, 937 bp, Homo sapiens
  misc_feature (1)...(937): n = A,T,C or G
catagtgagatgcaaggtaatggaatagaataatatngccgtcgagggtaccggcatacctgatttgaaaccatctcccaagccatgctgaatgctgtggaccgggatgcagtgtcaggcatgggagtcattgcccacattatttaaacggaagagataaacaccaggacactgaaggcccaaatggnctcgcactgttcccagaacactatttaatatatttctctgatcaaaaacatcactgtttttcactcctatataaaataaaaaaacttgtcctcttcgatcaaactagtggacctactcaaaaccctaccctttaattgaagtttctcattcatactctttatctgattccctctaatatatcagcctccttcccctaccttacattacctgaataatatgccttatacattaatcgttcctctttattgtttcatatcttaatatcacaattcacccattacgaattcaattttactctcagcatcagagatacgttaatcccttgtgtcttatatatatattctagcgtatcatagacagcccttatccactttctcgcgctatctcctatatcgtcacatatacccagtgatatctctttcttccgacaataaacccaataaattactcttatctataatctattctactctccctttatcctatcgataccacatcatttaattccacccacccaccccctattttttcaccccttctctcagcatattaaccttcaactacatcacatattaatttctcttttctccaccatactaattacacaaattttttttatatccaccactctattaataatacaccgctcaattcgaacatatactgaatacagttcaaagatcacctacacataccactattatattgttaagcttccaccacatcattttatagtactccgtcccca

SEQ ID NO: 11580 - DNA, 916 bp, Homo sapiens
  misc_feature (1)...(916): n = A,T,C or G
aatgataactactactgaagcaccancananacgctaaagtcttanatgatctctagctcgncttctacttcgcacagctactatatatcgagagntgatctngatgcatatgatactgatcagctgatacnaccgtcgctgctgacncgagcatgacngtaaaagtncgctcatcaccactgttactgtatcagcgctcgacgacgcacagcactngctgatctgtgntgtgtgtatgatgatatgtatncttagtagcgccagacggaagtgncgtttanangtgcctaactcagtgttagtangctatgngtctgnatcacntcgtncattcnactcctagatcatctcatacaacngagctacatcatcacnctcgatcgtcaaacactcatcagtntcacgtcactgcanacgcagacgcagtcgcantggcacngcagaanccgtagtgatagctgtgagctgncatacagcgtagactatatantngtagtgatgatgctaagagtgacagagnagttgngagctagntactactgctgcgctagtcagatagcgtctcgncnagancgaaacnagctantgtgagtatctagtgacaggcacancgcagcncacacnnacgacncgcctaatgagaatcgcatagnatacgggacgactccggcnatgatggcgagcgatgttcgtcaatcacactactactgatnattgatngtngaatgactcatagtgcagcacanacgatcacatacgaatnatacatgtnagtgncctcntaatntacgtgcagtantatcgatanatatagctacantnatcacgtcaatgnacgtagcctagcaatcactacangcatgctcgtgtgcgactgagantcgcgcgatatacntctcagtcgacactgcgctg

SEQ ID NO: 11581 - DNA, 1709 bp, Homo sapiens
  misc_feature (1)...(1709): n = A,T,C or G
ttattaataatgttagtgattgnnaagttaaatatatgatagagttatcatcaatgtagttatcagagccantccnactanttttttttatatcnacncgangcaccagcacaagaagcactccactcatcatcgcacgcatcttttttttatatcatgatgatcagcncgtaggacgcacncacccnngaaagnctccctctgacttgngattagntnatacgagcncagncaaanctgnctctccaatttncttggcgcncttacagtgtacaacaccttcggtatcagntatcagctcncctccttgtctccagcctgcgtctcacctcatcactactcacgatcccanatgcgtctcagactatcgcncacgntcntcttcctctcctncaccctatcncacancncgtcacactctcctccatgatcgctcacactccagacttccgcgatnttcgcctcgtntgcttactccgatctctcncacanccacatacaagcatntccgtcacgtgccatgccnctcgcagatcagccatacgtaatatatcnatcatctaccntcacagccaggctccacgtcaccacactatactacgtacgatacaatacgccggcgccgcgnagctnttcacacgcaagacnatagcgcgcgcgacacgactctcaccacaccgtcgcgcacgcgtcattctccacatatagcaccatctcaccgtcgtcgcgcaacacacctcgcancactcancgacgccacagacacactacacgatcctatcgcaccgccgacacatcacacacacacacacactactatnntccaccacatacactatcactntatcatatctattgatgtatcacgtcgcattccactgcgccgagtacacgtctntcntatgttagttgtaaccacgcgtagctcactctctcctatgtgtgacgacccacagtcgcgcgtctcgcgcagcatcacctctcgccaccgtcccgcgcaccacttcacacaccgtgcctccactcgatatacaccgcacacgtccacatatcgtcccccaccatacacttccacatccccaccattaccttccttcatctctctcgccctcccactcccactctcactcccacctcccatatctaccacccccgcaccattcgcttcgcccctatccctaccgaattccattctcacgactatacccgtctccccaattcttcccgatctcgccatacgtcaaccacgtccgccccttcttttcactgacgtacccaccccctcctccccccttatattccttgttccattccctccttttccccccccccccccctccccaccctcccgccttccccccctcttcacactcttccccccccccacccacctctttcccctgcccaccttccccccccctttcctcacttctcccctctccctccatcctcacctacccccctttctccactaccacatccgacatcatcccccccgcaacattccccccttttccctcccccccgacaccacaaatcccaccccccatctcccccccttatacccccgccccctttccacctgtaaagccccccccaatttttccccccccccgccttccccatcccccctagtaataacgctatttcctccaacttccacccctttcccccgccccaccaccctaccaccaccccccccacaatct

SEQ ID NO: 11582 - DNA, 906 bp, Homo sapiens
  misc_feature (1)...(906): n = A,T,C or G
cgcgaacagtacgtggaagagagttgggaganacgctcaggagtgacaacgtgacaaagttagcagggtctacatatacatcggatctaggacctgcttctggttctaccatctgaaaaaaggagcatcccatgccatgaacagtgtagctaaatcatttgaactgtgaatttcgataaatcgaaaccgcttcactatgctgacagaagtaacattgagtaagtttcatcaactcaattttactaagtcttatgtcatccttgcttatgatattttaaacaacatatgtaatcagaatacctctaggactgtttgaggcaataaatacattttccaattgagcattatatttttacttatttttattggcattataaacgggcaacggctacctcgctatatgtggatgtgcagctacaacgatcaccatatgaacggctgcattacataatccttcatctcaactgctgaacagtttttggggggaagaacatggtggatctactgcacggattggggataccctgtccatcgtctagtgtgaacgcgcccccgcttgcccccatccctcgccataaactataatcttttcgctgtcgtgaaaaaaaacatacacatcgactatcggcccccccgcgagggcaactctcgggcgcgctggcccgcaggcgcgggctcacgcacgcaccggctcgagtgactctgcaacgcgggaatcgaactgctcccgcgataaacttacggcgccacgccgggcaagcggagataggtgataacggagtagatcacaacccggcgccgagcggaagcgggccggcgctcataggccaactacaggtcgcgtgaagcgatgacagaccggaccctctgcgggaccacacacatcaggcgatatggggagaggca

SEQ ID NO: 11583 - DNA, 1219 bp, Homo sapiens
  misc_feature (1)...(1219): n = A,T,C or G
ccggctcgctcctcctgtcctcgccgtccttcggctctccggtacgccccctctctcctcgtctctccgctctctncctgtcctgcccggtttcttttgttctcgttctgtgtgtggtgtcgccggtgttcgttggtgttggcgcgctgggctcgggcgttgcgtgtggggctgtgtgtgtggttntgtcgcgcgggcgggcgtgtgttggtctcgtcttgtcggtgtcggtccctgtggggggcgcccgtgggtttctgtggggttgctcgggcgggtccgtcggctggcgtcggtggccgtgcgcgtggctctgggcgcgcgccgtcgcccctcgtctccttggctcgctgggttgtcgcggtgggtgtgcgctcgtggtttgcgttgggctggggttgtggtgctttgtgggggtgaggtgtgtgcgtgggtggtggtgggtgtgccgtgggggtgggggtcgcgtgcgtggggggcgcgttggcggtggcggtgtgggggcgtgcggtggccgtcggctcttttgccgcgtgttgntttcctttcgcccgggcgtgctctccgtcctccctctccctcttcctccctccctctcccgctcctgcgctacctctcttcccgtctcgtctctctccgtctccctttcgagctctactctttgcttctctaccggccgtctgctttntnnttctcttgtgtgcttgcctaccctctcctccgggtncggtccggcgttttggtgggtgccgtctcgtgngtgcttctccgtgtnggttcgtgttcgggcgtcgctgtctgggttctcgtgtctggtggcgtgctcgttgtgcctgctgcggtggctctgggtgcctctcgcgccgtctccgctcgcgcggggccccgccgcggtggggccgcccgcgcggctcttccgtngcccgcgggtcggtgtgtcgggcgnggngctgcctgtgcgtgtggtgttttctgtngtcgtgtgggtcttcgcctcgttccctgtttttgtcctctgcccttgccctctgtctcttcggcgctggccctgtgttttttgtcctcttgtttcgtcggtgtgcctctgttcctctgccccgttggtcttgggtggttggtttttcgccggcccaacggncggtgtgcgtgttttccccgccgaggntcgtctgttttgtgtgggggtggctttgcgcgggcccggcgtgctgcggtggtc

SEQ ID NO: 11584 - DNA, 1267 bp, Homo sapiens
  misc_feature (1)...(1267): n = A,T,C or G
cctgcgcatgctccgcaccttacgcgcaccgcgcgcgcgtgctctcacagtctctcagatgttgatttgtgtttgcgtctttggtaaatgtcggacgttacttgttgcgcagatctctcttgtgctcgctggttctgtacgcggtgatctcatcatcgcaagatgtctcacaataactcgactcgagaaactccgtcgcactgtcgcgacgcagctcatcaactcgcgcgctcttcacgatcaggaggtcggttgcggtgcgtcgccaccccttgagcatcagtagatgaaccactctgcatgtctcatgcgactcgttacgatccatgatgtatctaaatactagacttacggacggaaggtggggagcattgttggttcgatgtgactatcattcgtccagattacttatgatagttcaccgagcatctcgttcgatcagtctgatatagagaatagcgtgcgtcgtttagtcgcgcgtcacagtgcgttatatgacatatacatatctctcatccttcacacacgcggacgcgatggcgcgacgtggttgtctcgagtacaaacaccacttgtgggtgacgacaattaggcgtctctcatcattcctacgtcttcattgtcaatctgtcagatcgactacagagggattgtggccagagtatcangtagagcgtatgtccccgtcacgcggtgtagtacgctgtagtcggtcggagcgcgaggggagcggttgaagataacatcataactgctaacgcgctgttgcgaacaccagatgagtcatgtcacgtgaggtagtgagcttgccgagactcgtctacgaacctacgtcatctaccgcgctgatcacccacatacaccactactacctcatcacctcttcnatccactaccacaccaacaatcgactactttaggcgcatctaactaatcatcagcatatctacacacatcgacacgctgagtctcactatgtgacctacaagtacgcctacagagagctgaaggccgctatgaagacattaagtagaggaataacgcacctctaacaaatcaaataaacacaccaaacacaataaaatacagtacaaatatcgaaaacttaacacaacagaattatgagtgggtctctnctgtgtgngacataaccacgcggagtggtactgntgggcncgccgctacacgaaaacatntcgtcacatccgctgatccctatattcaccgtcatataaccacagactctcgtgctcacgctcagtctcgc

SEQ ID NO: 11585 - DNA, 881 bp, Homo sapiens
ggaggaccgacggagtctcgctctgttgacacgctggagtgctgtggcacaatcttgactcactgcagaaagtaggaaagaaaagaccagaacaaaaggcctcagatctgaataataagcatgccataaagagaacagaagaaacagcagaggaaatcaccaatgaaactgaaagccatggctttccagtgcccagcacaatatataaaaacagacccgcactagggtatgccattgtgaatttcactacaaggaatacctgaactagaaaaaattttaaaagtttcatacaaaggactgagaatctgaatgcctcaaataccatcagatatgagaagaaagcccaccactatctttaaaattccatgggaatgttatctccagcctcaattagagcaagggaaggaggaaaaagaaggttcgcggctcacctacgcgtaagatcgttgtagcatgttacaagtcggccttgccggccttaccggcgatactctgtgcgacgttccctttatatagggtgtatagaacgaaccacacccactcagcactctatactcagttcgaagtcatgcctctaacgaccgctagttaagtaaaaaggtccgcggcgtgttataaagaccacgacggagataactcaccgatgtaattttctcaataatatcattataacgagagcacagtattgatagaggctcgagccccgacagataagtatgtgatagatacagcggtcgaccgaatcacggagaccgagggtgagagtatagcaacctgactatggacgcgcaagtcacagagccaccgtgtcgacaactcaccgtacacctagacatctattcgcgacgacatcctcgcggcgtctgtgaggtcgcgagtca

SEQ ID NO: 11586 - DNA, 965 bp, Homo sapiens
  misc_feature (1)...(965): n = A,T,C or G
cagattattgtttatgttgacacaagaacgnacgcgtgagccctcngcgtggtaacgcacgccagagagcttcacagtgatcatctttatacatgataagaattgaaacttgggagcctgttaggaagcaaatgaagccataagggccaggccctgatgcaatacaactggtgtccttgggagaataggaggatgccacgattgtgatgcacaggagtatgtccatgtgagaatgcatcaagaaggcagccttctgcaggcctaggaaagagacctcatgatataccaactgcgctgacaccttgatcttggactctccagcctccagaacagtgagaaaataactttctgaggcttaacctacccacgtggcacaatcgagacaggaacaggcgcggatgcgttttccgcattccccgtacctgtgttagtaggtcgaaagtcctacggtgctttattgccccggcccacgcacttctggctgcccctcccccggtggcggggatagttagaccgtcacatctctgtcaggtcgggtcgcgagcgtatagtgattgaatctcgttgtctaatttctccaataaggccgattattcccgccagtcttttcgtctcgatcttcgtctgtatccaccatctacgaagacaggctctgtatgcctgttaatcgatggcgtgctcgctgccgcgcatcttgcctgattccaccacccttcttgtagcacggggctatacagcgcggatcatagtgggcggagaggacgctgcatcgctctatgcggtaggtgaactccgcgagccctcgtcatgcgctttctggttctgacgcgggtccacctcatgacagtgatctcgatctgttcggagcctagctgtgcggagtcaagtctcaagttctccaatgactcacgtttcctatatccttaggtgcatccagctcccccctaccgcccagcgtcgggccg

SEQ ID NO: 11587 - DNA, 2006 bp, Homo sapiens
  misc_feature (1)...(2006): n = A,T,C or G
acgaacagactcatctgatgcacctataccttatgagcatagtaactgtggagnagattcatgcagcgtngntggngattgtcgacagatagggtgacataatatacatactataggatagactacacacacgcgtcgtcgccgagaggtcgntagaggccgtatagcacaggtngggtacgccagtatcaaacacgtgtgatgatcacgacaccgacggcgcagtctgtccggacagagncagaatactagagagcagnagtcgacacatcgatgagtcacactacgagagtngtattgtagtaacgtactccatcagtaaggtgatagtgtatctcgcacnacgccaccgcgtgtagacgcatcacagcgctgatatatcctgtgtgatgcacgcctcntgtacgctctcaccgtcagngtcgcatcggtgcgggctccacgtcaatccacacaacatacgatcatgtggagattagcttatattcacattgctgtacgtagtcgngctcttgctagtgtgttacgcgagatggtacgacatctgacgtaggcgngngtgatcactatattcgtgtgcgcagtctattgtgatatgacaatggacaagtcgntgtgtcgcgaaagcgatgtataagtatcgtcgtactacgagaggatatgacngctgtcncacgtacggacgagacagtgagngcacactatgantgtgtntngcgagtaggatgagangcatagctancgangtgngacatctaagtcagagntctctctnctcggactgcgggtcgcatagcgcaggtggacatgtgtatagacgtcactacgcgactngagtcgtcgcngtacaggcaggaggatccgtatctctnannntgatatgcntnangatcgtcatcatcgctgcngatacagcagacgtcacgcagcaatngagcgngagcagacatcatagtngtgnntgattaattgtacngagcnatnantatacctcgtcgcagtcgtccagatnccacatcatacacgcacatnanctacctccangtacacacaactgcagnatnanncgcgctatgactgcancgntgcgagngannngcgcgcgtcggacgactcgntacgcgtgctgctctcgacatgtgtcnggtgcagtcgcagcgcgcaacacgagcgtgcgtgntagctgctacgcgngcngcacanccgtgagacgaganagtactcngagcgagttatntcagctcgtagcagcatgggtcgganggtgtcctgcttgggacgcgctctgactcttctctatctactcccacagcagacgnatcactatcacgctgcggcgactgatacatcactactcgctctcacaacgtngggcgnttggnnaactcgctnctgtgtactcgtatacngctagcgtctatcncgtcncacacgcanatgtacatcggtantcatatcacgctgactgttgctgtgcttgncgaactantgtgtganacgtcgtactnacgaatctgatangtcacggatatggacngnatgnngacatataatngnagtnggagatgcagnantagctatgaggtgcacatcacatctgcgctaatgcanacgcantctccagttagcanacacacacncgcgacagttactgtgcgtnctgctgtancgcgcgtatacntgngnggtcaggtatgtgtgtntcctngncatctggtgacgccacgtcgtcggnangcgcaggtcgaaagagatggngtactgaatgtgcggngcagtctcacgtgntntgtgttgcngtcatgtgtgtctgtgtgtncgngntggggtgtctttctcttcgngtgtgcctgaacaaagtgttgtgttgctgcgtgctntngtgtctcgtccccnggtcctngcaggngcctctgctgcttggtcgtggcgagtcagcgangtggagggatgaggagangatggagcaggaaacangatcgagttagactatgaanagcagcgtt

SEQ ID NO: 11588 - DNA, 1241 bp, Homo sapiens
  misc_feature (1)...(1241): n = A,T,C or G
cgatcagtcgtctgcgtctgcactactgatcatctctcacgtgactgtanagctcttcacatcactgcgacacatcactccagtgtccattgacnacgcactctccgctatgcgagcgcatgacactacactctatgccgagcacggctgcgatcgcacagtgacatcaatgtgtgacgagcncgtcntactactccagcacatactatcgtgagtatagagagtcggtcaggagtcctgcacgctcgacgacagatggtgagcgtcagaggaatgtcgcgtgagccatgacagtggcgggatggatactgcgttcgntgccgcgcnangggcttagctatcactatccatctgttcgtctcgaagcatatcattgtaattcacgcatagtgccctcgntatagcctgtctctctgatcgccgccgtatcctgctgtgaacgcatcgtgctgtagtgctctgcgaattgcaccgagtgctgtctattgcgcgcgcgcgaccgcgagcggcgccgaccgacgaggccgcgactaccgtgttatacgcgataataggcgatgcgctccagtggcgcgatcagtgtgactcagttcctactagcccgtccatcgctcgctctactcttctgccccgatacgctcctatatatatattaccgtcatgattcattgtctcgtgttcttcactcctccgcccgttcacacggcacctatctatctacttgctccctattccgccagtgtcgcggggtggtgatgctgttggcggccgtcgatggcccagaggcgcggactggtgggggacgatcagtgcgcgctatgctgtcgggcggcggagggtgaggggctcaaattatgctccgtgtgggctagctattgccgcgctgagtggtggggccggatggggtgttgtgtgcccttttcgtactttaatcgccgtggatacggttgatagtttctattatggggtgggggtggtatcgctttcgtgggcggttcgacattattctgcactctcaggttgcttaggtcgtgccttggtggacgatctgtggggtgagtgcagtggccattgatgtgtctattgtcatattatctacttatattcacattctctatttatttcttcacttgccatcctacataaccctcgcgggtggctctcgttgccctacagcggtgcgcctgtcccccccgagtccctcccctttctccagccgcataataattctcatccttact

SEQ ID NO: 11589 - DNA, 792 bp, Homo sapiens
  misc_feature (1)...(792): n = A,T,C or G
tgtgcgtgcctcggtctcctcgttggctgctgcccgtcggtttgtcgtgtcccggtctccccgctgttgtgtcgttgggcggtgtgggcgcgtgggctctgtttcgcgtggtggctgcccgtctgcccgcgcgcgcgcgtggtcgcggggggcggtgccccgcgcgtcctcgctgtctcgcgcggccttcgtgccgcgctccgctccttttccccccctcttctccgtgccgcgcgtcgcgcggcgctcccccccttctccctcttttttgttctctccttttctcttgtcttccctccgccgccccctctcctgctctcccgcctctcttctctcttgtctttcttttctccctcctccctcccctctttctctctctctctccttcgtgctctctctcctccctcctcctcccgttctgcttggtgtctctcttcgttttttggcgctccgcgtcgtctctccctgcttctcctttgtgctccttgcttcttctctcgctgtgcctcgcgcccgtccctccgtgcctcgccggtgttctcttttttttacttcttctgcgttgtcgtcttcgctgttgtctttctgtcttccttttcttttttcctttcctgcctttctctcccctccttgcctcccgcccctctccgcgccccctctctctcttcttttgctgctccttggggcgtgggtctcgcctcgtcgcttttttgttgttgtgtctcctcttgggtttctttcccgttgagggtgggggcgctcggcccctctcgntccgggttttctcttagg

SEQ ID NO: 11590 - DNA, 375 bp, Homo sapiens
gctttcaggggacacacacctaacattgcaagattcatacggctacagttcagcgaacatttttggatcctttaggaggaaaaatcttacatagactgcactttaagaataaggttgtgcaggatctggattaaaaaaaagaataaggaagaagttttatgggacctaaatttcacgtcaacagccctttgaatctctggctctacgaggaatgcaactaatccagggaatgcctttctttgaagatgttttatgccactgtgaccccagaggaaagatagcaaattatttggactctgatgcaaaaggcatataatctgtatcctgctggttctggttcttactaataaatagttaaaatgaaaaaaaaaaaaa

SEQ ID NO: 11591 - DNA, 996 bp, Homo sapiens
  misc_feature (1)...(996): n = A,T,C or G
cccgtcaaataacatatggcagaacaggcgacgcgaacgacgttctatggtacacttcgggaaccccatccggtacccctccgaagttgtacaggcccagagtaggaacttgggctgcatcaatgctgaaggaaaggaacacatctccatgaattcgcgtcccctccagcaagagaccctgttcagccggaggaaacaccaaagctgctctgacactctccaaccggagacggcgctgatgactggtggctgaatactgcagcgaacttgtcattacaccatgtgcatgaacaaaggtattttcaatccattctttacctccgagacattccaggagttacactctctgctattataccacaatattattatactaccgacccgcgacggccgcgctcgcgctactgatcgcacgtacgacgacgtacccccggatagataacatacctcccacgccaccatcgcgctacccgcccacaacaacacccacttctacaccttgagtcaccaatgcgtgcgccctgaccgccgcaagcgacaagaacaggggcgcgaacgccccgacaccccctttaataacacagaacccaacgacgtctcaattaacagcgatccgcctcaccacagcgactttgcactattaatagttttatcacacgatcacacgacaccccgcccacccctggacctttccgcgacaccgacgttagtcccgcaaacacctcataatcagcagtctctgatcactggtattgccgtatggtatgccgctcgctttttctcccttgcgtcacacccggactagaccttatagagctcgttaggcgaggcgaagcaacaccaaccaagtctttctgttgattatatgatagccgatcgatatcaacgtacccatagcactagatacatagccggccaacgcgtatcggcgactataccacctgtccagtaagcaatccacctatgagcatgtcangtgtggtcttacgagataag

SEQ ID NO: 11592 - DNA, 698 bp, Homo sapiens
cggggtctcttcccctcgcaggcttgtgaaactccccaggggcacaagagggcggcctcaccagtcacaccgggcccacgggtcgccgtggcccgattcggcgagaacgattctttgtgtgcccacgaaggtactggagtgggttgtccacgccgtccagaatgcgtactccgggccggctccacccgcggccctgtctcgcccgcgtctatggcgaggccggtccatccagctccccggtccgtgggccgggtgcgtttagcccgggcgggggtgccgccttcgggttctcgcagtgccccgtggagagacccaccctgggatatccggtccctccccgtccaaaccggcctcgtgcggagcgtctcagtgcgcctctcgttttccccgccgtgcacaaggcgggtgttaattttgccggctcgagcatcgctctcctgcccccgccaagaccggggctggagtactacgactcggtaaagggcggagtactttatacgccctcagcgggttttctcctccggacttgtgttgacctctaatccctgccctatttccgggttgtttggcctcccacgcttggggccatcccctggatcatggcgaacttcctttagctggctatgccttttagatggtcctgcatctttctacgcagagaactttatttggtaacaatcctgttcttgaaggaaact

SEQ ID NO: 11593 - DNA, 1769 bp, Homo sapiens
  misc_feature (1)...(1769): n = A,T,C or G
atgatacactgagatacattataatctanagtactatgcgacgccgcgctcacagtgnacagcgncctgctcatctantcgcgagcgtatcaactcatcnagtcnccgcgntgctgcactcgacactagcgagtctcgactgtcaggtgtctttgagttcgcatatatgagtatcgtactatctaatancgacgcaagctaccgtgacacaagacgcacaatacccttcgttcagcgtaatagagataaagatctcgcgctgatatcgcacataatatatatatcgagtgttcttattatatcatgtcacggtgttgagcgcatttcgttgattctccgtcttcnctccaaccacaccctaccgccgcgcggcatcggcgtgacgantatctctcnttgcgagccgacggcaggctcagaggaccatcgtgtcgcgatcagtgtctgcatgatatatcatacttatatttctgcatatcgtatgatcactagtacattagatacgccatcgtctgctccttcatatcgcaacactgacgttcaatacatagtcttcgacctacatagctgngcttccgcgatatatgagacatatacactatgcgaggtgcgtacggcggggactagtacgctatgcnagttcagcnctcctagcngtcacactgtttcgtgtnatctgacgncatacgcaggcggaganatcactgtgatctacagcangcgcgcgagccgcgcgtatggatagtcgtgcgtgngctgcgcaatgaagngtgcgtgctagacatgacaagacgagcgcgcgcgatacgtgcgnagtatacacgcacgacgcagctcgtgtctcgcgctgcacgagacacgcgtatccacgagatgtangtatacatgtagaacganangncagatacgaatatgctgagcagtanggcgtaatgagcagtacactnatgacgcatgangacaatcgactacgacgtaanctacantactacagacgatccgattagatagtagcgtgctatgctcgtgagaccggagtgtacgcacgtctgtcgcggcgagcgctgtncgcgacntatacanctcgccgcactgtctcacgtcatctgctactacccacgtcgacgcacatcgtatcgnagtgcgtcgtagtggctctntgcgtgtatgaagcgcgctcgctagacactgttcggagcgtacgtgctcgtctatcgctcagtcacccgtacgcagctagacgcgatcgcgctcgaggtgacgctcagcgatgtcncagatacgctagtncngaagacagcgtctcgcntcgcagtgtactatacctcttactgaggctcaatnacaccacacggcaccacacatctcactcttgcaatacgtcgcgaaatcgcgcgaaggacttgaatcgtgtctagacgatgcgctgacttccgctcggtctgcatggctcgtcgcgcgctcgcccgtctatcagtacgcccactcgcagcatagccgctccgtcacactgccttctcgtgtcacttatctcctctatccttgtactacatatacatttacgtcacggactcgtccataccactatcagatcctatcgcgtcgatgatatggacctcctcttctatgagctccctaaacatatctatcagagctactcgtctcgccgtaccgcaatatatacaacccacactcctctcacacggcgtacttgctgtatctatcatctattactaacacactcgtgtcgtctcatatcactagctctg

SEQ ID NO: 11594 - DNA, 1210 bp, Homo sapiens
  misc_feature (1)...(1210): n = A,T,C or G
gtgggcggtcgcggcgccgtgcgtcgtgtggtcggcgtcggcggtggggggtcgccgggtcgggggcgtcctttgccgtgggcggcgtgcggcncgcgtggcgcggtgtgtgtggtgtctgtggtgatcgctcgtggtgcgtatggggcgtcggctgtgcgcgcggtgtggcgcggtccggcggcggtgctgtggtgcgggcggcggtcgtgttcggcggcnggtcggcgggccgctccgcgtccgcgtcgtctgcagtggtgtcgcggcgcgttctttgctccgctctcgcgcggcggtctgcgggccgcgtgcgtgggcctgctcggcctgcccttacggcttcgctttcttctccctctctctcctggctgctactgtcgcctttcttctcctctcctttcgtgctcctttctggcgtgtcgtggctcctcttcacgccttccccctgcttctctctccncgccctccgtcttcgtcccttcntttctcctctcttcttcccgcttttctacnccgctctctccgcttctctcgccgcttctcggtcttcccttcgcatgtgctctggtcttcgcctctctctgtcgttgtgtgtctntttcatgtttcgtggtttgggtgtttttattctgctgtctcgggtggtggcgggctgggcgcgggtggccttgggcgtggctgtcgcctggtcgtccggtgtttccgcctcggttgtgggtttgtcgcgcctctcgcttgtgtgtgtgtgtcggctgctgtggctctcgctttctttcnccntgtttttantgtncttctctttgcttcttcgtttcctttggctttgcgggggcctgctttcggtttttttcgcgtttcgtgtttctgttgtctttgtcgctctgtgtcgttctggctcggtgggtgtcgtgtgtgtgtcgtgcgctgcgcgcgtgtgtgtgtggggctgtctgcgtgtccggcggcgtgtgtgtgctgggggggcttgggcctgtggggtgttgcggcngggtcgcgcgcgaaagcggggtgtttgtgcgctgtgtngttctctgcttcgttgggcctgttggttggcccggcgcngaagaggcttctgtnnttnncntgtttctccgccgcaagctcttttcctttttctcttctctctcttctctccctccantccttcccacctctttctnntnttctttttttatactttctt

SEQ ID NO: 11595 - DNA, 929 bp, Homo sapiens
  misc_feature (1)...(929): n = A,T,C or G
cgatgcttacggatacaccaattatttacagtcgcccgcctcaacaggcaacccattggtttcaattgaaatcttactcagaatcccaatctattaaagagtggagctgtcctccttgaagcagagaatggaagggtcaagggtctcaccaccgaccctcctcatcattcactacagggcacccagaacactccctgaaaaactgccgctttatgagattgttgcttttcatgtgacaagaagaaaagcatgtgataatttgattatgttgatttctacaagagggatgataatcaccattttacagatgcagaaactgaggtccaaagaggtgaagtgataagccccaggctcatgaaagatggttagtgaagaagtcaaggactagaagccaggtcttctacctcttacacgagctaggatgctactggtctctggccctgcagctccatcggaacttgtcttgcggctgaacaccagggactctcgaagagagctgagtttgggttgacaacaacgctattgaaaatggagggtcgcagtacccacccgcccggctgatagctcacaagtaagtcgaatagactacgcgccagccaaccatatcaacagtcaactcacatcatacagtgaaaaatcgcaagtaaccacaccggacccactccctcctcgccccaccgttgtataaccgcgcgcaacccagtcaggtcatcttattaggagggggagaatgacgcctcgtcctaatttaataagtnctaccgccccgatttatgacttctgatttgactacacacgggggacgaccaaggctccctcgtagtagggatctcccagaaatcctcgcatccagcctgataccgcacaccctatacagccattatgatggaaccatagctccacgcacgaaacactaaacagtccctccc

SEQ ID NO: 11596 - DNA, 741 bp, Homo sapiens
atgggttttcccccctatatgacgcgtggtttttgtgtaccgggtttcgtcgaaggttccggggggggcaaaaacccggggggggggattaacctcccctatggggggcgggcgaggcccccgtttttcaaggaatttttccccgggccgcccctcttttaggagggggggggtccccctcttaacaaaaaaaaggaagggtaaggggttttccccccccccccctcttttttttatagaggggggcccgcgccccccccctaaaaaaacccccctttttgggggggtggtttttccttgcccaaaaaaaaagcccgggggaatttttttttttttttttttccccaaggggggggatttcccccttttccaaaggcgaaaactgggggcccaagggggggggttttacccccccgggccctaaaaatgggtttttggaaaattcaggggtttaaacccggtttttttccttttttcccaaaaagggggggtttgggttttgggcccccccccccccccgggggtttttttgggggggcccccccgggcttttgtaaaaaaaggtgttttggggtttatttacccccggggaaaggggaaaaaaaaaaaaaaaaaaaaaaaaaaaaaaaaaaaaaaaaaggaaaaaaaaaaaaaaaaaaaaaaaaaaagaaaaaaaaaaaaaaaaaaaaaaaaaaaaaaaaaaaaaaaaaaaaaaaaaaaaaagaaaaaaaaaaaaaaaaa

SEQ ID NO: 11597 - DNA, 886 bp, Homo sapiens
  misc_feature (1)...(886): n = A,T,C or G
gagaatgcacctgcgcctgctcaggggacatttggcaatgtctggagatgggtattgactgccatgacttgtggcggaggcgatgcttctggtatctagtgaatagagggcagcgatgctgctaaacaccctgcaatgctcggggcagagcctccacaacaaagaatcatccagcccaaaatgccaataatgccgaggctgaggaagcctggtttccacaaacatctaagaaataaatatcacataaaaacctcattcatttgaaaagaaggaaagaattacaaaatggcttgcctaggtgtactaatattgtaaaattttataagttgcacgcttgtttttgcattcctcttccacatcaagaactctattgggtcactgaattcactggtaaatntactaagaacatcttcaaaagttcttcactccttccttcttttccttctgaagctattactgcaggtcttggtattatcattattagaccgccataatatacttttaatcacccatttgtgcttccatgttcacagaacactattccgtgttgtaacaaagccacttgttaaaccagtccaaatacaatgatgtgattccacaaaaaaaaaaaatggccctcgtgccctcaacgcggagctttggggccgttccttatgggggttattatgatcctcgtactgattcctggctcgcgcgtcggtgcggcaacggatcacctactcaaaggggaatccggttttcacagataagggatacccgcggagaacttggggcacaaggcaccataggcacaaccgaaaaggccgttgtggggttaccaaggctccgccctgaaagattacatattaccgtacaacaagtgggacacccacgaataaaaaacaag

SEQ ID NO: 11598 - DNA, 900 bp, Homo sapiens
  misc_feature (1)...(900): n = A,T,C or G
agaggtcacaacccaggaataaaaaagggttctgggtcaccgagcgcancgtttggcngnnagacanaacaacggaaagaaccaaggggccgagacacttccggggaaagaaaagcccaagggcaagacgccacngcagcggcccctccaaagcggacgcggccaaacgcacaccccgagcaagacacgaccgcacagggaggcaaagggcacacaggacaaacaccagaacaacgccaaaaagccccgaggcattttctaatagacacaactaaacacacactgaccccatcaagagcgagccacaacccacacggaaggcccaggaaacacacngcccgacccgcgcgaacacgcgaagaaagacgccagccggcggcccagagacccccctaccctgcacgaagaaaaagcacgacccacaccaaaccaccccacccggcaaaccgggcaaaagcccagcaaccaanaaaacgaaacaaaaaccagaaaccgcacagcacgcgaccccggcggcgcccggcgaccccccccacaaaccgagggaaaagcacgaaccaaggacactgccgccccgcacaaggagcccgcgccgagagaaccgacgccccgccccaaaaggcggaacaacggccccccaaacaaccagcgaaaaacaccagaacaaacaccccaacccaagcgagcaacaacgccggcaaccgaacaacgccccaccacaccaaaaacacaaccccaccacccccacanaacaacacaaacgccaaccccacccccacgccggaacaccccaagacacaaacaacacccccgcacactcgaagcagcccaccaacccgataccaccctccgcgtagaaggaacgtccacttacctcataggaacgggacggaaacagag

SEQ ID NO: 11599 - DNA, 1605 bp, Homo sapiens
  misc_feature (1)...(1605): n = A,T,C or G
acctctgtctctcgcgtgtcttctggcctcttaccgngctggccgctgtccgctgtctcgcgcgagagtcgcgcgtggtctgtctctcttgcggcgtcttgctgcgctcgangctcgcgtcgtcgtcgtcgtcgtggtctacggtcgtgngcgcgtcgctcgcgcccacgtgtccgcgctcacgctctnacncgcgttcgcggcgcgtcgctctgtctcgctcgcgcgcgtcgtctgtggcgcgcccgctgncgtctgtctcgcgctcgtctgtacatcgtgtgtgctgcgtgcgtgctcgcgcgctgtatcgctgttgtcttgtcgttcgntcgctgtgccgtctgncgcgtgtctccgtacgccctgcggcgtgctcgttgatcgcgcgtgtctcgcgccgtncggctctctcgtntgtgctcgcgtcgctcngtgctagncgctcgcgcgtctcgcgttcttctcctgtctgtgnctccttggtgtcgcngctctgctcgcggncgtcgcgcgtctcgctgcttccgctcgtatcgtctgctgtccgctgttgctgcgcgctcgtcctccgcactntgcgcttctgttcgatctcttgcgcgtcctctctgcgctctcttctgtcttcgtcttctttctcgctatgtgctctctcctcttctcccttcggctcgctgcctactccgcgcctctctcgccttctcgtcccgtcctgtccgcttgtcctcctcgcctctgccgtcgcctctccttgctgtctgcgctcgtcgctgtgtcggtcgcgcgcgtctacttctgccgcgtgctctctgctcgctggtggcgtgctgntngnctgcgtgggcgttgttgcgtatggcgtgtgctngtgttgcgccgcgccggcgcggcgcggnggctctgctttntctggctagcctcgcgctgggtatgctgctctggctctcatgtcttctctgctctgtcgtgtgtgcttgtgtctgctggctcttcgtccgagtgtgcctatctctctcgctccgtcccgttctgtgctggcgccgtccctcgtctctcgtttgtgtcgctcgtttgtgtggcggggagacgtttttcgtgtttcgtgttcgttttctcctcgtctgggctctcggcgtctgtggtgcgcgcgtcggctcggcgcgcggcgcctcttctgtttgttgtccggcgctgcgggtgtcgctcgtctgtgttctnttcttctcgtgtcttctctcttcttgctggccgcgcttgttcggtttcctgtccctttcgcgctgtctcgtgcctgcgcgcggtcgccccctcccccccgtcctcctctcccgtgtgtgtttcncgcgtntctgcccttcgcgccaagaggtcgctcttcgtctctcttcgccgcttcccttcgcgttcgtcgtgtncgctctctcggtgtgtttcgtgcgccctctctgngacgccggttgtgctcttgtgtgtcttggttttcgctccttcttcaggggntgcntctntctctctnctttcntctctcttctatcnccctnacgcnccacnancccactcctnttatctctnttcttcnncnncnntcttctnctcttcttc

SEQ ID NO: 11600 - DNA, 176 bp, Homo sapiens
ctagaatgacagcagggatgtctgcacaccgtaaataggaagaatttcaaaatgatttctacagtatcagaaaaccagttgtattttcctgtgtatttttttcattacatgttctatcttcttaaatattttgaatagaaacttaacagtttttattgccttgaaaaaaaaaaaaa

SEQ ID NO: 11601 - DNA, 1005 bp, Homo sapiens
  misc_feature (1)...(1005): n = A,T,C or G
tgtacatattcatcctcagaaaaaggaaagaagcctcatggtaactggggaaccccaattggaacccnaaacaaggaggacaggcccagtgaaggaacttgggctgtcttctttgcttaggaaaggtagacaaacccacgaacnccgggcccagccagcaagataccttggttgtccggaggaagcacctacgctgctctgtatctttccagatggataatgcgctaggtgactgttggctgaacctgcggtaccgcttgccatacaccttgtgcagcaagaggtgcatattccactcggcctggaacaagctcgttctaaatgccacctccttacccagtgcttctgcaacaagtccatgtcatgaccgccagtcccctacagccaaacaggactctcaataagacctgcgcgggcggcaacattatacataggcattgtatgcatgtatggactattctttatagtccgatactcagcccgagccgcgaactacaatattaccgactgcttttcgaataaaggctcatattagtttccactttatgacaatagcaggacatctttgcctcgcctctatattctacgcaatactggtatgtcgaatatgtgttccgtggcnccttctattatcttcttncctcttcttcacttccactatacataccgatgctcactcagttggtgtggtgagtcccttcaaatcatcccacaatgttattgttattatatagttttatatttttctagttgacaccgtcgcctcccagcagtattggttacaccgcatacaattgcgtctgttagagcgacaaactgttgctcantcctcttaatagtttgttctcgccccgccccacctcgtcacgatttcctaaggctctagcgcttaccgtgttctactcgggttatctctgctactgtctccaccccatccattgttctacacctctatcagcgccgactattgcggttgttgagnaatggtgcggctttgtggatcag

SEQ ID NO: 11602 - DNA, 1513 bp, Homo sapiens
  misc_feature (1)...(1513): n = A,T,C or G
gggcacgtggtgctacgcatctccgtatcagaccgtagctgaatgtacacgatagcgagagcaactcatgagcgtggcgatatgactgaacaacgatcatgtaagtataattgagttgtngttatggttggcacagagangcaagcactactcctaggtcgtaggcattgatacggtgcgagcggattgaactnacgaggagtggnggtagttgtgcgagcgaagagggggaacaatagagcgagactagcatgagtaagatagaaatactttatgataattcgttaaacactcagcaactactaactnttcgataganggtggagggcgnacgtggctgcgcatggtggtgcgttcgtatgtgcgtgaacgacaatacggtatagtgcgttcgagatatctcttacaatcggtgactactcgcaagacataatcataatatatgtaatatantacaatcatactaattacacacacgcacgcataacgtactcttaccgtaaatcatctttaacttantcatctcactctctatagacatctatctctacctctcctattccgcaactctcgcactctcatcacacacttccacttattaacagatactgnaactactactataacgctaatcaacaaattaatcgtcacactatattgagatcagtatagaagaattattataaagtattgtagtgtacatataacagaagacgtgattcacgcgtcgctggagtcgtagatgctgatagtacactgacggcgcggagcgcgcactacgggagagatgtcgcgcggaggcccaggngccgtgcacntcgtgtcgaagctgctctctggcgcggcgtcgggacatgtagacgtgggtaccgggtatactcctgtgtagtgtgtcgcatcatattaagtctgatcggntcgtgnttaatcaacgcttcttcactacaactaactttcacacatntacccatccttatacacatctataacctaccacatatccacacccgtgcattagactttccatacgctttnatctcctactcgtgatgtgatgctgccgacgctctatcggcgcagccgctaaatcgcgtaagggcacggccgcgcagcagccggcgcagcgcgcgcgcgcgcgcagtgcggcacggcactgatatgcacatgccacgcactcgtcatcagggctgatctcagtccacacctctatctgcncacacaactggactcgcagctagcacacgcgcatctcgtcacaaaggcagccgtgagnggaggcaacacgcgtattacacacaactacacacatgacanaaaataacgtcgcnctatacttctactctcaaagactgtcttantctntactttanntantanttttcnnnncaactacataactcaanttccttactcctnnactcttctctctcncacttntcctctcncctactcctaccatcttntccttntcttctctcnttatnctctntctcntnctnnactttctctccat

SEQ ID NO: 11603 - DNA, 902 bp, Homo sapiens
  misc_feature (1)...(902): n = A,T,C or G
ggcgataaggtataccagccacgcagaaggctgaggaccgggatgcagtttcaggcgaagggagcacacccgtccgcaccagcgagaaggacaaaatcaccaccaggacactgaaggcccgaagggactaacccagcacccagagcccactttcttgtcagcccgcgaaacaaaaaagcccgtcgctcactcctaaaaaaagaaaaaaaaccctcccccgaaaaaggcngaaaacaaccaaaaaagcccacaggccgccgaaggcccaaccgcggaggagcaccagaggcgcacacccatgaaacagaggccaaggcgcgagacccaagacgagaaaacccgcgggcgcacccccgacgaggggggggcaccgggaccaccgcaacgccaggacacacagccgccgcgacccccggccggggaaaaggaccgacgagaaaaacagggggcggagaacgccgcaccgagccaagaggccgcaaacaagacccagaaacccgggcgccccccggacggccccccccgcaaaccgcaaaacaggagcgagaggggcacaggggccgggcgcgcccccccaaggacggnaaccaacccaacacccccccccggcaagcgcgcccagcccaccgcgggaccccacgccgcaaaaaaccccccacgaaaggccgggcggccacgcaagagccccccaccagccaacgcaccccggaccaacggcaacccacggaacgcggccccccaccaagccccgcgaacaaacgcccgccaccccaccggggcaccgacgcgcggccacccagaaagaccaccaagccacgcccacgccaccgccccgacgggccccgccgcacacaaccacccccgccgccccccccccaacggccaaaacccgagacaacgaa

SEQ ID NO: 11604 - DNA, 729 bp, Homo sapiens
gcagtcacctgcacaggacggattgagggggctctagggtgcataaatacctgttgcacgttgacctatgggcggagggtagaccagtgctgattcacggggcgtcgaggggcaggccccgcggtaaacgccggagggtttgcggtaggggggttgccgggaaacgcgcccccgcgtactcgctgggtgtttattctcgcggtccgcccctgtgccggtacaaccatcgtgccgtgcccgatgggacgcgtgcgagagcgttcggagctgccggggttaatttagtctgactcccattgggaaaacaggcttgtgtggtaccacgaggtctcggcccccaggaagccccgcgtggtggcgtccccttgccccccgaaggtgtttgcccccgcccgtgatcccggcgcttttgtttcagccacttctggcaatgggcgggtaacaagcttgactagggccggctttgtccaaccctgagtggggccgggggatcctggggtactggcgtgaccgttcctttcagccccctgtttgtctcggggaggggcctcctgttcccggtggggtgttccggggcttatgatctttatggccaaaatcaccaggctcacaattttgtctgtaagccatgtaaccccgttcccgaagccttaattcttttctctttaattaatgaaaaatccggtgtgtgccatcgtaacaaaaagacaaaaaagagaaattcatgag

SEQ ID NO: 11605 - DNA, 1060 bp, Homo sapiens
  misc_feature (1)...(1060): n = A,T,C or G
gacgcgggaagggtggtgcagcgggtggaggaccaacgctgaagaacaggaggcgggcggtgccggggatacccggacaacgtgcgagcatcactctttataaggctcaaatctttttaattcgatataactcggcgcgtgaatatgttcaggtgtgtgatgccgtgtggggcgttctggtgcggtgtggaagactattctgggctgggatggtggtagaggcagttaaccccggccgcgaccacaatatagaagctggcctttcattatttttagactttagtctcgtgtgggtggtcgtgagtgcggagggtagtgtaatgtgcgcttgttcgtgtattgattcggcgaccccctgtagggtgtgagacagggacgtaggcttatgacccggggtgcgtgatttgtgtccaatagcaggtcaaggtggagaggtgcggtgttatatgaccaaggcaatagtggtttccccacaccgtagtatgtggtgcggaattcaggtgatatttgacgtccgtttcacggaacgcacacgggtgttgaattctttttacacgtggcgccggcttttgttgcgcgccttaatttgagctgttgagagatactctgtgtaattctggggggtgtagtaaaatcctctccaaccggtagatgtatagtaaaggagtgcgcgtcccctccatgttcgcgctatgaggggcgattgcgcactcgtgcctctaactactcggtaagaggcgagaaatagtcccatagcgattcttatgtatttgaggtgctgggtatgaccactgttaacctctcttcgccgctggagacaattcagtagcttttcgttttcaagtataagtaagaaaatcccggggctgtgctaccgcggtaacgataatgaagaaagaaacaaaaagataatatactaaaaatataaaataagaaataaaaaaagaagaaaantatggcccctcggttgggccctactagcgagtggcagatggtagcagcgccagatgatatattattacattagataagataatataatacatatgagtcgcattat

SEQ ID NO: 11606 - DNA, 1237 bp, Homo sapiens
  misc_feature (1)...(1237): n = A,T,C or G
gcgggggcccgcagccgaaggtctaaaaaaaaaggaaactagctggaagactctctgatttttccgctgcagctgattctcggagggaaaccaatagacagaaacccagtggcgagccaaaggaaaaaaccacccaaacgagaaggagtaccgaccccccgggccaacatagaaagcacgagccaaaaaaaaaaccggcccgcaaaaaaggggaagacagggcgcgtgcagagcgacgacaatagcgagatcaattatatcatgccctttttctcaccccgcggaatgcccgccctatttctacgcaagcaaaccggagtagaagcccgacgagcacacactaggatccgcagcaacgaccgnatgcgagcgatagagtaagcacccgacgacgccggctaacatagggatatacaagtacacctacacaggcagtccccagcacagcagtatataacggcgcaaacataaaatcccgacatgtaaacggngtactcgtaaccgcaccgatatcgcgccgaggcgcgccttaggcgcgccgtcgtgtagcgtcgcagaccatcgcaccacgcgctgcgagagtagtctactgcacgcatatcgacacgcgcatcccacacataatcacgagcacacgtcgctcgacgtatcggcgcatatcacgcgacgggtgaccaagcggcgcaagtaccgagcgcgcgacgctgcatcgtaggccgacgtcacccgacataganttcgatcagtgtcgatgcgacacacacgcagcagatgcgatagtacgctggcacgagctagatatccacccgcacaccgcctatcgtncatcaccacaattacacacaatctacgagaagccgcggtccacacggccgaccccattagacaatcgagcgcaactataaatcagacacagcgtaacacagacgcgtatacncagcacacaggtagcgacgtctctataacgatacacgcagccacatgacaaatgcagagcnacaacgactcatatatcgatacgacgancatagcccagtagcactnaacccagtacgcgaatatcgatatcgatgtaccggacaagataacacacaccgcgcgcancgcgcacggacacgcaaatgcanagtccaggggcgaatatncgacgagtanagaatgacacgacgtaccgctccgaagcatgagtgatacggcatcggtggatatangaacgatntngagtcagtggccggag

SEQ ID NO: 11607 - DNA, 530 bp, Homo sapiens
tgagccttataacttgccatcagtggaatattccccagtgtccgttactggctacacctgtttgcagcatagcctgaactgccctgctggagcactttcgcccacaactctcccactgccccaccagaatgctgttgccagtggccactgccagagttctttcactggcagcccccaccatcctgccagagcacttttgcggacaggcccctgccagagcactttggcccgcagccttccaaagaccctgttggagtgtattcacctgccccatggagcactcttgccagtgtctcctgatggaacactatttccagcagacagaaagcacctcagcccttgtccttcagcacagccagtgctcaatcttgaggggtcagagaaccaaagctgtgggcccactactaagccctagtgttagagtacacaggccaggaataccgagcctgacctcaaccccctgtaagcatccagaatgaagccaattagtgaaacataaattattcgcgcaggcaatcctcaggggcaaa

SEQ ID NO: 11608 - DNA, 567 bp, Homo sapiens
  misc_feature (1)...(567): n = A,T,C or G
cccntattttnccctggtntncaaaataacnccaggngggttaagttttaatgtaaaacttccaactaaaaaagccngaanaaattntcccatatgcccttnttgcagcggccttggtgaagaatttctggctaaatttccaaaagcaaaatgctataaaaacaaaaaatcgccnagtgaaacctaactaaagagcttntgcncagccagattaactatccncagaataaacngatggccnncaaagtgggaggncatatttgcccnctatgcttntaagagaggttttatatccagagtctacaagggacttnaacaaagcaacnagcgaaaacccaataacctcnttaaaaaatagggaaagaatatggacngacccttntcaaaagnaacatgnaagnagcccnccaacataaaaaagatccgtatttctaagcatcagagaaatgnaaatctnaactacacagagataccntttcncnccnntcnggaatagggtctattnnaaagtccaaaaataattaaccccgatgcggccgcccccgcggggngtccagcttttgttcc

SEQ ID NO: 11609 - DNA, 543 bp, Homo sapiens
  misc_feature (1)...(543): n = A,T,C or G
ccaacaagttttgnaantttaangttgcaagggnctntttttaaattaaancnccgcnnccagncattggnttccnctggcagggcccccatcacnaaagcaagccntaagaatgcatntccagggctcctgtttgaaatccctnacacanaaagnacgnactctctatntgagtatccctgcagggcagatgtgaaacctggaactactgtaaccgctttgccaatgaacgaaaacagcctttgaagatgccnagacatagaaaagggaatgttagagaaatggagctgcagcttttggattaanccaaccctgatgctcncctatctctggaatcnccgtttatggctatgaagnacctccngctcatgagaaaaatgagatggaagatctggaagtatatcgaggggnctatctttgggagttttggtgaagtacaggaaagacaatgttcacattttatacttctgtattaacattaggtgtttttacaaccagactatgttattttactttttcgtttaaatttttttaaaattaaat

SEQ ID NO: 11610 - DNA, 772 bp, Homo sapiens
ccagaattcattggtccaggaatcaaggggtggaagtgaaagtggcaccactcagcaaaacccctagtgatccactagcaaaatttttgcttcctgttcctgtgacattacattctgctggcctagaggtcttacttccagagggaggaatcctgccaccaggagacataacaacaattccattaaactggattctaatatggccacctggacactctgggctcctcctacctttaagtcaacaggctaagaagagagttacagtgttggctggggtaattgatgaggactatcaagatgaaatcagtccactattccacaatggatgtaaggaagagtatgcatggaatgcaggagatccactagggcatctcttagtattactatgccctgtgattaaggtcaatgggaaactacaacagcccaatccaggcaggactacaaatggcccagacccctcaggaatgaaggtttgggtcattccaccaggaaaaaaactacatcctgctgaggtgcttgctgaaagcaaagggaatacagaatgggcagtaaaagaaggttgtcatcaataccagctatgaccacgtgaccagctgcaggaatggggactgcgattgtcatgagtatttactccttttgccaaaacatgtttgggcatgtatatgcatgtactaaaaaaatccttattttgttttttttgccttatcatgggacggaagatcattgattttatatcagctttaagatgggtaccttatgaataggattggct

SEQ ID NO: 11611 - DNA, 554 bp, Homo sapiens
  misc_feature (1)...(554): n = A,T,C or G
annntaaggggggggccttcntttttgaaaaantaaaatttggggnagaattttttaangntttggtaagancctggggaantttttggtcnttttgtttaaattttgggaaaaattctccanaanttatctccttnaaaaatttccctctgggttccattctcnnatctttttctttnntctggaatccaaaatgcatatgnttagttattttaatantgctangcagcttttggcagctnttattnttttttaaaactcttttggctctttacattccagtttaaataatatttactgatctatttttttatttgncaaatatttagtgagcccctaacatatagcaagaactataactttcatcctctgnataaggattacnaccntgtatagaacagatataatttcatttccatggnaggtacttttcagntgagaaatgaaaagcnatacnaccaattaaaaaatatatagnctggtgnaccaaataaaggaaagaaaccaaagactctttctaatgctaagaagaattaataaaaaatgagcaaaat

SEQ ID NO: 11612 - DNA, 647 bp, Homo sapiens
  misc_feature (1)...(647): n = A,T,C or G
angtctnngangactcataattnaccaccgntntctgganggctctggaganangaancaatatnatcctagtgtgctggatgnanccnctnccntnaccgggatngatggnntccctgcatnggnccttgcacgantnntaaccatcctgnanatngaccatatcatagaatncctcntctcaaccaantggagaggttnaatacggcctctnatgccttatatgaggtgncatgcnatgtaagcccntgctgcagaacttcatttatttatggcnagaataatnnntgcgtgttgcgcgatataccanattgtggcncnttcnttcnttgattggggggatcccgnattgcttccccctcacactctggggttgtgctannttaccatnntgaaccccaanngaggctnattntnancngggncataanactggntttattgnactactacctgtggntgcagtcnntgcatnttggnatctttgagcaccaagcngncncnaaggaactnncctttnnncacgggtnctntcttntgaaaaaaaaaaccttnacnaatgagggngtgggtcanaccacccgganaattggcccntacctgaaaaggcgccatcttanncagcagcttaanantttaactggcat

SEQ ID NO: 11613 - DNA, 1636 bp, Homo sapiens
  misc_feature (1)...(1636): n = A,T,C or G
tctagggcntttattcatcgtgagtacagggtcggcaatgcgggtagcatgctagtaacaatggcattattacatcacatgagatccactattctggctngtgtcacgcgagccacgcgcatagatcacatgctcgatgcagcttgccttgaacgggtgcagctgatctcacagngctttacaanatgagcttgtggtagaaatggntccatggtatgctacgacacctcttgatgatactcacttcttgggatgtactattacatgtaacatgcggttgtcaatattctccttatcattcttgttataagcatcgtttgattagcgcgaccatgccgatgagttgtagtcttttataaaccctttaatacaacttggatataaatattgtggttctcttttngggctctttattctgttgtgtggaggcttcatggacgtgttccgtntctcgccctnggtacatngggcgggagtgganaatagacgntgagagatattctgcattcaccttgtagctacgcgttgacggccttctggtaccgttgtctgggcgtcgcagtggcgaacgccaggataatccntagcatacgacatgcggacagtggcgaggtcatatttaccgtgtgnttattgcgacatctacgcaaatctctgcggggagtcatcataacccgcganagcgggaacacagcaaactcaatcagtgcgcagagctcnacganaaggggctncacnatcgattatacgantggtcgtcaactgtgaganacccgcagcgntaacacataggcgagcccccngatccgctgctggcanttaggcgacagtattatatnagctcacatatatagaggcgctccatcgccgcgccgcacactgctgganctcaatgtctggtctatacnacatnagagatctatcgtaacgcgcctgtcacacgnctctagagaagggtgtgcgggtgtgacacaaacacgtcgcgnacgagcggcggcctgtagtttntaagtaatgtataccctacngngncgagtgtnttncagcgctctgttggcaagagacactccccgctcctgacgcgacgctctctntncactgtgctgcgccncgannangctcggcgctcgtctataagacggcgtgatcgcacaacgctcnacgcgnagtgnctcactgtcgcgtgtgtacgaaggaaangntgacgtgcaggcgagcgtattactcgtgcatgacgctatgcgatgcgctgcttgcactagaggtcgctactctgagactatcgccggncgcncgcgacgcagcgagtgcagtgattncccgagcgccatcggggtgcttggtggnttgacgccncgntanacgtcagcccngctagtntactacgctccgtcnagcagacnctgtgacgctcgcgtctattgctgcgtgatgancagctatgngatggtgttgnagtgcatnnctancgangcantcnacatgatgagagactcgcatacngttctgcagtnncgcagtggncgtagctncgacgccagatttgagntagncagcgtgggtctanacataccgcagagcgagcggtagagncgtgacgacacgcngcgctntgacggacgtatcgnatgtcatg

SEQ ID NO: 11614 - DNA, 1189 bp, Homo sapiens
  misc_feature (1)...(1189): n = A,T,C or G
ctcgcttgcgtatttttttctctttgtctcgcgtctcgtggtgtgttgctggtttcgtggctgtgttctccctttcctcgcttccctctgctttgcttggtgctcttctcttctatgtgtggctctgtgcttttccgtgtgtttgtcggggtgtgtgtggggcttggtgcgtggtgggcggcttctgtctagtgtcggctgtgtcttcgtctcgcgtgtgcggccggctggctgtcgtcggctgctctctctcgcgtgctctcgctgctgcggttgcgccttcttctgtcgttgtgatcggtgtctgtccttctcttttgtttcgtcgttcgtcttcctctttctctgccgcgcctctcttctccttcccgcgtgcctgtctgttgttcggttgtctgctctgttctccgcgttgtctgtcccggcgttttcgtctctctgttcgtgcctgtctcgctctcctctgttttgcgttcttctgttgtctccttccttcgtcatgctctgcttgtgtggctgtctcctccgtccttgtgtgtttgcttgttcgctttgtggtgttggtgtccccgtcgcctgcgctggtgtggttggcgtgtcgggctgtgggggtggggtcgtggcgtgggggtgtgtgggtgttggtgttgtggtggtgcgtgtgttcgttctctctctgctnggccttctttctctgttctcgctgtgtctctttgctcttccgtctgtcggggtgttcggctcgcgggtgggttgttttcctctgttttctttttttttttcgtttttgttgttttgtttgtttttgctctttttgcgtctttgtgcgtgtccttcgggtgcgcgttgtttggcggccctctgcgcgtgtgggggttggttggggttgcggggctggctggtttgtgtccggtgtcgtggtgcgttgtcccttgtcttctgtcgttgggcgtgttgtggtcttttctgcctgttttttgtgggctggcgcngctgctcccgtttcaagggtcttgtttccttccctggtctcttctgtcgttgcctgtcgtgtgtttgtggtcgtgtggaaggctttttcaggtgttgtccggctctctaggatcttctttcgttttttattttctttgtcttctcttttctcttgctcntnntantnnntnatcannaaannctttttanattattt

SEQ ID NO: 11615 - DNA, 883 bp, Homo sapiens
ccctggagtttctctttatacatcgatatagtacctgcttctgggtctaccatctgagagatggatcagcccatgccagaaaagtgctgccaaatcatttcaactgtagacttcaattcatgcgatccacttcactttgctggcagaccgacccattgagtcagccccatcaacccactcgttactagagacctatgccaccgcgtcgcacacgcatttgctcacagcatcctgtgtacccgacttcgtaatagacttgggggcgggcccgagacccctgcgcggcgcctgccctccacgcgtgcgccctcccaccggactagatcacaattcacgcgacccccggcacgatacgacatggcgagcatccgatcgagcacacaccctactgtcttaggacgtcccgggaccacacgccgacgccccccgacacgccaggtagctctcgcccgcccccggcgccctagaactcccgcgcgcatcgacgcgcaccccacgcgctgcgccgatgatcacgcggcctatgtccgcgcgtgggccacgtgatctcgtccgctagccccactcgaccccagcgcgcccccgcggtcacattcccgacgcgcctcccaccgtaccgccgcacaacgccgccccgccgctcaggtcctgacgaacccgaaacggctcgccgcccccccctcctcgcgccgccccgaccgcattgaacgcgcggctcttccgcgcgcgcgttcgggcgccccgcgtacccacccaatggtcgcacacggttcagtgcgccccaaaccaatgcccatccagccctaattactgtggagtctcgccttatgatggcagcgtaacgaccggcgcgatgtctgtcaccaccgccgcgtcgcgccag

SEQ ID NO: 11616 - DNA, 280 bp, Homo sapiens
  misc_feature (1)...(280): n = A,T,C or G
ctcagtgcacctaattattgaacctcggagttcctggaggaaattccctggactgcatggggaagtgagcaacgatgagctgctccagaacacgtctaagttcctccagactgcctccagtgaggctggtgaagaatggaagaagagtgacagcttggccctgtggagcaagacagacataagaaactgcacgaattatggcttatatatnctacagaataaataaaattactgtaagacattgcaaataaagcattatgtggaatcaaaaaaaaaaaaa

SEQ ID NO: 11617 - DNA, 351 bp, Homo sapiens
tacctcccccacccacaacacccccaaccctttcagaagtcttctggagagacatactcgggttcgctgtttaatcatcagagacactcaggtgtacctggagacatgaagacatgataacagacacgtctataaacttcatcatcaaagctaccatcgaaattgcactcccaaccacgcacacactcgcccctgtcattagatctctcccacaatcatactctcctcacctcatactgcgtcggcaccttcagtcgagcccctcccgcctccctctgaacacctgccttatggatcacccgcccatcgtttcgccctcccccataatcccccaacaccagccccccacca

SEQ ID NO: 11618 - DNA, 834 bp, Homo sapiens
tttctatacactgggcacgatcgggttgtcagacctctgagatttaagggccctgcccctggatcatggtgaacttaccaaagcaaacccatgcctgcgagatggtcctgcagtagacaaccagcgaactcatttggcgacattactgttcttgatgtataactttatattactataaatacatcaaggacactctcaagttctggttctacaccaaaaaaaaaagatcagtacctcataggactcaccagacgacccctgctaccgaatacctttccagcgacttacaaaccgatcttccctacaccccctcactatcacaccccccaacccctaccccccccagcataagacaactccaccgcccacctcgcccgtacccaccctactgctagacatccgaacgaaacaacgataacaatgaaataaaacaagcaaaacgataccacacacagcgaccaccacatcctatccattacaaatctccatacccaccacattattataagaccgcactatcagtcgtataaagtcacgcccccctccccattaaccataaaccgccaaaataccgcaactcaattcgacgctacgtgccgcatgtactatatcaaccgatccactaccctctccccagccaaaatatacgcacctaccagaccattgcgtcacaccaatacaccacacccacgacaccaccctaacaataaccacattagtaccacactcccgacagacgaatcactaccgctcaataaaattactaaccattaccccacaaattacacacccaacaccacactcctattctcaaccgatcccgcaacaatatac

SEQ ID NO: 11619 - DNA, 402 bp, Homo sapiens
tttcagagcacccagctcaagatgttgttattctctgtaaagcatttgctaaccacacccattgggctgcacgtatgcgcttttccttgagggttcccattgcctatttctgttatggataccatggtagatacttctccttcgcatgtttaattactttggtaatttgcccacttggtatttgcataggctccagtggccaacacagccttcttttactgttcctacggcatgggagagactttcatccaccctcacctcaggaaatactctattttgagctggaaaaaaaaacgctgctgagcagaaccaccggagtcagttcttttcaggaaatagcaaaactgagcccgttgtatacttacttaaaataaagaaggctatacatcaaaaaaaaaaaaa

SEQ ID NO: 11620 - DNA, 1210 bp, Homo sapiens
  misc_feature (1)...(1210): n = A,T,C or G
catcaaacctactaangncacatatacaactccactaaatgtgnnnnacgaccatattcattgagcacaaataaatagtatgnnnggactctatccttactctgtntatccttnnactctacttgnattagctntggnctcagttgttcgtaatatatgtactgttatatacttgtgatagattcgtcacgagaatctgttggtgaaacctcgctatactggatagtgatgtacatgtcagtgggcgaagtgagnnnnnnacacactcttactcataggactattctcatagtgngcggtnggcgtgcggagtacgcgcggaagagcgggaagtagtatgagcggaggtggagaggagaggcgaccgtagctataccagcgcttgaataanagcgtntngnanagcgtctcctactcacagtaggacgcgatgttagacgaactcgtgcacttgtgcccctgctgcgagaatgatgttgagagataatgagcagagagagtactagagatganaggagagggagcgcagcgatgtaatgtaacatatgccgattggggtgnggcgggaggtgacagaggtgagtgagacgtgggggcatacgagagagtcgtccatcttacgtctagttgtcttaggatcgctagtctctgtatcgcgctgtcttctgnncttgatttcatttcctttctgtgattgatangccatccnactttacttgtnncttgagcagaatttatgcggcagtttcgttgtcctaattngatacactatcgtggtggggcgaacatgggncaatcaattnnaccttatgtttgcagtgaatatggttcgtactctcttgatttatttatacggtctcggcagtatagggggnccgcgagacacgggcccaaacagacactcaattaataactccagtgcatatatttaccataactggacgggttnattaactgantntgcttctcttttatcgctactatctgcacgtttactttcaaaacataacttttcatataaattaccaaagcagcgtnnnaactcattcntctccncttctcctactatctttttttattnnagtaactttcattctcattcaactcactaattctanacttcttttatacatacaacataacctcatnnttatatnccttcaatcatttctctnnnncctttcctccncccccttnccccccccccttt

SEQ ID NO: 11621 - DNA, 975 bp, Homo sapiens
tgatcctctaccccaattacaccacagccccaaagtcgtagctttccctccctatctggtgtgaatggaggagctatctagaacaatgcacattcatccataatacctttctgctagtcaccacgggccatgatgaatctgagtaggttatgaacagctaccgattccaggatttaactcatttgccgctcctaagtccctacctactttatactccacttgtgattctcacattaaagcgtcttaacaccttattctgcccacttcgctgattctgacatccagatggggtctcataagtctcctcctgacatctctatcctatcccgcttgcctctgcgtgcttaccgaacattccgtctgcccatgcctaaacgccaaccctcaaccccacaacgctctcgcctcctagttgaccacggagcgaccatcaccgacgcttatatacggaccaggaatcgacattttacaccacaacagcatcaccacaccccatccccctgcgccctcaccgcacgcagcagtccgactcctaccgaaccccctcccaccacccatgcatcgccgccaccaccatccgtcggcgctacacctcatcccccctatcggcgcacaagctaccaatgcaccacgccaccccctattgatataccgcgtacactctcaccgtccttatcgcgagcagagcacagtgacactagctaccacgatagcatcgcgcgcacagtctgattccacgacggcaccttcacctaatacatcactcaccccgtcccgcattgatgacttacgcctgagaggccggccacaacagctctacgcactcgttgaatcctcgacataaagtactacgaggcgcgaccgatattacctcttccaacccacctatcctataatttccaacgatatgatccggccctatctccaccgatattggtgacactaatgcagaacaaaatgcgcctcagcattgcg

SEQ ID NO: 11622 - DNA, 1240 bp, Homo sapiens
  misc_feature (1)...(1240): n = A,T,C or G
cagtggagccggttgacgagccgtgagatggagagggtntgctttgactgcgtggcatcgatgtctgtcgtgnggtctacaagaactacacacatcgaacacgctcctgcctctgatgcgaggcctgcggcatcaccaagaagtgtagacatctncgtcgccactcgatctcgcataangagacggtccatccgtatactaagaggtgangagatctcgacataacgataacgatnannnaatacactcttctcatantgactaactcctataaccnagacgcngnnacaaatacaatacatgatggcatnagcagcgcatgactatgctacaggttaagaactaatagtgcgcggcacacagtagactgatgtcgtatgngcgtagagggnggggtaatttatctgcgagtactagagggcgcgcgacgaatcgaagcgtgtgttgggcgacgatatacgataaatgatacgtatcgacttgtactctcgagacagacacggatggataggagagacggcactgcgatgtcgaacacggaggagaccgaagacagtgnnagtagagaaaacgcaaggacctagtacgtattagaccacgagaaggngcagctcgtaggtgagcgtctgttgggcttaggttgacttgtgtcgtggtttactcgtctgtnngattgtatgtcactgcttcatctacgccttgtgagcttggtttctgttangatgtgccgacactcgtgcgccgccgctcgccctctcttctccgcccactcgccgtgcgcaaaacaacatcacacactannnaactctgactagncgatctttcgtgtnttaagatatagatctgtcagagtacgcgcgagccatttagatggnaccaactggagaaataacacgacattcacgaaaacagaaattaattaataaatcatctcagatcccatctacaataactattatatgnncactgctcgtnagaactagaccatactgccaaccgaccgactaacaataaaaaaatacacaaaatataattaaatagttatgantnnctcacaccctcctattatctaataccacactacataaaacnatcaatncactcacctatacaatcaattataatcatatccancaaaataacattatcttacaattccatacataatccctaaancccctnatncctccaccactctaccctnnnnccctctcctnccccccccttnccccnccccccc

SEQ ID NO: 11623 - DNA, 936 bp, Homo sapiens
  misc_feature (1)...(936): n = A,T,C or G
aatgaataataaataaattccaattagccttaggccctggcacgctatgcataccgtgtgtaggagacctgcaggccaaggagcaccctggaaattctctggaatgtgtcctggaggagtacctcatccttttatctcaatcttgtggattatgtacgataatccccacaacttcctaagattctgggctcaagattatagagtcattttcctctcccaatgaaaccacacattttaatctgatccaaacatctttacttttaatgtcacaaaaactacttctatggtctacttcatttataggcttataagtaagaggaaatgaatctaaattcttcacaattctatattgtcaatgacctcctccacttggaaagtaattttgaccatcacgacatatgcataatttatatccagaaacatgtgttgcatctttaaaaatcatgtaatgcctcttttaagaaggtcacatacacatgggtcaaatatgcagaagtacaaaattttattggaaggccttccttttacctcttgccccgttacctatgccttctgtgggaagctcccctatttcctcaggtgagggacctttcacaatagattttcaaggggccggaaggcgttactcacccatacgataatacgtttcgataactaaaagaaaacctgttgtgcgccattcaactaaccattgttcaaaatccagcttgcctggaacttctaaaccctttaacccttgaagttctaaaataaagacgactccactttcaaggccggcctgcgtgcgaaaaaataaatacatgtccccttncctcaaatgtggctttggtgccattcctattgatgggttttatgaccttgccattaccnttggtatggttttatttgtggaggtaccgcctcgacgggagtacggtagcataccggggcaacatg

SEQ ID NO: 11624 - DNA, 1863 bp, Homo sapiens
  misc_feature (1)...(1863): n = A,T,C or G
cgctctacntgtctctcttctggtgccctcttatgcgtcgtcnncgcngttctctcggttcgctcnctctctcacgcccgncctctttctctccgcgctcacactgtgntcncgttggtctcgtctagtcgnttcgcgtcatgatgtcgntggcggtntgtcngcgtgcagtcatgcgtgttcncgtgtgngcacgcctcacgcggtcgttgtcgnctgatatcgtgtgtgatcgctgttatgctttagtgtgctgcgtctgttgggctcgagcgctgcgccgtctgctctgtgcgcgtacggtgtgggcgttgtgtgtnggnagtcgacgttggaggaggtgtcatgtattcgcgctgtctctctgtctgttgcaccgtctctgctctcngnnctcgcgtgttgctgctctgcgtgctctcgcctgtatggctncagcgtcgtcgtgctcttcggctcgctgtgttgctctntctgctccgctcaggtcatgtgctcgtcgncgctcctcgctgcacacaccccgtgcgcgcttgcagngtctgngagctcgcgtcagtgactgtcgngacgtgtgcgcgtgcgttgntcgtctccggtgcgcggcgctcgcgccgtgcgtgtcgcgcgcgcggcctcggcgcctgagncctggcgangngtcgtggctggtggcttgtgttcgtgcgcgcctcgtgctgccgatgcgtctgttctntgcgctgtgtnggtcgtctgtgcgtggctgtgcgcgtgcaggcgcgctnctccgcgcgtccgtcctcgatcgtgngcgcgtgtgtgtgtgcgagatgtgtcgntcgtctgcgcgtcgtgcgcgttttgcgcgtcgatcgctcgtcgactcgtgcctgtgcgctcctgctctgccgcggtgtgtgccgtcagggngcgggtcctttctgtgagcgtctgtctgcagcggcgctccgactcccgcgtngngcgcctcacagccgcctctcacgcttcgtgcttgtcgttccgttgtaggtgtcgttctggccgctnttgctcgcctctgcgcgcgcgtgcggcgcgtcgtttcgcgcgctgcgctgtggctgatngnggcgagcgtcgtctctctgtcgcgcacgcgctcgtcgtcgcgatgctgtcagtagtgttcgtgtgtgngntacttctcatgtgnttgngtggctgctctttcgcgtcgtactggtagngngngcgtcctgtcggtgcggctcgtcntgtntcgtctgtctgtcgtgggtgtgcgngcgctgtctccctctctcgtggttcgcgtttgctgttgggctgctcgtctgtgccccgtcctntctctctctcgctntncgtctgtcgcgccngtctccgcgtnggtctccntngngtctcttctcnttgctgctgtcgcgctgtggtgtcttcgctgtctgcgctcntgtntnctcgtgtntcncctttgtcgcgtcgtctncgngcgcgtgcgtgcgtcgtcgcgcgctggtgtgngtcgtttgtctggcgcnggtctncgttctcgtcgctctccgggtttctgtgctcgtgtctgtctaggtgtgnttgtgtgcgngtcgtcgtgtcgtcgggcctgtctntgctcgtctcttctctgcgctgttctgtctcgctggntggtgtgtctctntctctctgnctgtgtgntcgncaccggcgctcgtgcgcngtgtgtgntgtgntggtcnctcgcnccgctctgcgcgnggaaggngcggncgttctgcgtnctgtgtctngttcctcgtngggtnagactggctcgtcgctgctgatgctcnttgtcagtgcgtcgtagtcgtctgtgcgttgcgtgttgcgtccgagctg

SEQ ID NO: 11625 - DNA, 1213 bp, Homo sapiens
  misc_feature (1)...(1213): n = A,T,C or G
cctgttgtgtccgtgctgtggttctccccgctttctttttctctgcggtgcgttccgggtccctgcgaggctcttcatctcctgcgtgttccgcctttgcgttgcttcagtggctctcgtgctcttgctgtggtctcgtgtcttgtcggtgtggtggccctctgtccctggtcggtgggtcagcctcccgtccttcgtccttctcattctctggctcgtgtggcgtgctgtcgttggtctcttcgccgctgtgtcctgcgtcggcttgtggccatcctgtggtttgtgtgcgcggggctgtcaggttgcggcggtctggtctgttcctcgctcggtaccgctgtgcgtcgtcctgtgctgtgcttttttcttcccttcttgccttcgtcgcctcttcttccggttctcctctcggttctcttgcggccgcgcggctggctggtcgcggcctggtcccgggtgtgtgtggctcccttcctcgttcgtgtgcttcccgtcgcctttcgctccgggtcctctcctcctctctcgcgtgtccccctcgtcgtgggtggttgctgctggtgtggtcgctgtttttggcttgcggctgtgggccgcccctctgggcccccccttcgcatagtcttctgcttccttctgttcgtgcccctcttcttcgctgtccgcctggtcctgccggggggggcgtgttcctttcctgcctggtcgctttcctcctccttcgcttctgtctttttcttttctcttctgctcatcggcgtccggcgtcgtgcgcgtgtgttgtctcttctttcgcggcccttcgccggctgcgctgtcgtgtgctcgtggcgctgtcttctcgcgtgccgcgcctcgttggcttcgttgttcgcctgcgcctctgttctcctctctgcgtccccgtgtcctcgtaccgtctctgttcgccggtctgtggcgcgttgtgctgggctgcgttgcgtgtggcctgtctccccgctcctcctctctttgcgcgtctggtccgtctcctctctccttgatgtcgcgggcgctgcgtgtcgctgcgttctgtcgttctcctgcggtcgtctgggtttctcgcgcccgcnccgaaagctctcgcgccggccgtgtttcccctcctctgaagggtctgtcgccctcctctgcctcgccgtctgtcgtgcctgctctatgattggctcttctgcccgtgtcttggcgc

SEQ ID NO: 11626 - DNA, 1622 bp, Homo sapiens
  misc_feature (1)...(1622): n = A,T,C or G
ctgttgtcgtttcgcgcgtgcgctggcgtcgcgtcgtgtcggcgcggcggcgtctagtctctgctgacggttgtgtgtcgctcgctgcgtgcctgcgtgtgtgccgtgtccaggtctggttgcttagtnttntttctctcgttcatcctgtgcctctcntcttgcctcgtcatcgtctcttgcgtcgggctgcgtgcgcgtntctcgcgctggcggcgtgtatgctcgctgcgtgtctattgcgtgtcggcgtcgtgctggcgtcgtcgcgagcctcggctccccgctcgtcgcgcgcgctcgcgtggtgcgtcgccggctcgtctgtctagctgcgcttgngctgtggtgcgcgctcgtcgtgctgtgcgcacctctgcgacccgtcgtctcgtgtgctttgtgcagctccgaccgtcctcgcgcgtgccntgcggccgcgcggctcggcgttctgtcgtgcggttgcctcgcgagcggcgctcgcgcggttctgtncctcgctcgtcgctattcgtgcccttgcgtgtgcgtcgccgctgtggctatgtcgccgngcgtcgntccgtggcggtgtcgntgtccgtcgcgcggatgcggtgctgtcgtcgtccgccgtcgcgacgcgctgcgcgcgccgttgntggcgcgctgtcgcgcgtgcgggtgctgtctgcgtgtcgctgcgccgctcgttcgcgcntactcatcaggctgtcctcgcggtncgcgtggcggtcgccgtccgtgtggtntcntatgctgcctcgcctcgtcctcggtgtgtgccgctggctcgctcgtctcgtgtccgtgctgcggtctgcgtggcggcgtgcggtgtgggctgtgtgttggcgcgctgccgctccttccttctacctcttctgccctgcgtcgcccgcgcgttcnccnctcttcttcngccttgtttgctttcgctcgtgtgccgtctggcttatcgctgtcgtgctgtgctcgtcgtcgtgcgtcgcgtcggggtgtcntntctccgttcgcgtcgtggcgttgcgtcgttncgtncgcgcgctgtcncgctncgctctcgtgcgctctgccgctcgccccgcctcctgcgcgttgtgtgctctcctgtgcttcgtggtcnctccgtngttgtgtgtcntcctctctctcgtcgttgtntcggctngtgtcgntgtttctctgctcgtncctttctncgttgtgctcgtctcgggcgtgcgcgtggnttgtcgnctgtgtttgtcgtggcgggtcgngtgtcgctcntntgcgtnggtgtcttctcctctgcctgctcgcgctgttcgttntcgtcgtcctctgcttctctctgtttgtgtctcggcgcgccgtgtgtccgtcgcggtcgctcctcgtctgtgcgttcgcgctggtgcctcgtngccgctgctgtcgcctctcgcgtcgtggtctcgcgtctgtgcttggttctgtcctntgtgtgtgntggtntgtttctttcctctctcttgctcacgcgttccttttngttntgtnggttntgttccgccgcggaggcgcactcctcttcttcgtctcccgtttcgcctgtgatgtgtggttggcagcctcttgttggccggccgcggggc

SEQ ID NO: 11627 - DNA, 1186 bp, Homo sapiens
  misc_feature (1)...(1186): n = A,T,C or G
tccgggtggctcgtgcgggctttcgcccggtgggctgccggcggcgtgcgcgtccgcgtcccgtgccttcctcctttgttggcctctttccccctttcttcccgtttgtgggtctgcctcgcgcgtgggcgcgtcgtgtggcgggcgcggtgcttcgggcgtgtgccgcttctgttgggcgcgttgccggcgtgccggtctgcgcggggcggccgtgcggctggcggagctgttggctcgcgctgggtgtccgtcgtcgggtgtgttgggtggcgctgggcgcttcgggtcctctgtgtcgcgctgcggggcctgtgttggtcgtggggcctgtgcgttctgcgttgcgcgctgccgtgttcgctggcgtcggcggcgtctcgcgcgctcgtccggcggcggtgcctggttggggtgtgtgtggggcgctggatcggctccgggtctcttgcgccgcggccggcggtcgcgcgttgcggtgtgcctgcgcccgggtcgggtccgcttgccggtttcggccttgcgcgcgctggctggctccttctcgggctgcgggggttgtgcgtgggtgcgcgtgggctcggttgtgatcttctgcagcgcggccggtggcgttctgcgctgtcgccccgnggtgggttctctcggctctctgtgtgcggcctgtttcgtcgtgtctccgcgtcgccggttcgcgcgtgtgctcgtcgggccggttcggctcgccgtgtctggccggtggcgttgccgtggcgcggggctcgcggggcggggtcgcgggcgggtcctgggacacgtggctgctgtggttggcggtggtgggctgttcctgcctggggttgtccttggctctcgttntccctgtccgtcggtccgcgccttcccgctctgcggcgcgcggttctgccgtcgttcttgcccgtcgccctgcgcgcgccgggcgtcttggctcgtcgcctccggtcgcttttcgctgcttgctgttccgtgcgtttcgcgtctcggcggcggggccgttgcgcgccttgccgtctggtctgctcgctgccgctttccgctcggtgcgtctgggtttctctcccccnctcaaccgcntgtcgggncnggtccctcccggtgcaggcttggtgtctgtgtttgcggctgcgctgtctggttttgtttctgtgtcctgtcgcgtgtttcg

SEQ ID NO: 11628 - DNA, 496 bp, Homo sapiens
tttcaggaaactgatctccctgctttaggtgttgctgaaatattgaatggaaaaatgtgcaaagcgaagacggctcctccctatagtaggaaatacggaaacacatgatcagacatctgtgaagtgactgaaatgtgttttcctccactctgtcttatataaacgtccccctctgaaaccattttataaataagaataaaattgctcttagattcttctagaatatttgaacccgactttttttgaaataagtcccatgaaaggaaatgggaaaacagcattccaatagcaatatatgagccctaagaggacaattcaaatataagaaatattatgtgggagaattaaatatccttttttaaaaaattaaaaactgcttgaattcagaaatggatactaaaagaaacaaggcagatacaacgttaggatttatattgaaaaaataaagccaaaaactgaaatcaaaaaatcaaaaaacatggcctccttggcctca

SEQ ID NO: 11629 - DNA, 909 bp, Homo sapiens
ctcagattgcacaattggcaaaatggtgtcttcaaagagaattccatatgctccttctggtgaaattccgaagtttagtcttcaagatccacctaacaagaaacctaaagtgtagagattgccatttttatttgtgatttttttttttttttttggtacttcaggatagcaaatatctatctgctattaaatggtaaatgaaccaagtgtttttttttgtttttttttttgagacagagtctcactgttgcccaggctggagtgcagtggtgcaatctcggttcactgcaagctctgcttcccaggttcacgccattctcctggctcaccctcccaagtagctgggactacaggcccccgccacagtgactggctaatcttttgcatctctagcacagacacgcattcaccatgtgagccaaataggctcaatcccccgacctcgagaaccaccccgtttagaccctcacagcgatgggataacatgtgcgagcccccaccccccggtcctttacccccgtgttcttccccgcaacaagctatcatttctattaccagattccccctacgtagtatgacattggctgtatggtgattcactacctccccactcccctcctctcactacccactcgttacaccccacctagccgaccctcaacacctcccccgcgtcttgtaccctgtcccatcccctaatcacaactaaactttatagagaaatatactgtactttcccgtgactacaccgacccgccccacctttccctactcgctacttccctccctctccctccctaacctcctcaataaccaacaccacacccaccccggcagcgcccctctctcccgggccacctccctcctcttaataacgatccaatccccttcgacctccttacatccatt

SEQ ID NO: 11630 - DNA, 1738 bp, Homo sapiens
  misc_feature (1)...(1738): n = A,T,C or G
agtgtggcggttctcgcgggcagcgtctaccgcgttggtcggaccggtacagactgctcttccgagngggtcggccttgntgtgagaataatagaattattacccgccgccgccgcactatcagacgttatcacactgtcccgtcatcaagctacgcacgagaggtgcgcgcgaagcgccctccacactgacgtgttagtacttgttttcatcgcgcacgcgattcctcgactacaccatctctaagtggttacggctcaattacgacggagtctctccgcatgtagagctccttagtgatgngactggacttgaattagacgatacctacacactctcacttaattcgctccgccgtgtgtgtatgttagtcctgccttccggcgacggccggacctcattgcgtctcttcgatagagtcggtgcgtcacatctcgcttgctcctgtctcgagtctctaactacccacntataacgtgatatgtagatgtgtagtcgcgacgcatccgacaanatgtctgtatatattgacttccgtacccgnatagctcatggttcncaacgtcgtaattgtnttgtattagtgctccgagcgtggtgcgcgtacggacactgtccctgacngtgancatacggcngctcactactaagttgcatcgcagcgtagtatggcgttctcgcgtagtgatgtatcagactctgcgctcacgtcaagtncggtcatgtgctcgcatcgcaatctctctcgttacgtgggtcnactgctagagagcgctcctgcgacgtgntcggatctgccgcgcatgacgcagcctcagttacacctcgctcgtattntgtcacgtcagtgtaccgnaacatacgccggtagaacaagcatgcggcagacgactcgncctctgtactgtgtcggctgcgcgacacggcgtcacgtcgatcgtcgtcagatgcgtctcgcacaatctcagctcgaatcactgcagtcctcgcgtcgactgtacgtgtcagcttcgcgacgtcgtgcgcacactgaccagtgcacaccncgacactgtcgagtcatagcgtgcagcggntgcgcggnacgtttgtatggntgatatatgtgtcggcgtacgcacatcgcgtcgtcgatcatctgatacacgcgacacacagacgcactgagancactactgtangtgctcgtgagcgtcataggtgagtcgagtgtgtactcagactgcatcacacgagagagtcatctcatatngatcagtgataacgtcgtcncgctgcaggtcgatcgacagtgcatacgacacgtagaatagtgagtctacgctancgtangcagcgtcgcagtctcctcacgttcanagtatcttcgntactcagtcctcgacgtcacactacgattccgncgagcgcagnataagtcgtacgaagatcatattattcactangntagcacggntcnatactctnacgtatgtngagatctatatataccttgtgctactcataccggttactccngacccaatatcgtgcgtgtacgtagtacagtgagcatgacatgtacgtgtcttcgcgtgtgctcgccatgacgcatcgcacgcgcgatcgtcctatctctanctgattctantctacccgacgtacacaccacgancntgcgccgtcgtcgtcacaactanagtgtgtacgagtgtcttggcatgtcgtgttcgtggntcccgcgtggctctcgcgcgct

SEQ ID NO: 11631 - DNA, 306 bp, Homo sapiens
ctcagatcccgaattctgattgatcagctggtaccacccagaccagtaacgtggctcaactagttctgcgatcccacccaggaactgaagacagcaagaaaaacctatttcaactttatacaatttcatctgcaatccaaccaatcagcattccccactccctaaccccccgcctgccaaattatccttaaaaaaaccctagtctccaaattttcagggagactgatttgaatcatacaactccgatctcccatttagccagctctgtattgattaaattctttctctattgcaaaaaaaaaaaaa

SEQ ID NO: 11632 - DNA, 437 bp, Homo sapiens
gttcaggttacgtctacatagatctatcctgacagctgtgattctattcagaggatgcacaatggacagacggtgtgagctgacgcggagctcaaggaaattggccaaggcaatgctttgctctaaattcggcctcagtaaacatttattggctgagtgcatgcacagatggaagaatgtcatctcctttgtcacgacacagagatttcacctgaaccaagtccgctggaacccccaggcaacgcgactcctctcctgcacctgcatctgctcccaagagctgacaaccatccacttcttgagatccagaaaagaacctgtttcaacaaatcaaccccctagattcatttgcttcaatcctcttgtaaaactaataaaaatgcaaagtattaccataattaaagttttaaaattataccaaaataaaaaaaaaaaaa

SEQ ID NO: 11633 - DNA, 1336 bp, Homo sapiens
  misc_feature (1)...(1336): n = A,T,C or G
cgcgccactagcacctgcacttcagactgggacatttaaactgaccgcagagctaagagggcatcttgacgctagactgtcgactcacagttagagcattagtcgtggaattgtagttgtttgaaagtgaggagcgtgaacatgccagcgacagaaacacgcctcgatcgcctcttgttctcgcgtgtgctccgctttgncccattctcagcgattcatcacgtgtcacttgagtgttatgatctgcacagaggcgtacgtacgactacgtgtcgagcgcgcattcgtgcgtgatcgtggcgcgtatcctctagcacgacgtatattgtctataaacactagattcagagcgatgctattttcagagtctaatcggtangctgcataagagcaggagtggggcggcatctgcgacgcgacgtaacgtggccgtgagtcgcggctctacagaggttgcgagtagctggcctctctctgtcggctggtgaatacgcacacggagccgcagcggatgatgcgggtgcgtggttcgcacagtcgcgaccagcgttcgcgccaccagcgtgcctgtgtgctgtagtgacgtggatctgaagtgcgtgcgtgggcgcgcgatgacgtacgtcacagacgtgacagcggagcnactaggacagatgacgagcgctcagaggtcgtcactgcggttgggtcgcgtcggaggggagcattgtcgggaaaccactcagctagtcagagatttgtatctagtgatantctagtctcatagatctcatgcacacgtgagcagttatcgagcgtactgcggcacgcctgtcatacatggacataatagcgatgatggtaggtgagcgtgtcatgtgataacgtatacgctgagtggctgctctntntgtccacgcctgtgcgagcaactatagtatgtacggatgttgcgtgcgctacatcggtgaggacgtattgatcatagtgacatgacgtgcgcgcgccggtgctgtgtgagtgtagtaccttatgcgtcgtgtacgtcntcagtcagcattatattgacacttgagngcgtcgctctcgagtngcgttactgtctctgagtcgctatatggaacacagacgcctcacgagatacgtatggatatgatagatctgttgacgattgntgtcgatcaagagactgcagaggacgaganagagaagggtggttctccttcatgtgtcactaagccgtctgctntgctgctnttgttttctcccgaaattgagggggtctagttgctgtgtgcgctgtcgtgctgacgatcagtgtatcaatcatagngctggagctatctgtcagtcg

SEQ ID NO: 11634 - DNA, 992 bp, Homo sapiens
  misc_feature (1)...(992): n = A,T,C or G
actaccgcgtggcgatgcgcgggcctggccctgagtgagcgagtcgcttgtcttctctctccgtctctgtcactcggctgcgctccggcgcctgccgcggaggcctcgctcccccgtgtgtcgcggcgcgtgatcgggccgggggcgcggcgcggcgtcttccgcggctcatttctgatttccggcgggttcggtctctgcgctcgccgcctcgccatgtccctcttggctctctcgcccggctcctccctgcctgcgcgctgagcgctttgcggagttgtctgtcgctctcccctcctctccgtgcccacgttctatatcattgtgcccctccgcgttgtgttgatttgctctccgcagtgtccgccctctctggcccatgatcttcttcgcgcggctgtgtgctagcgtattgttccttcggcttgtgcccagcaggtgtagcgtcctctgttggcccccgtccgcgcccggccccccggagcagttccgcggcgcctggttgccgctcggggcccgcgccctccccgccgcgccggctgcccctgccgccgcgcgcggcccatcgcggcggtctatcgcttgttcttgtctttggtctcttctgctcctttctccctctgcctgcgtttctcgtgcttttttttgcttccttccgtcttcgtgcccgcttcgggtataatattattttgtattttatattttattttctgttatcttttttttatctctttatattcacgtttctctatcattctctttgtccaccgcgcccctcctctcccccctttcactgcgctcgcgtcgatgttttttttgtgcttgnctcgtntcttcccgttcccccgttctcccctccccgccccnntccatctatacgtttccccattcttttctaaaattcttcgtnttctttnctatttctccgtgtntcttgttgttctcttgaagcttttttntnnggtccccccaaaaggttcttttntttcttt

SEQ ID NO: 11635 - DNA, 912 bp, Homo sapiens
  misc_feature (1)...(912): n = A,T,C or G
tataccaccacgaacaaccacgagcggatttccaaaaaatagttgagacctcttcccacatctaagtcgtcatttctcaaaagacctaaaatccctctaaacacaggcctagcgcagctaaaacaaccacccttnttnaacactttttnattcatctttttattaatacccantcctaaaatagcatccttatccacacacccacatatttccttaggtcaggtctataaatctgaaacccatgtcccacccgttaagcatgggtggggacccttaaaatacctcanatcnccaacaaaacattccccaccccagcaaccccagtgggcccctctcacctaaatagtcattctgtatccttaaaaagaagagcctctcccaaccaatcatggagtccttccaaagacaacccctctcatctatcaaaaaacccagaaacccaacccataccacctgacaacactgccatcaagacccttcacccccttagaaaggctccttacctttacctctcttgctccaacccaccataccaacttatagaaaccatttcgctacaaccccactttacctaacccacctccctaccctctaatttttttctacataggaaaacaagttaaactctgaccccttaatccctaatcacttgaccctcacccattcgctttcccttaaaccacttaaaaaaaccccattctataattacttacccaacctaaagcttctattatcaacaacccaatccttaaaataaaacaantcttcctaaaacaaaaaaaatacctctcacccaaacatcaaatttccaaccctccttatcaccacaattctataccactacaactactccccaaacttagcccctgaacccctaacactaaacctacaacccatcaaaataccaaaaag

SEQ ID NO: 11636 - DNA, 1718 bp, Homo sapiens
  misc_feature (1)...(1718): n = A,T,C or G
ctcgcgtcntgcctgccacctgcggcgctctcgcntctctctgctgcgtccccnggtggcgtgtatgtctagttcgccgcgncgtcacgtgcccgctcggcatgggtgactgcgatcgcgttgtgcacgtcggcgcgtccgtctgctcgtgtggtcggctctcgcgcgtctctcngcgctctctgtgcgcgtngngcttcagccgctgcgtgctgctcacgcattcgctctntcggttgctcntatgttcgtcttcgtntgatgtcagctggtgttgttgtgtntgcgtctnttcagtntctgtctcttgcgctgagtcgtcgcgtgtgtggcctatgtggtgggtggcgcgtcctngcgcgtcgcgtcgtgcttctgtcttgctcggcgtgcgcgtatctcctgtctctctccttctctctcgcctcctgtctatcgctcntcgctgatgncacgcnctgtgcgctcgctatcgtcgtgcgcgcgtgccgcgcgcgtgcggttgcgcgcgcggcntnggtncnctggcgtgtcaggtgtggctgcgctgcgcgcgtatctctgctggcgccgcgtgggtgtgcacgcgtgaggtgtcgctgactctgcgccagtcgctgcgcggcatctcgtagtctctncttcgtcgtcgtggcgtcgtgcgtgtgagtgctgctgttggcgctcgctgtcgtgtgtgcgccactctcgttgcggtgcgagtcgtgtggtgcggcgctnggcgcgtgcgagcgtgcgcggtgcgtncgcgcgccgcaccactgcgtgctcgcgctgctagtccggcgcncgtcgtcggcttgcncntctgtcgtgcgtcgcgtgtctcncttcggcgtcngtgtgcncgtgtgcgactcgtgtcgcgcgctgtcctctctctcgctgtcgctcgcgctgcgtcgctgcgtcntgctgtntntngcnactctatggtgtgtgtcattgctctccgcggcgcctcctgtcttatcttctctgtctcgtccctacgccgctgcttctatctcgtctcctgtcttcgcgtctgttgtctcgagcgtagacctctgtctcatgtatcgctctcgtgttccgtcgtcgtcctcgtcctctcgtnttgccgtgtgtgttgtcctccgtggtntcgtacgtgtgcttgtgttgtcttcgtcgattnagtctcgctgtcggttctnttctgtctgtgcctgccgtcgtgtcggtcggtctgttgcgtgctgtccgtgttccgggcgtgagcgggtggtgctgagtctgcgtgcgcggtgtcgtctctgtgngtgcgctcgtggcgtcgggcgtcctgctgacttcggtgcgtcgtgcctgancgcctcgcggcgcgcttgctgtccgtctctcgcctactcttcgcgcgtcgtgttcatctcgctccatgtcattctgtggctccgtcgcgcgtgcatattgctctgtggtctctcgtntggtcntcttcgcggctctgcgccgggacgcgtgttcgtcgngcggtgcngtcgctcttgatcgtctggttcctgttgcctcccgtcgcgcgtcgcgggtggctcgtgctggtcggttttcttctggcttcggtcgaacgccctcgcggtgtgccgagttctcgcgcccgcacgagcctgcctgttctcgtgtcctcgtgggttgtacgtctggtcgtggagcttggtttgtatcttttttgtcct

SEQ ID NO: 11637 - DNA, 1559 bp, Homo sapiens
  misc_feature (1)...(1559): n = A,T,C or G
ctctgtgctcctcgctgcgcgcgtctcgcgcgtacctctgctcgcgcgatgcccgcgcctccctcgctcgtcgctcgtgtgcgtgtgccgtcgtgcggcggngcgcgttcgtgctcgtcgcgcctctacgcgcgtacctntgtgttgcgtctgtatgcgctgcgcgactccactgtacgcgcgcnctnccgccggcgtcgtctcgntacccgtcctgctgtcgtgtgcgtncagtgctgcgacgcncntctccgactcgncggctgtgntctgaggcgctcgtgcgctgtgactcgntgctgtcgcatcgntgcactgctngtcctctcgcgtcgttncntttcgtcgtcgctgctacancatgcttaccgtacgtantcntactgtctcactctgcgctcgctctgtgtcgctcgcngtngtgtggccgtcgcggtctgcgcgtgctctgttgcgccgncgcgctctcgtggtctgcccgcgctgttgctcgactcttgcgtgcgcctgcgctgcgctggctcgtgtctcgtgtcggccgncggttgtgatcgtggtgtgtgtgtctctcgtcgtctgtgntcgcgcacgtgtcgctggctcgtgcgcgcgcgccgcgcctcgcgtctgtcgcccggtccggtgcggtgcgcgggtgttcgtgtgccggctcggctgcggccgcggtgacggctnggtctnggtccttcatcgcagactcttcgtccgctctcgctntcttcgcgtcgntgcgtcctcgttctgtgtccgcttgtcggtgggttgcgtcgtcgctctgcttcgtcgctgccgtcgcgcgctccgcgctctcgtgtgtgttntgtgctctgtggtggcgttgcgctctcgctcgtctcgctgctgtctcctccgccgctctctgtgtcgccccgctcgtctacangcactcgtgctccttctncgtcntgtatcgtctcgcgcgcacgcggccgtcttcacgtcgctcgctcgctcccgctccgtgcgcgttcccgtcgctcgctccgcgtgtcgtgtcgtgcttccgccgcacgactcctgcgcaggctcgcctcgtcggtcgggcgcggcgggcctctcctctgtgcttcgtggcgcggcgccttcggcgtgtcgctgcngtgctctcgtgctccttctctcccgccttcgcccccgcggttccctgcgtttctttgcgttgttctcgtcntngcgtctcccggcttcgcctccgctggtgccgtttcggtctcgggctcgccgtgcggcccccgcgctctgtctctctgcccctcctggctgcgtggcggttgtcgctctcgcctgctgtcgcctcgcgtccgcgtcgctcctgcccggtgccgctgtgtgcgtcgcggtcctctctcttgcttctctcctccccctctcgttccgcttccccgttcctcgcggcgggccgtttggtttccgccccgcttcgagggccctgtgtgcgntgtttctcctaccgagggctttcttcggctggcgctgttcgcgccggctgctccgcctcgcggctcgcgttccccccc

SEQ ID NO: 11638 - DNA, 1197 bp, Homo sapiens
  misc_feature (1)...(1197): n = A,T,C or G
cagtgtgtaagtgtagtgtgctgcatcgtcatcacggnnncctcgctcactgcgtcaatctcatactgttgananagcataacaagcacgtagttcacgaactatagagagtatgatggggggttcgagacatctcagaggactaggcatcgagtatcgctgtcatcgcctgacgggatgcactcgtaganatgattcgtacctcctacgcaggtgacacgggnngagaagtatcgtcggtaatcgcgcgacgcggagggggggcacgtagaaacacaggganncagacacaagacacacgtgaantggcngacgagcgcgatgatagggacgcgagcgcggcggtaggnnggaggaggagataaaacgcatattggacgggcatgacaataagatatgcacgtcgcttgtgctccgtgacgacttgtgatggtcgggnngcgtaggacatcgccttgcgatggtgcatgtgaggngnaggtacggtgcggtcggagagggtaagaggaangcacacatacttgnngcactagtgtactgtttacaagtgtacgaggatgcataagaattagtctgcatcgttcgggctcgctgactccgttagtcgtctatgtcgctgcgctatactcgacaggnactaataggaatacacgttcgtggacggttctatttaattattaaagatnnnataatacctatcacgagaaatcagatggcaggtgagganagccggaagagacgcgcgncggactacgatattaggatggannataatggcggncgctggtgcgcgcnagngagaagggaggataagaagcacggccgaaccaaaacaggtaccgcggaagaaggtggacgagcagcacgtgcaggaggnggtgttgatgtataagaagagtattattataatggctagttgggtncatcatccgaggaaggagatccgcaaatgccagggtgggctgtgcggtcnactggtatgtagctacatgtgctctgctactgaggnaacttgttcccattatatttatataaaattaactataacctactcaaataatctagatacctacctaataaaattaatacagccaaagatgtggaaaagtatggtacaacaacggttataaaaatagaatacatacatccttaaacccacctcctncncacttcccccccccccttcccccccccttt

SEQ ID NO: 11639 - DNA, 1425 bp, Homo sapiens
  misc_feature (1)...(1425): n = A,T,C or G
cggatgacgnngcctcagcatcaggtggaaccacacagcatcgatcatgtgtgantntcgaagtatgngggaacngctataatanncgcatatagtgangttactgacatcacgcgantgagtatntgaccagtctatcgagaaangatanntnnnnnntngtatgctctacgatagcaccagcgtgagcggaattcagtgancacaatgaggantnttgcgagngagcgtgagacgcgacngacggcgtcttgcgcgtgtngcgnggggtatgacatacgacacggggcacgacagatagacacaccgcggcaaaagatatgtaattggatgnncacgcacttatctgtaatcgtcgcgcgcagtgaaaagtgagaacatgtgcgnagtcgttcttccgaagacgaatagcgggacagcgtcgantcggacaagtaattgagtaaagacaccgacacgtatctnngcgaatatatatnnacatatgagcacagagacagtagagaagcacgatanacagggatgagaagagagagagagcgactggacgagaacgcggcgaggtgngcacgagacgcactatattaagaagagcgagaatgtgattgagcagtaggagcatgaatcagatgggcaccgaagaacagaataagtggtaagcgcgcgagcgtgggagggtggaggacagctanaaacagaaggtataactataggagattaggactaaaaagagggagacggtnttcccctctgctgtggagtacaagtggnngcccgtagtaatacagagatgctaactagtggagacggtcacagattcagctaaaccacgagaggatagacgaaatagacgatagaatngataaagaagagatatanaaacgaggcggaggngggagtaccggggtagggccggctggagtacagggtgcggggtgagaggagagcatgaagtatgtgcggtggatggatgatttatggcatcgagtccgtccgtggggggaggtnnaatgaggaatgaaacgacaaanagtatgaaccagaagagagaaacgtgaggaggcaaccgtcacagcgacgctcgagnngaacgtggagagcacgtttggcgcgtgncggttgatcgtgtggtgtcnggactggtaggacaggcgncataatatagnaatacacgcatggagcaacatatatacagtgaaaacatgcaaggaacataggagaacagcattnggaatgtcgtgaggaactgtgagctcaggagctcataatanaacgaggataaatagaccaagcctgtaacacattaataagacagaaacaccatgatcatgtnnangacgaaactatnacatgaaacagatagaaactatgaccacatagaaatgataaatgaaaactataaacataacatgataacaataagac

SEQ ID NO: 11640 - DNA, 500 bp, Homo sapiens
  misc_feature (1)...(500): n = A,T,C or G
gttactcactactctgctgttctttaacatggggctgaaagtcgtgagtgatgttacaaggcaagaaaaagaaacaaagtatctaaggtatctgaggactggaagcgaagagacgtgatcatctacatataaaagataaaagaatgatggtataatctattggaacaataacagagcccagtgatgcagaaggcaaggtcagctggcaaaaatcccagtgatcctcctagtgtcacaccagtaacaagcattcaagaaatagaagttgaatacagagaaggggaagattcccaacagcaacacaaactattaggttggtgcaaaagtagttgcactctttgccattatctttacatttaataggagaaagtgtaggataataactttgtaatctaggcacgaggaaagacttcctaagcaaaatttcanatgcacaaaatataaatgaaaaatataaagaaaaaaaaagaaaaaaaaaatgggcctctgttggcctcagc

SEQ ID NO: 11641 - DNA, 922 bp, Homo sapiens
ggcgagcgcgagagagggacgggggagagagcctcatgacaacaaatctgggtgttagctggtaccacccagaccagtgacgtgggtcaactagttctgcgatcccacccaggagcgtgggacggcaagaaaaacctatttcaactttatacaatttcatctgcaacccaaccaatcgacattccccactccctaaccccccgcctgccaaattatccttaaaaaaaccctagtctccaaatttctcggggagactgatgtgaatcatacagcggcgggcggccatttagccaggtgtggattgattaaatcctttctctatggcagaggaggagcgatggggcggaagagctgtggaggcgcaagggaagaggctcagagaggctaggttttaacctcgtgacagtggtatcgccgcgccggacgcgctgccgagcgctgcgggccgagtacatgccgctcgaggcagcgtataagcgcatcccctcgaccgggtgtgggcgcggggggcggactcgagtccggccgcgtggtgtaccacgcacgcgccgggagggtgcggcgggaggccccggacgtagcgccgcctccgagccgcgaggcagaatgatgccgcgccgccccccacgcacagcggggcagggacggaccgtctttaagtggtgttgaagcaggagcggaccaaagcgggcagataagatgtgcgagctaggagggagggggggggtaggtgatggagccgtacgctgacacctgccggcaaccacctcagtagcacggcgccgtaagggtgagcgcagacgccgcccggtgtaattgtaggacgcgacctaaggggagtgatcctggacgggccgggggcctagagggacgtcgcggagccggcagtcggggtgagtgtggtggtgggagtgggaccata

SEQ ID NO: 11642 - DNA, 1380 bp, Homo sapiens
  misc_feature (1)...(1380): n = A,T,C or G
ccccgctcgcctgcgcgcctctggcgtgtgcgtcctgcntcggtgtgtcccggtgtgtgtcgntgcgctcggtggttggcgtctgcgcgtggtgggtggtcggtgtggctggcgctcgtccgtccgccgcttgncattgggacctcgcgcggcgcgtcgtcgattctttcgtgctcgcctcctgccgcgggctactcgccctcgtcggtgcagcttgcgagtgcttggcctgtgcgcgcggcgtttcgttctcacgtcgtctcgtcgtcttgcttctcttgttccctctgctggcctgtgtggcgcgcgtggcgctgtgcgtctggtgatggtggtgtgcgttcgcgtgcgtgtttcgtgcanctcgctcgtgtgcgtgcctcgtgcggtcgtgtgagtgtggcgggcgtgcgcgcgcgcgtgggcgtgcctgtggggtgtccgcgggtccccgcgcgcggtcgtcgcgtccgtgtgtgccttgccggctctcgcggtctcgtgttggtgtcttctttcgtgcgggtcgcgtgcgtctctgtgagtggcctgacgttggtgctggtggctcgtggtagggtccggcgctggcgcggggtgcgcgcgctgtgtccctccgtccgctgcgcctcgcggcgtgtcggtgggtcgggttggggggcggccggtcgttggctcgcgtgacggtgggcgtgtcgtgctgcgctgtcctgtgtctggtcggtgtcgggcgtcggcctcttccgcgtgtggtgtctcgccgtcggggcgccgtgcgcggcgtctgtgtgtcggtgtctgtgcgctcgtggccggtcgtggctgctccgcgcctgcatcgctcgcggctgcggcctcctgctggtggtgtgtacgatctgctcttcgttgtgtcggtggtccggcggtggtgtctgtgcgctttgtgtggctgagatgtagtattttgtcgtttctgctgtagttgtctgcgctgcgtcgtgtgtgtgctcgcgtcgctctctcgcgcgccgcctcgcactgctccgcggctggcgtctgtcgctcntgtctgtctttccgtctcctctcgctntctgtccgcgcttgccgtccgcgtcggccgtctgcgggctctttggttaccgctcttgctcctcgtctcttcctcttggtgtcttgtcgtctcgtgctgctgctccngccctctgtgcnctcgctgcgcctgtgctgtcgcgttggctgtggggtttcgcttgcgctgcgnncngcaaggagcgctcttcgntcgtnntggttntctccgccnacncaagggcctgcggtcctgcgcgtcgcggcgctgtcgggcggggcaggtgcgtggggagggctttgcgtctgctctgctcgcgtcctttc

SEQ ID NO: 11643 - DNA, 1712 bp, Homo sapiens
  misc_feature (1)...(1712): n = A,T,C or G
cgagaggagnnggagtagttcgatgacggacgaagagagcatactgagagnaagtgagatcgtatagngggaaganacagagtgatgtattatagcaagtcagatcagacgtancatcgagatcacgtgttagctgcggtgtntcgtnnnccngtcatgtgatcgactctactactatataggtggtcgcgtgtggatgatatantangtaggcgcgttataacatggtgagtcaatacaaatgtcagatatnanactgtatagtcgntaacatatagacagagatataatagactgatagtgataactatatgnaagtgatgtagaacacacgagatcgacgcagggaacgagtcagtcagagacagncgagagagttacgagtagagcgctgagagagtggggggangaggaggtaaggtggtagtagatcacacgcatagtctacaacggcgtggtagnagntgtactagacctgagaagcgaggtgcgacgtggtanaggagacagtgtgttatnaggagagagagatnacagaatgtcagagataagaaacaatagcatgacgagtgtgagaggcagtgnaggaagtagtgttatgatgcagtgtggagttgatgctnagacagatgnnataaagtgtatatagacgtagacgcatgctgtnncctctcatagtgtcctcagctcactanggtctgcgtatgtcagagaanacgcaatgtaanaagtaatcanatatactatangacacaattganacacatgantnagttactgagttangctcgacttnntntgtgtagtctagcgcatgtagctcgngagcagatcacagacgattgntgntgcgatctagtgtacagtcacagagacacatcttgtaaatcagacgccagctnaaacgcacgcgctgtatgcacgaatatnggttaagtnttctctgtatgctggagangacgagacgaatangggcgcagaggngngtagctagtagtcgacaggctcaggagtggactgtgcatatgatgcgacgaatagaacaagagtgaganangcatcaacatgagaattgnatctaatatgttcatcctgtctgtactatctgcatgttcactatgtgntgcgtagtgtgtgatgtacgangcgactatgcgtgttggtngcgcggtgaccgctgcganncagtagagaagatcgacgtagggcaacgtacgantatgtcgatnantgatagnaccatgtgagattagaatgtaaggacgacatgcagatcaacaacatagtcttnngngagactgtgatngantatcggagcatagaggatagtgaggatcatactggaatgagaggtgganaagctaggaangtaatgtagtgataagacgtcggannttacctcatctataaatggtaacataacattatgnggagtaccggtggagaggagggtntggtagacgcgctggagtggaggtgggagngggngagcatatgacagatgatagtgtanaaggtgagatttgacggtgtggngagtgataaattgaggagctcatantnagcagtcgnnatattgtatagcctcgctggagctacttgttntanaatcacatgaaccacattantgtcacntctgtgcagtgttnatngcccttctgcactgttngacatatatatatatattactacatagtccaactgtattaggc

SEQ ID NO: 11644 - DNA, 931 bp, Homo sapiens
  misc_feature (1)...(931): n = A,T,C or G
caaaggaaaagaagacacgaaacgagaacaacaaaacaaccttgagggtaacaacaagnggcctggaagacagaacggaacaccacancagacctgcagaaccggactcctagctcatcaagggggacggggcacagaaacagcagaacccaaaaccagccaacaacaccagcgggatgcgacagaacaccccaggcaggaccacacaaccccatacaccatcatagccgaccaaggaatacacgctacagcaaagaaaatggggcttttgtcccgggggggggaaaaaacaaaaacgagcaacaccgcagaaacaagacacagggggccccccgcgccccaacagagcgagcacccgaccccaccagcctaaagggggggcgaaacccacgacccgacggaaacagaccccacaagatcacccgacacggaggccccccgcgagcgcgaccccgcgcccccacaccgccggacacgacacccaagccaaacaacagccgggcccaaccgccacaaacagacccagcaaacgcaaacaggccaacaaacccggccgcagacaccacaaaaaaacggccccgcacccccccgagcagaaacccaagagagcaccaaccccacggccacgcacccaccacaacgccccacacccacagcgaaaggaacgggaaaagccacgcgggagaacaccccggacccggcgcagagacgacgcgaggaagcgcaggcggaggaggagaaggaacacacaacacaagcgaccaagaagcacaacacanagcgaccagcgagcgaggagggagagcgcgcgcccccggcgcccgcgcacacccccgcacacccacacccgcacgacccaccgaccacaacacccaccacgcgcgcggcgcgcacaccacccggcgccaaaacggcagagaagcacgcccag

SEQ ID NO: 11645 - DNA, 990 bp, Homo sapiens
  misc_feature (1)...(990): n = A,T,C or G
tttattattatttattatanaaattgaatagtagatatgagcaaaaatcantaactggatgacgacccatataccacacttagaccctgtatcttttaaccattactccaagaataccatcttactctatgtaggaagacatcgccatcggggacgtgctgaaactgctatcacactcgcctcctacacgtaatgtgattcgaactataatacttttagttctttgaccattattgcctcgcttattgctatgcagtgggacccccggtggagactatattattactatgttcttccacactggtgtcaacctgtcccccctccgctccgggccactcctcacttcctcgttcgaccaccacctctcacccctacagtagaatttgtcgttatcgtgcgtcgccaatgtgacaccaacattattcaaaaacttaaccccaccccgcgcagaaacaaaaacaaacacccacccgcacacataaacagcactcctccacgcccctctacaccgaatatggggtgatcatagcagagaaactacaggtgagatcatggctctgctatttaattagtgtagatcagttgtcttgaccgctgtggccgttgtcctcatagtgcatcggtatgattagcatgcgctattgtagcagtttatatttattcatcacatttgtctgttcttcatgtacaagtgtgcgtctagcgatgtcccccaacttgaccatctctctaccacatacttcttcacaccccaccctcacaccctcctctttccaatatagtgcacttgtggtgtggcgttgagtgtactgtatcaaccgaatacacatgtcccagctacatctatccatccgaccctaacacaccactacatcccgcgctcgtgtcccactcatcctcccagcgcgctgtgtggcgcctacgtgatcgcttcacttcctactatatggacggagtcccccctcacttcgggtcacgtagagcgcaaag

SEQ ID NO: 11646 - DNA, 723 bp, Homo sapiens
tagcaaagaaagcgagcagatgtttgaatggaaggggaaaaaaaaggaaaatatatcggaagatggaggatatcgggtattgggattactaatggtaaaaaatacataggagtattcatactcgatgttaagaaataatatatggggcaaataaaattcctcgtatttgacttatcttcaccgtctataaaaaaaccaggaatataccggatgaaaatacaggatattggtgcttaggtcatactgattgaaaataatagaaagtgttctttagagtgccattgggttagatcgttatgagagggaaatcgagtgattcttttgacgtataaaacctactcgcagacatgtattagttatatttatcgttttgtgcaaataaggggaggcggtgtatatttttggtcagatcatgaattgcgtgcggggagctggaatgtaacatggtttgagtaaaaagactctgtatagggtgactggcttaaaaaagaagaagccaagggttacaggaagagagatttacattaggcctgcagtatgaaattatgctcatcaatatttactggtcacagaaactgtttgattcaaaatctgccagcaattccatctgtatgttaccaaaatcccttattcaggatcaaattaatccttatactatcattgttgaccaaaggattattattttacagcaaataaaatgtggcaaagggcccttgctcgtgt

SEQ ID NO: 11647 - DNA, 1950 bp, Homo sapiens
  misc_feature (1)...(1950): n = A,T,C or G
cgttcgtgcgtcgtgctgtcgnacgtgtatactcctgtcancnttgcttcgtgatgngagcatcgtcnggcgtgcggcctgtctgcatctgcgactgccgcgctgatcggtaccgtcgtcgcngtctcgtgtatgntgctgtgctgagnccgctgcgttctgctgcganntgtgtgcgcgtgcggctgcgtctgtgcgctncgcgctgcacgtgctgcggtgcgctntcatcgcgnganagtagcgatgtcgtgncnncgtggtgcgtctgngtgtgtgctgctacgggtncgtgtgctgcgttctntggtgtcgtcgactngntcgcgcgacggcgcgtgcgtgcagtcggtcgcgtcgggtagtcgcagtgatggtgcaggtcgtgcgcgctgcnntgactcgctgcgcgncccgtatgtcgccttcgagtagtgagactcgcacggtntnttgtgtgcgtcgtgtctctgtgngtgccgtcgcgcgcgacacgtcgcgaggccgcgccactggcggcgcgtgctgcgcagncgtggcgtcgcgctgctcgtgacgntgcgcgtcgcttatcgttatacttcacgccgcgcatcgcggtcntcgctggtgcgtgtgccgcacgcgcgcgtactgctctcgtgctgctggggcgccgcttctgacgcgtatgcgctgtcgctgtgcggtcgcgtccgctgctcgcgtgtgtggcgtcntntgcgctctgtgtgtcgctggctgtgtggcggctgcgtgnctatgccgacgtgtcgctctcgtcgtgcntgccgngccgttcgagngtgagtcgcatacgncncttgggatacgtgtctgcgctggtcgagttcgtctctctctgcgtcgccntcatgtagtcggtagctcgcgcgtgcttgctcctgctccgtacgtncgtcntccctgatggttgctgtctatatatgtatactnctctctctatctacgctgtcgctgtcttgctggtcgcggcgtgtcgcgtgtctgtgtcgtgtgtgacgtgtgtgtggctcttgcgacgcctcgtggtctccgngntcggttctcgttgctgngtgtgtctgtgtcncgtcctcgctgtgcgcctcgctatcgcgcgtcagcgcgtcggcgcgctgtgtagtgacgtgtcctgccgcgtcgtgcntgtntcgcgtggtnctctgttcgcgtacncacatccccgcagcatgctagctgcgtgcngtcctgtctgtcgtntnctcgcgctggcgtgtgctncgcgtcgtncgtcgcgcgcgtcgcggtgccgtgactcgttgtgcctgtgtatgtcgcgtgactatgtgtctgcgcagactacgcgtgtctgctctgcctccggtcnggtngtgtggcttgggcgcggtggtgtctcgctgtcgtgtgtgcgagcgctcctctcctctctcgcgcgcgctngctggctctgcgctgctcatggctgttgaggggtttcctgttgtctggcngcgtggccgtggtggccgtcttgtngcttcgtgtgctgtgngtccgcgtgcggcgcggccgccctcactcgctctcttgccgcncttgctccgcgtgtntncgtttcgtgtggtctgctttccctcgcgtgtgctggtgtctgcnccgtctgccgcgcgcggcgcggttctttcntcgcgccgtctcgctgtgcgcgggttctctccggtgtcgtcggtccgtacgcctgcgtntcgccgtgcggggtgcgtcgtcgctgctcgcgtcngcgtngtgcgggtcgggcgggtggtgtcgctgcgcgcggcgtgacaaaggggcgtccgtcgtcgcgcgtntgttgttcgccccgcgncaagaaggcggctcggcgctccgttccgggggcgcgcgtgggcgtcgcggctgtcgtgctcgctcgctccgctgtcttgcgtgtgtgtgttgtgcggt

SEQ ID NO: 11648 - DNA, 1420 bp, Homo sapiens
  misc_feature (1)...(1420): n = A,T,C or G
atagangatngcatnatcntggacgagcagatgagcgagatatagatgnncatgcgcgtcgagtagcgacgagcgcgngangacatcgagangntcgctgcgcatgagagagggcaggagagcggaggatgtgggaggcgtgngtgggtngtgagctgagacacacatactacaaataacagtacnaacgcaagananagaanactacagnnagaatacagagcagctacacgcatagctgagagtagncagtangagacgcagtgagagaantacataagtagcagcatacaagcggcacgtagcacagcgatagggaagagtgtngtagtcagagcgacggtgganagacaatcagcggaaangagcgcgcacagctctgagactgcagggcgtgtgagaagataaacgatacataaagagtagacgacaatagtggcgatcatgtngtaatcttgactcaataatgatagagagtactgangagagtagagataggtangtggagcagtacaggagagtgaagaggaggtaacagttagcgccgctgactgtgtgtacacatagtaagtaagagagtagatatagaatatgtagcttgctacgtgtaggntgcgtcggtnatgcgctgtggcactcggtatatatgtgccgatatgtngctactagttcagcgcgagagacagngaccaacagaaccatgagaagacgaggaggaatcgagnnnnatagacacgatcgttataagcaagacggctgangnaactattaattactttaacagagtgacgtcatgtagcgtgaatcgcactgctatatacgtaangcagatgagagggatgaccatanaattgctgatataggaggctatgagggatcgagatgacagcgagcgggaggaatcagactaaaacgagacgtggcacatgctgncaccactgtacgctcgtttacatnancgactacaatacttagtatacgatgatggcgcgagacaccggnacggctcgagggagcggggcgcgggagcgcgagaccatcatgagcgtctanaggcatgngcagttncgccgtgggggatggnnggggcaggcgggctcggccgcgctggngggcagtatgcgcgacatagtgaattannccacccagacatccattgtcactgtgtantctaggggagcacgcgagntagacagttgttngcgccgtgctttggggacatctctcgaggcctgatgnaggcgtagtcagctggtggnaacactgcctgctacaatgactgtacactcactgagggagcgggtgtgccgggcgtcgagagacacatgtagtgtgagagtgatgtacgacgtaacagataggaacggngatacggacttagacgtgagcaacgcagctggaaagttgtaacacgagcgac

SEQ ID NO: 11649 - DNA, 898 bp, Homo sapiens
  misc_feature (1)...(898): n = A,T,C or G
ctacggtggggatggggatcttgtccccacacccacactgggcttgggtctcagttttagncacccctcaaagaccaagggggagaaatnacttccntatcttcanaatntaacttngataaanngtngtttctgggngacatttactgaaaattaacacatngtngtagccttaaaattttagacttctcgaacatgagggtngtacagtaatttttttaacactgggcgtggggcgtttctaccttaggggntcngtgagaatatttataaaataggcntcnnttccttttaaattttcttagagaaatttctctgggggtcagttttaccacccataaagcggagacaggaatttataggtaccctttctgacccacaaagtatgaaaagtgtccgtaatctagaaactcagttctggaatctggattatggggatgattaatataaaggtgtattttccctgggcaaaaagagagnagggaagcgcacaccaccccgcccgccgacagagacgcncggggggggggnggggggggccggcgcgcccacgggcgcggccccccggcccgggacggccnnnncagggggccgcttcggccacgggaggggcttgccggccctcctcccctggggggggggaggaggaacggccgccccaaagcgggcggcgcgggggnnnggggggcggcggggggtccacttcacccaaggggggggaacccgtcccccaaaggngggggggaggagaaagatccgtggacggggcgcccacgcccccaacccaaaaaccgcttagtgggttgaaaaaaccagcccccaaaaaaatcaaanaaacccctcgacgggggggcgcccccggggggagaaggccggccgccgtgaagttctcggccgt

SEQ ID NO: 11650 - DNA, 1566 bp, Homo sapiens
  misc_feature (1)...(1566): n = A,T,C or G
cggctctaccacgctcacgcactcatttatactaccgngtactccacttacgcagagactctcgcatgctgcctcgcgctattcggcnagacntcgtacgaactctatctgactgtgtgtgctctcgcgttcncgccgtctcgcccgcactctcgtgncttgagtgtcgatatggcgcaatccactgcgcgcgtgcagtcgctcgcgttcaagtgacagatcgcatncgcagtgcgtgtcttcttgtatgctgacgaccacacgttgatgagccgacgtgangatgtagtagagtcgtgtgangacgtagcgtcgcgcgaagtgtgtgctcatgagagtcgcgtcgcgcgcgtcactccacctccgcgtgtatcgccatctcgtgcgtgcttatntcttgtggtnctgttgtctctcantcagactgcgtatacagctgtagttcctgcacagtacgactcncacatcacgcttgccgagtnacgacagtactngttaccacncacacaccacagctaagtgtatgccgtcgcgtatgcgtgtggtgtatgtgtgtgtagtggtaacgtgctcagcgcgtcgtcgtgcggtgggtcgtcctcgcgtatatgtattcgtcgttcgtcaggtcgactgtacctgcacatgcacgatctctttcgctttgttctgctgtgtcctcgcgtgacgacgtgctcgtgtgtcgtgtccacgtcctctccnctccccgcgcgcgcgccctcgcggcggcgagctcgtcgagtgcgcatcgccacgcgatccgcgagaggctctctccgtcagacaccaccgttctcccttcacgctctctgtcgattcatgcctgtgtactattcactaacccccttcgagcccgcactcatactgacgcgtctctctattcttctctctacagcgctctcctcntnctactagcactacgtcacgcatatacgcgtacacgccttcccttcacgtcagtgtgcatcacgcgtacgctcagtcgatttgatctgtctaaatattatactcagtatgtaatgtgttattcagctatatatgacgtgcgtgcgcggttcatatcgtgtgctctactgtgctctcctcgtgtatcgcgccgactctgcatcgagcggctgcctcgcgctcgtgcgtcagctcaggcgtgcgccgtcgacgtgtgctgttgtgtctgagctgctgtgtgngtcgatttttacattactatatggttctatgacgttacctctgtgacagtaactctcttctcgtgtttgtctgctcacgtccggtctcacttggttgctattggccacagacggtcgcactntgtctactctctcttgcacatctcgcgttctcatctgttctccacagtctccgcgcccgtgctgcgcctggcataggtcgtctgtggtcctgtctgtcttcgtcttcncagcatgtctgtccgngttctncgtttntcgcccnctatcaaggcgctcgccttcgcgtccgtctcntngtcgtgcctcgacgcctcgcggttagcaaccagtgctgctcttcctgcttgctctcgct

SEQ ID NO: 11651 - DNA, 1085 bp, Homo sapiens
  misc_feature (1)...(1085): n = A,T,C or G
agtggtgaactacaagacgaagagagtaatgagggacgtgtgaagaagagggacaaagactctccgggacacgctgtagtgtgcgtggcgtgatcgtggttaccgcanngaaatatattatttacctcatgatatattattctatggtgatatgtntacagagttaaggatgacatcgatctacgagaaggcgtatccgagcagccggtcgcactcgtgagatacagtaacaactgccaaaggaaggatgaagatagaggtgcggaagtaatgacgatagatagaggaataagagaaggcgtaagaggtcacatagaaagctcggcgcgacgagagacatatnanacttcactactgttgtaccctggcgcggtgcggtgggtgggggtggtggcatggagggttcgacagtgcacccagcaggngtctgctagggcgatggggcagtaagactgaaaacgacatacttgaagcgtatcctagtcgctgaattgagtgtccactggagttatttagttatagactattagaggagtgtaggtgggacagtgtggccgagtgtatangaccacgctgccggaactatatcgtggtgcacagggcgtgtaagacagccgtggtggtgggggcgcgggagngctgtggcaggtagtgagatgtgggagttgggccgtggtggttagagggcgtatgagggacagtggactcagctgtcaaagagataagtagccggggagattggaatggcgaggagattctcttccacctattctccgtgcaggggaggagcggaagggtcgagtcattgacttggggtaacaagtgctatggcgcgcgtgtaacccgtgattgagctcagacacagctccacagcactgtacagacggcactgtggtcagaccaccggttcacatgttcactactttggcactgcggcgcgggcgccgcgcgcaggggacttacccatgacgagcaagtggaacaaggagaacgttaatcgatacgataagcgtagaggttacataataaatcgtctagatttcctttgaaatgctgtacattataatttacattttaaattaggc

SEQ ID NO: 11652 - DNA, 1132 bp, Homo sapiens
  misc_feature (1)...(1132): n = A,T,C or G
ggaggccgtggaccgtctatcccacatangactactatcgtgctaataacaccctctggctcgtccccgcactctgctgaagtcgcgtggggtgggngcggcgatgctgtctcgtgntcttgttagcgctcgccttcacgcggcaggctgcatngtgagggagcgtgagtcttactatgtgatnaaccactgtttacggcatggtgcgtagctggggggggccggaggcggtgggagagcggcggggagatgggtgaggaggtggtggcggttggggctcgttttactatagngaggctccaacccaaagtcggtaccttaatacgatgagtacgacgataggaggacatataaagatggaggggagcggcgggagtgatagtgagacatacagtcgcgaggcacgtggtagcgacggacactagtaggggggctgggtctatacgannagggagggcgaggggcacgacggaattggctcggcggcggccaatgatcgaagtgcgtggggcgtgggtcggggctgttggaacgcattatcacacttaacgcgcgcatttaaatatcttcgttataggggacagccgtacagagaagatctgtcaagcnagcttantacgaattcgttcgctatctctactctctacacttctgtnacccgccactngcctatcgctgtgtcctncctctactttcccctgctagtcggtctggggggcgttggtgccttcgtagtgcaatagaatcatgatcgagacgaaaatagacatcgaaactaactgctgcacgcagccgtacagcgcgaactctcgatttgtcgcttattttgtgcttgctgtcaatgtcgcgctcacgcgctcacgatacccatccattacccagattaacatgcgctagaaggataagtatnganatccagtttctaataatacttgaatactcttacactgaaaccccccctannacacttgatctctctctctccacctagctcctgtgtgttctccttgttattcacatgtattccacctncctaccaccaaaccactagataataaacaaataaccatacattancatnttacactnnnnnncactttcttnnaatnaacattttnnnnnnnnccccaaa

SEQ ID NO: 11653 - DNA, 1034 bp, Homo sapiens
  misc_feature (1)...(1034): n = A,T,C or G
cggctctgcgctctctgtcgtgcgctcggcgccgtcgattgggtctgcgtcgcggcgttcctctgtcctggctgctggcgtcctcgttgtgtcttgctgtttctggggcgcgttttcatgngtgcaccgtcgtgggcggttgcgccgcgcgcctgcgctcgctgctcgctgtccgggcgctgcgcgctgcggggctcccttcgttcggagtgctctttcttgtcgtctgtggtgttgtggtgggttgtgcgngtgttgtgtgggggatgtccgtttcgttcctgggggtggttgtggtttggtgcgtgcctgtaggttgttctatccgttctctctcgcccgctccttgctgtttcgctgttggctgtcctccctccgcgggccctgcgccgctccgctgtcttttgttttttttggtggtttcttcgttgtccgcgcttcctcccggcttcgtgttacttgttgttgttggcgtggtgcggttcgttgtgtggtcgctgtgcgttcttcgtccgccgggtgtcctcgggtggatgcggtggctggtgtgtggcggtgtggctctggtttgtccttcgtgttgtgctttgctggggtgtgtgggtcgggcgtccctctcgtcctgtcctcgcctgccgttttctcttacgcttctttggcctctcctctttccccctggctctgcgtctttgtttgttctcgtgttctctgccttctctgtccgcccgttggcccccccgcggattgctggtgctccgttgctcctctgctgtggccccgttccgcgctgccgcgtgctggttccgttgttcctgtctctcgcgtggtgcctttttgtttgctctggctgtgcggtcgggccctcctggctcttccggctctcttctctcggtctgcgtcgtggttgccgttgttgctcctcggttggtgcgtcggcgcggggtgtgcccgccaaaggggcgggggttgccccgcgaagggggcggttcgttgtggcgcttgtgcgctgccgctcgtcgggtgctcgccgctcg

SEQ ID NO: 11654 - DNA, 1141 bp, Homo sapiens
  misc_feature (1)...(1141): n = A,T,C or G
aggaagaaaataatcgctccgcgcatgtgggagctgcatgcagtaggatgtncgcactcggaaacgcgacgtcagctatatgcgcatagctatacctnggaacaaatgcgtgcacatatagagatgcgggagtgagntggnnggatagtggattagcagttcgatacggtggttaacaatataaaaataaattcaatataggaataagatattggngacaagatgattggacggtgatggtcaacgtagagaattaaacagtggaggtgtagaggtcggtgatttcggtcgcgaggtagtatgatggagagtagtgcggnacgcacaaaaacacttgtgacatataaaagagagaatggatgaacgaacggtgaagtagtgcgatgcggaaataaagtggaagacataggtacctgatagaagtacaaggagaaagaagcgcatgcgacgtgagagctatgaaataggtgatgagggcttatgaggcaacatacatatantgtatgatagctagcactggaagataatgaacaagagaacggtataatcagtcgatccgttccggtcaacgtggccgagagggagggacggagatgaggagcgaatgattcacgatangctagatcaatagtaaagtaacgacatatgncgatttggaacctctacgcctaccaatactattataacttgaaaggacgagtcatagcanggcaggatggacgagacgtccgaaatgactaatcaccagtanaaagacttacgaagttataaaggacagccggaggatgggtggggagttagaacgtagtgacagcggaaagaggaacatgaacatagaagtagactgaanngagtaccacgttataaaccaagnngaacaccgagaatccataccaacaatgcgcctcacttcacgttnggggatggggcgcggagcagaagatggataccgaaaaggatagtaagggtntttcacaacaagacacttgagaagaagtcacgctgnaaaagttacataataagctaatatagaaaaaccagcgggtaagaaaagagaaaacaaacataaactgttacatacgaaagaagagcccggaaaggataatggcagggaacagtaacatgacatgtggaaatacaa

SEQ ID NO: 11655 - DNA, 400 bp, Homo sapiens
cttcagaaggccaactgcctcaggtgtgtgcagtcacttactggccctggaaatgtacatccagaacagaatattatcttcctggcagccgtcccattcagcctgtgcatggagctgtcccaagacctgagccttcttagtttggtgatgcttcactatggcttcaactctccaacttctgccctccaagaccatagtgataagaaaacaaagatcaactacccccgagctgggaggaggactccttttttctctgtacagccttttatatgtttaacttgcttaccatgtaatatggataacctatgaaaaagatttcacgtgtatacctttttaaatcacttactctacttgtttgtgaagacaaaaataaatttaaaaaatgccaaaaaaaaaaaaa

SEQ ID NO: 11656 - DNA, 840 bp, Homo sapiens
  misc_feature (1)...(840): n = A,T,C or G
agatcagaacaagtctcacgattctggagacaagaaagtccacaatcaaggtgctggcagatccggtgacagaaactctgtatcaacagagcaaacagacaacctatagaatgggagaaaatatttgcaagatatgcatctgacaaagttctgacatccaacatctataaggagcttgaacaaattcataaggaaaaaacaaacaaccccattgaattttctgatgactaataatgctgaacacattttcatctaatatcatttgttttatgactgaaacaagagtgttttccaaagtgtaattaaaaattctttctatgaagaaaattttctttgaatataaatcaacctttgaaatcaagacccaacatgagtcatctctgtaacagaacaggtattgttataaatatgcatttgaaaatcatatgtaacaaacattaaaaaactaaaaatattcaaaatttctcacatttatacactaacaatttataaatgaaaatttatcatatgtattaatgcatgaaaattatatagtgtactttctttntatatttttacaaacatttttctttggatgaaattgattaatgtctcanagtacccaacatattcaaaatgatgcaaaaagatttagaaaatctacgtatctattatagcaattgaatttgtatttgaatcttacagaaaaatatcttcaagcccagtagcttctcataacaaattttcaatttttaggagaatattcagctaccaaaattttttgaaattggaagagaaatcttcaactatttgtgaggtatcttatccaaacctatataatttagaagaaaaaaaaaaaaa

SEQ ID NO: 11657 - DNA, 580 bp, Homo sapiens
  misc_feature (1)...(580): n = A,T,C or G
ctcaggacactcattgccgtcctttactggagccccgagccctgctgcagacctccctggttttgctgtgcctgcttctttcatgtcctaatcgccaagtgattaccattcactcccatggcgatgacagtaagaagacatgtgccctatcaggccctcccatctcccctgcgccaggaccccaggagaggcacgctgatgtcactcccattgcactgatgaaaagactgaggctcacacaggggtgagactttgccaaagacaacagaatggaagcctgtctcagggccaagcccctggtggccccagcagcccgggaggcagggagggcgcggcatacgggcaggggagagcgcgcagcaggtgcttccacaggaagaggtgtggagcacaggggaggctctgcacagggcccataaaaagcagcatggcggagtgcaggtgctcacatctataatgccagcactttgggaggccaacgaanaaggatcacttgagcccaggagttcagaccagcgcgggtaacatggcgagaccccatcgctacaataaanacttataaaaaataaaaaaaaaaaaa

SEQ ID NO: 11658 - DNA, 282 bp, Homo sapiens
ctcaggttgatcctcctgcttattgttctcatattcctcctcccatggctgactcctattcttcttgaagacccagttaaagaaatccacacccgggtatctactaaaaatatacaaaaattagccgggtgtggtggcctgcgcctatagtcccagctaccccggaggctgaggcaggagaatggcgagaacctgggaggcggagcttgcagtgagctgagatggcgccactgcactccagcctgggcgacagagcgagactccgtctcaaaaaaaaaaaaa

SEQ ID NO: 11659 - DNA, 987 bp, Homo sapiens
  misc_feature (1)...(987): n = A,T,C or G
ggccgaccgacacggggccgggagggaggggttgggtgtatcctgatacccagctggtatcattttgcttctgtggcaggcagtcctcaagattgtcccatgatccccaatggggggggtctacaacatacatattttcctcttacatagtactccagctatatgatgaatcctgagccagtgcaatgcagagaacctactcataaattcttcacaatatgaagctttgtgaattaataaatatttattgctttaaattgctaagcactgtggtggattgctatgccacagtatatagataataaagcttttgataactgggcacagaaagcgcttcgctactcgcgcgggagcgtggggncccgcgcgaaatcacgcagccgcacgcgaggatcgggcccgcgcggccttccagggggaacccttcggaccgtttcgttatagggaggggagaaacggaaccctcggaaacagacccttcgggtgggggatcggggggtgcagggcggaatcacctccgcttcaagggcgcggtgtctttgttccacggtatccagcggataatcgtaaaagaagggtggggcgcctactgggctcagtaggccgggagcgcccgaggagggccgtccgggggggctgtatacggagagggccgccccgggaggggaagcgaatattgaggggtgggcaaagaggagggcagacgggagggggtataagaagtagggctttgcgcgtggaccgccgtgtgcgaatgggcgtagacacgcgtgcgcaccgggcacctggcggtcttgccgcagagggatagaatcgatgtatgtgtgtacgccgcgggtgtgacaccgtgcggggtgcactaggtcagagggcgagcggagcatattctgtgcgccatcggccttggcgctacggccggtcacaactcgttgcgcgagcgcagcaggtctgcgccgcgtgctggggagtgaaagagggaggagggtc

SEQ ID NO: 11660 - DNA, 1521 bp, Homo sapiens
  misc_feature (1)...(1521): n = A,T,C or G
agtagagatgatacgtgctgcngtacgatatagcgtacacagctnganagtgatgtgagtagacgcgtctacaggagcagaggatgctatgcgttagacgtncgatngcatcacntgcggtgtcagcatgnttatctgatatagatatatgatatacgatagcantcgctgacgncgcacgagagctncatctcagacaatcagcngtgactagtctaagatcgtaganagatcagagtatgtgtgagttagggcatgtgtcgatgtataatgtgttagantattagtcagacatagaccgnanacagttcagtgtacttcgcgcgnaccgcggttntacgatacatcgaaggctgcancgctcntcgacggatcgacggttgcgcgcngcgcttgcgtgagcgcngccgagatgctgctagctaatgctcacgatgctgtncacctctgcctacgtgatangntgactgtcgatcacgcttnatcnctttgcttctcctcatgtgtcgctctagtagctnactgacgagatagttgatgacataagatangattacacngactatagatgacgtataagatacagtcgtgtngagacgtgtgtgatttgcgattgtagtgactatccgtatagtaantacatctcactcggacgcacgaagcaaggatcagagacattgacagtagtagtatctgtaattgttgtagctgacacgtcatacgcatacgatcagtaaccgcgactancgtcgctggctacgtgagcgcgctcatgccggactggtcacagtcgtgattcgtggctccatgcgaccatactccgatggattctcgacacctatcacagtcgtttgacactatctgatcgctcatgcatcatgtgccttctaatgagtgtgttagtctactgcttgtcctccgtgcaggcgtccatattctcactatcacntatcaatatcgacacataacataagagattcggtacgatcntgtagacacgatgngtgtatagtagcacngttagtatagtgccgcagagaaccatatgaggtcgagatgcatcctacactgcacagctaccgcgctcagtgatctcatatagaccagatacggctcnagagacatacaagggatggaaaagttaggcaacgcgttacgcgcggtatagacatgctgagagtatcgagacatgtggctgcaaagagatcgcttagatgacggcgcatcgttcgagcggtcggaattaaccagtcgtatacgcgtagaggatggtgacgtatgtatgtatgatgtgactagtaatcatncatcgacgtcacacgaagtatagtgcaagatacatgaacgaataattacaactgacagactcacgtagacgatctcacagtgctcgtgagtcgtctgtgcnccatgcgcacagtgagtcgatagacagtcttcgccgntgttcctcagtagaccaggtgctgtgatctcgtgacaactctgcatcggcacgcttagtaactgactcatcgcgct

SEQ ID NO: 11661 - DNA, 1336 bp, Homo sapiens
  misc_feature (1)...(1336): n = A,T,C or G
ggtatgtgagtattatcaaactctctagctatatcccagactcccgataacgatgcatagaaaagaggtccatacatgcgctgttacgatgcaactgatgatccggcacctaacctcccgacagtcgagaggtcactgaagcggtcgctccggagggcccacggccgacagctttcacgtccatatcgccgttaagccatcgccgtgcattcttgtctccgcgtaccaccacggtcagacctacgatcgtgttcatgctctcaatctgtcttccgtgataaacaatatttacgttacggtcggcggggctcacacaataaataaaatacatctcggcctaaggtgatgcgacatcaagaaagagcgggcaacatgtatgtgtagctgacatgatagtttaaaacgcaaggacaggcgaagtaccgcaaattagcaatctcctgcggcaagtttgggcgatcatcagtagaatgatcatcgcctcaactcacgacgctattgggtatgtaggtataggagtgatagttagttattaagtatacgcatacgtgcgtacttgttttctgtctccatctgcaactatagttctagatttatatcgtaggcagatatagatgttgtggaggcgcagcgacactcacgtatatcttcagtacgttaggttcatcactccatttctgtataatgcgtcacgtctctcgctagctgacgcagttctcgttactgcgctctatccncgtcagtatggntgaacacgatcactatatgtatactataatgataggagtatgatcgcgtctattacgcggactacccaggtcactactatgacttactcctctactatcgttcttatgtacttctntctaatgcattagcgatatgacgtcgagtctgatcacatacatctctatctcgtgactgcgcgcncacgcgctcgacattctcnagtaactcgcaggtactatgcatatcagaacatacagagacatgtnagaggagtattcgaagtcgcaataatgcagatacactagttggcgtataaggttactggtgctagtcctattgatcgccttcgcggntgtgtatagttatctcgaattatatatgagacacaggtgtgtagatcgttacgtgatatcgctactctgaattagacctcatcattattatgactcatcattgctcatagcgttgacgatatggtgtgccgactcgaagaaagaggtacgcgtacgacacacacagctcatcacgagtgctctgccccgttctaccatcaccgtcgctgatgcgtatactcaccgacgacagtcgtctctcgtcgcacgctata

SEQ ID NO: 11662 - DNA, 966 bp, Homo sapiens
  misc_feature (1)...(966): n = A,T,C or G
agcaaaatacactactttcacaagaccacggaggaaacgtcttatagttnacncgcggaggcngccttagaagnagngacacacggcggaacaggaaacaagggcaagacaacaaccttacagaggagagcngaggaacacagacccccaagccagagacacacagagagagaccacacgcccccgcgagacagccacgaccggcaagcggaagagaggccaccagacaacaggcaccgcgcacacagccgcacaagaaangcaccgaaccacacaagacaggagagaggacattttttttttgggacgcaggaacgagaggccccaggggcacaccagccaaggcggcaacacaagaacccaccacacaacgacaggcgagaatcctaacagcccgacacaaagcaagaaaaaaaaacccaaaggccacaggcggccccaaccgccgggcccacagcaggccggaccacctcaaggaacgagacaacaccagcgaacccgccaacaaagacgccggccgaccacggaaaacgcaggagcggcaacgcgcaanaaaacccagacgcaggggcgaccagaaacaggcccaccaccgacgacacggggaaaaccccagacacgaccaccngaacagaaaggccaccaaaccagcnacgcaccaccacaaaagccccccgaagagggcgacgaaagaaaagccccggcccccagcgaaaaccaagccccaccgaagcagcaacggcaagcgggcgaccccccaagcgccacaaagaaccagagaacccaccgcgacggcacagacaaaggtacgacgaaccccacagccaccacaccaacacaaccgacactccccaagcacagacgccctaacctaccccaagacgacctactcgaacccataaaacttcaagatatctggccatcgctactccccacactcgcctatccaagagcggtctagaccct

SEQ ID NO: 11663 - DNA, 1511 bp, Homo sapiens
  misc_feature (1)...(1511): n = A,T,C or G
agtgatgtgangagtagcgatgcctcgagtgcntcgagcatggtgtgnngcgtgttgttgcgactgtgcacacgcgtggcggtggtgcgtagagcatagatcatcgtactatgctcgtgcactgagtagtgntgattgagtatagtgttgngngtagtcgtgactgtataatcatgtgcgtgtagacngtctcgctcacngagcgcgcgtgcagtcggagtatcggtagtggcgcggtatagtcgtngcggatgctcgagatatgacactgatacgctgcgacagcgcgacggancacataacgtatgcgagtggatgatagagagtaacatngatctcgacgacgtacgcgctagaacggcgaggtgatgctgcncgcggtagtcgagtgcgagcggcgaggagcggcagcggngacgaggcgcgacgagtgttcgcgangatcgtacgctngggcggtgctcgccgactntgtgcgatgtgctgcggcgtacgtaatatctcganggtggcagcgtggaggagcgcggatgacggtcattatatacactgcgttgctgtctcgcgagtgcgtagagtccgcagagctacagcaccgacgggtacgaccgcgnacgcagcgcgtcacgcgcaacacgcacacaagcgaagctgcacacacgacaactccgcgtagctgaatattaacaccctcatcgttcatctttgcaactatcttatactcttantatataatattacatcctcatcgcgccattcacaatcgtacacttacatactcagtgtctcacgtgccggcggcggcgccccgcaccgccggtcctgtgggtgaggtcgcggcgatcatcaaattanaccgttgtgtntcctcgtttnagtcgactctctgcgcggtttgtggtgtatgttccgtactcgatcctcaactcgtcttctattgttgtcacattgacttttttattctctatagttattatcaaggtgatgtattgtgcgtgtgggaaggtagggtgttggagatggtaanatacgtgataactaaagngatgataaataaggtaatagtaattaanggaatatgnagagaagaaagcaggcgacactggctgttccntcgcatgcgcttgagccgtcggatacgactacccttcagctgtagtgctcgactgtnctccgatacctcgcaccaccgacagcgctcatgtacgcgcgagacgcttcggctaaggacaactaataaagactaattangaggttaataaatanatactattattatatataaatatgtntaatatataaatatatagatgtcttagaatacttactatnatacacacaaagagttagacaaatatcaatataaaaacactttnctaattactaatggttatctactnttctcaagaatttaatattatactacgtcactaacaaaaatatatatntananatacctttatttannataataaaanaannnttnnnnaaacanttttatattttttttt

SEQ ID NO: 11664 - DNA, 913 bp, Homo sapiens
  misc_feature (1)...(913): n = A,T,C or G
ctttgtatacataacaacaacaaataacaaaccctttcacattcactaactgaagcatgtccagcccctctccagcactcactccactgattgctgcagctaaggaggcaactacacacaatcactaaaaccacactcaccccaccctcattgcgccaagccttctgtgagacaaatgcacatttcacacactccaactcactgaagctctcttctccttgcacttgcttctcccacttcctgatctcgcactcctcaacactttgatccttgcaaaccgagccgcccacatcgcacaaaactgacacccaatgaataatcccctgatggtcattctctactcacgcgacttcacccctttcctgcatactccgcccctcccacaaaccacccaccccctacctcactccacagcccgatcccccccacacccatgccccaacacacacaacattctctgtcccacttacccctccctcttatccacccaccttccacccccacgacccaccataccacaccaccacccccccccacttctttaccccctaacccctaccaccctcgcgtattccacaataacaacacacaagtaaaattaacaccacacccacacttcctcctaagaatccagcaatcacaataacactatatcaaattttccccacacacacaccaccattataatgctccacctgagctaacatcctccccccccncctccctaaccactaactcccgcactaacatatatatcaatatattaacaacatatatacaaactcgactacctccatcacccccccaccccaccctccaccacacaccacgcccaactcctacctacnctcccataacacaagtaaagaaatctaaacaagaatccataggccacgcaaagatgaaaaccagc

SEQ ID NO: 11665 - DNA, 477 bp, Homo sapiens
  misc_feature (1)...(477): n = A,T,C or G
attctacagagacaaatatattaaaattcttcaccccgcctacagtaaccacgtgagacaccgctccaccgagtctgagctatcttataaacacacgacacacacgccaatattatttatatctcacccacactagccttcacatatagataaccacgtgcgagcgcgcggcagagtacttaatcaactcactccatacgtcccagtgttatagcaataacgcatgatttgtgccccaccgcccacgtacgcacggcaactcaattctatccctgcgatagttcatcaatagaacttccttggaacgtcaagttatctacnctagaaatagaagaggacagtaaatataatgacataccgaatagaagatctctcattaactcagatctatataaatgtacaatatagtcacaataagagacctttccactcacacgtatatgcacacttagttaatgaaagaacagagaggtccag

SEQ ID NO: 11666 - DNA, 1754 bp, Homo sapiens
  misc_feature (1)...(1754): n = A,T,C or G
gtgtgtggtctcggcgtgntgttaagtctagtatatagcgtgntacaagataagcatgtgagtngcgagcggctgagatacgtctagtttagtctatagagagtggcatctgtatctccacaacatatctnctgatgtgtatgtgtgtgagtaaagagtgatntgtatgacagcgagtcgatgagctgatacgcatgcgttcgtctgcgtgctatcaagtgtgctgtctgtcgtgctcatatgcgtanatgagatagtcgtatatcatgtgtgtgatnctgtcagacgcgtgtagatattgcgtgtcgactcggcagcgccgtatgtccgactcttgatatgcgcacatgcgtcgtatgtgcgcttgtcgccncacncatcgtgtcttcgctggtgatcgacaaggnctcgantgcgcgtcagcgttatgctgcatncggtcgggtgtccgacacgttcctgtgacgtcgcgcttgtgtcgctancagtattatcgctgcgttatagtctatgcgncgatggtgattgtgnatatgtgtactagttntnagtcttattactattactgttacttaactgaactcctagtacgtctcattctgtctcntatccttctgtagcatatagatatgactgcagtctgatcncntgcaagctctcgattacagcgtagatactctcagtgtgctagacgtgcgcatgctatactgtcatagttgtctctagaatggttaagtgttcacactgacactagagcgtcgttttcatcatcaatccatcacacggcactaatgtcgtagtatcgcgatacggattaggtggtctgctcgcgctcgagatgtatttctctccggagtccatgagtgtgtggtcgtcgaggtgccgccgagcgtcgtgtgcggatgntgaagtggaggncgacggcggcgccatgcgtagtagcacgagtgggctngcgcaggtaggctgccgtatgatcctactagatcgttatctgctgcgtttgcagtgtgcgtgatattactctgtatcttcctacacggcntgtcttgcagcatcacactgtagtaacgaatcatgtagtctgtgagagcggtagtgtagcgacgacgccttctgtgttactgatcgcgcgttgtgatnctgagtgtggtcctgctgtctctcatgatagtgacgatgtagtgtagctctgatgtatgtagctattctatcacaagtcttctcatcacgtcgcggatgacagtcgcccntatccagaganatagtaatgtataacgtacgcgtgatggtactagtgcgactctcgttgntctctgtgatacagcttctgctcgtgcatatgaacacgagctatctagagaatgttgcggcacgtgtcgataccacgctccaatgtntgtcgtttgtagtcgctagtgtganactgtgagggtagtatgcatgagtgacgtcacttatagtgccctcagctagactctgacgcgcgtcgctctgcgctagtcgcgtcgcacgttgtcngtgtgtcgattngtatgcatgatgcgaggtacgacgtaaagttacacagtantagnacagctacgtcgtgatatgataacttatacctagnnncagtgaggtgtgagagatgataagctacagcacgagagacggtacacatatagtcttcacntcgcgtantacgcctagatctgtgttctgatanagatgatgctanactatatacgtacatgacgtntacactactatca

SEQ ID NO: 11667 - DNA, 1008 bp, Homo sapiens
  misc_feature (1)...(1008): n = A,T,C or G
cggcagaggctgagcgtgcggcgcgcgacggatatccttctgcgccgcgtgactagtcgtcctcacggtcgcctaccgagagtaagagcacgcgcacagacgccgacggacgcacgccacggagcgtgtacagcgcgcgtgttaacatagatattcgtgtcggcctcgcagctgttcgcattggcacagcgcagtaatgagtgcatcatgacgtccgtcgacgatatgttcgtgatatggaagtgtactacgatggngagctgttggcatatatactggagggtatcgataattgcctcatggcaccacttgcacagctcgctgtccgcgccatgtcgccgcgcgacgcggagcacagcagagcggacgattagtgtgtctatgctcgcacgtagcagcgcgcgccacgcgccgcgacctatcctaattattatggagcgccacggcagtgcgtgtgcgatgccagggatctagttgttaggtgtcttactctatagtctcagcgccgaggcggaatggcgacaggtgcgagagcacgtggagccagcttggcgtgatgtaacgattggcagcacctcgtaagtcccagtctcggcgatagacgcccgtgtccaacgcaacgggtgtcttgcatattcgggcggacgaacttaaagagactgcgaataggatagaatgcgaagaaactaggatcgccgtgcttgtgtgtatgcgggttgcgttgtctaacgccatctaactgcatccaacatcccggcacctgactttcttctctacgtcacactcctcaccggccgctacctccacagtattgttttgatcttcgcgctgttagttgagtttgcaggaatgtgggtattccgatgaaagaacaatcgttagtcgcccggcaattcatatacgtgttcagacatcacatggtcacatgtacaccgacgtcgcgggatcgggaaaccgggactgaagatatgcgagggaagatggaataggcggataaaggtgagcggg

SEQ ID NO: 11668 - DNA, 1525 bp, Homo sapiens
  misc_feature (1)...(1525): n = A,T,C or G
tcatctcagaagtggacgaagagcgaataggaagcggcgcgatatggtccgacnacatctcgtgtgggaatgcagcctattgtggcacggccttnagtactagcattctagtacgcgacactatcgctcgcgatttcacttctgcgcaanggtcgaccaccgacagcgctcgaaatcgaggagggagtagganggtgangcgcgcgcgacgagcatccatgtgcaatacgcctgaataacacgtagcacaanaatngnacatcgcatatgcgtagcacgtcaataccgctaaccgctcctatcacactctcatcacanaacaataagcgctctcaacctcagcgcgcacggctgtagatcancgcccganagctccactagccggcagcgccgcgtggctcataagaacacaacacatattatactgcagagttgataaacatacaaagcgatatagcgggcggagagcnaccagcacgatatgtgagtctacatctgcgtccgaatgataaagaatatttatgagatanagacactaacggtcgcnagggataacgtggctgatctcgatgtacgtgcatagccaagcatgacgtcgatagtgatacaatagcagcgctcgcagctcctcagcgtctgactcatgcgagacgcagacgctagccgaccagagacacagaacagcagcacacgcacgtacaccacactgcgcccagtacgcttatctagttgcgggctcgnctagatgacatcagtgtgactccctctacactcgtagcgtgctagtgatattgtcgacgcgagctcatgtgatgacacgcgcacacagtgtcaactgtacctacagtagacgcatatatcgcgtatgcgaatgcgtcggactacgcaacatgncagatctgagtcgtagttagactgagagtcaagctgagtatacgactgtcatgaatttcgcncgcgatacgngagtaagtacgcgtatacgtgaacaagttgaatcgaacttccgtgtgacaaggtagtcgtgcacactacacgacgacacagatcaccacaacgcgangcacgctagangcacaagtctcactcagcgatgtgtaggactgctntgaggcacacgtagacgtggtagtagtggtagtcgatcntgaacgcgtgtactcgaagagatngntagtgacgacatacagtagtttatgctactgngcatggcagcgacgtgacgtgtagtgagtagatcgtgctgatctccgagctaggactctatcaggacgcnactatgtcttagctgagcatattgactcgcggcatcgaacgacatgtcagcagctataccgatcacacgccatacacgcgaagacagcctgtcatctgcctaggctctcactccactcgcatcgacagaactattatagcgcactcncagccaactatacctcgtaatcgactgcgtctcttcatatagaggtacttcacanctnacacgcaatcncgactgatagantcacagtaananagtatnacg

SEQ ID NO: 11669 - DNA, 590 bp, Homo sapiens
  misc_feature (1)...(590): n = A,T,C or G
tatattattgtcttagttttatttcatacactagctcaagcccctctttgactgcttctcgcgttgcttgagttatagtagttcgctattctctcctatccgatttgcagctcagtagagtacagtgtcactgatcgtacactcagcggcgcgcgtgcgtccctcagtggattattgcacatgctacgtcacactagtcctcttgctatcacgcatnatacagacgcgcccagactcagataacatttacaatatccgcattaatcactctcaagctaccttgctcttcgattatgcncgtatagtcacacgcactaagatagtaacgatacgatatactaaatgctatgagtgatgcagagtgatagactctaaggcgttatgcagtcgaggtagtagaaattgcntctactgtgctacgcgcctcatgcatacatcttgtcatgagccaatcgatctcactggtagcgcctcgtcccgctaccgatgtttctgtcggtcgttggtgagtactcgagcgatagttctatataccttatgacgacacgcgagaacgacattactgtaccagcctcctagagtatcnnccg

SEQ ID NO: 11670 - DNA, 1810 bp, Homo sapiens
  misc_feature (1)...(1810): n = A,T,C or G
catcactagattctgatagtgtgatctacagctgctccgcattctccacacttctgtaacgtcacggacgtctagctacctcagtgctgtatgctcctctactccagtcgcacncgctctnctctacttcattattatgtactgcgtggatcttntctttgccgtagacgtaccacagacgncggagatcatcatatccgagcccaactcgcacgtagctcacggcagggcgtagtccgacaggcacgcgccaccntgatggcngtgactgtgtcgtcgcacgcgaccgagtcacgcggccggtcctcacagatcgatcactgactatacagctatactacatcacactatgtacgcagtccgctcatcatgctgcactacgcacgcgacggtagatagtgccgtctctgcactgtcntcgcactctcgcaacaccgtagtgtcgacgagcttagcgatngcgcaagctatcacgatgttaggcgctgcacagcgacgcgcgataagacagagagactgcggcgtaccgntacagattacacgcattcgtcgancgtctctgctacnctcaaagcgncatcttcgctagttatactcantatcatcacacactctcaatatgatagtcacanacgantagcgacgagtgtgcgagtcatcgtgagntgcactatcacangactaccgangnagccgcgaccgcgcactcagacngatctgacgctcggacgtatacgatcngtgcagacgcacatgtatcagcatctctatcgtatcgcgcgagtgtcagtatgtatactnaacagtgcatgagantctctatcagcgcctacgagtgacagcaagtctatgcttagcagatcagcgagtgtcgagcgccgacagcagcacacggccacagtctcatgtatctacggccgaactgcccgacgtccacncgcagcgcngacacgtgaggagcgcagtgcgaagctctagtntgaagtgcatgtacacagacgaatcagtgtgactgtatgactacgcacgcgtagcgcactatagacacatgaancgcgcgtccatactgatcgcntcatngacagcgaccagcagtatgccatgcgctgatgtggttgtcgcgctgtacactcgagatctanatantgatcacgtcgttagcttacatgaatgactatacttactagacatgtntctagtatagctcgacgtcatacgcatattagtttctatatgatagtcgtatatcgatgatgatagcttactacganagatagtactaaacgcaagagtacgtcgcncacggagctcagcagcgctgctcgtnaacgcgagcgctctactctagacagtgctcgcgtactacacggtaagcanaccgcgcgacaacgcgatgaatgtcaagcgtacgcagtcngnacgagttaccgtatacctctgcacgagcatgacgactcgtgtcacgtggacgcgcgacgctacgangcgctcncgacctgacagcgcatatcatagactcgtcagtatgngcgtgatacgtgatgcagcgatagtgcagatccatgcttgactatatgtattacgtgctagatgtaggcatatgctgtctgcacatgtgtntatctgatcnctcgctccatcgcacctctgtacggttcgtgcgctctgtcgtccgtcgcactccatgtcgagcacntacatgatcgacgattccggcactcactatgtccggtcntatcactcatttgtaagtctaatctggctcgtacngtcttaccgctgcgacaaatacttactctcttactatcag

SEQ ID NO: 11671 - DNA, 166 bp, Homo sapiens
agacccatcctgctgttttcacagtggctgcaccattttacattcccagcagcatacacaatgtcttcaatatctgcatatgtatgccaacacttggtattttctgtttgtttgtttgttttataataaacatcataatgggggtgcagtagtaaaaaaaaaaaaa

SEQ ID NO: 11672 - DNA, 1722 bp, Homo sapiens
  misc_feature (1)...(1722): n = A,T,C or G
acgtcgcgctgcggacacctcgcctccacacgatcggcaccgcagatatgngctcgattcgcgtcngtggcggcggctccgtgctccgttgtcctcgtcgctccctgagtcgatgtagtatatgtcgccctgttctacgtgtgatcnagttgtactatattctattgctatggtcttcgtagatggaattagattagaagattcttgcgaatagcacgcgctacgtgcgccgcgttcgcagctgccgtaatgctacactctatgtntgatggacagcgatcgtgatatcgccactcagtgtatagtgtgcttgatgcaccgctactacaacagtagattcttggcgagactatgctggaacaccgtaagcaggtctaagcgacagatactgcgcgcacaccagtacgtgcgtcggtgcggtgaagaccatcgtcgatataatgtagtatatgatagctgcatgatcctatctagtgattgagatgcttcgacatacgatcgatcatggtgtcctaacaaccatcgcgctgcactcgctcangcgacgtatgtatcagtcctccctcacgncactctacttaggtcgctcgcacgcctatgcgntcacgttatcactatcatactgtcacatacgctttaattcagagtnatgtgtatctaagcgtctagncactatgttattnagctacccgctctgatgtccgtgctcgtacctcacggcgcgatcgcggancgaacctacgtgcatggcgagtgctgcatcaacgcgagcgtntcgcgagacaggtctcttctgcgatgtggtatttacgttgatctgtctgtctggactatacatagtntcctcaacggcagtactaccagctctactctaccgtatacgtctctctctacagtcgtgctgctataccaacatacactcacgtactacaactactattcgcgcacatctaaacgtgctcgtctagggtacctgcatgatcnagcatgtgctcgcacgcaacacgactagatttatactagataacactcatcatgcacctggcgcgtacgtgactgtgatctcgacagncgacatcacactgtcatgnactccacgtcgcatgctacgtcactgcatgtnctatgttggtgatctcagacntngcgtcganancgcacatgctcgacgcacactactgtgtattgactcgtcacacgtccagcggctgagcgttgacagtgatgcgntnttgagtactngtatctcagttgtctatgtacatgttgatnatgctcngcgatcantgatcgcgcanangntngnagtagtgcatgactanagcgaacatcctcngtgtagtgatcatacgtcagtcgctcnatgtnatgtngtgctgtcantgncgctgtcgntntacgcgtagcgtgncngagtctatntgatgtgatagacgtagatagatctcagcntgtgcatgcagactgcgccagtctccgtagtcgactagagtgtattgtacgctcgctgcgtcgtctctgtctgcatngcctgagatatcgttgtactcagaattagcgctgtgtatctatctgtcacgtcgccatgggttntntgtgatcatgcacgtcgctacatagtacgatcaatcggcntatctctctcttcttacnagctacactgtntctgtacgcacatattccattctatctgtaagtcatgcgactctacncgcgtcgtgt

SEQ ID NO: 11673 - DNA, 456 bp, Homo sapiens
cctaggaagaaagcacttaatgaagtttaatcccaagaatcaagagattgagcttttcacaataacctaccacatataaggtagagagaaacatgtgtttcagcacagttaccagacactgcagagactgggcctcaccgtcgctccagccccaaattttcgggcttctcactttctttcttgtgctttaacagcatcttcttccctggtccataacatgcaactccccctttcacttcaaggagcctgtaggtcctgtctctccctctctctctctctctctctctctctctctctctctctttctctatctctctctctcaataacttcttccttcacggattaccccccaagaaggatgtaagtcactctcccaagtatgtgactcatgtgtatgtgcagttgtgtgaaataaaacatatacagagaagtacacgcaaccaaaaaaaaaaaaa

SEQ ID NO: 11674 - DNA, 1683 bp, Homo sapiens
  misc_feature (1)...(1683): n = A,T,C or G
ctgctcagtaagccgctgagctgggtcgacgccgtccacgggggggaatcactgcttcctgtcggcgcgctgcgggatgaagtgatggggacaggtcgccctcctgtccaccgtgaatcaaggggagtagaatttatcgagagagtataggacgagacgggccacgtcggtggctgagcagtactgtatccaagcacaggctatcgacacatacatcacaaacgacgacgcagtccgtgtgacacgggcagccgtgagtggagcgagacgatgaaggccgtcgatgccgcacgtctcgctcctcgtcacgacaagatagcgacggcattgagagcgcaacatctaatcagatcacatattcgacgtacgcgcgcgagagcatgcgcgcgaccactcgcntcacngtatagtcatcgtnatctggcacgcagcagcgagtagacgatgtagtgagctgcgagtgatgctgagtacacgctggtgagtngtgcgtccaagaggacatagncggcagccactacagcctgagcagagtggcacgacggagacgcgagcgtntaatagctgtagatatgctgcagcatctgcgaccaagcaacgcgcncgacgctgctcgacggcactcncnacacagcaagatgctcccgatcacgaccattcgtcagtgcaccactgatggtgcataaccgtctcacgtatcgntgagtcgtacactacatctcggagagcgtacgcggacagtgcangcacgctggacaactatctaagaccgcgatggcgatcagggtcgttgcgatgtcatgtcgnactcactagattatagtagacgagctgaatgtgcgatcagtaaagntaattagtgtgactaatgagtgagcgagtgtaacacagactactcncactacacatacatcatacacactatacaagcgacccacttgagtagacgagtgagagacgtacatggctgacacgtaactcagcagacacagctacgatgatacactgtncagcagatgaactatgagaccgagcagcagacacagangagaagtcgcaataagangacatacgacacgaaacgacgacagngaacaggctgagacgacagcganancgatcgtccgagcgagcagnacgagatcacgcgtccgtncgcgacgcntagataccagtcagacagctgagcgcatctgncgtctacctcgtnctcgcacatgtctgtgcgtatcgttngcggagcagcggantgctcagatgaatcgactgagactatcgcgataccagttgagcgtagtagtgggagtacatctngtaatgtcgtagtagtntcnagcgagctgacatgacgnatacatgtctggtatagtgtagtctatgatgatcactgacganctcncgcgagtactcgaangtgcatagagcgacgtgacacggccncgtngactgtagtctcacactgctgatcgncgacgtcactcatgacggagtcacacacgtgacagtcgcgtcctagacntgacgtcgcgaatagtngctacagtagcacgacatgtcatgcacgctatgatacatagacgtancgcagcgcgactgcttcncagatgcacgacancgcgcgatgatcgcgctccacgcgcactcgtncagtacagcgatcatacacgtattccagcgtagtag

SEQ ID NO: 11675 - DNA, 586 bp, Homo sapiens
  misc_feature (1)...(586): n = A,T,C or G
ctagaagcagttattctatcctgtgatgtcctctgtgaccaaaaactaaatgaaggatgtctttggaagattctaaagctaactggacaatttggaaactgacctctaactatactttgattaataccactggcgaatcattcatagggtatatacaaatacaaatttggcctcttgtttaaagggtttctgtagttcaatcattatgaactcctaactgatacttagtagaacagcatataggtccatatttataattcaaatcattggcaattaaaagcgttactatcagccgggcacagtggctcatgcctgtaatctcagcactttgagaggccgaggcgggcagatcacctgaagttgggagttcaagaccaggctgaccaacatggagaaaccccgtctctactaaaaatacaaaattagtcgggcatggtggcacatctctgtaatcccagccactcggcaggctgaggcaggagaatcacttgaacccagaagtggaggttgcggtgagccaagatcacaccattgcactccagcctgggcaacaagagcgagactccatctcanaaaaaaaaaaaaa

SEQ ID NO: 11676 - DNA, 1688 bp, Homo sapiens
  misc_feature (1)...(1688): n = A,T,C or G
ctgtgtcattagaacgcgtaatatgatagtgtattgaagagatgagtgagatgtattgtataatactgatacgctaagagaaggcttagatgcagacattagtctattttagtattgtgaagttgtgtgatcatccaacatcgtatgtatacatatagcacatatagtaatatcgtgtttgtgatgagctgcactgtagtgcacagcgcgcgtgccgacttgacgcctnagtgtacgtaaagtacccatgagcttaccgctcctcgagcacctggcgccacggncgtcactatcacgtactctggctgtagcgctatatgacagacataattctgataagaacaatacttacacagcgatatgagcgttgaccatccgttcatgaccataaaaatgtcatgatcgcaatcgatatatctttatattactatgtagatttgacgatcgtactgtgatgcgtgttatcgcagtatgatagtatgtattgacgctgatgattgtgatacgcgcatatcgtctttccctcatgcgtcctcgncgacattctgttcgcatgatcgtataatacgtgagttcttgatcatcattgctagacccgctgcggcggcgtgatagtgtcttcatgcancgaccgactgtacgctgcactgtgcgttnantgcatatactcacccatcacactagaatgctcagtcgtcgcatctcaccgtgctacagctaaatgatcatattactatttcttatatcntacgcatgcagcttngncgctagatgatagtgtcggngtctctagtcgtgtgttgatacacagctcctagcgnaatgctcgatactgaacgtgaggtatagactgcntncagtcacatgatcgacanataatatcgttgcatatagtgatgaggtgtcgtcttgtaatgtgcattcgctcgtgcgcagcgtgatgataatatntatagtgtagngaggngncgtatgtcatcgatcgtcgtgctcntaccacgtgcatcgacaccggtgtaatatagngtcgtgatgatgtcggcnangtacctctgcgtactcgtttcactacatgatatacggcagncaggtgctatancatctgccagtccgtcatacacatctcatgtgaagtgtacgncnagtgcnatctgcagtcgtganattaacgtatcncntcgagacgtgntagcgagcgatacanacgcatgactcatcantagtacgcttgcattacgtgagtcantcgtcgatctctgcactcgatgctcagtcacgctggacgtacagcctgtntcagccatgcgagtgtgcatacgcgtctgncgacactgcagacgtccgacgtcgatgagcgcagtgacgccagantctcncgtatagacanctacatatgcactgtctatactgttgnatctgatgaccctatagacgtacagatagtcagcgtacagaagatgtagattcnancgactcatnacgcgtcgcgcggcncacgtgctcgtatcaaatcactntgctgactacgctctagtgcggctnancgtgcactctnatattatcgtantacaatctctgtatnctctagtactctcctgtcgcgntccgcacatctatgacgcgcgactgcatagacagncaatatanacgcgaaacgcagcatctggncatgactatacagtcttact

SEQ ID NO: 11677 - DNA, 542 bp, Homo sapiens
  misc_feature (1)...(542): n = A,T,C or G
tgtctcgggtaggagtgtaattcctctcattgttagtcaaccagagcactagcgtgaagatcgtgcgtgttacatatggctggtcacgtgcgagtgcttgaagctgtcgtagttattgattttagacgattgctaatgacgcaatcgagatcattgacgttgcatcgtagtcatctttatgctaggtcgttggtgagaagtgtgtcggatgacgcggatctattgatacaagacgatctctagtctttgtatgactgtcggactgcgtcaacgcgcggcgtaatgtgagtgatataccgtgagagagatcgacgtgacacgtcgctctacgctcgtagctctcggacgtacatatcgcctaattctcagtgcataagttgaagataagtacgtatccactgcaggagtgcgcgagctggagtgtaacgcagcgcggcaggtgcgtgagacgaccaacgtnacatcagtctatgagattaatgcgagcgtgactgtatgctggttatgctatgccactctgtgcagactctacgatgaactag

SEQ ID NO: 11678 - DNA, 573 bp, Homo sapiens
  misc_feature (1)...(573): n = A,T,C or G
gatatcgctatgacagcgactcaagcgtacatgacctcttacctcaccgtctgtggcacacgtgatcgcgcacggctacctagtgcgtttatataattatactgattctgttactataccgactagccagcgttgttaatttattactctcaggcattctagccctctctgtctttgttcgtgttcctccgttacgtatactctcagatacctttcctctcactcttatagactacagatacagtatacgagagacgcgcccgcctcactactcgccgtccatgcgtgtatccgcagcacattcgtttgttcgtgtacatatatgtacgtcggcatagcgggtcgccagtgtgtgcgtctggtgtcggtctcgttctcgaggctgcatagtgcttacgctatgagctcgtagtctgttccgatgtcgttcacgtgttgtggtctaactctccttcctctgctcgccacgtcatactctggaatcatgattgtcaagatctcttcgcatatgctcgactgtgtatcacttggcttgtagttctgctgcngcgacagacagtattgtctaccgcg

SEQ ID NO: 11679 - DNA, 1794 bp, Homo sapiens
  misc_feature (1)...(1794): n = A,T,C or G
tagaactatacgcggtaggctgtcgagctaccactagatcggatcccagtcggtancagactcagcgtcgacgtcatctnctgtgtaccacacatagtggctagctcatgtccgcagcgacaatggtatgtgtagctatcgcgctgttgacatgtacctctcgtgcatggactcttatcacagtagatacgtcgcttatggtagtgtccgctataatgtcgttacgacgtagntgatatgttgtgactatatactcgcgtagacacgacgcaacgtagctgccgagagtgacttctgcgcgacggatagagacnacgactgatgactgcgnagggtccaagtgagtcgccgtagagagaagatgtatgcagctatgccgtaggagcgactgagcgtgcgngcgacatgtggagtcacatctactctgctggcgaggatgcaatgcgtgcgagaaggcgtcgnaccatacgtatcaacgcacctattactcgcaggcgcgatactcagcctgacagtcgcgatctccgtgccgtgcaccgtgatacatgagaantagttcgtcgcgaagcgacgagcgngcgcacgcncgacggatgagcgacagataagctacaagcgacacgatcgctagcggtnctctagtcgcatcatgcacacatctancatcgtcgacgntcgcgtagactnttctatctagtatctacactgaactcatattgtgcgacgcngctcgctgctgctgntctacgcgatgacaccgtacgttacagtattatatagtagctggtagatagatgagcgatagttttcnctgacatagatancgcttcatcatactagaatcgcacacactgaatagnatcggatgctantatcagcntcgagccactgcacntacatcatcacgcgctagtgttccgcntacgtgcagagactatgtatactatcgtgcgtgctgactntgtactagngcgagntgcagagtagctgtgcgtccgcttgctgtcgtcgtgtcagagctgcagcgctgnatagctctaactcgtcagtcgcgtcacgacacncactagatncgncncggcgtgcgagtcgcgtagtagcttgtctctacttgtattggcgacgcgagatatcgcncctctactgtgactggaggatagcgactaagagnactgcgagatacagatagctactacgantcgactggagtagggtgtgcacgctactgagtcagcatatgtacacctactctacagttcgcgcgcgatactgcgagacgcacgagagcgtgcaggtgcgtgcggtgcacacgagagtagagctatgcatcgnggagtgtacacagttatatatacatcgtcgaactattgacttgtcgagatactgcagtatgaacaacgcagtacgcgtcggcgtgtcttccgcgctctatcntgtgtgtaccacgacaatcngtcggacacnacggtgtagttgntagtctacatgagaatctatatcgactatacatgttcgttaggtcagagtatgtgtcagacattgtgaggatgctatggtaagatatatgttatcnantnatcagtatcgtacgncgtgttatgatgtcgctgatgatgtntcanatgtgacgtanatgtctcactgcanacgccagatncgngactatcgagntatctgcgatacatagtatcaccgcacttacctgcgacgtctgatcctagtgtcgtgtatnnanactgacatgtacgancgtntatacagtantnagataattcgtacgatanatgcaagtag

SEQ ID NO: 11680 - DNA, 1789 bp, Homo sapiens
  misc_feature (1)...(1789): n = A,T,C or G
tacaggatgtagatatgaagttgttatatcatcacttcttcgtagagctactagcgtgatcnacntnatcgtccgtagactgtgcgtcgngtacngagactgactacatcatgtnagagatactntaagcagatcatactacggagacgcagatatgtgtattgtgttcgaacgacgaggacagtcgtatactatanactcgactgatgtgctatanctcgagngtgctgcggtcancgatcngcacaagtcatgcttactagcgtgtgtggtgagatactgtatancgagcaattacgctangtanaccgaatcactgatncgtatagtctctcacgagctttgcggaagtctcganancancagacgagctggtgcatcacgcgcacacacatctcaaattctcgtacngcgtcgacaatgtcggctgncatgcgtctctacatgtgatgctttgttgcgntgatgatcacagtaacgtacgtgatgcgcgtgacatacactcatctnaatgcgtcgagtcgntgcngatatagcgacatacgtacgatacgagcttactctgagagttccgaagtcatgtctatgttgtacggctgaagtcctacatgtgtcactctcggttgccaggtagggtctgcaacggagactattctacgtgtatatgatatgtaatatatgtacactatcagcacgcgactgtatagtaagacgcggacagcggcagtacgccgccgtcatcgtctgttcgtgctccgcgtcgcgcgtcgcgtagcgccgctctcgccgcgcgcngcagtgctgcgaatacgtncactanacactagtgtgtaggctgatacatcttacgcggacacacgttcagataccatcagctatagatcacagaatgaatataatctactactgcgcgcaggtcgtctcgagatatatagtgatcacggtgcagacacgtaaagcagcacaagacgccgcgtcgcagcatcgctgactgtacgtgtataatgagtggagagtatatnagatagtaggcaacgctacacccacgataacngctgatgacacatcacatacgacgtgagctacatcatacgacangatacatattaanagagtaaggctacatatcgacgtaatttctatgtgtagtattcatcttactatcgtgaagctcgtnctcgaacctgaggagaatatgacgcgcaagtgacgtcagcagtcacaagcgccatgcgttagcgcaacgcacngtacagtagtgtatatctatatgagctcgacgatggctggaccgtcctcttctagtgactgtcgatacgcagtgttcntattatatacgcgagtacgcgtctgttngcacncacgtcggagagtgcgtgacggatgntacagaggacgctcggagtggtgatgacgtgtagtggtangntgatggaaggaagagtaagangcacacgacataagcggcacgtgagtantatcagnggacagtacagcgtgtagtgtacacgtagagaatagaactagacaggctaacctcactatggcacacatagtgcagactaactagactntgactcatatatntatgcagtcaacgaagcaagctacactcgcactagcgctcgtgtctatgatcncactctaccatgtgaactgtctacagagacgtcatgagtagcgcgtcacacnctctctcgatatccactatatgctgcactcatctcgactacggcgctngctacgagacgtggcagcgaagctgagagtggcgccgatgcgctcgcta

SEQ ID NO: 11681 - DNA, 625 bp, Homo sapiens
  misc_feature (1)...(625): n = A,T,C or G
tcgtgagcgactcatttcgcagctgngtagtattatcctactgtatgcatggctctgtgcggattaccatgggaaaggtcactaccccaaggagtgtgcaatccagctgggagataagacaagcacgcatgacatttcagtaacagctacaaacacacctggaaaaggctcactaaatagtcaaatattaaagcccaggactcagcccacaagacttatgagcaacnatttacacccatggcagcctggagaggagcaggggcaaccgggagagcagaaggaacttgaaggagtcaatggcaatggctgtggccttgacaagcaggaggctctgaatgtaatggtcagtgggttaaccatcatcacactgaggccaatcctaaccagcccagcatggattatgagctaatttctgaacccacaaataaacaaaaagcacctcaatgacaatcacgggtgcccccagactgtccagtggtgcgatgctggaagagacacagcgaactttttgaaatctttgttattctccttggaccctttcaataaagatgatcatgataaagccaananataaaataattcagagtaaagaatgatggatgttgaaatggccttgttggcctca

SEQ ID NO: 11682 - DNA, 1736 bp, Homo sapiens
  misc_feature (1)...(1736): n = A,T,C or G
atagggaacggatgcaggatattgtgtctcttcattagtcctnagtgacggtagagtcactgtnctcgctgcgcngngnatgantgagcacgatagcngctgtcaggacgacgagcgctgtgnatgatggtatggctcatatgagatttgacgacgtancaggtatactgtatgtatgtatgagataggaggagatgcgtgtctccgctgtgtctgcacgtacgagtgtgcgtcgtactctacgcggattgtccagttgatacgcgcagcgntagcgtgctaccgagctgcgtctgacacntgtcgactacgtgtgngatgcgcgctgatcacgtggtgtggctgtagacgactacgctncanacatgcgntgccgncgtcagctacacaccaacgatagactagttctgtcagcgtattctcgactcttctgctgtctcatactgtanctcctcgtgatagtatgtagtgngtgggtacggttgtgacagatgtaagcgagagcagagtacggtgtatgagtantcgtatagctcgntagtgtgcggggantgttggtggttcgcacgtcagactcatcaggtgtgctgctcgatgcaccgctcgtcgcnacgaagttgcgatctgagtactgtcgagagtcacntgtatcgacngcacatgacgncttgtatgtatgggcgcgtcgagaagtgtgtgtngcagagctagcgtgttnatgttgtgaagtcgcgancgcgcgagtgggtcggcgggcatgcagagtgcgcgcggtcgcacgcagatactgcactcgtatgtcgtgacagcacatgctatatgttcttcgacatgaacacgatatacacagtangttgtaagcatgacaatcgtgagaagcagcgacgagtacgtgtgacagtcangcttttatatgatttaangttgtacgcttgctatagacatatatgtgcacactcacgttactacgcatttganataagttactctcgatattgcatgtgtgaacgtacaatcttctagtgttccacccaacagacgtgagtagggcgagtgcgcgctgtcagatgtacgcgcgcagagcgacgngcgacccgtntgctgagtcctgcctcatgtctctctctcactaatacgtccncntatctcgacacacgtcgccgccattatcggagtcagtgtgcgcgatagtataagatgatagatagtagaagactanttcaatatactagcagtacgcagacgagtcgtgtgcgcncatatncagagtagatatatatgactcgtctgataatcttagctccgtgtgaatatctactatttaantataagagnagagagacatgcggctaaatacggtgcgcatccgtgcgcgcgcgatgcggcacgtgacgtacgcgagcgatccccctgtcatcacgacacgacacggcgttggagtgcttgggtaatacgcgtggtgtcagacgagagtacatggataggtagtgtgctggtgtgggagattatgatcgtcgtagtctattccgcgccgtcttaatcttactcagtctctcgtagacgtcgcgcagtgagtatatgtctactactctctcccctatcgatgtagcacgcgctagaccactctgcctactacntccaaggagtctagtagacgcagctacatacgaccaacgcacttggacgtcctattaatctgcacacgaccagattgatagtcgcggctctcgagcgag

SEQ ID NO: 11683 - DNA, 173 bp, Homo sapiens
  misc_feature (1)...(173): n = A,T,C or G
gtcactaccngtgcaacgtcaggtgagcacacagcagcaggtagctgtctgcaagctgggaagagagacctgaccaaaacttaacccttctggcaccctgatctcagaaactcagtctccagaactgtgagaaaataaatgtctgttgtttaagccacgcaaaaaaaaaaaaa

SEQ ID NO: 11684 - DNA, 1981 bp, Homo sapiens
  misc_feature (1)...(1981): n = A,T,C or G
cgaagcatgacagatgaatcgagatgagnctncactcgagtagtcgtcgcagtacgtctatctgacacganacgacgctactcnctcgacagagcatcagactctagtcacagctgatgtcagactgccatcncgatcatacttcactctactactgnacnagctgcgatgactcgacgatcagtgcnactcatagagngcagganagcngcgcgnatnactcngctgcggctgctgncgggncanctcatcgatcgcagctacgacagccngctcacccntcgactactgagcaancgacccgacgagagtacnatcagcacncncgatcaatnctctaacnaacnatcngcctacagactgtgncgnacngagaccacgantgagngatgagatancnggaagagancntcagctgncgttncgacgtagtagnatgcgatatnactatntgcgagtnacnagatatcgnctcnacctcgtcacctactggacnctcancatgtgcactctgtcangctagacnctctgangtactgcgacagtaatcccatgcncncgcgtcgtnacagagtcacaccagactcagtctantgntgacacacaccctgaaagagcacagaccgagtgtacagnaccagctcagtactacgtctntcattganacgctagacccgcgcacacgcaccgnactactatgatgcactactgcgagncntactcactcntaaacgcnactactangtacgcngcncacacagcanctcgaccactgctgcgctgtcnantcggcgagtatgnatgctgtgcacgtacgtgtatgatgtagttcagagnctgatctnatcctttaacatcntnacntacagctatgtactactagctggtacctacgatgctcctgcagtgnactnacgccagtatacntatctcgtgttgatactagtctgagagtcgacactgntgcgctctcatgtctcnagcgtgatgacgtgtagtgcancgacgtgctcatgagnatgactgtgacgtcgttgcactactcncgacgtagcatcaccacgatctgactcgtactgcgatcgactcatcactntaagtacntatcgtatatagcgtacagcgacncncncaagagcgatagagcaagagagcgnctntgactactgcacttanattgactgccagacgtngtngcgacgacgaggagagangcgtantcagtcgagngacntagtgatacagctgcgacgcgcgcgccgactcaacgcgcgccncgtcgtgctacgtgagcgagactgcgtacagagtctgtcagagatagtcccagcgcgctaccnaactacgtaactcgntagatgtgcgaagtgtatacatcaggacgacgtcactgtgtcgaagactcgcgaccagtcagtccgcgcactgcagtcaccctcacctactactgcatagtctccacgcgcgacgagacggccgacacacgatgatccacgtaacactgtataatgttcanagatcactcactcatatgtatacgtccacagctaatatcaaatattatgtgacacntntgttatatgtgtactgttacagactagcgatgcatgcacgaagtcatatgactgtgatgcatcgtcgnatcccaatgtccacgnagtggatatcatcatcaagtatttctcgacatcagttcattattgcttagtcggcacatctgagcacgagtatgacgcttctgcgacatctcatcgcacgtgactccgttcgcgagtcgacctgtaatgagcgctgtgtagtgatagtgattgtcgtgtcccacactcagcgctagacacgccgtaacacgtcgcgcacagtgaattccgcgaggaatncatactctacgcgcaacagcgcgtcatatctgctcatcctcaggcgtgggctagtgtcaatactcgctgtcctttatctacacatcagatgcngtcagcgtcgg

SEQ ID NO: 11685 - DNA, 465 bp, Homo sapiens
  misc_feature (1)...(465): n = A,T,C or G
tcagaaccagccatcatgccaaggtgactttcagcattgaactacacctcacaatacctgcattctcttttttactacaacgggctgcagacttcttttttttttttttctggtagcagaaatccccatttgatgccaattcctcatcatcataagggaatgtaatcaaggattctttcctaataatgtgaatagatgtgcagtgactgacagaggtggtacagcgggtttattcttcttatggcagtgatcttctgactgtaacccaagggtgaaagctcatgcactcttagcaacaagtaaattgtacgaacatgccccagatatttcttcatttatttgtaaattatatacagtttagtctattctgaagatatacagttttttaaaaattgtaaaacaaatatgtttttctttactgtgtaaaattaaatgtcactgagagtaanaataaaaaaaaaaaaa

SEQ ID NO: 11686 - DNA, 971 bp, Homo sapiens
  misc_feature (1)...(971): n = A,T,C or G
gtgatgacaatgataaggagcgggnngggggggncgctttagggaaacattaattcctgaagatgaagaaactaaacagtcagacctccaggactaaaatgaagtgagcctanagagatcggtggggggatgcttctgtcnttancccggtgcagtgctgtgtgtatctagttccacctacttgagaggctgaggcaggaggattgcttgagtccaaaaagtggcacttgcagggagtggagatcccgccactgctctccaacttttttggcagagggggggggtttctcaaaaggtaaacaaaaacaaaaggcttctggcagggaacaatctttattggaggggggtgaggcgttttttgtcagctggatgtaagtggggtggcaaaggcgaaaaagcggctttattatcctttggttgtgaaaataaagaaaaaaaattggccctcttggcctaaagcggggagctgtgcggccgcctcccttttgaggagggttgattcagggcgctgcttctttgagtggggtggagtggtggggtgggtgggggggagcgggttaatcgggcgtgggggggggtgtacccgctttccaccgaatgccgggggattcctgacgaggcaagcgcgggggccgaatgccgcttctactggcgcagagccggggaaagtgggggttgcagttgagcttatggaatagcgcgcggagtggagcgccccgatgggaagagagacgtcgcggagacaggtgtggccgggagcccggcaggggtatcatggtgcgcgagtgggtatctcacggtagcgtcgattatgtgtggtttatgtatcagagcatggacggtgtgcgctagcgtgcctcccttcgctccttgctagggcgnggttgtcatcgccccccgtgctcgagttatctaactagggagtgggcgccggcgcactgtgcgctgcgggcccgtgtgaggcgtggggg

SEQ ID NO: 11687 - DNA, 1813 bp, Homo sapiens
  misc_feature (1)...(1813): n = A,T,C or G
cgcgtgactagatcacgcgtgacatagctgctacanatgccacgacnttcgngangagacgcgtgcgtcctagngatgtagatacgtatgctgtatgcntangnngcgcacggcngcgcatacncttgagctcagcgtgtgcacgctgcgtatgcgacgcatnctgctgtgacgccttgtctngtctactctcgtctanntgcatactctcctcgtgatntcgtctctcactctcgtcatgccatctcactcgagtntngcgctcagcttgcgcatnataagacggtgatagcgcgtcaatnactgtggtctactcntngngcgnnncgctccaactgtcggcggcgcgcgcgcgtcacctgctcaacatcacgacgcggatgaggcgcggtcacgcatatgcacatgacgcacgtgtangcgtgacgacgatgactgctggatatgcgcatntagtanaaccgantcntgcgccgctgcgtctactctgtagncgcatgactcgatcgagaganctcacganaggtngaggagctgagaactcgcgtagtgacaggcgncgcgtcgatcatagatngtcgtgncagatgangagtgggtaggagcgcgtgcgagatatagagctngaggtatgagtgtcncgtnagatactggggtcggagctctgcgcagtgtattgatattgtgaggtcgatcgacgcgcgcgtctgacggtcgagtgagtacgaccgatcgggatgacgcacgcgcgagctcgtggagncgcntgcgcgatgngctgagtgcgtganacggcggcaatgagnggtcgttgggcntagaggtgtgagggtgtcntcgcgtgagtcgtgatacatatactcttatnatcactnctactatcgtcagcgacgacacgtctcattaatatatgaaagtctctcatatagacatcgtgcgagagctgtagtcgacccgaatngcctccttacgcatgacanatgantataactactnaatgaacatntagangagaggtgtgctacataagngatgangagccagatgngagctgcatacactgactgtcgctagagacggatcatcacgcagacacctcntgtgtcnnaccacgtctcgctcgtgcgncatctgctctgtcgttgagtntggcgacgacagatgcgcatcatgatgctgattagaaataggacgtcgaaaggggtcggcgcgggatgctgtggtcacgcatcacgcactgcgactacacgcatgctgcgngnacaatgcgtaacatagacggcacaacacgtgctgctcctctgcgactgctagacgttgcgtangccgcgcacgacatctcttcgtgcgtcaacggcgtatgtggatagagagtagagtgagagagagaccagggtaggcagcatgngcgccgtaatagtcactcactgctcgtcgtaggtgggtcgagcggtgtcggtgtaagatgcatctactcactatantacatancannnnnattctaacataactatcgcatatnatcagtaatatataaannaatgnatnannnacatctaatactacacaatactctacagnttataactatnnanntananatagtnnaagttatanattatntcanatattatntaaaataaaaataatatataatnttttctatatnnatgatatttttatanatatacntaaaaannnntnannntntannttnatntntanntccttttnatacatttatcatnttnnatntatatatntntnnntnnnnnacaccttattnatntntntntnnattnnnntntcanca

SEQ ID NO: 11688 - DNA, 979 bp, Homo sapiens
  misc_feature (1)...(979): n = A,T,C or G
ggactggaaaggaggggggcagtgggaggtcggttttcaggcccacccagagaccctgtaggagtagaggtgaaattttgcttttcctacaccagtaatgatcataattacctccatgggtggagggggcacccactgaaatgtatcccatcaatgaggagcagattctatctgaagaacaacctgagcccattatttatgaggaatacacccgtattaaggtctgttgctgaagagacagaagtggagttaggacccacataccatacctccgcagggggtggtgtctttgcttgccaaancatagaattgtaaaaaaatgactgaaggagcagatgctaaagtttctagggaaatacattgggaaaaaaaacaccaaacctttggatcaccaaaggttcaggacaggcctaactcctgaagaacaacccaggcaggggaaccaccaccaacaaggagggtggtgcaacccagaagggggaaccctttcttggggtgttttctcacattgggggccttgaaccactaacggactgaaaccctcggttgacttaccagggtccagggaggtcccaaggatttgggtggggaacctagggagctttgtaacccatgatggggcttgtcccttgtctgccccattcggcagagaggaagttttaattggaacttttcttcccttcgcaccgggtaagtatgggggatgcttacgtgggacttctatccatggcgcaagttggtatagctccacttaagaagagtcctattccttctaagatgctnggagtagtaaagtacggcgcaggaatacttgataaagagattaatagaagaggtgggtgcgtaggcctacgggggaatctgggggcgtttccttaggagggtaataataactcgctgatgaccccctagtctagctttgggtgtggaagttgtatctccgtcgacggttgatcccgtgcccgtatcgtgagagggg

SEQ ID NO: 11689 - DNA, 1059 bp, Homo sapiens
  misc_feature (1)...(1059): n = A,T,C or G
cgaacgacgcgcgcaagctccaccgaacctagncacaccacatcgtaacatcacatccagtnggtcatcaactacacgacgcgaggaataccgtgacataggagagtaaatatataagtagataaccagttagagtgtttacttagctaagtatgtgagtgacttgaaaaactgttatacagcgccgcaatcgacanctncgaacaacgcgatgagcaacacgatactgaatggggcagagatagaaagaggtgaccaagctactaaacatagcgtcaaacgacagcgtgacagatgaaacgagtgtagcaaccagtacgancgcgaaagatattggatataggagaatagggagacaataacgaccgactanaaacacaataaagtagtacgagagaacatagtacaacaaacagagataacaaaaacgctgcgtggacacacgacaaagtataacgnaaaaggaaaactatagaacttgaagggcgaataactacatcaaaaatactccactactataacaccaacgacgaccaaaaaccaaaacagaatgaagtgtgggtgagggataaatggattgggaaagaaacaccacgaattccatgtaggggactgaggcgggagggcggtagaataccaagaagcgaatatatgatatgataagtaccacaatataaataaacacaaaagacaaaaatagattaggacatgagggtgtgtaaggagcattgtgtaattaaatgtgtggaagatcatcacattcgaaagatgtgataaacctacgagagaaagtgtacggactcataaggaaagacaaaccagaacaaacgaagtaatacacaatactgacagcgttgcnttttattntgtttcttctttntttccttaaaaaanttttttntttctctcttttcttctttttctttttttntggttnntntcnttttaaactttttntttttttgtttnttctntaaggantnttaatnattaccttttaattatatataatatnanaaaaataaanttttattattttatattatttttacttttttt

SEQ ID NO: 11690 - DNA, 891 bp, Homo sapiens
  misc_feature (1)...(891): n = A,T,C or G
tcagtgcatatttcctgagatataaaataccagttggcacattccccttgtttgaagatctgagacaactgctctttggtgctggggggctcaacctgccccgagttcaagaaaatctaagtgttttcttgatggcgagccctaccattcacttttggaagatattactgggaggaggatgttggagagtgttggaactgggctgttggattttgcaagatttcttggacatgagaaatgaggtactggttaacaccaagaaaatttttctacttttttgcgtcaaagagtgctactggtgtcatctcaagacctcttccccactattacctcagtatacagaaaggcctctaggccagatggcggtgtttctacattatgaatgtggcatgataagctntgtttatatggccaacaattttctcatttgtagcctgttctttcccttacactcttacacctttcttttgctttggactcacggaatcagagataggtgagtaacctgactaaaggtgtcagaaacaccagcttctgagaatgctaacatactgactacttgatgtttttatctatttctatgagacattttctgtaccatttttaaaagtgtagaggtaacatttggtttgattttctttaataaaaatactctcttagaaaaaaanaaaaaatgggctngttggctcagcgggggctctgcggcgctccctttaggaagggttatcatgaccttgctactgactgctggctcggcgtcggtgggggagcggtttagctactaaagggcggataccgttatccacaatcggggatacgcggagagaccttgagcaaaggcagcaaaggccngaccgtaaaggcggtggttgggttttctaagctcccccc

SEQ ID NO: 11691 - DNA, 174 bp, Homo sapiens
  misc_feature (1)...(174): n = A,T,C or G
attaaattatagtcttanctctcgnttgttcaggtgacacaagcaagaagtagctgtctgcaagctgggaagagagacctaaccaaaacttaaccactctggcacccgggactggagaaactcaatcaccataactgtgagaaaataaatgtctgttgtttaaaaaaaaaaaaa

SEQ ID NO: 11692 - DNA, 416 bp, Homo sapiens
cttttagggaatacccctcttcttgatttcaagatggggactgagaaaggaggagtgggctaacaccaaatggagttcaataatttatttaaaagctgtattggcacaataaagacatataatgctaactggcaaattaaaaaaacagaagctatgtggccgtatatcagcaagaaaataaaatcaatgctgaactgtacaaatgagtaaaacattttggaaagtcatgaatattttggatcagagcatttaaatgttatatatgagacttggaagaaatagcaaaggacttcatacattccaagggaataactatgcgggttaactgatgacttttgttacgagggaaaacaagaatacttattaataaaaaccttaataagaggtgaacatactatctattaaaaaaaaaaaaa

SEQ ID NO: 11693 - DNA, 1897 bp, Homo sapiens
  misc_feature (1)...(1897): n = A,T,C or G
atcagcgtggctactgcagagngccagtcagcatgtagtctatacgagcagctacagatcaagctnagtcctcgatatagcagacntgagtcacgagctctacngtggttggtcnatgactgtnatcgnatgattatcgntcatgatgtcagacntagatggatctctgcagctcgtctatatagcgactgtcatatnctgctgnctgctgtctgtnacgcagctgacagctnacgctgaccacgctcacacagtactagancatagctcgcagagcatgtgaacacnatcatgcgtgtacnacgcatncacagtgcgtctgacgcgatcacactctgactcatgtacaggcagagngatcgaatcagtacntccactancactcactgatactagtatatcagctcacacnacacacgattagcgtcactantcatgctctnataatnagtcactcattgtagatacagcgcatctacagattatgtagattatatcgtantacatatcgacagtctctgacatgaatncattanacactaacaactattgtatatagtacacagttagtcgagcgctctacgtctcacactcaccgancgtaccagtagatantgtagtgagttatcaacagcncgncaccacgctcagagcgtatcagatgtcgtgagtgagagtgacactgagtacgataagtagtgngagcgctgagatcgatgacgctcantggcgatgagagcntgcaggacaccatcagagatgcgagtcagtcatggacgatgagtaggacatcgtgcgagtgagcaagctcactcctacctgacncacatacaacactgtcagtgacgtgtgacgctgacacatatcacgcgaccaccgcgtattagcgattaattcgcaatactctgactcatgccgtgaccnagatgatcagactattactacaccgaccccgcgatcacgctcacacgcgcgtctgcacgccgtcgattcacgacctaacacnccncatcgccacacacacatncaatctgacacgcnactnctagtgtgtcagtcgtatacganctcgtatactctctgattcagtgctncatctttcgtacgtcacagcgtatataacgacgacctatatccgctgcagtagcacgtgagacgagctcaagtcgctcacaccgcgtgtgtacgtgctactattagctntngagtttctactcgatcatttcttanccaagaccacatcgcacgtcgcccgtgcgctacagtctgtcagctgacatagtcgccagacgttctgtgatacacactngaccatattagcactactcactacagctagtgacattgcgaagtccgtgtgacttgcgcgtctctctcgactatgtggccatccgtacgaatcatgaatatntccgctactcanctgctcatgcacatcgatgtcctcatcaccgagcatccgtgctcactggcggnagcgctgatcntctgntgctctagctctctagcttcgcagagactntacgacgatacgtgcgtgcacgagatctctagatacactcacacattagtatatacaacctatcatagcgactanatgtgcatgcatacgtacacactaantagtgtatataccgcatcgatatcgcgcacagcgtcagtcgagcacagcgagcgcgacgatgcatacggacacgtgacgtatctgctngccgtcgatcnatccgcacacgatncnacaccacgttatctcatcattaacacgttgcanccatgacgtagantcgtctcgctactcatcactgcantctatcttgaacgatcgtggantcactcagtcgntcncgtcgcgcacgtcgcgagncacncgacgacgtcgtatantcgtgacgtcaac

SEQ ID NO: 11694 - DNA, 514 bp, Homo sapiens
  misc_feature (1)...(514): n = A,T,C or G
ctcaggaaatgttccccctcaggggtcaatgacccacctccagcacaaaccccagggacagactgagagggaattccattcagggtgccgggtgattggttcccaagtagcactgtgagaaaatggagataagcaatacaagaaaaggacgaagaagttcacacctgatcccatcgcccacagaaatcactgcgaacatttgtgcgtattctttcagatttttttgttggtggctgctttcagaaggaaaggaaaggggaaaaactggtatcctcatgcactacttctgggagggcgcattggcctggccttctgctattctagatgtcattgctagtgccctatttctgcctgaggatgtaggcaacaggaagatggcagagcagagaggtggaaagaagaggcaccctgaggacattgctgagctgctgaatcaacctcccctgaagcttgccctatgtcctcattnttaaatgagataataaaatatccttgttgatgaaaaaaaaaaaaa

SEQ ID NO: 11695 - DNA, 159 bp, Homo sapiens
tcagacccaccctgctgttttcctagtggctgcaccattttacattcccagcagcatacacaatgtcttcaatatctgcatatgtatgccaacacttggtattttctgtttgtttgtttgttttataataaacatcataatgggggaaaaaaaaaaaaa

SEQ ID NO: 11696 - DNA, 937 bp, Homo sapiens
  misc_feature (1)...(937): n = A,T,C or G
atttaaccaatgtatacaaacaccggccacgcggctcnagggacacttcaaaaagatgtangcaaaagtaagctgggcatattggattttacccatcataggcgctgttctcttaggtttcctgtaccgctactacacatcggaaagcaaatcctcctgaggaggccttgctgaagttagaaagtgcatccactttggggcgaaaactacagacttgcttgggggctgcagaagtgccctctcctcgaatactgccagctgcattcttctcccttggagccaccacgatcggtcacacataacctcagatctgacaccaccgtcttccatctctcacagccttactaccaaagttccctgatcactgtcccaagttagcaccattgccagtcgtctcttgtattcctcgcactacctgaagcaccgttgatcccccccactactcagcataataaaacctccggcccctagccacctgctatccccccctccatgctccacacccgcaccttcgctcactccacactcctctcccccccccaccttcccccttgcccccccgattctttgacccaccctcccacctccaccctcacatcccaactgcttccacacacccacacctctcccctccaccctccactctacccactctatcctccttcatccactctctccttcttcatatcctctctcccctctcccccccttcgcacatcatacaacgctaaaccggccccgttataaaactaattttcactctctctttctcccttcatacctctctcgctccacttccaacacccacttaatacctatacccttaccgccccccaacaccactactcagacgctaccacagacctctgtcccatctacatccccttctcattccttacctctattatcgcttaatcttacagacacacactacttg

SEQ ID NO: 11697 - DNA, 903 bp, Homo sapiens
tatatatatatccaaaacacaagacgcccgctcagggcttcacaaaatagtgttgacgtacatcttgccaaacctattgcaacctccccttaggtgcacaaagaagaggtcttatgagcatatgaagagatagcaaccacccacaagccaagaaaacagctctcagaaggaaacctactttgctagaactctgatcctggatgtcccaccctccggaactgaggctgtttaagccatgcagtctataatattttgttagggaagcctgagctgaataatataggagtgagactcggaatagaaaagggctctgccacaaatccaaactgctgagcaagtggctctgctaatcgacccatactgacattagcggtatcccttcaggaacctgcgaaatccgatgtccagttacggcacccagaccgccgtgttctatcaccctcaccacttgtggaggaggacagaactcaccctcgttcaggcagcttgcgacaaaccgtcgctttaagcaagacagacagtaatgcgacgcccggtgtcgccggcccccccttccgtctcagaaattagttgcttctaagcagctacaacaccccaatcactatgcgccaccccgcgtggtgagagacgcgcaccctccaacaatggtattcaccacgtccacccatacgcctacccagctgatgtcccataacttaccaataaccatcttaccaccgtgatttttaattctctctttctatccgtctctcgttcatcactgcctgcctcccacaacttcatagctcatctgcctccaccgtgtacctacacgctcgaacggtgacaagtcgcgaatctgaagacacttcctcgcacacccccaatactaccccggcaacctaccgcccacacacctacccg

SEQ ID NO: 11698 - DNA, 1226 bp, Homo sapiens
  misc_feature (1)...(1226): n = A,T,C or G
aatttacattgaaagcagacgcaagacgaaaatggggctcatgggggaactaaaagaagggcgngttaagaggggagtaacccgagggctaggagggctaagagaagagcagcaaaggattttattaatacgccccactgagacaatgaaaggcgtaaatgacaattcaataggtgtgagatcgcctacgtacagtacatagctgccaatagaacagctcgtgcattcataaccatcgtagggcatggtgttgtggtacgtggtaagatgtgaggcggaattccttgcacaaagacatcgagtttaccgcgctatttttttttgctctctgcggtaggcgagctgtgtatagactcactgggtactacattgaagtaaatgcgtagggcaatactagctacaactaggctcgagtttgactttaaaaatgatatagaatatgaatcagaattgcaaatgacgaagtgccaacatgttaacgatgagttttatgagaacgatcctaaaagggccagcacagagttgatgggcagcatacatatctgtaatgtgtagatccagatgcccggtgttatcaccgcccgcatagagacggaagggggaggtgataaatatccaacaaggtcccgcgcggcgacacacgggaggacgtcgcattccataccatggtgtatattatagggctgcgcaagaagagactgagctagagataagagacagacatgtgcatatagatcagttcacgaaagtctaggtattcgatttatcctcaagcagtgctagataagattcgtgtctaataccgtcgctctcacacccactgcttctctctctgtactccatttcttcatccccacgactcagtgcacgaccacatgacgtgaacgagtgtatctttagatctacaatagatagagaaacgagttacacgatctaagacagtgatagactattcagggagatgtgagcttgantatgtattatagnacatgatggcttatgattatcacaagagcgactattataatcataatgactactatgacatacacgacgtaccctgcaatgagatcatatctaattacttactatctagctagtgagatnttatatcaatactacttctatcacatctaaggcacacactgacgagcgcggacgcgtatttcgcgtgtaatntatgtcttcgcacgcgtgagagtgagatgcggcgcatgtatcacaat

SEQ ID NO: 11699 - DNA, 736 bp, Homo sapiens
aaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagccactgactctgtctggtgttgacagacgattcatttaagctatcatcttaaataaagacctttgcccattcctatttccatattcgggcccctcaccaacaggactctggaagcctgataaatggtaaaatgagcccacgatgtgtaccttttccctggagtgacccgaagcactcatgggaaaacccgcagcctttcttttgccaccccaacaccgcattagcgtatttccatctctggccctgtcctaccataggcatcccaaccaacccaccgcgctagcgtacgccccaacttcactttgggttctcgtcaaatttagccctcccactccatatgtcatgcggaagagaacgcgaatattcactttcaagcgccggcacacctaacaacaattcaggcaccggactagatgacgaagagatggacttgcaccata

SEQ ID NO: 11700 - DNA, 862 bp, Homo sapiens
agcccaaccttgcctctttaaaaagaaaaaacacatgtccactctgaagtcagcctctgtaacctccccacaagaaaaccgttttacaccagtcactaaccaaacaaccagcagtgcttcaacacagaaagtaaagcattatccagggcttggactgtctttcaagaaagccccaaatcccctggcaggaggatgtcacagcagtgaagccccatcccaagcccagttgttcccacgaaacacaccacgtggagacccagcatgactgccgactgattccaagtccccaggagggctttattttttcttttcaacatcctgttctgcggcttccttggctctttttgcccgtatgccgaagagccgggcgttggcacgggccatacggagactagcgaaggctttgaaattcttctcttcctcagtgatgactcgagctttctccttcttatagacctagaagagaaagacaggttgttaaacccacatgcaccaaagggcaagggaacaaccaagcgtcaggagaaccccgaggacctcccggggattggcggtcacgttccctgccataagtactgctgaaaagcacccctgagtcaatgacccttccctgggaatttaataacaaacaacaactggcctccttcgccttagccggggaacctttccgcccgctccctctcaagacggtaattctttgacccccgtcattgccccgtgcgatcgtccactccgccgtcgcccgcggctcacctcactacacgccggcatacggtctccccacactcctcgctcctcccccgacaccttgaggcgcatcggcctccatccgccccccactcataaagcgaccgtatgcgtg

SEQ ID NO: 11701 - DNA, 413 bp, Homo sapiens
cttcagtggacacttttactgggttaggcattgagtgtccaggtttggataacagaggcgactcttttggaacagggaaagctgtggtgaagaaggcaagtcatatccatgttgtgtcctggcctgataggaggttatcagcaagaaagggagaagtgtgtatttcctcgttcacttacacgttctcaatgtctatctattaataccctcaaaccagtgactttcattcatgtttataaataaaattatatatatgaataccctatcaaattaataatgattatttctgtttactggaattatggaatatttttccttcattttgctgatctaaatgttcattgatgattgagataacatgtttttcagaagagaaatattaaaagcacaatttttcttgaaaaaaaaaaaaa

SEQ ID NO: 11702 - DNA, 520 bp, Homo sapiens
  misc_feature (1)...(520): n = A,T,C or G
tactcttacctatcatatgatatatgatctagatcttgagaaccgtgtagttaggtcttgttagggaggccagcctctccagttttatgttccctatctcggaccatagtctacccgtccggttattataaaaacgagacgtggcactgcgcaccatagtatcagtgcgtaacactggagtctgctgggtgcgagtatgtgtaggatagatcgactgtatatgttcttgtattcaccgtagcntaccacactgccagtgccggtccacggcacgaccgatcacgcgtggcgtagcgcgctatgaataggtagcgccgatcggtagggagttgtggtacgtagtctaagttcacagtgatatattaatgtgtggtatgctgtcttctgctcgctgcgctcacgcactacctacgtaacgccacgcaagcactgcacgggatagtagagtccaagactgactgtttcaggcgagataagtcagatcggctattcagcggcagcggtgaccactatggctccg

SEQ ID NO: 11703 - DNA, 582 bp, Homo sapiens
  misc_feature (1)...(582): n = A,T,C or G
aatgttaatgatatataatataataaaatatcgtactgtacagagctgtgtgcatggnagatagagctagtatttactagagagtaggtagctagcnntatcagcgagtagcgtcccgcccggccgaggttcgtnagtcattgcgcttacgcaagtaaggcncacaatatacacgtggtagagggccctaacatgagtactacataactcagagctccacttgcgtaccccattctcacactgctcaactaactcactcttcacacctcgtgccagtcttnatcagtcgctntagtcgtctggttgcccattatgctgcagacggattccggctctcacgaagtgcgatgatgnncctcactacatatctactgctataagcatgtgtccttaacgccccttactcatacgacacagtctcncgtatattaaactaatcacccgtatacctaccatcttatncccgancgccacaccgacacaccgcataggtctcgacatcgtcngagggtgtgcacaagatanccgcaagcgcgttatcgtacagctccacatacagaggcagcgcgcgtagacatnccg

SEQ ID NO: 11704 - DNA, 725 bp, Homo sapiens
  misc_feature (1)...(725): n = A,T,C or G
atgaggtatcgatgcttcgatatgttagatttacacaaaatgctcactcgccacctcactgaacacagtcaactgtcaccagcgatagttcaatacctctaaggtgtacgtccaggatgtccacatagtgatatcacgtngctgacaactagcagttcatattctacgttgaggaccagacgcacagacanggtacgncaactagaccacagtacaacgaagacgctgcatgcataactaggacataccacagttgcaaccgctcgatgcaatccgcacagccacatgatgctagagcgtcgagcgagtccacgatgctcacagagcaacacgtgcgctcgcgccgtctagactgcgcgagtctatgcactgacgtagtgcacgctagtcgtaacttagtgagctngagatcaatagtacatgaaccgctacaatatctagccgacgcgctcgctaacatatagctccacacgacgctacgcaggatgcatcgcgcacgtctagctcggctactcgtcctcagcatgattgcatatcgactagtcagaaccattactcacgctaggtcaatgtggtggacgctcgcgcgcccgcgctctgtgcgttacagttcgagacgcagatagagcgaggatcataaaatagaaagtnatgagagagtatagcagcgcgagtgatttgttagatcacgcacgtccaccgctacagacatgcatggcncggng

SEQ ID NO: 11705 - DNA, 635 bp, Homo sapiens
  misc_feature (1)...(635): n = A,T,C or G
agtgaggatacgatgaggagacgcttccgatagntagtaaagtcaactcccgtctgtgtgagagatgatgtatatcagagtgcgantggtnatcttatatgagtcagtagattgtacttacgtaatcgagatggacagtcgtgcctgagaatggtgtgtctatatgttcgtcgcgcgacgnagtttgtcgnatagcgccggtgctcgatctagcatgtcgtagctggtaatatgacganagcngtactcgttatcgggctgtntcgggtacgatgtgcgatatacacgtagctgactgtcgtgttcgtcagttatgcgcgcacgatactacgagagacaggcatgtctaagcngagagctgtccgagacgtacatcggccgagtccgtcggactgacgtagtgctgcnatcgcagagatcanagtgtaatantagttggtattacttagtctaggtgcgcgtcttagtntatattcgttctgtcgctcgagctgcgcctgcgtatgagttcgtatagcccaggatgtgcgtggtgagnagagtagatatataaagatgcgtgtctgatttatgtatatgtatgctcntgtagtgatgagatttagtactgcgngtggcctcntagagttgctgcg

SEQ ID NO: 11706 - DNA, 980 bp, Homo sapiens
  misc_feature (1)...(980): n = A,T,C or G
ggcaacggcgcggcccgccccagcctgtgttggttgtgccggaaaaaacttttgactcacctttatttcaagagtgtgtgtacgtcgcgacactgaagatataacaatgggaaaagaaatttgagaagttgagagtgatataaaagatggttacttaaaacaataaatgccaacaaagcctgcattgaatatttaaaaagacccgggagcgtaaccgcctccgcgcgccatcaacgggcgcgggcatggtgacgcatcaggcgccccgcgcccggcccctaagtaagaaggctacaccggacgcccaccgcgccgccccgccggccccctcggcgccgccctcccctgccgagggggggcgtnatcaggcgcctctcggccagcccgcacgcagccgggaaatcgacccggggccggggggctcacgataccagtcattgctgttcatgcctcggcgaccttgaggccccactgctaagctggccctgtgtgacaggtgtacttttgcgggcgcccccgtaggcgggccgctgtctctcgggagttcttttctccttcccgctgagttaaagagcaacaatatgcagctcctcgcaacgggccggcatccgaccaccggcgtcaaaatgaccggaacagccgcgatggtgcacccctacactccactcattgcgggacgcggcccccggcggccccgcatggttcgcctccggcacagcaccgccggccgcgcgccccagacgcccccagtacgatccacgcgagcgccggccaccgcacatgtccactctgatatgtactcaccagggtcggccagagggaggccatatcgagctacacctcgattgtacgtcaccccgtgagggacgagtagggacgctttgcaccacaccccccaccagagcgcccgtcgccccctcgcccgcgcgtctgtatgtccaagagtgcccatacgtggaggcgtacgcaccactacgagc

SEQ ID NO: 11707 - DNA, 1070 bp, Homo sapiens
  misc_feature (1)...(1070): n = A,T,C or G
cggcggtgagcagaccgaggacctgtcacggcaggccgtgtcgcaggtttcgcgacaggcctcttgcttacatcggggttagaaggatcgacagctttcactagcggttgaaaagtaggatggactagaatacttaataaatttgagttagcatattattgagtggtattcttgatgcactgttgttactcacttggtgtagtttagatacatggaaacgtctcagtcatgagtatacgtagggcatgacgtacagttaccgctccaaatacgacgtacgcttggtcacggttatcgtgtgcgagactcgtgtgtgtctacccctcgaggctgtgatgtggaggagacgtatgtacatcgtgtgactgctctgacactcgattcgcacagcnaggtaagaatcgtctacaccgcagataaccattactaatcatccaccgcgttttcgtgttccgtgcgcaagggtgcattcttgattcgccgtggtcggtcggtgcgcatctattactcgacatacgcatgtgtgctctttccatgtcctaatccacagacgtcgttcatcgtttcacgtcgtgtgacgacctagcatcgttcccgggcgcctttgatactttctcgggtattgtcgagtgtgaactgtgtgtctgtgtggttccgccccgtgtacgcgctgtgcactgtctccgtctacggctggggcggggagacgtagaggtgcgtatgccctgaaggcgcgtcacgtgcgtcgcgccgccgtgtgtatgtcgtgtgtgacgcgttcggtcgctcgtacttgatcggccgtgcttcgctcctctcctcggtacgcttcgccggcacgccgcaccattgttatgagtgctctccctcactccactcgctggtaatgaagcggaaggatgcgagggacgtcgtggcgttattgtaagcatgcaatttcgactctccgttatacgatactctctatcattgtgtatcacccactgctcaccgtcacaccccccatatgtcgcaccacgcgtcacaactaacgtctggcaggaggagtacttaggcgtgtgccgcaatct

SEQ ID NO: 11708 - DNA, 155 bp, Homo sapiens
  misc_feature (1)...(155): n = A,T,C or G
gtctatttgtaacacacagcaagaccttagcgntctaccagctgggaagagagacctaaccaaaacttaaccactctggcaccctgatctcagaaactcagtctccagaactgtgagaaaataaatgtctgttgtttaagccaaaaaaaaaaaaa

SEQ ID NO: 11709 - DNA, 1092 bp, Homo sapiens
  misc_feature (1)...(1092): n = A,T,C or G
cgcgtcgtcctctgcccttgggtccgcgtgcggcccgttggtgggtgcgcggtttttggctgtcgtgttgtttgtagtttttggtgcgtccccgcccgcgctcgtcgtcggcgcgggggcgggtgcntggcgtcttgtcgctggcgctgtccgtcttcggttcgttgggccggttgtgtggctgtgtgtgttgtcgtgcgtggattcgtgggagnggtgcggcggtcggtcgctgcctccctctgcgcctttgcgcttccttgactggtccttgcgtgtgtgcgccgcgtncgcggcgccgtctgtgccgttgcggtcggttggcgcctcgtgcntctgcgccggtgcctccccgttcgcttcgtctcgcctctgtgctcgcgtgcctccgctccgcgtctgtctgtcgcgcgccgcccggctccgtggtcctgtcgccgtggtgcttgtctgcttctcgccgtttgttctttgctgtgctccctgtcgcgccgcgtgcgcgctgttcgcttgctctcctctccgtgtgcgtggtgtcttgtttgtgtgtgggcgttgttggctgcgtgtgggtggttcgccgccttttcgtcgctctctttccgctggctttttttttntccctgtcccctctctctccctctctttttcgttcccgcggtcctcgcctctgtcgttgctcggcgggggttcccgctctggtgtggcgcgcggtcccgtgcccctctctcgtgcgcctcgtgggggttgcccgggggctcgtggcgcgggcggcctcgtctgctctttctctccttgcgctcttctgtttcggcccgcttgtcccgtccttcctcttcccntctctgtgcggccggcggcttcgcgcgtctctctgccgcgccctgctcctccgcgtggcggtctcccctcggcccgcgggctgcccgtcgggtgtcgttctctccgcccccgcttgggtttcgctgcgcggttctttcctcgcgtggtttccccccgtttaagcttgttgtttggtcttccttccagggtttgtctcttnttgtggtgtgcccgctgtggggcggtggtctgtccctcctctgtctcgcg

SEQ ID NO: 11710 - DNA, 799 bp, Homo sapiens
  misc_feature (1)...(799): n = A,T,C or G
cagatctgcaccacggcacagtcgacctcatgcagtacaatcgtccagctcccaccagtcatcatactatgtgttaatctgtagagcatcgtgtcttcaacaatctgtatatctgtgaccnctgatgggtagtgtcgcgaccactccgagtcgnccagtgtatggcgtatatgtaatagtccggagaccgtatgtagatgnnncactacgtggatagtgaagtagtggcgtcntatgagatatgtgcgtgtatgtcacacgcccgcgcgtcctccttgcgtcttctctctgacgtccatgcgtcgctctcgtagttctcgcgtcggagtgactatgccncgcgtgccgccgtcagtctcgcacctgtcgtctctatctagtattagctctggacntcacatcaatgtctctntncatngctctatattgtctgtcnnntcgctctgcgcgagtcgtagtgatnnccnatcactacattcatgtgtacacatctgtactcactatatcatacagncanctntatgtgcncncncntatgtgtagcagagttgctatgacgggtcntacgatgcgagtttangctgtatagtgtncgcgatatgcgnagctcnagtgtagtgcatcatacgancaggctgcgctctccggcgtgnatacatgtgtcgtacgagtctccatcgcgtcgatgtgtcacacacgatactgtgtcattctagtgtctacatcctcacactgtgtgtgtctgtgtntctatccttactatcgctcacgacactcgcgagtcattgtnagtcncnnt

SEQ ID NO: 11711 - DNA, 574 bp, Homo sapiens
  misc_feature (1)...(574): n = A,T,C or G
cnnggggtgcgaagngnttacccanncnanttcccnnncnttnttttgaaaaaggttccntntttaagncncntttggtacttctaactccctcttaggatctgcttcctgaagaacccccatggtgcagaggatgagttgcaaacaaagtggcatgcaatgcagaagagggtgtgatggatccaaccactgggggaactgaggaaggtgaagtcatgaaggaaactgcatttgagttgactctgaagatgaacaggagttgaatgagtaggaaagaagaaaataggcatttcaagcagcgggatggacacatgcacaaaggcatgttataaagagcaggatgtgggagcatgggtaatgcatggaaccatgtggacgtgtgcagtggtcggggtgggggatgaagcggggagataaagctgggaaatacgggatccaacataaacagctgtcacaaacactctatgtatatactcctattggtttgtagactctgataaagggaaatggtagtcctgggagaagaatgagctgtacaaagcaataaaatatgtagaattccaaaaaaaaaaat

SEQ ID NO: 11712 - DNA, 1148 bp, Homo sapiens
  misc_feature (1)...(1148): n = A,T,C or G
gcacctgacgataggcggccggagagcgaaaagcataaaagatagaatgccnagaccctaatactggcagagagctnctgcttgaatttttcgcgaccgctgcagngacacacagttgccagcggaatcttatatatgtgattactgctgtcgcacaattagactcatccaccacaatagtagagatagagtcagagcaatagcacgacagcccttgtaagacagtgatgctgattcgcgttggtgctactcacgaacgaattgnagttagcacattgatcactctggctccgtctacgtgangaatagatagcagagatggcgtagacaagatcgagcccaacaactagccaatcgacacgactgtacaatcgaccctttttctcgcgccgcgccaaccaaccacgctaaaggcaaaagcagagccctagcgaccacgccgcgccacgagcacgccaagacatggatcgccgaacgccatgataagtggagtcccaatagtacgcacacagctaccatacgacaacaaagaatcacacaacaacacccgcataatcacgaaaaccacaagcgcacagatatacgcgacagcaaagccacgtcgcatagcatcgcgttccccccaattcccaaatacccccagatatatataacatatcacatctccccgatatatatcaggcacatccgccgtgaatccagaacctcaatcgcgtcgctgtccatctttaagcccgaaactcgccggcgtcatggacacaaagcatatcaccgccagaatacgcaaccagcccggttgttatagcctatcgtgccgtaactagacacgataattagtccccctgtctccgcgacgaacgtttgtccccacatactaatatgtgctcaatagacagcgaacccccctacaaaagctaaatctcattattgcgagcgcgcctctcacgagcttagatacgtcacgagcacagtcaacgccagtacatatcctcaacccgctcaccattcttactgcaactcatgcccatacaatgaatacattacccatatatgacatccgccaacttccatgtacgccagccacgaagtaatatgttacctcagacaccctaacacatacaaacgataacacagcgtttccgcgcgag

SEQ ID NO: 11713 - DNA, 744 bp, Homo sapiens
cacagcgttccagacaaaaagtcacaagtcacatgaagaaagaggaaaacactcgccctatcaaagaaatttccagaaatcaaccctaaagaaaagctgtatataaatcactctgaaaaaacactcaatataactgtcatgcaagatgctcaatgacctcatgaaaaaaaaagcatggaaaaaattagaatatcaacggagagcaactctttcggccaagtcctgtctgatagaaaatcggagtgcaatgattgatccctcctgttttcactaatctcagtagccaaagagagagaaaatgtagagggttctgactccatgactagaatgcaggattatctgtggaataatataaaatttattctggtggatatattggattcctggctctttattttctgaggtattttgttgattctttgaagataactttcccaacatcaagaaggcccataccctactctcctaagacttctctgagatcatgagctacccgtggactaagaaagacggcagtaacaatttcatgtgaaaatagatatacatttggcagccagactatgcctctcagagaaacgtcgcagctgcatactgaatttttggtctatgaagagagcctctgctttcttagctttgggaagaaaacacaccatgacgtgccctttaaccctttatcctttaagattggcgtggaaagcggtaagaggagggaaagactatcctaagaagcgggaataacggacg

SEQ ID NO: 11714 - DNA, 563 bp, Homo sapiens
  misc_feature (1)...(563): n = A,T,C or G
aaantttgggngaccaccntganttagaggtttaaaganaagggttccatntctttaaaataaaacctattaaaatntttttaagtcctccattttttttcataatgaaaataggcaatttagcaaccagaataaattttaagattgtgtgttttgaaattatattttaaataaccattcttcaggggaaaacntaagtttcaattcttttcacaaagagaacttttaaaagttgactttgtgctttgaatgatagctatagaccatcagcaaatttttgtggggcaaaaagaaaggaaattgataagacatttcaataagtttaattttaaatgtagagttgcagagaaagggcatatttaggctatttaattccattcatttctaagaaaactctaattatatccttcctgtgaaaagtaattaataacaaaatgaaaagataaaatgaagtaattaaagtttgaacaagtccttaaataccaaatgcagactttctaaacatagcttatgtgtaaagaaatatagatattataattgctgacttattcttatgccaaaat

SEQ ID NO: 11715 - DNA, 961 bp, Homo sapiens
cttcattctatcctttctcatccccccttttttttttcatgagaccaccatcagaagtagctgtctgcaatctgggaagagagacctaaccaaaacttaaccacgctggcaccctgatctcagaaactcagtctccagaactgcgagaaaataaatgtctgttgtttaaaataaaaaaaaataaaaatcaaaataaaataaaaatatatttataatatttatccacttaaacttataattttaattattattccaaaataaattcctccaccctctaattattattacttacttattattattttctctcctcttgcttttttactctcttccccctaatatctttctattctttccattcatgatttatataaattaatttttatttatttattaattcttatcgaaattgcctcttttggtgacttatgtattatttataatacatattaatgctttatcactctctctcctattcttacacccacaccctctaccttatatttttttatcctcgcattcccatcttctcttattatttatattaacttttctcctacttctctcccatctcaccactactgcttaaaaactaagttcacatttccccgttccgctctacttctctcaatatcactactcccttcttgctttcattcaattaactatctttattttttcaaatttattatttttaaatattctattttgattgttgttttacagaacttaatacttcctatgcattctttattctcactatcttattaaccatccattcctttacttcttctccaacatccattatcagtcacttaccaccttctcccctccttccaagatatctaattagtatatcactcacacatcttatctattctatccctaattcaaataatatttttctccccgaagttatctgctctacttttctatagatttattatttctctcacctcct

SEQ ID NO: 11716 - DNA, 669 bp, Homo sapiens
ctcctcttgttggttgtgcggggcgtctcgggggggggctctccccgtcgccccgggttttttttgtttttcctcccggggcggcggtgtgggggggttctccgggttcccgggtgccgcttccgtgggggcggccctgtttccctgggcggttttctttttgggcccgcgctggtgtgggcggccggcggcctctggggggggttttttttgcgggggtttttggcccccgcggttcccttcctcccgcccccggtggggtccctgcggcccccccccggggtcccctcccgggttgttccccttccccttgggggggtccccccccggggtttcccctccttttttttccctttcgggcttccccccccccccctttttttttttttttccggtcgccccccccccttttcccgggggtttttttcccccctccccccccgccggcccccgcccggggggccccgggcccccccttttttggggcctttttttcccccccggggggggcccccccccccccctttttttggcggggggggccggggccctgcccccccctttccccccctgggccccccccctttcctctcttttttccccccccggggggggggtttttttttgggtgttttttttgggggggagaaaaaaaagagggggtttttt

SEQ ID NO: 11717 - DNA, 864 bp, Homo sapiens
ccctgcaggtacaacttctaaccgcattcttgccgaggggcggcttttactgatgaatggataagatggccgggcttgtgctctatcaccactcatccaataatcaagtgcctatgacctgcactgtacctacttggaccacactggcgaatattaccatagaggagactagatcacccgccatgaccagctaaccacctgatcatagcttgtctggaggcctgtgagctcgcgctgctgcagccgacatgccgcccttgcattcacggggatgcgtagggcattcaggtaaattttgccacaagagagataatttgcatatccttacgccttggggggaaattggaaacgaggttgggaggaagtgagggcccatatcaagctgccttcttcctccgtggggttatcagattccaagatgaccaaaactgtcctgactcaactacttaccgtggaggctccaccaagagcctccggcagcccctccagttcgttacacgcatccacccgcccctctccactcgacgcctcacccgccacaccagccccaccgcccaaccactcttattcaaacactagggcacctggcactaaacattttataccacatgcgctcccacgcccccactccgggacccgccgcccctcctcttatcgccgctcttcatcttccccccttctccctccgtgctctcagaatactctccccgtccccctcatcttcttcccgcccttgccccccctctccctcctctcgctcatcccaccccatatccccccacccacccactagcagtcctccctattgcccctctccctctcctctttctctcctcttcctaaccccttccctccccctccccg

SEQ ID NO: 11718 - DNA, 732 bp, Homo sapiens
tcgccagactaactcaaagtacaaagttttccagagcttatataccttctaagttatatatcaacgtggaagtgtgcattcatctaaagacataagtgattaacttcttttaatctataactaaggtctgagtcctgaagaccttcctctggagcctcagtaaactgacttaatctaaatgagtccagctgctggggtgattacccttatcttgtctcctactaaatcacagaggtttggggagttccttcagacgcccagtaaacttgtttgtggaggcctggggattttcttcagacccacaataaaacttgtctaatcctaaatgggtcttgttaaaaattccttcattattttatcacgctttaaggcccaggaaaggcctaggcaaaactcttggtgggcttttgttgcatcccaactttggctaagggcactggcttttaatattcaacttaaccactcggtcagtactgaaacagttgttacggaggcctgtgttagtgagacctagcttgccacattaggatgcatctatcttatgttgtgcgatatgatgtaattgtctttttttgcattggcaaatgcaaaatcaagccaactacctttatttacatgcaaaggaacgatctgtatttcattgaaaattctgtagacttgggttatgtatatgtacatatattttaaaaataaatagtgtggtgttgtatatgtttaaaaaaaaaaaaaaaa

SEQ ID NO: 11719 - DNA, 1129 bp, Homo sapiens
  misc_feature (1)...(1129): n = A,T,C or G
cttctccttcaccatttctcccgccccccccgacctcggtcgcagcataacctcactntctggtaagcataaagcaaccttaaacagctcagtacctcccaggactacctatgaagtcgagcccgagaggcagatccgtgtcataatgacatgcattctagtccgtttagcgcgcgctgccagacgcttgtagtcgtcattctatgtctcccacgcttacctctgacgtaggctcgcatgccagcgaggcatctgttctcgagttcctcgcatagttgtgctctaccgcctgcacgagccggcaccacctattcctcacattgcgttctaccagtctcttgttctaggctacatccacagcactcctctccttcattcattcctacctcactcatctatacatgcgtccgcgccacccttctagctatatccgtatcctccacggggcccgctccatgctatttctctttcttcactctaatgaccgtccaccccattctttgctctctctcgctctattctccctgccctctaccacatccctcatccattcctatatcgcaacccttctcactctccattttcacttccttaccccaccacctttctcgccccctctccctcgcgcctacttcctccaccactcctcgctcacctcctacgttaattgagttcttccacgtcccactccatctccctaccctcctatacatcgcccgcccctccccccctccctctccctccctcccctccgccctatccctcgtcctccgctccccaccactcacaccatttctctcctattcctttttccgcatccgctctgcttcactccccgccggccgtccgactatgtccatccccccctctccctcacatgcaccgatcctccgcctctcgcttctttcacccctccccccgacctctttcttccgctcaccctatactccctccantcactccacatcttcgccacctcatcccgtcatctacaccatctctcgtccaatcctggctcccatcctatagatgtacagtctttgnttccacgcttcactctcaccggcgccccctcgatacgtcgtgcatgtacatctcaatccactactcgctctcctactcctcctcc

SEQ ID NO: 11720 - DNA, 950 bp, Homo sapiens
  misc_feature (1)...(950): n = A,T,C or G
cggtctgttgctgctgcttgtctctgtgttcctctgtttgcgctctctcttctgtgagctcttcctctgcgtcgcgggacttccgttcttttgcggctcgctcttctgtgtggtccttgtacgtctctttgttgctgctgttttgtttgggtctgcggtgtggttgcccgtccctggtggnacccacttgcgtgtgctgttggtcctgtggcgtggcgctctgtggctgctgcccttgttgttcgctcgcggtgcgcggggcggccgggcatcgttgtctgtctcggtcgggcgcgggcgcgttccgttttgtggtgttgtcgcccgttgtctgttcgttcctccgctcgcttggggttctctctgtcgttcccttggtgctcgggggtgccgcttgcctctgtttgtgtgtccgtgtcggtctgttggtgtcggcggcggctctgcggttcgcgcgcgcccttggctctctctctcctctgctcgtcccccttggctagatcttttctcctttctctgctctgctttcctcttcccgccgctcttcctgtttcttgtcccgcgttggtgtcttgtcccctgtgttctgcgcccctttccttgtctctcccccctcctcttttctctgtctgttcccgtcgcctcgttggtgtctcgcccttctttgtttcttttctctctctctcctccccctctttccctcctcttccttgtttntcctcttgtctttctctctcccgcgtttttcgtccgtcttcgccccttctccctcttctgttgtcggnnnntcttttttttttcttcttcctccttctctccctaattctctcctcccttcccccccccccncctnttggttttctccttaaatttttttttgttttttttaattttttcttttttcttcttcttatntcctctcctttctttctcttntcatctttcttttt

SEQ ID NO: 11721 - DNA, 740 bp, Homo sapiens
accactctcatttatctccgtccttcaattttagaggaccttctgtaataccacgctagtatatgagcacaccatttgcctccaactattgctttgccaagcctgtgttcaaagctaatatcatctcatattcttggatatgccacagcaataatcatggctattgcctcaagccacctgaggtggtaaatcttacatgacaactggtctgggccaccaggcccagatatttggtcaaacattattctgaacattcctattaaagtgtgttttggctgagattaacatttcattcagtggactttgagtaaaacagattaccctccatgatgtgggtgaggtcccatccagtcacctgaagcccttaatagaacaaagactgaccttccccaagtaagaaggaattcttccagcagaccgcctttgaactggaactgcgactattccctgaatcttcagcctgccacccaaccccatgagattttagactttccaagcctctacaatcatgtgagccaatacacatccacatgcacacacacatgcataacattgattccgtttctctggagaactctgattaatacacctaacctgctacttctcagtctttagtatcattgtaaaattaccatttttctaatgacagcctgtatctcaactttggattactcctaccttttacaaatatgtattaaagatatattgtgtaccagactctaaaaaaaaaaaaaaaaaaa

SEQ ID NO: 11722 - DNA, 260 bp, Homo sapiens
tgacgtagatccagaatagaaactgcttattccaatagggaaaaatattcacagtcgctgctttcttcagcttccaaggaatgcacaaatatatttttgtaacacaatatgcttattagtcattatatgaattaagctgcctcccttgcatcaatattatagctgacatggaagcaaaacttttatccttttcagatagtatcaactatttaaatgcgccctttaattttcactatattaaatttatttttggactttac

SEQ ID NO: 11723 - DNA, 419 bp, Homo sapiens
ctttgggaacttaatattgctattagagctaaacggagagaccttctgactcactatagaatactacctagaggagtgcgatcaacaacaatgctattgtcacagagccggccgcagggctgtgtgtatttagaatcagatgcttgacaggctggggcaggagtgattgattggatcacaggtggcggctgggtgagtggtgatcaatccactgctctccagtctgtgtggcagatcgagaccctggctcaaaaaataaacaaaaaggaaatgcttggtgtcagtaacggagtttattagagggtttttagtctttatttctcagctgtgtgtcctagttggttgactcatgcgaattagcgtgtttattatcctttctttgtgaaaaaaagaataaaaggtggcctcgttggcctcaa

SEQ ID NO: 11724 - DNA, 1499 bp, Homo sapiens
  misc_feature (1)...(1499): n = A,T,C or G
gctgtcgcgtcgtgtagtggcgtgctctggcgcgatctggtgtcgcgccgtctggcgngttccgctggtctgtcggggtgttctgtggtctgcgctcactcgctnggtcgtccgtcgnggcgtgtcgggtgttcgcgtgtcctgctccgttgtggtgtggngttaggtcgcggtgctgtttctcgctgtgtccnctgacgtcctcgtgtgtggttgggtgctgcgtctcgtcgctgcggtctgtgtggtgcggtgcgctgctggctcgtngcgcgtgctggctcgttctgtgtgcgngtccgtncgcgcccgccttgtntcgccgcgcgcgtccgtgcccggtgcggcgcctgcgcggtctgngtgcaggaggtgcttgtcgtacgagtggtgcggtccgcgcgcggtgcggcggctgctgctggatggtgaggtgcgcgtcgcgcgtgtggtgcggcgtgcggcgggcgcgcgcgcgcgccggcggtggcgttgtcgagcggcgggtgcgngggctgcgctgtgtctgcgtctcctccgctcccttctagcacgcgtgcgcgcgcgggcgcgtcggcgtcggcgcgtgcggcctcggccggttctgnntcggccgcggcctgtgtgcgcgcttgtggtgcgttgtcgggctgtgttcggctctccgtcgctgtcgtgcgcgtctcttacactctcactncctcctcgcgccagttccgtcccgcgtccccggtgctgctgcgncccttcgtcctgtgcgtggcgcgctgtggcgcgtgtggtggggcgggtcgccgtccctcctcgccgcacgcgccgcggcggcgtcgcgtccctgcgctctctccgcttttcgctgttcccgctcctcccgagnttcgcccccctgcctcggcggttggtcctctccctgttccgctcttctctttctgtgtctgttgggtgggcgggggcgctgcggcgcgctgttccccgtgcccttgtgcccgcctggctcctgtggtgtcgtgccgggttgctcgactgttgcttcgncctgcgtgtgtgtcctccgcgtcgcgggggtngcctcttgtcgtcgcctgctctgttggtctcctcggcggcgcgcgcgtccgcttctcctctgcttctcctgttcctctgntctcgctggtgtcgcgtgctttgtagcatctatcctctcctctcctncnctccccctgctgattctacgccgnccnntcccttgctcacgtntagagagnnttnntttctctgtctctgttcttcttctctttgtctccttnnctctctttncttnnnctctctggggtttatctgttngctctnatgtgaaaggcctctttgtgttctatntgtntggtgttnntctcnttcntcaaggnattacttttatctcgtcattacatcttcttctctnctccctnannnnnccactcttcatcncttntttntctactctctcatttantctttcttcntttatcttttttctt

SEQ ID NO: 11725 - DNA, 914 bp, Homo sapiens
ctaccttactctcattaaccacgtcacttatctcagtatcctatttctgaacagaagaactatgcagtcagacctccaggactaagatgaagtgagcctagaggagatcgtatcataagaatgcttctgtcgttagccggccgcagcgctgtgtgcatctagatccagctacttgagaggctgtagcaggaggattgctccgatccacaaagttgcacttgcagcaagcgcagaccgagccattgctctgctgcctccgccctcacaccgacgacatgcctaataaacttaacatttaccaacccacaccaccaccctccctctctacttcacgccctatacattctcttccctcacctctccacttcacccccccctcctgctccttccactcttctccctccgttccactttcataccctccacccccaagcgacacttcctatcctcacatcttgtccctctcaccccccccgccatcatcttaacccgtaccccatcactgtagtattatacaacgccattccccactcctcatcatagatcaccattggtataattatactccattcaccgttctgcctcccctcctctacctttcaccctaccacgtccctttcctccctcaccgacaatcatttgctcctcacccctccctaccccatccacccccccatcccactctttccaatgccaccgacattctcaaatctcacatccgcaatcactaccaccgatatactccacaaccgccccctcgtgctcctccctcaaccgaatttctatccctatggcgcactaccctcctatccacacctccacgacgtaccatacttctccactttctcattagtcattttcctcgaaacattatcttcatccacgtctccattccccacacactcgcctacctc

SEQ ID NO: 11726 - DNA, 1724 bp, Homo sapiens
  misc_feature (1)...(1724): n = A,T,C or G
ctatatatcttgtctatctattatttgtgganngatttaccgcagtctgcgcnacacgaccaangagctcgcgctcttctctgagcatatactctatggtnaaccattcacantcgcgctagggnggctgcgatgatgngtgagtgcgggctgtggtgatgaactccgagctacgcacgacgaggccgcgcgtgcaccctgagannnccgtgagcgcgacacgaagcgcgagacgtgagnccacgccgtaggganncacagcaactctctcnnttctctataacacgttantcttgtactcatatcgacgtnnntnacggctggcgccgcgnacgctatgcgtctgacgacagacgcactggcgggcactatcatacgtgnngcacgctgaggcaccctctctntanantgtnatctgaccggtggnnngnctctgtcactcagtctgantgtccgcactgcacgagcactcgncggagcttggcgcgcaaattttannnggaggcgcgacgtcgtcctgctgcgcgcagagtgatgctgtctcgtataggananttatgtgagctgttggtgctgtntncgtctcttntgnactacgcncaagcgctctgtccggttcctactatctcgcgcgccagtcgtgagtcacgtgatatgagtgatatnacaccacgtgcgtgagaggannaacagntgnantcacacacgatgtacgaatcaacacgctacatatanttcttantagacgccaccgatggacgcgtncnttngntcatcgatcttaagcgaggcggacgggaggangtgacgaggaccacctcagacnggcgcgcgntagacgactagaagataangatanacagcaagtgacacaccgnnnnctcgcgcatcgctatagcattgtngcgtcgtganncatacttcagctctcgacactatcgtcgatagatattatgtagtcacgtggcgacggcntcggtntgangagnggacgtcgcagcgaagtcagcgcatcctgcgtgcagcggagtgggtggcggcgcgacctacgannngncncacacaataacgtgcacacagaggtatatcatcntactactatgtgccgcgggatgcacgagcggaacgatagagatgcaccgaccgcagaataaccttctaacatanaaactatcttgcatcaananctcgctctctatttnctatnactttctgcatctctcctttttttttcnnnnnnncactctgccacatncncccatctctcgtatcggaccgcgcgcgaganncgagctatatactattcggcgcgtatcatgtagctggactcctcatgtggaccgctccgcggagtcttntgttcagttctttctgcggtngtcctctctctaccgctacgtgcggnntcatgtcacttatctcttccatatacctcctcttctnctnccttactatttcccctctctccttnnncntnnnnccctacctcatctctcttnnnnccatcctctctctctcnncncnnnnnnnnnnccacatttnnnnatcttcttncnactnnnnnncacacataatnnttnnnccactctctnnnnnnnnncctcnttnnaattnnncctcaattcctncntntncactctnaanncatcantccacacttanatattacttattaattacaaatctttatatactacttaacttcttacttcattatactacat

SEQ ID NO: 11727 - DNA, 995 bp, Homo sapiens
agacgctgcgcattccccgcccccccccgaaacctcagggacccacctgcgcagcctatgcattaaacctgaaggacaacctctgtacttggagagccaagcacaagtgacgggagagagcgaggatgggaccagctcttctggtccgggtactttatgtttcagagaccgcttttacgacgactgcttcagccagcacctgacgaggaacgctccgccccccgacaaccatgcacccggcggtccgctggccggctccatggaatttatcgaccgccgccgcgcgaccccctcgcggtcccgatagagacatcgcccgccccccgcggacctccaccccccccgacagcgacgctccacgtgcccgcggcggccggcggcgcgtggagatcgctcacggcggggccatagggtagctccgcgccccggctcccgctgcgaactcccgtcaggtcgaagcgctgttcgccacccctactcgccgcggaggccgcgcgccgccagtgtcgtgagtggatcacaccgccccataacgacgtcgtgcgcgagcgaccagccgccgcggtcgcataaggcgcgatcccgtacctaccgagccccccgcccggctccccccgccccctcgattctaccctcgcacgcctcgcccggcccgccgaccgcccaccgctcccatcctgtgtagcggaagtctccccacgcgcccgcactcccgcgcccccaccagcgcgcggcgcgccgacggctcgatacgtaccgccgcagcgtcgtatggcgcggcgccgcggccagcccgtgccgctgcatccgctctcgcgacgggtccgtgaccaccccggtactacgcttcgatctcggtgcccaccaacgcgcgtcagccgaggagtaagcagcgggccgcccctgcatcttccgtaacatatcccaacccatatttggccagcgatatgttctggggctggatctcctctcgcgacccgttcccgccacccccg

SEQ ID NO: 11728 - DNA, 296 bp, Homo sapiens
tagggaatgaagcatggactgtgtgactctaccaggagcgaccccttggaagcttgtatttggtatcctctggacttcattcatgtactttttccctttcctgattttgcttttgattcttttgctataataaattgaagccatgatttgatgaggcctgggggagacttcctagcaaattattgaaccctagagtggtttgggagacccctgacttgcagctgtagtcaaaacattttgcaattagaaggcactattatcaattacattatttttaacattgaaaaaaaaaaaaa

SEQ ID NO: 11729 - DNA, 270 bp, Homo sapiens
ttctgatggagtgaaaatgagagggtgctggtagttctctgacactagcagcgacaaatgacagcgcaaaacagccggaagttcaacagagaaaaccagagaaagagacagccaagaagaaccttcctggagtcatagtcaatcctgggagttggatttgttaactgactgttgtcatcatcttacaacatatatgtatatcaagacatcatatatatacaccttaaatatatattattttttaaaaggaaaaaaataaaaaaaaaaaaa

SEQ ID NO: 11730 - DNA, 990 bp, Homo sapiens
  misc_feature (1)...(990): n = A,T,C or G
atttggaagacaattaaggtattattaatagtaggaagctcgtctgtttcagctggagcgttggtgcatctagactatgtacctctgcctaccggattcattcgattctcatgtctcaccctccccagtatttgggactacaggcgcccaaccccatgccgcggctcctctatgtacctttttgtctagcatgcttcgagcctgaaggctcgtctgtcatagaacttctgacctcacgtgatccgcccacgctccctcccccgcgtccaaggtttccaggcatcggctcctcgccctacccccgttagttagctcttcacctctcactcccgaccccacccccctactattacccaattacttcctccctcctctagatgcggcccagtcttttttataaatttttaggccaccttctttactatcttcttggtgtttagtttgtagccttagtatttcatgtctccagccaggtccactgcggcccacaagaactgcgttctatgtctcttgttttatcctatcatatagaaacatgacgcggcgcactctatataagttcctcctagatttatagtagctccgagtcatatcattattttcgctctcataacaagaacacccctaagcttctccctgcagcgttcctngactcctccacgtccatcttaatattgaatatcataatacatccgtctctctgtgctgctgcccttgttatcattacccacctactgtcccttcctgcgcaccctgtagcttggcgcccactcaaccctactaggccctatgtntcatcctgcaccctctcgtatcatattcttgatnncaccctctgtcgcgagctgtcgactgtgcgcgagcgattatcgttattccctatctctcctctcgatcttatttagatgtttaccactggcaagtcatttgtacttatctgttgttccccagcaacaatccttttcagtacctatgattactcaccttacc

SEQ ID NO: 11731 - DNA, 1921 bp, Homo sapiens
  misc_feature (1)...(1921): n = A,T,C or G
ccacgtagcatctgagaacggacgaatacgtagtcggggtcgatacagtacgtacctctcgtagaacggctcacgcacgctacatgacacgcttagctcgcatcgcgccatctcgcgcactatatgacgtngtcctgacggtcgnggcgcgtgcgacgcgacagcgcgcttaccgtacngagtgcgcgtcgctgtctagcgtactgcntcactattgntcgangaggcgcgcggtgtgaatgaatgaacatantagtgcgaccgaacgcgatcgactgcgacagcgaagaantaatcagactcacgaacagctgngagacatgatgtcgactnactagtgcgcgtagcgtagggagacgagagcccgagcagnctccnaccgcgacccacgtcacatcgacacagcagtcntctgacgcgcgcgtgcgcgcatgttgtagacgaggtagcgtcgcgagtacctcgaccgctcgcaancgcactgaggcacggtgttctgganatcgggatgcgatgctccactatncctagtagcacacatcgcaggctgctggcganggacgntacgtatcgntcgctctatgtcgacggctgncangngcngcgtagcgcgccggcctgcgntcacnatgcaatgctgactgcatacgtacgtgcacgctgcaggctgtgtccgctctgagcgtgtacgtgagctagatagcgctgcgngacagtgncgngcgcgctgntgtcgcggcgcantgatgactgtagtgcggtgctcgtntctgacgccagcgtgngngcgtcacactatggctgacggaagaactgaagatagaatgtanaagaaatgtgtacgtccaagctgacggagagcgagttgcacgctcagcatgagncgtnctgctangtgctacgtcgcgactcctcgagcgctggaacgagaagccacgctctacctcctcgtcgcgtgatcttcttacntgcgctctacagctacaacttcctcctctcgtcgtcgcccgtcagctcgcacgcgacgacaccgagtcctcgctangtcgccagaacgactgcatgcgcgaactcttaatactcnacccgtctcacatctcactgctctctcatacctntctntcctncntctactcagtcgcctcgtntcaactacagtagctctgtatgntnctcngactgcggcngcgacgatcantagctgctgaatcgcgncgctcgcttcatatcagctgtctgttaccatgtatgttatatacgatcgtncnnacgactctctcnacactaactacactctgtctgcatcctgacatctatatattgacactgatnctatcnagtancnacgtgagtgattagntctacttgacgtcgactttcattcntntgtgagngcgtnatcagttcantgtcgcgacatctgngtgcaaacgctgtcgatatnggcaccgacgttgtgcatacaccagtgtctctctcgttgtaactgctntcacatgtgtcgtgatgatgtaatnanatanaatactattctatnagccttaancattatatcacatgatnttatantttctacttcantattctnaatacantatacaatatcatcttacnatattctatatctctctnaatcttcatnatactcatactatattataaactctttannnatatatatanaggagactntatatnnanataccnactaattatatatacttcannnttnttctttctaattacantnggggatnttatacntannnnananaaaaaaatanntatatatanntaatcntntaanatntannncttatatnaacatatactttntntnnannntatanactatcattnaatntnnnttacnacnacnncatnnntnnnnnatntaannanattaccacacataatcctt

SEQ ID NO: 11732 - DNA, 343 bp, Homo sapiens
ctttctgataggagctggagttaggacaccggccctaaggtcaacacatcaaaatctgtagcacatcccttgcagatatagcctgaaaaaagcttttctacaccttgtccttcttaaaagcaattcatttccacataagaaagtattattagacttcacaatagttttgaaatataatattaatttgcaaggttattatggccaatagctctaaataactcttgaaacttactaatgacatcatcctgtttattattccatggagctaggtggcaaatggtaggcatttcattttagtgctcttgatgaataaatgaacaaacaattaagaaaaaaaaaaaaa

SEQ ID NO: 11733 - DNA, 893 bp, Homo sapiens
gctaatgtcacattcacccacacgcttaggcaaatatcgcctgcaacaacatatagggaaaatcccagagcacaagcatgaatgaaaacgaacacactcaataccacccggactgtaaagaactgcaacactgaaaagaacacgcggttaggtttatgtaagctgaaaaaccaataaccgccaccaatgctcacacacaacatcaaactcttataactgtcttctatgatgcatggccatgatatagcattgtgatttgataacaaggaattacttgaatcttatatatacatacaacctatcacataacactaaacaaattatttccccacccccacaatgcttatagtgacttttgtacttcaaagctgctctttacggtggagaaaacatgtttccattgctgtgaaactttaacacaaaaataatgttgtccctaagaccaaatcttttacaaatgatctgagttgtacctagcattaaaataagtgaggaaaatgtatgaacaacttaatactatcgtctggattgacattatgcctcactggtaccctggggatatttttgcactaaattggcgcctgttatgagttctaagagcagtacacataattaattctgatgatatcctacaatgtctgcaatgaaacatcacactacaagtaactaatattctcgttattgtccctattacaccggtacacacacataccattccacttatacccccaggatggatggaacatataatacatcccccttacaattcttttattgggcttttctaccccatgtgggatttggctccatccccctcaggcataacacccccttcctttacttgtatttacttccatcatctaatggtataaggacacacattctttatttaa

SEQ ID NO: 11734 - DNA, 951 bp, Homo sapiens
  misc_feature (1)...(951): n = A,T,C or G
tctcaggcagatagagaacagatgacatggtagaacatgaaaaagaggatacccacaatgctaggagtacagtataggatgtttcaccacacactggtgatgttggagtggcactctgctctgatcatagcaagctatctgaaaaataagttgcctggattcaacccatagatggagacatggaagaaaccaccttgtatagtatatcattggctagacctaacccttccatgtaacatagtaatataaattattactagaattaccttcaacagttctgactacaaatgaaaaagaattttcttaaagtaggatgagatcaagtatatttatcattccgactcacaagtagtgattattctacttttctatttgccttcacaattaattaggttatgattcctatatagctatctgtcgtaactcaccttcttggtcaatgtcatctccgattgggaccatatctgtacatatcctagatattcagctaatttcacagggtccacgccactacaacaagagctcaagctacccaagctcgagaactcaatcaaaagaaaatcagtgcctgcatttatcccgtaacgatgccctcatggcgcctcgaaattcgtagtactgttggattcctcctctgttgcctcctacgaacacaatatattgtcctctcctgcntgcaacacgactcggcttttcatggacttgtcacgataccaccacatcacgtcttctaggcagaaaaaccaaaaacatatacttggccgctccgcgctccacacctgacttgagttagaccatctatttaaaggtggattaatgcgcggcgctcgatcaactcaccactcgcgcctgtatacatcttacggtgaaccgccgaggctagagactaggggaacggtagctactcatggcgctcgtcgaataataaatacgtgcagtcatgcactaaca

SEQ ID NO: 11735 - DNA, 1064 bp, Homo sapiens
  misc_feature (1)...(1064): n = A,T,C or G
cgggctacgcgatgcgctcagcatgtccaagacagagagtcagcctaggcttgtgcacaatatgatagcatagttgtgcgatacattagttagtacagtgatgagaatgtgacgaagtatacgtcacaacacgcatcgcgatgagctctcgtctatacacgctgacagaataattgtgagtgtgcgcntagctcgaccgccttgacaactagatatgatctccttagactctcctaattatcgatcttgttcctgctcggcgtgacacggacgtgcgcgtggaatgactactgaatatatgccgtacacgcagtgtcgcaccggcacatcgctggactggcataagtatagtagagtcgcgatattaggtaagtgtatatgttatcttacatctctcattaaccgtatgtgagtgcagtttcacgatgaacgaggagtgagctggtagcacgaaccgtggtgcgagcagtagtcactgtatatcgtatctgctgctaccggactcgacagtagtgacggcgcctgtatacatatgtacacactgctccaacataacacaattcagtcggagcgtacactatacgtgactgtgaatagaatgtgtgctacctgtctcagatcataatatctctccgtaatgagcgtcgtagataacatacgatctcacaaactcgcatcgacgtctcgcccactcggtcgtgatagagtctactagggtatcattgtgtcgtaagacagctatttatacacatccagctggtacgtcaccatggagatggacaacgataggacgcggcgtgcgctgtagagaatgtggacccggctcacaggcgaggcgacgaacctctgacggcggccgtaggccgcgatcccctcagaccactcgtcgggaacatcgtctactgtatccgactcgcgcaaatcaatttatctcgtaaatgcgagcacggttgggtggtgtaggcagcggtcgcgtcttaatcagtgtagcgagaggggttgaaacaaacatcaagtctatgggcgtaccagaccgcatagttccgccgcggcttgctgttgct

SEQ ID NO: 11736 - DNA, 1109 bp, Homo sapiens
  misc_feature (1)...(1109): n = A,T,C or G
acggcccatctcttaaccagccgctgtccgcaagttgccctccttctgcgtacactgcctcagcgaggtggacacggcggtgcagtcgcaccctataacgctataagcgaagtgcctaatcgcaaacctttgtagcctgacgatggtcgagtcccagcgtccggtaagtggtctaggctgcggtatgtggttcctctttctcgtccgccgcgagtgcgatgacccggcgtgctgccgcaccacgtccgcgaggcgcgcacgtcttgccatagcgtctgctctgcgtgacgcgtggtctcgctcactcgccttgtcggttccacaatttactctttatcgttacgcgagattaactcgcgctgacggcagcatgcgccgggatgcacttcggcgctcgttcggctccgcgagtcacgcgaatcgcgtgcgcgggccgaggagacatcgctaaggtcgtagcacccctcaactgtctcacccccatctccatccttgaacggccgcgcggatgatccgcccgttcacgcaccccccctgtgttcctttctgccactctcaatatcactctctttcctgcgctctatatctctattccaccggccgcgcgcgcgcgtcgccccgccctaccagcggcctgtatctacaactctatggctctggtctccgcaccgccgcgcgcccgaacgccgctcttccgtagtcttctcgttgtccgcaccggctcgatatcactctacatccgacctatatcacgtgccggccgacgagcccgatcaaccactacctcctcgatctcgcccacatgctccataaccgccgccaatctattagatctatgtataatcctacctctgtatcgctcgcttctttggggcgtctggcttcagtctgctcgataacggagctacgacaacctctcctgtcgtcctcgtccctcccctcttggttcaactaaatcctcacataaaaactatatttcacttcctacaccattccatctctttcnctgtttnctcttataaaantttttttttttaggttttattttaanttattatattctatttatacctttttcctcctatttantctatattaattacatcata

SEQ ID NO: 11737 - DNA, 885 bp, Homo sapiens
  misc_feature (1)...(885): n = A,T,C or G
ctcagagtctcgccctgctgcccatgctgaagtgcagtggcgccatctcagctcactagcacctccacctcccgggttcaagcaattatcctgcctcagccttccaagtagccagggattacatggcacactgccagataatgatagttcttctctgcaattntctaccaactactttaagagtttctcgtcattggtgaccaccaggaatttgaagagataatcattagacttccttggaataatgtgtttctgtccacagataaataatatacccctgatattaaacagacttgctcatataaaaaagaacaaaataatataccgcgaacacctcgattttgcattagagacaccaacatttaaatcgggcgccntccccgctcagaagtcatgacccacatccaacgcaaatgctactcggcgaatccctgcctccttcgccgtgtctgtacgccgccgccgtcatctccacagggcgtacctcgttgcattccgccctctccaccccgcttccaccacgcgcctccttggtcggagtggctcgccccgcgagagcgagacgcacgcccgcaacatatgcgagcgcacgacgtataagcttgtcctaagccacgcgtgcccgacaccaaagtgcacagatccgggatagttgctctgcgcgcgcgatcggatgacggtacccgcaggctctttcgcccccgctgttgctgatggtcgcgtcgccgccacgcgcggtttccgaactatcgtcatcccagtgtatccccagacagatatcaacgtcatgcacgaaaacagagcagcagtggccggcaccacacttgtcgtgcaagtctgtcgaagatcggatctgtcgtatagtatgcggcacagcgaccatcg

SEQ ID NO: 11738 - DNA, 959 bp, Homo sapiens
  misc_feature (1)...(959): n = A,T,C or G
acactacgtccgtggctcgcgccggtcgtccaccgcgcgtggcaccgcagtgtgnggctccttgatgggcagtaggagtgtgatgtgaggtcgttgggggtgatatgntgaggcgtctgctgcattatgtggctgaaggactgcgccgttgagcgtatacatcggtcgccgtgggcacgtgggggatatgtgggtgggacgtagaagtnacataataacgtgggagtgtgtgatatagtaactctagtaactatggtatcaattgaagagtgaatattatggtgagtatgnnnnttaatatagttatactatcattaatgtagcaggaagggggagatagttatcagaagggagcgctgtgtaaagagtagagagggaggtggtgagaggtgctattaaaaatattatgggtatggcgggctaacacgtcagaaatacaacactcctagtctacttttcctttagtaacttanatttgtggctgctcggagtcggttggggtgtggtaggagggaggggagaatgtgggggggggcggactcgcgcgttaactctttcatcggttactcgattataaatttgngccggaaagtccatctatttctgagctaaagggatctagctctctgatagaagctggtgggaagggaaaacccaatagtacaaacgaacttatttcctactttactacttacttctttcatnnnctgtttttttccttctctttggcttttctttttcggaggtgggactggcggccgaaaacaagaagaggaagtaaagtagagtgacagtactttgctatctaattcctcttnctcttatttanncatcatattnnntctcctnnccnnnnnccctnncacctcttnnncaaatnatccctctnnnactnnncttactatcnctncacnaccaattttnaaatttattataatttacttaaacttaatattatt

SEQ ID NO: 11739 - DNA, 908 bp, Homo sapiens
cttcaggttatctcacaacttgcttcatagagaataaaatacttaggaatccagcttacaagggatgtgagagacctcttcaaggagaactacaaaccactcgctcaatgaaataaaggatgacaccaacaaatggaagataatcccatgcccatggataggaagaatcaatactgtcaaaatggccgcactgctcaaggtaatttatatatctaatatccatctccatcacgcttccagtcgactatcctcacacaattcgccaaaaactactttaaacgccctatggaacccttcaagagtccacattgacccgactttcctgtcccccccaccacccaccctggacgctctttgcccccccgcattaaatcttcccttacccgctcccaaagccttaaccactctccccctgctacccctcttcagatcatcccccctcgccactcatccctattctcacacccatactcgccatccctcctccaccccatctatccgctcctccccactccaccccacccccaaattgctcaccccaagcacccatcccactcgcatacacctcctccctttccaccccctccaaacctaccccactattcccttaataatccctacactactctctatactcatttctcctcacgcctcatccctcacacctacactctctttgcaccatcgcccccatcctcacccacatccactccaacaactccttccatactcctacctcctcccccacatcttcctacttctcccttcttcactatcacccccaatcccttcccatcaactctccttccccgcctacccacccctcccaccccaacccctccctccccattaccccctctccccccacacacacccccttctctttgtcccactcccaatacaccacc

SEQ ID NO: 11740 - DNA, 2038 bp, Homo sapiens
  misc_feature (1)...(2038): n = A,T,C or G
gggccgtacgcgcgtcgcgagcgtgtcagctatcggtgatacgcatctaatcncacgccgctatatacntaccgcacgncgtgntctcacgctcagtgtggggctgatacgacgtggaatacgctactgtccgggtcagcgttctcctagctgngtctgctatgagagtcgtttttgatntctataagtcgtgtggtgcggtgatatctgtggtgtncgacgactcgctgcactcgtantgtctagttggtcttcggatggcgccgagtagnagacgcgcggcatgactactaactcgctgcggcgtangtagaatgatngccactgacacgagcatacggtnctggtgatgtacatactanagcacgtccgcgtatntgcanacgctgagcgtatcgcattacactctacacgctngttcgatctcgantnactgtgcggctncttgctatgttnnngnngcgtgtgggagagcgtggagacgcgagcacacgatctatgagtgagtggctgcggtngcgntgagtgctgcgcacgctccgctgacgagtagtncgngngntgtgcgctgaagagcntagctcntctngcagctactccgagtngnnnatacantcgatatgtattcctcatatccatctatatgntatgtctactcagtatanaattcaactgcatctntacatactantcgtcaacgcctggtgtgcacagatctcactggtacgntacacacaaanangntantatactactcgtgcngtgtttaagtgtagantgtgtgtcgctatttacagagatatcacgagagcntgtgtgtgtagtggcgtatacgngtgtagcactgcgcacgtataganctgacactcctatgtcgtacactntctctctcgacggtgagcacgcgcgtacagtgagtnatcgactgctcgttactagagacgcgacagcagcatgngngacgcagctctcgctagctcgcagctgcactagnacgagcangtanggtgcagcgcgctgctgtgcgcngatactgcngctcggttcgactgcgctgatccgtatantnaggtganggacgttgnagacgcagcacgactcaccgcaggcgtctacgctcactgctgtnngtgcgtgtctgcagctgcttgattncgagctacntctattgtnctgtangctgatgcanttactgtccagatgtcanggatctcangcgctctacntnangangtacagtagtactcgncatacaacgtntntcgtcatgtgcgtcatgaagagttgacgtaggntgcgtgtcgcngtcangatcgtgtgtgctngngcgaacactgtgagttgngangangngatagatagtgaaggagtgacttgtgtngtagactangagacgatnccgtacanatatacgtgngacacactatcgctacgatggtacagtgcngtctctgtcagtgactgtnagacagtacgtntgcgtctgatctatatnatcgtantgcgcatcatcaatcatcagntantcacganacaataccgagacacgcgcatgangtgngnttcgcgttgcgcntatcatgtcacatgangcgagctgtngtgcggcgnactgctgngngcgaccagcgctgagacatntacagcngatcagctatacacancgattacnacggagcncgagcgagcgtgtcngngctatcactgacaccggatgcgcgcgtctgacgcagtaggtgcactccgactgagacgagcgtggtgnggcgacagttatgncactaggagagatgtgtngaggtatgatcgatgtggccatgttatgtggcatgtgtggagtgtgctctgcangtattcagattgttagnatactattctgatagagngatcagagtgtgagtggangcattgtctcagtgtagtcgtaccagtgatgnggaatcgtctgtntggtacacgctggtctatgtgtgattgtcgtgtagtgcacagnagcactcgcgtagccgctgtcttantccgttagacatgcatcaca

SEQ ID NO: 11741 - DNA, 1223 bp, Homo sapiens
  misc_feature (1)...(1223): n = A,T,C or G
tctcaccacactccctatctacaaactaaaataaattaagaaaccgcctcagatgctttctcgcactctgatctactcggttattaggtagttacggtaagctaatattgcagctacggcaacatctcttgcggaagcgcccacgaaacacactccatcttctttgccgccatcgagtatctcgtccttcataacgtaatactatcatctcatgcacgcccacancacaggtgtaatatatctgataatactacacaactacactcaagctcgcctatctcctcgcgcttccccgatcacctcgtaattgtncatactaaccgcctcaatacttatagcgtaaacctacactctcaatcatacccattcnctctatccctccgcccacatgtaaccatccccttctacgacccgccaccgcaatgcttcatcaatctctactcgtgcacgcgacattaattctctcctgcatctcgcttctcgtgccactcatcccgacatactctcctcttcttctatatattcactcaactcgcccccccatcctaccactattataatattattctttctctcccacccgactcttatcacccaccttccccctcccctcttaactttaccccaatattcccccaccctctaccctccctatcatgatatatatcccctctatcatccactcttaatacaccacaccccactcactacaatcctcgacttactactcatacaccaacccctctctatacacatatcccacgcctacccactatgcactaccatctcatccctcattacccttccccccctcaccacatatgtcccacctaccctctccacaatactccgagctaactcactacttcaacgtaccagcaaatttatcttctcactcacaatatcaacaccatatctcatcgctcccacctccatttcatatcccatctttcaccgagtcacacacctacccatatatcatctgccatctctttactacctcacaacccttgcctaccaccccactcccgtcacatatacttatatcacataattttctacaacaactaccacaatctactctctcccactctctcctactctctcacatccacacaccgcatcgctctactctcgtatctcacactactcttcttcctctaccactcctcccactacaacagcacactacattacagtgaccccagtatcaccctacacta

SEQ ID NO: 11742 - DNA, 1752 bp, Homo sapiens
  misc_feature (1)...(1752): n = A,T,C or G
acatananaaataagatgttgcacttgancgatgnntctacgatctcatatgggagagctagctgtcgctgangtactctacacgtccgtcgccgagagaccttcggcngagacgctgcgcgagcgtatgcggggagcatgcttcattagtnatgtgagcgtgangcggacctatatatcacgaggacatgcaacgatntcatcacaccaattagtcactctctctcatatcctctgccacnttanagaggacgctcgttgnganngtgcgagacgaccagagagcacgcgctcgacagtgatcagagacactatggngcgtngctcatcnagactacantgaacatacatagacgcggtatcgagtagatcggtnagagcgaganctacgatagnctactgangcgcgtccattcgtagngagngngcagtatcatgngnnngtactgctatgcgtcagtgtatatacacagagtcatcacgatggtngtgagagaagaagagagnnnanagtagananaccgacagatacgtgcatgagtgatgtagttaatnactactactcagtcatcagatagctcgtctcgtgctngngaagtcgaggcgcagagcgcgtgggcgtgcnggagccctgttgggnnctctatctccaatcagaagagaactagtatcgagagaataacgaactcatctattaatacaagagagctcaagaaccagctatagacacaagacacggcgagatgcgtagattgattcccgagatgcgtgatggatgacgaagaggacatagatgtgggcgattcgngcgccgcatccgcccgctcacgtcctanggcggcactctgccgccgcgtctgcgagcgcgcagactccttaccgatgcatctangnngtcgcagagagagcatgtcacactcccgacagcactcagcatcgagtanccnnnnnnnnnntcttcatntctgcctgtcgcttctcgctgcgtcggagtggtggtgcgcgcgagactgttcccgtcgctcatcttatgtntngtagaggactacngcgtagactatctnatntngancgtcgcatcacttaatnganaacgtacattactatacactantcnagcgatgtctctcctaaaaacatnananantggntnnanacagctataaagtatanaactcacacaaaatacatnttatctatattgntgtaacatcgcgctgtcngagantcagcctacagcggagccgcgnaggagncgttactcaatatgnggatngncgcgatgagtgnacatgatcatgngtagctgcgaagcgntgngngnctcancgctctgcgacgagcgcacagctganccgatcacgcgacagagcacgtnacacactactgcaatctgatnnnntnncatcacatctnnncgtcctnaaatcatatnanangnnnnnnacacacnatacttnatcnannnnnnnnacagcataggctatgnntnaannannnnnnnnnancacagctannnntngnngccctctnncnngntgtgnngnnccaatactctatcntccggngtcgtcnnacgcnttngtctnnncnctgcnnnncncagaaaaancccctatccctntcatctntcnatnntctnnnntnttcaattatanatctntntttnnactcatacnttnntnacantantctatccatctcatntatcccctctntntnctcatctntncatatacttncactctactt

SEQ ID NO: 11743 - DNA, 1399 bp, Homo sapiens
  misc_feature (1)...(1399): n = A,T,C or G
acaaaggatagtatggataatgcaaaggatggactacatggctcgagataatatattagaggtcagataagtaagaagatgaaactagacngacaccaacagagaaggacagatagcatgaaatagtgatagtagagacgccgatataagaganaagcggagatatataggagagtatatatagntcgtcacatctcaaactacataacatagcgagctcatacattgtagagatacatcacaatgacagagatacctatacaagagtaatacatactagagagtagagaatatcgaatagatgtagantgaacaaacagtagttatcgatacgataaagaacatgtaaaaattattatccttactagntgctagtggtgngaaacagtaatagtagatatatctagaacagagatcacattgaatatatagaaatatagagatagatagagattattcgtatacacacatacagaatgaaaagatgggtacnagattacgagactgtgtagtggttacacatgaacgagaacgtgaaacacagaaaagaaaagattagatgacagaagggggagcggaacgaggacgagaagaacgtgtccgctccctcagcgtgacataataataaaacggttcataggagagatataaaatgaagagatgaataccataacataacatacagcgcagagagacantaagaaccataaatacagatgtacagcgaactaaattaatatagttaattgtgttatnttaaattgatagagagagtagagaagacaagagagtatagagggatnggagtaaaagaaggaatatatgaagattagaaatatggagagattgatagnaagtaaagaaagcaaataatggaaactgttcacgtcgacaacagctaacaactacacaaanaatcctataacaaactacaatctaaaaataacaacatacaaacanacatcaaaattaattacaaacacacatcacatatctatcaccctcttnccctccaacacaaaccatatacaacacctccagaacangaancaaacgaaaccagatatataagataaagtaatagtatattgagaatcaaagaaatanagattatatataaagaataatatcgaaagatcaangaaaatcagtactgagttatttgagtttntnnttattaattntttttttctnnnttttnnatttttattctttnnnttnttgttctgttnntnnnnnnctntaacttatntcttcttaccgtttnnnctaatcttactnttatcatattttntnnatatatttaaattcaaacaacacacncaaacaaaaacaaaaaaaaatacataaaatatacatcattcactttaacaatatactctaaaaaatcaaaacacaa

SEQ ID NO: 11744 - DNA, 693 bp, Homo sapiens
  misc_feature (1)...(693): n = A,T,C or G
cctggctagaaacagcnacagaacctagcccagaaggaactatactaatgcttattggaatgaactcagctgatggtttaacaacaacaacaacatgtccctagggcactgaatcctgaaatcctcaaactctccttaaaggtatctatggaaactgtaagcaaactgcatatgcaaaaggggcctttccacgcaaggtctgcggcatcaaaactgcaatcaaaatccagaatttgatgacacacagcagtagcagcagtaaacactgctgagcctggatggatgccatcatctcattcccatggaatccgatcattacatttttgttttcagccccaagtttcagggtatgaaagtattatcatactatttcttgagatatttacaaagagctaaggaatttttcctgttctggtggattttattataataccgacatttatattgaaatcacaggaggacaagaagtacttttgaaaaattattttcaccagactctttattgtgtttcccagaatggccagcattgagtaatgggttgtatcgttatgtgtgtgtgggctgataccagatactaaggtcctcaaaaccctacagcattttctttcttcatgaaataaaatgggacataacatacngttgagcaaaaaataaactacagaaaccattatatggttactaaaaaaaaaaaaa

SEQ ID NO: 11745 - DNA, 1033 bp, Homo sapiens
  misc_feature (1)...(1033): n = A,T,C or G
gacccgtaagttattgggtcttgtacaatgatttatccgcgtttctgggaacttatataaggacatatatatatcggggggatagccatggtatagggcgcagagtggagacaacatccgaaaacaataaaaatgcgagctgagcgggtatgactgatcgtgcctacatatttgatatagcgcctaaactgtcatccgttcgtcgctctgatcgtgttccgggcgcgagatatttagtcaacatgcgtgctattgcggcgcattagactcatcaactcagtagaccgacgtcgcgcgctatcataccgtctaattaaaaatggaaaccgggaccgagctgtcccacgataccgtgaatcggtagcggacgcaatccgtgcaacgtcgtgcgcgcggatggagtacataatataacgaaagctggcttgaggatccataatccattccctatcngtcgtggaaatgctgcaatataacgtggcggcgggcgcgccggacatcgactccgagcgtagtacacgtattttcggggcgtgccgagtattaagtcagatcgtttcccggaaccgcgacttacatccctggatgtacacaattatgatgcgcggaggaaataacggcgggcatagacaacgcgcgtacgttgaaatggacgagatacaatgaacggggtgtacgtgcggaggtaaaataatggcagtcggagttattcacttatgctaggtcacgaatgcttacttttatctatgggcgtcggtttcttaaacattgggcgcgggccatatttccctacggcgccggcatgaacagtcgcggcacgcgatcctacagcaagagattaggaatagtcttgcgcattttcttttgtctattcaggaactttgtaggttgtaagatgactatatctgcttccccatttaaatttgctgtaaatgtgtacaaaaaagaaaaaaaatggcctcgttggcaacagcgtggagtctccgcaaacactcgaatttcttccaaaccccttataatttctattttcaac

SEQ ID NO: 11746 - DNA, 905 bp, Homo sapiens
ctcaggacaatatgaaacatggacttggtcgaagctgaaaaaaagactcccctgaatggttggaacagagatagtgtttctctccaaccacttggttcatggttttggactctactctgatctgcatgactgcctgaagaagaagtatgactggatgcaagtcataaatggagacatgggagagaccgtgaggatagattgattggtggaccatagccttctatgcaacatgggtactctagaatattaatagtatgcccttagacagtactgactacaaatgtcaatggtcttgcttttatatagggtgagcagaagtatatatattattaactttatcaggtagagattatttatactttaatatttcgcggaacgcttaatgagtgatgattcctatttacttgcctgtcccaccatccctttgtctgcataactttattgggacatatgtcacttattaatatacacacttatttccagtgatctatcaaccccatacaagtagattcacgcacggtggtcaatcaccaggatgtttttgcgtcggctgatacccagtagaatctccgaagtccgctgacactacatactagagttcactccgtgggacctcagcgaacaataatggcctctcttggcatctggttggggctttccgggccttcctctttatcgaggtggcgctttcgggccaaaaacaggaaccgtggggtcaggccgagcggacggggaaagcgttcgacatccctcagaacggtcaacgcgcgccgtcgcggacgggggcgggccgtgcacgcgaccggtgtctcgagaggcgtcccacgcctatcccccgaaaccggccccggccaccgccccgggtcctgcgtcgcccgtccgcccggtgcgaggaaggctccagg

SEQ ID NO: 11747 - DNA, 1477 bp, Homo sapiens
  misc_feature (1)...(1477): n = A,T,C or G
cgncggcgcatgctgcatagcagtgtgcggacagtagcgtgctatttangtacgctgcgtcgctcgtgtgcgcncggcgntnttgtngtcgtgccgctcttgtgctcgcgagcatggcgcgttgctggctcactcgcgcttcttacatcgaagtctgtgtcgtgctcctagcnctgtcgcgncgnatctgcggatggcgatgcagtcggtctgtgagggtggcgtcggagatcgctnttctcgggacgctattcgacttcagagttcgtgcgtgctgcttcagcgtgtgttactatagtgntgangncgcgtggtgtcgcgtgcattcattacgcatgctcgtagctgtctgcgcgctggcgctgccgtcntgcatcttgctagatacattgataacatgtcatctgcacgcgctgtacgcgagtgtngtgcntgtgccggtccatnatctagtctgatcgctccgccgcgagcgccatgntgcgaggtgttgagctgngcgtantatgtgagtagtgagaatgtctacatntatgtgtgtctcgagccgccacgctgggatgtntcctgcttcaccgacgctcggcgcncgcgctcgcgcttgtagcgtatctatgttactgttctgcgtgctcttactgcgctcatgtgcgtcgtgtatgtagtgtgtatgtctatncngcccggcgtagaatgcgagcatcgagggagctggcgtagtgcggcgtngcgcgcgtctgttgtgcgcggtatgagcgtagatcatatcantgtgtgtgtcgcagggcgtgtcagtcatcactntcncgtcgggtggggtgggtgatggatgagcatgagccaacggcgtcgcgtcgagtaggttatctagggctatgtangtgagactgttaagatgaccgtggcgtgtgcgtgtcgttcgtagatcgtcggtcgtgcgttctcttggcgatgggcgctggtcggcggcgacgtgcgtcgctctggatgtgtttttatttgtttatttcttcgcgaacagggcgccaccaaccggtgcgtgtctcgtcccgcccccctttctatgtggagagangcgtgcgcttggaggcnggcgtgaagaattgttctcctctttcacagggcggtggtgcgctgtgtcgtgacacacacgaacagagaggggtgggcggtgtgcgtggagacgcttatntcttatgtgatcaactcgacgcctctcctcagaaaaacagatgctgcgctcctgttnggtgtngtntgntgaggtgtttatatattattttagtagtacacacacncacactaagcagaagaaagagaagagaagaaaagagataataagaaagagagaaagaatataacaataatanangatgtgcgtcctggtgttcgcgctctcaaatggggggtgggaggctcgtcggtgtggggaaagcccggttcgtcgttgttcttgcgtgngcgcgtccgtttccgc

SEQ ID NO: 11748 - DNA, 679 bp, Homo sapiens
ataaaaatcgaaattaagagcgtgtgcgagtccatcaacgcagtatgattcggaagatgttgtaggactatcaagcttagagatggattacataaactgcatgtcaagttgtaggaagaggtggaggagaataaaacgtcccgttgcgtgtcgctaacagcgcagagcaggattaggagtaagaccaaaaaaagaacgataatacatcaatgctaggtccctccgccaaacacacgacagcaagggaccaactgagcaaatgcaaattaggaagacactgcacagaatcactaaaagaccgcggaggtgcataaagaccaactacaataacacatcacaaatcaaacaatacgggtgagaattaatattgaaatgttactacgatttctcttatccttcatccaacattaccgcggcgtggggcggcaatgatgccgccgtgggatagcgtgggggttgatgatgcaggaattttcacgccatccctaactaaatggtacgaaccacctcggacaagtattgataataaaacaagctaagcacaaatcaatgatataaaagagaggaaagaagttaagaataaataaaaaaacaggaacattctactactcgcgtcgtttgttactaacatatatttcagctagataaaccactaaatgagaaggtccgaataaacgaa

SEQ ID NO: 11749 - DNA, 907 bp, Homo sapiens
  misc_feature (1)...(907): n = A,T,C or G
tttaggagtatctgttacaatcacattttgacgtaccaggaaatgcaaaggaagaacatcttaatctgttcattcagaatctctctgtgctaaaagaatgtgacaaacaaggacaatcactgcatggctgtcataaggctcgaagggattggcgtctattcaaactacaaaccaactacgtgattgtccatggctgtcttcgttctctgagatcgggaggagactccagtgatcctcaaggatgacacttgataggacacatnnnattggtcctcattggcagaaattttagataaggatattccttaaacagaatgtttatagccttctggtgatagcaaccagattaacccctgggagaacacatttcaaacaatatcccttttggggataatactacaagcctcccttaatcaaaggattggatcataaaaataagtttctactggctattttcaaagcattcaattcttatctttgtttcccaccccatccgaggttaacctggttataacctctacacctaactccccaatttagccctcccccctgtaaagccctcaacatttgtccaattctcctaagccccccccctctttaaaaattggaanatcacacccccttttcttggggttggaaccccccctggccttttactttcccccaccgttcccccttatgaccccccttgtctctcccctttcctccctcttctctacccaaacccttcccccttattccttgtgaattgtgatccatttttattaaccccctgagggttccatttcatgaagacaatctccccactgtctttgaaccaaccccccatggcccccccgctccctttcggatttttggctttgccccctcccaaggccctctttcccccttccacccctcttaccag

SEQ ID NO: 11750 - DNA, 802 bp, Homo sapiens
atggcagagtgagcagcggaggtggaggggtagataggggggagagagtgtaggacgtcgatgggaggtgtgtacggggggagaggggagagtggaggaggtaatgtgtgagagattaattaggtgtatgttttgtgcagtgttgctgaagtgggttaagtggagtgactaggtggatttagataagatgggtgaatagaggggaggtgggtgggtggggtgggtggggggggggggaggatggactagagggggggggggagggggggggggggggttgagggggggggggtggggtcgggggggtggggggagggaggggtggagaggggtggggggggggggggtggatatttatggtgggttcttgttggtacggtgtttagaataatgatatggtgatttatattatgcgccgggggggtaggggggtgggtggggggaggggggtggggagtgggaggatggtaaggaaaggggggaggaaaaaatggggggggacggaagggacaagcgctgttgtagtaggaaggtgagatatggtattaagagagatagtgattataaaaaaaagcattgtatatttgtattgtttttaatgaatttatgttccttaaacaatatgtccaattgcacaatatttattcttcctatccatggtcatgtaattttcttccattagtttgtgtcatcctttatttcattgagcagtggtttgtagttctccttcagaggtctttcacatcccttgtaagctggattcctggttattttattaaagttaagcaattggtcaaaccag

SEQ ID NO: 11751 - DNA, 1092 bp, Homo sapiens
  misc_feature (1)...(1092): n = A,T,C or G
actatctacctcatctaacctaagacgtagactgttatcatcatagtgatgccttactgagtctcacgatgtnggtcgcctcacgccggggcgccgttgattggngctcggagctctaggacaggccttgtgagggatacgtggtacggggcacgcggagatagtgtgctcgtcttgggggccacacacttagcaacacaccgcgtcccacacgtcttaccctacaactgtccantgtagagatgatagggggctggagtctggcagtggggtgtgaggcgacgctaaggaaggtagaggggtttatagctcagtctactctgcattgggcgagagggggaaaagggaagagaggtatgcggacgcgcggccgattgagaacatgtaagcacgggggaggaccggcggcgcgccgtgcttctgtatcttgaccaagagatgttagctgtctaaatgcatgtttccatattcctttctataacatatataaggcacagaagtcagagtcgatatgggtggcagatgggtacgctgcgggtaggggggatggcaaacggcggaccgtggatgtngatgagagtaaagctatcaaatgagatatataaaacactataataacagtacccaataccagtanggcctttccgacaatccataatgaacggagggtgtggggggactgctcggccgctcgctctataatacagggtgggagcataggaaaaatagaccctggttggttattttcccggcttnttttctataaaancaatccaccactccccacnnncaccgaaaagactaagaatccctcggggggccgcncgctagcttctcttcgctggtgcgcgctcaggagccacgcggcgcggcgccggggccgggagattatctccactcggctcccctccctgctctacttctcttttttcctnccttctttncttnnctttctctcctnncgctcctcccctnnnntncccctnnccttctccctttnnctntctatncccctctnctnccttnnnctnctcttctctctctctccctctctcnaaacttnaaatactcaaaccaaaccttacaatccca

SEQ ID NO: 11752 - DNA, 1700 bp, Homo sapiens
  misc_feature (1)...(1700): n = A,T,C or G
cgcacatcgtgtctaggctcgtgtactgctacngtgttgacgctcgctgtgcgcgcagagtagagnacgtgaggtgatgagagagacactcgtgcgtgtgagtaggtngtgtcgattgtgtgtgtgtgagagatcttatacgtgggaatgcactataagatataacttagaatacaatggcgcggtgtatatgataacaaaattatcgatcatatggtgctcttagctcgtcgctagcttgtagaatagtcggaggaaggacgtgngcgtgtgaggcagtgcgcgcgagcgacggagctgcgatgagagatgtgtatgtgtgatagttgcagtgntaataggcgngtgacgagtggtcnatatatcatgtcatatactatcgtcgaatactcattgctatatcaaganagaatgatcagactgacgngnngncngctcgatgatagtagtgtcagtgtactactactctatctgctgagtgactgtggtttcgngctctgacagtgnganagnntaggagtgcacgtattctatgatngngatgatagacttgatgtacgatcttcatgtctgantnangattcagctgtcgagncgctatgtaggcagcgatcatatgtatgagctgangnatntangcatgcgcgcgtcactatanatangctnagatcgtcatagatctgtgtgagacagtacgaggaagcacttgtgacgaggcatgtagggtatcacagttcagagcgatgncgtatgtacatgtgcaggtagtcatgctatgtgcncnggcgantcagananacactgatgngagtngcgatangatgacgacagagcatgcgngcatatcgacagatggattgtcgagtatgnagnntactacntncgatcttgtancatcatctctctataagtactcatgtgantcagnanagtgacgcgatgtgagngcgtagtcactactctntntnctattacatacttnnataagagacgactgncgcgatgtatgactgcagatacgggngaatacgacatatggctttctgtgtgagntttttacgtgagccgtatgcgcgacagatcatacctcgtnnngtcggcatgagcgctgtttatgacgtgtgatgtggtctggtgtagtggagtgggaggtgcacgagagcgagagccagtggnagtagtcgagcctaattgagaccgtggcgctgaggatagagactctggtggaaaaggaaaagagtatgattggggatgtgggggcaggacgggcgtgcaatggaacaggtcgcgatgcgtcgtggcgcgggggagcggggttaagaatagggatagactgaggagacagagggagatgctatacggacgcagacaaccttcatantagcggtaccctccatggactatcgggatcgttagctgatctgttgaattggtgggtgatgtgatagttaatagtttggagacacattccgagttcactcttggaccggatatgcgatgaggcctagtagaatagagattgagacacgtaggtagggtacatggtgaatgcagttgagtatgtgtacaacactagactgagattgagatatggtgtacacgggacactttaccaatacttccgtgatcagagatactttagtattatacactaatgtagcatcaccacatgtctcctccttgtatgttaatatcacact

SEQ ID NO: 11753 - DNA, 1229 bp, Homo sapiens
  misc_feature (1)...(1229): n = A,T,C or G
agtatgtgtgagagagaagtgagattagaatacgtcgtgtagagagctgaggagaatagatggtagtcatactacgtcggcacacgagtggagttgtgtcnagttgtcgtnggatacnggtgtgntatacaacagtatcgctgttcaagagtcgtgtcacgctgtgtgcgtatctagtgatggagatgatagagtctgttgtgtcgacttcaagcagtctcgatactacgataggaagcgaatacattcagagaagtcgacgtgctcttgatcaagcctcagctcagatctacacgttacgccagcatgccgaagatatatgcgagccgtcgttatcgtccatacaaatcagcgctgtcgtccgataaaagatacngacctaagagcgaacgttgtctatgttgtggtgatggaaagtggcagattaagacgtggtgtctcgtcagcgctgtgcgtagacaattaataccacactcttgtgtggttagattgtcacgaacagtcgcctccatncttcatcagcgcgctcgccgatcggcaccgcgcagccgtagtcgcgcgtcatactcccctactccctcagaacagcaaacgacaattaacagtcttaagattcttgaatttggtgtatgtaattgagttgccgcggagggtggtggtggtgtatgaatgtgtataacagctgggagtgaaagagggagactgtagaatcgattagggtacggatgcagtgtgagatgggatggtggatgagagggcgggctgcgttgaagtttttgtttatgattatnactatcaagtgatgttgattcccgtcgcccatcgcggcgggaggggtggtgtagttgggagtgaacacggtatgtgtgttgtccttatcatgatcgcgggggaggagtggaagaaacggggtcggatgtgtcggtntgggctcgcggataggttgcgtgtcgacacggcagtaaactatggaagaacgggtagtcaggtggnggagcggaggaggaagataaaggtgtgcgacaagaaacgggtactgcccacggcgtaggaaacaagagctaagtgttcgataaagttgaggtgaagcgacatgtagaatgttattgtgtccttctgttgagcctaacagcggagtgggaggtggttagtcgcgcataaaatataattctggtctattgtgacgtgatagggtaggagcttaagttatactatcatagtgtggagtg

SEQ ID NO: 11754 - DNA, 926 bp, Homo sapiens
cctagggtggcaccaggacaaatactgatgaactaaatcttggaattattaagaatctgaacgacgtaaaagaaaaccccaattcacctttgagaaaggaaagagtggggtggaataagaggaagaacatcatcatctttatatggaaataccttatagctaacagaacccggcacaaattaatgtctttacgtatcagccaagcacagatgtgaacctggcttctttgcttcagtacttccaatactgtttattatgttaaagaagatgtgtaaatctgcaagggattctatagacaaaatctaacaaatgtattttgcctccaacttttttttcttggagtatattatcaaacacgtattttgataatcccactctacgaaattttaaaaccataaactcgctttacctcacaaatcgttattgtaccactaaccctaaacacaaaaactcgcccctacatgaactatctttatccccaggcattttattcttgccttaatgacacaaacaaaaatagactgggactgccttgtactcaatagccggaactcttaggtcccttccctagtgcggggttacatcgttagcctgctctccctcctcatgtggcctcggtcttccgcctgcgttagacgccctcccctccttccctgtacgagtcacgtcatcctcagatccagccgacttcgcttaacaattcctctagcagatcgaattcacagcgcaccgacccgaccaattgaattttggtgatgattcacctatcttcccctgatcttcatacacgcatctctctatatctcagtaccgagatgcaatgcctacgtgacctatcctgatacgagaagcagcgcctgtccacccacacccccctacatagtccacttctctacatgtgccgagctgccgcgcgtctcttaccg

SEQ ID NO: 11755 - DNA, 1769 bp, Homo sapiens
  misc_feature (1)...(1769): n = A,T,C or G
cgtcgtgcntctgnctgcgtatgcgtgtctagcgttgtatcgtgttgtgtagtngtgtctatgagcgatcgtcgntttctgtcgngcnttgntccgctctggtcatgatcgctagcagctancacgcanncgcatcgcgtnctngtagtctnatcgatatacgtcacatgtctgatantgctgatntcgtgtcncagatatgtcgtcaccttttactaccacgtctcccgnctctcctgcncagngagactgtagctgccagncgncaagtcgcatgcactgngctgtcggtatgatcagttgantcncctcctgtagtgcattgtcgnacggatacagctnacgangtgcntgctagtagntatctctacatcatcntctgtttacatagtcactgtcatacagcatgacgatatntacgctcttanccactatantggncnctcntccgtcatacttaattagtacccagtgtcatcagtacagattgacggacagnagactnancagtntacgtcatctactctgncgatgacgntgagatgtgagtgagagtnggtgctacgtctcatgacgantagattgtngatcatcgcataccagatcatgatctaagtatgcagatcgattgtcgcgtctgcgaagatgcanaacatacacgtantactcacgaccgttacgtgtagatcctctctacatatacagcgacngntcgatgtcgatgacacncgcgttacatctgccacangtatgcgctcgctgttcnctagcattgcgagtcctctcgttgcacgcacgattcgcgtgcatcgcgtagtgtgcgtgctcatacaactatgatcgagttgagttaggtctcgacgagtatgttctacatgtacatcatcgctcgcttcntcganactagcgcactatatcgcacaacaggtcagatctcagccactattatcctactatgctgctagctgtgtcgcatatatccttntagataggcggcgcgagcggcgcgcatcgtacgcgatgagttactcgtgtatactacgtaccatgtatgcgctagtagagttgagcgtctctcgtcacgttaggtgtacatgtgttcgtagtagcggcgcangcagtgtgagaagactcaccgtagctgcgtatactgagatacctcgacgtcgcgcgtggcanagcacgtaatatnctatctctgcgattgagatatactatagatgacgccgtctgatgtctagcacgaacgtgtcctctactgatctactctgacttgctgtancgcaacccacacccacactcccttcgcctcagtcgaaataagatcatgcgtgcacgtgcttcgtctactacacacgctccattacgtgatgttgttgcgtgtctgtgtcgacgtgccatctctagatagtcaggacgctgcggaggtntctcgtgcccgagcgaggagcagcgnagacgaatcgcgagtcgcgattctctcacctggtgcgcatcccacagctctctactgatgatcctatacacccgtagtcatacgtagcgcgagcatgagataaatcgtgtgagacacgcactcanaacccaccagaagagaagaaggcaagacaggacaataaatggcgcgctacgaataataatataataataanatatgcgtgtgtccgtntgcgcttaaaacgctgtgtgcgcagttnctgttcntgcacaacgcacgcctttttttctttttgtgttggtcgccaccgtgtctcgggagacttatggcg

SEQ ID NO: 11756 - DNA, 1665 bp, Homo sapiens
  misc_feature (1)...(1665): n = A,T,C or G
atacactctacacaccactcacgagcgactcncatagtcgntcgtgaggcgacgtatagtacacgcactaatatcgataacgtatgacgcgtctctcctcaacgagcacaggatagcacatncnantcactctangtgcatcgtgtggtncggagtgagtgaccgtagcangatagcnacaatttctacagctgggtacgttgtatactcacgagangtgatcatcacancgcatcgtgtganttacactactactcatncttcacantncatgtactctngcatgtgcatgtatgantcatggacgcgatgtgtcgtcagtgcagcgtgcacgtgtgagaccagactgcgcgcngtacagtcgcgccgctatgtcgacgatcncgagtacantactcgctccggatcgcactcactatcagccntaacntggatagactgtgtgntgcagacgtacgctagtagatcagtatgaancgtgacatcgattcactancacatctagtagattactnagtctatcgacatcacagtctatgntngcgcaccacacagtgctacgagtatgaactgagacttctcgatagacagatgagtgtaggacgtgcccactcacgtgtcacgtccacagtacgcgtagatcgcgcgacgtggtntataactgcaacacagcgactcccacctcgtctgatcgntgtgactcatttcgcagtactgcgtccgcatatcgacgatgcggagtcgtcggaggagcgtgataggtagtgtatgatgtatgtgtatnanacaccacgtatcaccatcgtggcgtaagtgtagttcgtctgttacacatggcaagagnatagacgtgctcatctcacgttgtcgcgccacgacgagagtctggtacggtcgcgacacgctggctcatctgtcgcgtcgcgtacgcgtctagttagtcgcgagacgtcacgagtgtatgtgctaggcgcgatgacatcattcaagagtcaacatactaccgatcgcgacatgcggtcggctttcgtctgcgcaatctctcatctgtgtcacgtcgcgcagtatgtgggacaggagacanaggcagagattacgaacgaatngagacagatgaacacatgatttagacagcgttaagagatgaggataaanttcataagagatcacactggttgtatctacaaacccctaccgctcactgctntcctaacttgtcatcatcactcttaactctctatacgacttgtgtagtctcacgtcgtactctgctatacgcagcanccgacggcacacgacgacacactcgcttccgatgtagcgatcatcaccagtcgaattanaacatagacaacgggacaagacacacgcacgaagcaacagaattgcgtcaataggactagatcaagtagtggtgtacttgaacactgccgcttagtggcgcgcgttgtggcactgtcatagtgaatacacgcgagtagattgtttgtagatgtgaaacgacttaacaacagtcggggggtttcactacacagctacatagaaccaagatcaagcacatcttggttcacacggtatcggaatgccaacngaacctgccatacgctcgccaaatgntactcagnactatggaacacagntgtcgtatagacagtgcttgccgct

SEQ ID NO: 11757 - DNA, 844 bp, Homo sapiens
  misc_feature (1)...(844): n = A,T,C or G
ttcaggaccacataccaccatgagtcgtgtggatctgttgaaaaggctacactatatggtaggatacaaaaaccgcagtttgacacaacacttggttccatgtaattacgagcatggtaggatggtcatggcaccattgatgaaaacaatcttaaggcttatctgacctgaatgcgaattgtgaaagctgctgtctttatcacatttttaaaagatgttcgttatcatgggagctactctaataaaatacatcttgagctcaactaaaaaaaaaatgacttaanatgaaaaagatcatatatttaaagcaagaaagagatcaaaaaaatataataactaacacctcaaccaggataaaataacaacttaactcgggtctctgggccctaagcgggggtgattctacgcactttctttttaggggggggcatagctgatacccccctctctggacatctggccacatctatggctgctggttgcgcttccctctcctaagcgggcatattctctctcccaaaactcggtatcaccctagaaaaatgttcgctcaagggatcccttaggcccgccacctaacacccccctgtggagttcaccatacgtcccccccctagaaactcataaactcgtccacacgccggtgcgcccccacccggcatacacccccgctccccccactagcccctttagccccccttctcccccccccgtccacacccgtccacatctccttggacagcgctcctctcaccagcctccgccccccggctcacgcctccaagccaagcctgcacccacccggcgcccagcgagccctcccgtatcccccgcccaccctcct

SEQ ID NO: 11758 - DNA, 875 bp, Homo sapiens
  misc_feature (1)...(875): n = A,T,C or G
cgcccgctcgactatgtacagaaaaacattccttagttcacgcgccagagaccgactatttcgtcttcccgcagtctgtatcattcgaacactctacctgaaanttctccctttaacattcgaagcatcattcgataggagaccctctataaataaatgcctttagagtccaacatatcacactacatatcaaatatctcgagcctcagcccgaagatcataggtcatctcagcgctcagctcgcttcataataatcaaaatcactcagccccagcgtagtaggtggacgagaaatgtatgcttaacgtcgacttctcctacataccttaaactaacctagcaattccctcaataccgcccatcttgaatactgaaggagaccccaaatctccacccgagtgcgcccgcatctcaactgcaataggcctccccgggatgcgacgtttgacgtatctgcaagtcataccgagtatcgtgtcccctcgtaaatataggtccaccacactattccgcccacccaactttgtgcacacagttcccggctaggaaccataacgccaaaaaatgtgattaacacacatctcgtttctaatagcgactttttggttcatagtttacatatggttttacaccttccttgtttattttttcaatttaacacaataagcccttgtgtcagtaattacaccaaatttaaacatttttggaaataaaataacttaatttttctaattctattctaattaacatcgtacatttcatcttttccgattgtattactaaaataattttttttgcattgtaattttaatttcttacatcacaattctcctaaggtaaataaaaataatttttatgtcaaaaaaaaaaaaaa

SEQ ID NO: 11759 - DNA, 1562 bp, Homo sapiens
  misc_feature (1)...(1562): n = A,T,C or G
cacgtaganatgcatattgatagcggtaatgaatacgagacgagaccttagaagtgtggtagactacancacagtatatcacaatgatataactagtctgtacagtgtaactagagtcagtcagtgtgtcnagcgatatcacgaatatatagatgttaggtgagtgacgantcatattnataaatcgaacattaactgtcattgtntagatgtgatagagcngttagcgcacagcacactggagagcgaacgcaagatcgatagtagtaatatgcagtatataggatgatatgtncagtatgataactactacttactctaatatatagtgttgtatgcgtgcgaggtaccgaacagagtatacagtatacatgatanaccaatatagaanagcaacgccggtagacgcaccgtgcggaancgtgtcgtgagcagcacccagcactccactctgcgtcgcatctactgacgacacgcactatgagtagcttactaacgatacacataggagggtatggtggagctagcggcgtgnggacgaggtgctgtcggctacgttataagacgtgcgagtatcgctggacactggtagtcagattattgctgnaatgtagataacaatcttagtatntgagtacggtcgtctggacgaggtatctcattatatnaattgtgtncgcgcacacgagtatataagcgccgtgtgagaggcgagcgtaganaaacgtagcatacgagtacgtacaagcacgtcgcgacantacgtcgcgcgtatacgacacgatacagtagangttgtatgtnancgntacgccacgttactgcctgtagtgacgtcaacatactaaactnactatacganggactggcagtcatatggtagtagatatgaactcggatcagacaggcagaacgancatacngtccctactactgtngacgtactcacagtngagctggagaggcgagtgatgagtcatgatatcatatagatatcagtagtgacgaccatcagcgctactcacntctctgncgatgcgaagtgagtcgtacgcgctgtgacgttactctacgtcgagacacaatagtatataactcgacaccntangatgcacattgacacgtacnaatgtaatagatacgcgtagacagagacgaacgacacgagctaagaganactgacatgctcactgnacacgctcagctctcacgcgcggcgctgantacgncgccantatcatcggatcggcagagtgggatcagatgccacgcatgtgcacatacnacatcacgacgcaggatacggagcactgacagcggtgtagtgcgggagagcaccgtcgtgcgcgatcgagtgagcatagtggtaggnagacagcaggtataggacatcagtcgacgatcaccacatagtatcacatagggtgtgccttcntacagacgaacaacgagcgctgtgataggggtctaatgagcttagaacgactcantctcactgtgtctacagcacactaaccancgacacataatcacactatacacatatagagcacatgctccta

SEQ ID NO: 11760 - DNA, 1704 bp, Homo sapiens
  misc_feature (1)...(1704): n = A,T,C or G
gtcgtcgcggctcgtgcgttgtgtctgctgtcgtgcgggctggcgtgcgtcgcgngcgccgcgtgcgctgncgctcgctgcngctcgcgctcttgcggcgctgttcgcgtcagcgtgccgtntggctgcgtncgcgctcgtgcgcgcgcgcgggcgcgcgcgcggccgagacacgccgctcggcgcgcgcgncgctcnggtgtcgcgtgcgagcgcgcgagacgtctcgcgcgcgcgcgcgcgtgtgaggtgccgtcgcgcgctctgcgtcacgtcctcgncgcgggcggcngcgcggacacgcgcgcgcgcgcgcgctgcgatgtgtgngcgcgtgacgcgcgcgctgcgtgccgctgctgcgcccgtgcgctctctcgcggcgcgcgtgtcggtgctgacnctggccgcgcaccgctgtgtcgctcgncgcgccggtgcgcgctgcttcgtctcgncgtcgtcgcggtcgcgtcctcgcgcgtcgtgagcgtcgggatgggcgctgcccgctccgcgcgcgcggcgcgctgctgcgtgcggcgtgcgcggtggcgcggcgcgcgcggtcgtggtgtgtgttgtcggcgtcgcggcgccggcggcgccgcgcgccgcgctgtcgtgtggtccgtgcgtgggcgtcgcgcgcgccgcgcgcggcgggtgcgcgcgcnctcntcgtcggcgttgcgcgtgagctctggtcgcggcggctgtcgcacgggctgcggcgtgtacgtgagtntgtctgacggtgctnngcgctgctcgtgttggctgggtgttctattttacctttctctcttcctcctctcgcttatctctcctgtcctgcctcnctctgtntcattctctcnttcntgncacncgcggcgcgcgtggcgcgccgcgcgcgtcacgccctnggcgcgcggtgtcgtcgtgcgcgccgctcccggtctgctccgctctncntcgctgtgctgctacggcgtggcgcgtcgcgcgtcgcccgccgccggcgctgtgngcctgctcccggcgcgcgcgccgcgcgccgttccgccgtcgtgcagccgccgtcgctgctcccgccggcgcgctccctcgctctcgcgncgccacacagngcgcgctgcgccggcggcgtggncgcgggcgccgggcccgcgcgcctgtgcgctgtgcgctctccgctccgtcctcgctgntccctcctcttctctgcgccgccgtccgcgngtcgcccgcgccctgcgncgccggcgctctccgcgctctcccgcgtncntcgctcgcgcncgcgcntgctgcgcgcgcncctgcgcgcgtcgcgtcgcgctgctgtctggcgcgggttcggcgcgcgccnctgcggcgcgcgcgtccgcgtctgccgcgtcgtctcctgccgcgcgcgccgcgcgcgncgtgtcgggcgcgcggcgtgctcnnctntcncggcccgttccntnctgtcctcctctcctctctttaaattctttcttttcttcctctcttcttcctctctctttttctcttcctctccctccncccncnnggggtttcttccccnccttttagaggtctttttnttcttttnggggtctttcctcttttagaggccttttcttctctcncttctccncccctcctcccccacccaccctcctcccctctttatcttctctctctcancnaccctcctttccttctctcctc

SEQ ID NO: 11761 - DNA, 1549 bp, Homo sapiens
  misc_feature (1)...(1549): n = A,T,C or G
catctcctttcgcgccgacgctccacgcgtcgccgtcaccgtggccctcgctggcgcgagctctctcgagcgcgcctctgtgagatgagcgtagtagcggcgantggccttgtgacgtccactacgcggcngcttcactgntaggtgcaatgatatcgtggaagaggggtgcgcgcgaataatacagagtacgatacgaactagagtgtggtgtcatgtgagtggtggcacgcttgcgtcgtcgcgcgtatcgctccgcnagntctcgcgcgtgcgnccggtgcctgtgcggaggtctctngtcgaagcgctacatctcgtgtccgntcgcgacacaacacagacatatacactcctccttcgagtcactgcggtnaccgtcgggccgtcgcgaggtaggcgagagtgcggagcggcacctgaaccacaactctggtcgaggtgtgcggngnggccataagngngcgacaggcgttgtacggtggttgcgctatgaagagacgtgatgagacgcatacanganngagaccacgtagctagcacgctagacgacgaagacgnggagancgatactgnngcatgcatgtgtggcagtcagtcgagatacgtgtgatatgaggcatatcatagatgagagctgaaggaagcgagtgtaggataatagatgatgatatgcgtggaggaacgaagcgcgagcgcgcgcggaggacgcggacacggcagacggagtcacagaacagctgcgcaagactgacgcactatcgcgccatggcacacgcggcgagggtgtgcgttgaagaatgtagactcacgtgtgcgtcgccttcctctgtatatanctatttagacaatgtngtangagagataggcacgccgtaggngcggtaatgagctgcgacgatgcggatgtctccgccatgccaacntcctcacctctctaccgcagcngcgaccgtgcctcctcgtcgcactctactcactactntacatantnttctcatagatgcgcctncagcataccgagcgactctacagagatgaatgagggtcatgtatgggatcaatgttatgtcgtactngtagacaggagatgcacacgcaggctatgacnggtgcacgcaatcattgacacgctggccatcgctaccgacacaccaacgtacaccctcgcacacacaaccgctacctccacatacggagctaccatcncngagaacctcgcgtgccttccggcggacccgtgtgcaccatcggaagcgagaacactcaggggtcattaggcacctgcgatcgcccgtgccacttgtgagagatgcgatagaaatgagagggatgcccctcacacgaccgcgtcggacatagggccgacgggctctgtgctgttttgaacagcgctcgcggtagcggtcgtctcgttgcgttcgttgtcatggtatgatcgcgcgtacgggcactgatctatggcaatccgcaaactagctgccatttaaggagtttacaagtaaccggaatctgcagtgactacattgatgtagacttcgccacatct

SEQ ID NO: 11762 - DNA, 1865 bp, Homo sapiens
  misc_feature (1)...(1865): n = A,T,C or G
agtgatanantatgatatgtgagtagaganagagatttgtcgtgctgagnntgacggtactccatacgtgcactatgttgtcancagcactcgcagacatcgncatgacagtcntgtggtgcgngtgtctcgtcgcaagctcgatcgtctagtgtcgtgntcgtcgatctgatgcacgagatctcgacacgtgaatctcgaggtacagtggtgtatgttagcatgatacatatacacgtcttgagtactgagtatagagatcgatgactgagtcggtgagtgagaanctgctacgtgtatgagaagngtgagatgtgtgcgtctacancatgataagcaggctgcntcacngtagttgctntgcaatactctatatatctgcgacactagatagtgcgcgtgcggcagacatactgctgatcntactgnttcgatgtatacgatgagtgacggtgatgtcgganggcanacgtactgncactgctcatactgtatncttctatgancgctgtagcgtggcgtcatgtatagacgtcgncgacgcacgcggtacgcgtanttacgncactntntcacngcatcgctactgctntngcgatactgcatcttgggntgcgtnctgtcgtcggctgctctctngcgctagagngnacgtgggagtctgctgcatgtcntatgtactagagtacgtctctnggtagctactacgtatcgtngtcattcngntgtacatagatgntgtactcatattgatgagacgttcntcgtattcatgcgctcgcgctgatagnagacgactatcacngcgcgctgcgcgnacgntnagtngagatancgcgcactcacagacgcgtcatgtacgnatactgactcatatnatcancnantcntnatgatcgtcgctgccgacancgcnacgatcgcgtgcgagagcgtgctgttgcnncgacgtgtctaatatacaatacactncgacactatctagtacctacacagnagctctaggtacgacgntatatcagatntcatgtcgagtagacgcgtgcacagctagatgccgcagtgcacagangttggagtgagtagcagagaggctggcgcgctgtggtgctactatggtacgacgtgatcgnctctcntgngacagctcgctctggcgcgactactgcagaaatantggcagagctgtgtcacgttgatgcgtgtgtggtgtacntgtgcngctactgagtagcgagcgatgtgtctgtgcgcancgagtctacgancatatgttgataagatatccaacgatgtaagagacgcacgtggtgcncctgtgctgtgtgcgtngccgtgcgcgctctgtgaagtacgactcttgttcgtacacancgacgtcagtacatacacaccacacacgacttacgcactcattggctgactgganangttgtgtatgntgtcatacgactcaagantatatttataacagtacctcagctcacgactatcatatgcgcgctgtctacgcgaactgtgtatgtgcgctagagtaatcagtatcgagtngctataatacgagtncgtatctcgtcgattcgagttgaccttcgaatctgangtnctcgtcgatgtctcgtcatattcaggctcncacgcgtcgcggatgttcacggnttaacatttatctccttcacgcagcgcgttggcgcactccagtatactatacgtagaggattcgcgcgtcatcnagtagataactccgtggcgtagtgtctagcgggtctcttcgtacgtataatcgagttgntgtactatcgtatctgcagatattcatgtcgttgagtcgctcactatgtcgcacgtctcctcttctctcgcgc

SEQ ID NO: 11763 - DNA, 1704 bp, Homo sapiens
  misc_feature (1)...(1704): n = A,T,C or G
tctcacaattctcccactacctcaatctatcctgtactacccccatacactggtgcagctagtcattcccaccaccaatnacaccatttgttcgtccgagactctagcgcataatcgccactagcgtcaagtatacattcctctcaactcatagcccttcattctctcatcatactccctggtctcgcncgcgtgcacacacacgaacctcgttccgccagtcattaccaccatccgcattnactctcgcactcttagctatctccgtgctatcgtctctcattnatatgcggcctttgnatctgagggtactgctgtacgnatgctcnacacctatcattanatgtcaccagatactgacgatcnatctactacatgtaccctataacttgctctctcacgctgcgtctacgtnctcganctcgaantgctttncactgagtgtgcgatcacctatggcanagtcgcatacatctattatacgactgntctgtacgtgctcgctggtatatcgtcggnacttntacaantcccctatcgatcattcagtaatatactnctccgtgcctcgcncntcacgcgctctcactctcatatcactccgtccgcatctactgtatcttanacatacacttcatgcntgcgcattccatgtccgctctactacatcaacatcgcnttnatttntctcctacagatcatatcatcgcgtnccgccgcttccancntacgcacatacgcgtattatnttccttctcatatacgccttcgctctccacctcacctatgatgatgtcgtatacaatctcctcctccatctccacatcgcgtattgtcttacactacgccacgatctcntntactcaatcactcatatctgctctctctgtcatccagcactatctctctcgcagtccacctctgtctgcactcgacgttatctctactatctgtcatatcgctctcgcacgtcatctctcactctcttctctcactcgacgctgtctccgtactctcactnatnattgtatactctttgtgtctgtatnctacgtgtcgtgantatcttcgcacgatatactccactctcctcgcctcancctcacactatagcatactccaacncgctgcacaccactcatactgcactncacncntcactnttcttnactgttcttcctcatctccacatctcctcacctcagcctctncctccgtactacgtctctcagcacgtactcgtcgcactantgcatcgctcctatatcatatcantctctggctcactgttcccatcactctactcactcttctaatcgtcactctctcctgtctccgtctctcacctcatctctcgctgntcgcactcctttacttctttgcnctcgctccatgcgctcagacgcactanataacgngactacacgacgccgcatcacctcgtcattcagttactcgcgacacgatctcctcgacacgccctcgaatntctattcatacttcacacnattagacctcctactccactccccacatccgcttcgttcttcttaatcatctctactctcctcnctacgtgcactagtcgaacatagctactacatcatcgactactcttccaatgcttctccacactcagcctctctcgtcnctctcaccacgctatcctcacgcatcctgcctctctgccgctatctattctct

SEQ ID NO: 11764 - DNA, 901 bp, Homo sapiens
  misc_feature (1)...(901): n = A,T,C or G
ttagattgagtggattgatatgaaggggtggatagtggggagttggagtgggggctttgtgggtgggtggatagagcaatattgtgatgttataggtgtatttgtgtgccgtgagtatgcataaggaaggtgatttattgtaatattgttgtgtgttttggtgactaatgtaatgagagagggacgaaagggggagagtaggtaagagagatgatgtattcttcataatgtttgcatatagtatggtaaagttaatggtaggtaaagatgaaataactatttatatgtttttggagtgtagattaagactactgatgtgtgggtgatggcggtaatgaggagttgtatatgtggtagtaacttgtgatcttattcttgtgataatttataatataaaataatttatatggatagaaaaattttaatgtgaattaaataaacatttgagagttctacaggtggtatggatagcgtgatgctcattgttgtaaaagaggagggcgcagagtaaaatttttacactataggatcttaaactcttcctatgatttagggcgacaaaacgtactcgaatctccgagcgatgggtcataggggagattaggtaaatatgtaaatgtttatatgattatccttaaacagtatataccattttcacagcaataattcttcctatccatgggcatgaaattttattccatatgtgtgtgtcatcctttatttcattgagcagtggtttgtagttctccttgaaaaggtctttcacatcccttgtaagctggattcctagagtattttattataatttgatagccaattgtgtctaaagctaagtttttttatannctttttctaccaaaaataatctaataaaaacaataaaannanaaannaaacaaaa

SEQ ID NO: 11765 - DNA, 1157 bp, Homo sapiens
  misc_feature (1)...(1157): n = A,T,C or G
accatcctctctcgcttcatttcccttgcatccactcgtcgggagactccgatgggtacatcacgtggacgcggggcaatacgaatggacgcgcatcatgcgcactccatcgtgcttaagaacctacatacaacacacgaacacatgcacgantgaacttgttcttacactcacctctactatgtgncgcaggagggntctatgtacatagcacagatctgcaatataatgactgcattagcatggataaagtgactcatgcggattcaaaaacctggcaaaaacgatacatatctatgggtaacagcaaggnngagctacacagacatcactacacagaggtacactcaactatcagggggtgagaggaggatccataggtcggagagcgccaacaacctacgtagctgatcgcgtaggtacccgatctgcatgtacatngacgtgccgcggcgcgggattaacttcccccaaactcgctccctgtaggaatgatataatatggggactatggacttacnaaccataatagccccctgatgtctcgcgcggagatagttgatcaaataaaatactttctccctcctcttttccccctgcattttctcacgcctccgaatgtgaccccatccaacgctggcctgctgttggcctcctccccgcgggaataaaggggggcaccggggggcggggcgtggactcacacaagatttactgaaatgagcgcgcataacaactaataaaacaccataaaanaactacaaaaaaacacaccatccccactccccnnnnccaaaacaaaaacaccaaaaaaacaganaaatatgtataactcaccacctctctatcccctcatagaatcagagaactccctagttctctccgnnaccgcacacgcgccgtgtnccctcatccccctccatcctcctctnnntccctcttntcctcttccctnntcnnnncatcttcgcttgttnnncccttcctttcnnnnnnnngntntcctctnnnccgccttccctttgngctatccnactcgcctcctctntcntnctcccnncacaaaacccccccnctcttcnntcnatacaaatacactcatcacacacaancaatntcacacaccccacctacncactcatacacatctacctcca

SEQ ID NO: 11766 - DNA, 301 bp, Homo sapiens
cttcaggtgacgtgtttgcaagaatctaaaacataacctgaggaaatccagaagtatatgtctactttaatgtgttttcagcacagtgggtgatgtttgagttactagtgcaatcaaaaaccatgtaataacccatctacttccttaagtctaaactcagactaccacctctttaacaaagaccctgtttccttataatgctttccctagcatctcaaacaatattggacacattattagttaaacgaagaaataaataagctttgttgatttattttcacaaacaacaaaaaaaaaaaaa

SEQ ID NO: 11767 - DNA, 1153 bp, Homo sapiens
  misc_feature (1)...(1153): n = A,T,C or G
gcgctgtcgtgctgtcgagcggcatgtcgcaaggtattaattcattcgagagtctcgcgtcctcacacgacgagccctaggtgccgcgtgtccgtaatattagatttacaaaggacatagaaagaagtaagctgcggaagaacgtgtattatcgaggaggtatatatattgtgcagtaacggctgttatatctgcgtctggtaattatatatttcgtccctgcctctccggtctgagctccatgacacaacccactcatccgtcatccacatacattggtgatatagcgctacgtgttcacataccgctgcttaagcatccatgtcgatcgcaactactgatctgtctcnccgaaattcgaatgatagaagctagttagttctgtatctgtctcgaatcagttactacgtcaacgtcatgcactgtgctgtaatactgtgttatgttgctctgctcactaggtagctggaccctgggacggcgactaccggatatacataacgggacacgtccgcgataagcgaatccgatccggtaatatacataaaaggagaggaagaataatgtcacacgcgacccgcaatctaccactagtgtcggaaaaacggtactcacgccgttggattcatcgagtacgtataggacgcctgagtaaggtggcgactgacggcggtcgagcgcgctgagaatcttcaaactcccaaactccgagcaaacggtcatgaacggaagtgggcgagatggggcggcgtctagtatgtctcaatgagtgnttctatagcttatctgtagcgatgcgatggtacagccaaaggggtctgtcccagatatgcagggtatctgagcgccgtgcacgaataaacaaacttccgtcccacgcgcggggccgtcctctttctgatcatacagtagacgcgaacggaccgagacagttgagagcaacgtgatggggaccgaccagcatcgcattcgcatagnctcataatagtaaataatcgctaatgagcgaaaactaatgattataacaataagtgtgcggctactgttgctgcnctncacgactgatgtgtatgctccacgatctgaccacatgcacggnttttttctctgctcttctctgttttacgtcatgggcggctgggtgttcctgatg

SEQ ID NO: 11768 - DNA, 1200 bp, Homo sapiens
  misc_feature (1)...(1200): n = A,T,C or G
catataagaaataaaatcagattagacgttatagtcgatatcattgagctctaatgtaatatatcgattatatcctatattnacaagtctagtcaacgggcatctaaagagtatatataagtcatactctcatctgttacgtagagacatgtttatactaatctataacaatatatagaatttaatgcatgtacatcaacaggatactacatatactcgcgacgcacatcaatatattcttcgattgattgtatctgactttgtgagtgtggcatcggttgcgagcgctcgtgcacgatatgtcgcggatgctgtgtgtgatgaagtataaaagaatacgactattcaacgaggccactagtgggaatcgctttagcgtacagttacagcgtcggtacggataggtctactagatgagtggtctgtgttgatggtggagcgcacgtgaccaaactagcgattcagcgactatattcgcgantagctagcgacaaagtagatacagantatattacgtattggcgcagcagccgcgtgataatgggtgagcgaatctaagnaacttcactggctatcatacaaatcatagcagataagagatgcatattacgctagatctntcatcgaaattagtctatctgcccgcaagacttaggtagttacatctcgggcatgcaggtagacgagaacttgatcgtagatggatatttcattagggcagtgatgcatgattaacagccacccgcacaacaaatgctctctagacgcgtcgtgataaatcaaaacttttttgtacatctctcagagtgataggtccaaggagcccccccagacggtagcgcgggccttcatgaccatcttatctcatcacctatattggcgatcgccccttatacacccacacattatctccgccactcatatcagattatgttagcacctataaagntcccttatattataccttcatgcgatgctcacgtctgtagctttcactcatgcggaagcgctatcatatacacacagtagggcactatcactcactttgcctgcagagagagcatccaccatttgttcacataaaaacaaaaaaaacagtagggctttctgatggccacactagcgagtggagcttggtaggtgtacaaaacgaagccactatctcctcctatacttctcatcacctactcttgacttcca

SEQ ID NO: 11769 - DNA, 1051 bp, Homo sapiens
  misc_feature (1)...(1051): n = A,T,C or G
cgtcaggagtaactcgtcctagcatatgattagggaaccaccagagttctccctctgccatgtgagaagacagtagaatgcggctgcctgtagccagaaagagagactttatcgagaactacaattgggctgatacacttattcaacggactataccagcgcttnaagatcatgcgaagaaataaaaataatgttcgatgaagtacaaaaaacaaaaaaacaataataaaccacacaaaacaaaataaaaaaaaaaatacacaacaaaaaccaaaaaaaatcaaaaaaccacaaaaaacagaaaaatacaccaaaaaaaaaacttacacccacaaatcaccccctctatcgctccacaccaccccccctcctccccctactccttctccccactccccaccaactcgtgtttccccctctcccccaccctctgctctctctctcccaccacctcccccaccatccccacctccccccttcacgacccaccaccccccgacataccaaacacgccaccgaacaacaactatacaaacacatacccccttccacaatcttaaccaactatacccacctatccacccacccaactaaccctcgccctatacactctccgacccctcaacatcatctgactccccccacatcgccacgatactatacaccatacctcacaacctcacactccctctcttcccacacctccgccccccgacctcctacagcactctccactcggccacttctcaccataccctctcttcacgcttcactgctatcacctactcgtactatatttacctcttactatctcacctatcatactcttccacatacccccactcacctccctagatatctcacgcatcnaccataccccactaatctacctcctttgactaatatcacatcacttcgcactacgtccaacacgctccacgcataatgcatccacgcatcccataaccacgtatctactactttccttacaacgctaacgtcacgnaanctctcttctccttctcatacttccaccatacactcactcact

SEQ ID NO: 11770 - DNA, 1465 bp, Homo sapiens
  misc_feature (1)...(1465): n = A,T,C or G
acagtccgactactatacatacgacgagaaggcagcgacagtgcgcgtcgatcaagtagaggtagtgcggaagatcctacacgcgacgtatctgacgcggtntcagcagagagatactgtgaataaagtcatagaatcacatcgataaatagatacaactaatcactaactgtacatgacgtaagctatctcgagttcagattatgcgctgttcgttgcgtcgtcataatgtaatgatgtacagaagtagctatctgaagttatacatcaatatgagattattttagcatgcacgctgacacgtgtgtggccacctccgctctattcgttcgcggatcactaagtacggtgagagaccgatccagtacgagataaatataccaaactacgctgangtgcagcgacagcgcacgaccacgcacttcgccacttccgtattgtgcaagagagaggactgattcgtagtcgctggaagtcgactatagctgctanagtgacggacacgctggggcgagacagacgacacgaatgctgccgatacgtgtgacgaagcaaatcattggtgcttgcgctgcgcagtaggtaacattcatgtctgacatagacagtactgaagtacgactngacaatattctccnatcttacatgtanctcgttagctagactctaagtgacgtgatataatattaatagcgataaccggagacgcgtgacgaggacagtgtgagagtacacgctgtnacagacggacgattaccaacgnagagagatgtgcgcgacagctagaacggatcatgttattcttgaacatgaggcngctatgtcaatcgttgtatcgtaacaccgagtcatttcatggagtggacatgtagataattatccgtgatgcacgtagctcagatcgcatctacactatagtccactacagatagatcatactatataacgaagacagtgaagagatacgtaanatcactaaggtgagtaaaaacaaatcagacgttagttaaagtgttagttggccgtctagccataccaanttaggcagcagaccgttgaaacaatacaactattcaagattatacggactaacgcaacacgcggagaactacatcgtgtcgacctaccgtagtcgaccgtgtgcgaatagccgtaagaagatgtaatccttacatcatcagaatcggaagcgattattcatacactatgatattaactattctgatcgttaaatactataccaatgttccgcgcaacgtggagttatgagtgacaatctccacattatttctgctagagattataaataaaaatgatgtgttcaccgtcagttaatgacaaaatataggagtgacgttaggggtctgtcacctatccgaatatctctctatatnttatgtggtntacatccactcttctctctatattatatatatcctatactcatcgtacacacttgcgcgca

SEQ ID NO: 11771 - DNA, 891 bp, Homo sapiens
  misc_feature (1)...(891): n = A,T,C or G
ctcaggcttcctagaggaactgaatagaggcactccagacgatttgagagaaatattaagagtgaagattacacacagacaccatacacaggagcagcattaagtacacagaggactgctggacctagaacgacacatctggaataccctgagtggacgagtggaagaagagcaaatggagtaaaggatatctcaccggctatctgcatggacacatgacattgaggactgtatggacccttcataatgctaagcactcttacttggcttgaacttgggggaaattaggtaaaactctatactgatgacaattgggtctctaccaccctgatagaagctgggcccacaatacaaaccaatcacactcctacttcgtcgcccgcacaaaaagagaatcaatacaaacatacaacagaacacactaacacatacaataaaaaacagaacacaacaaagcatgatatctattcgtagatgaccgctctcagcgtctcaacctggcgcacgcgtgaattggtacgtctttttaaataggtattccctacttcacatatatctttcaattcacgcgcacgatcatctgcccctatccaagcacgtcttcgaccccttaatcgtttgcctctcgccacatccatacgagtgccaccctctccccacacatcacgtcccgaacccgctttcaatgtcctcattacaagacgcgggcccccctcgcccgacctcttgtcatgtctcaccacgactaccgtcttccctcatccaggccaattcgtcacaatcgctccccctccacacctcctcgcatccccacncgagccccctacctcgcccccacggcgtcatccacggcttaccgccctatccgcctcgcgctcacgagattgctcg

SEQ ID NO: 11772 - DNA, 2254 bp, Homo sapiens
  misc_feature (1)...(2254): n = A,T,C or G
atcgagcaagatcatgcgatgctggtgngagacagtcatcgtcganncantagcngaacacgctcgtgcgtagcgacgtagagctgatctgaagtatacacgatcactcgngatgctacgtncgtcgtnngtnacatncagctcagtgtcggtcagcgnccgcttcatcgtcanngcngntcntnactancccgtcngtnntgnctatgcactagtagtagtcatcatatcagnanancaatacgacatctannancacgacgngangtntcgctgattatattggganttgtatttnacgacgagacgactgnacgtagagcatncgaagatatngacagcgancacagcagctgnggatgagagtcagaacncgaacgacgnatgacgcangaatacaatgactganagcatcgcggatcatcatactcatcgagtntntacagctgncgacgtnactcatacgagtangattagcnatncactgagnatgtagtgtntatcgatatagaatgattgtatgtatactcatagatcagtancatgatgtangtatananaactacacgatngtcantgagcgaanatcgtcagcatctganantacgcagancgtcnatnntcataccgtgctgacacnncatagaggtcngtacgtacnangactatcacattcacncagctgctcntacnacatcatactnatgacnacgatactctcgtacgcatttacatcgcacatcncgtgctgtacgcnnacantanacacgccagtagtgatgatcgctncggctgtnatcatctagcagcgangacgnactcacgatgcgactaggcnctgctgagcaccgncggagcgtactcgatncngtncgntgantatgtcaatacaccgcattatgcgtgagcagtacagctgatancgncnctgcagtactgatgacngantactatnctgtancaatcgtcatgcagctctgcgttantactagtgancacacgtagcgntctcgaatgcgcgagctgtcggcntcgtcgacangacgtagcgtgaacgtagcgaacgntagtctgtgacgatggtcgagacgagcagttatgactgctgctgcggatcangtgcatgtcgcgtgcantgngcatcgtcacgagatcgctagnagnacccanccgttgtcganngacncttctatccgcagcagcatatacatatgtagtggtgnganacagntgtgtgngngnctgtatcgtcgngcagngactganagnagagagtagngnacngatatggctngngtatatgnacnacatgagagagtcagtnanccatctcacacgaatctgcgtgagngntgngacgtactagtatcttcattttgatgtcacatgacgacatactaganctgatgtattgctggtctctcgatacctcgctngactcgtanantattgngcccatccttaacggtgnagncaactantgaacagtcgatctctggacaaatatcagtnacanatgntgaagtacaagacagagatgtgtcgtgcgcacatctacagtntacagcgagaggagacnacagcaagagtacactgagcgcatcgagtnggcgatgtagtgagaatgtcgnactgaagacgcaggacgtctgtgagcgacgggatatactatcgagtgtagggatgataagcatgangcaggacgtcggcgtactacgcagcacatcagtgtgtgcagtgacacgcagnggcagcgatcgctgcagacatcgactgtatangcatacnagtntgcagatacgatcccatgggcactaacctctcacnaacgactanctgtgcactgatgagcgcaatgcagctgttgcngtcangtatggcangatantagntgagacagtcanacgagcacctagtagacagcacagagaacgagaccggagcaaatgcagnnnngatgtagatgtgcgatacgtgtcatctctgacnaaacgcnacactgacactatcgatcgngcnanctggatgcgaccgtcgtgtgtnggctctgatgtagtgtgtatgttgngtcggttatatgactgacaaagggagttgaggtattgcgtcattcagcgtgtacgngtgtcgttacgaactgctgttgatgatgagagtgcatngacaattgacgtatggtnagcatggacnttatatgcagcgangagcagtagctgcagtcatcgatncatgngnngcgagcgcgctactgtgc

SEQ ID NO: 11773 - DNA, 2051 bp, Homo sapiens
  misc_feature (1)...(2051): n = A,T,C or G
cagcaagtatcggtntatatcatagatanatagacaccgagtagctgtatcactagcgctacgattgcgacgagagtatgcgtnttgcagtcangtngaatgaacngatgtgcacgaggangaagtcgtatcgatgacttccgtcgatgtgtgtgtgntantngctcncctnacggcnangcngacgcgctgctgctagagncggggagcgtngagcgctacgcagttgacntgtgcttgctgncagtagangcatcagtcagnagaggagtatagtgatacacgcatcagcggtnacgcgatcgcgcgncgcgtcgtactaccgcgagagacgtacacgcncagcgcgtcagttcntagagaaacggctgcggtcgcgtggtacgcgagtatganaactntgtcangcgagcacatgcaggagacatgacagcatagtgaagtgtgnacgtctgcatcgcgacgtcgtgcgtcggttgcgcggagtacgatgtcgtgcacgntncccacatgcacagctctcctcatatntcnantagtcgacagangtgagcgcagcgtcgagacgtctgatcaatcgttngagctcggtgacgcgacggatctgatcgtgacgtagagcagcgactggaacggancgcgagatgatcgntcgcagtagagtagtngacgcgtgatcgacgtacgagcgcagaggcaaacactactatacgtatcangcactacgcagtngctganactagtcgcacactggatggngcctcaactgactcgcgtagtantttaacgcgtatatangcgtaatgaatacgtcatgaagcaatttatatattcgtcgcagtacaacgtgactactcgcacactctctatactaatgtattgtagtttgctgactctgctnncatgcnatngagtgtcactcacggctctgcgcatcatgtctagtcgtantaggcaaagcgagacgagagtcgaagcgctgtacacgtcgagtagagantagangtgcaggaaggtactagtatagcagctatgaggtgagtgacgcacgaaacnatgctntgtaggncgccacgtatagtacgccacaccgtatnacgactctcatgcggngcnggcgagagagagngatagntcacgttcatcangagtgtcgcgtagtgcggacggnggagtatggcacagtctantgtcacggcacgatactactgccgncgctcgcgcacgatcactgataatagcaccacaatntattantctacggacgtccgctacgagcntcagctgntctnantagnctactgccgtcaggcagacgagcagtgcgttcgctaggctanagatngntgtantctnatacntntcgtcatgcactncgantcactagtgtagntcgactactctcanacagccatcatacncagcaaacngcgacagctnatgntgcgtnntactcngcagnccgctctatactgctnacagtagcagctactgtcagcangctcatctcagtcgattgagcngtccgtanctncctnctaccatcgacatacacagtcagcgtcaacntacagtcgcacacgtcttcntntatcaagcatgagtttgnntntagtgtaggatgtatgactcacatgacncagtnggngtngancnagcacacgtctatcaatantagacttcaagagtantcgtctaatctgcagtgtacgcagactcgcgcgctgctgcagtcacatctcactcagcgtggcactgcagactgtcgcatcagagcatngcagctgtccgatactagacantctatanctcnactatagcagtgacgatgagcactggagagtctgnanangaagcgcagagcatctcgtctgttatggacgccanctaacncaatcnagcactgtgctgtcgtcantntgtctcagcctagacccagcagaacacactctatgcacgtaacagtccgnacgttagtnagatctagaatcctcatgctctcacacactaatatagcncnatcacagatagtgaccatctatactcctcga

SEQ ID NO: 11774 - DNA, 159 bp, Homo sapiens
accccttcgaaacaacagcaaaccagaagaggacgagataatccacctaagcaggactacttgaaaagaagcaagcgtggaaactatgaagccttcgaatagatcctctttttttttttgatgagcctcgcctctgctccctctggaaaaaaaaaaaaa

SEQ ID NO: 11775 - DNA, 210 bp, Homo sapiens
  misc_feature (1)...(210): n = A,T,C or G
ctcagggtctcggatacattgattaaggaagcattttcctgattgatgaaaaaagaactcagtgatggccatctaccgctgctagaaggttacagtggattatgtagtatgccatgtgctctgtctgcgttgaatacaaatcaaacgactacagaaagacgaatacaactcactacaaggcggaaataacgaaaatcccanataacaaga

SEQ ID NO: 11776 - DNA, 1500 bp, Homo sapiens
  misc_feature (1)...(1500): n = A,T,C or G
cgtgcgatcagtgtagtcgtgacacgacatcgtcgtntgcgtgcatgctgtcgtagagacacggttcgcagactcgcttgctgtngtcactctctcgtgtgttcgagggccngtcgctgtctccatgctgagcgcgcncnaccatctcgtggactgtacantncgtatcattatacnaaatatagctgctggcgtgcgtagctggngcgtgagataggagagttgtcgtgcgtnctgacgtgtgatggggtagacgtactcaagtanccacgagaggttcagatgtgggagagtgcgtgncgcgcaggcgagcacgagaggtggatgagtctgtgacttcgtgcgggtgtcggtgaggctgcttcagtacgcgcgngccgtcgtcgtgctcgagcgagtgtatggagtggtcgtgaggcgcgngaggaggcgcgntgcgactctaggtagtagacagcagacgagtaatactccggccataggtacgacgtagtagtcacctcggtacgtgcccacgacggaccgactgtgtcgcgcttagactacagcagtgcctgttcntngcgcctacgatngtgcatatgcgctgggatgtaggtgggtgctgggcgggctgtggtgtgtgtggacagancgtgaggtgtgaggggatcagtgggtatggagcgagaccgcacgcgncgcagaggccttccaggacgacgtagctccgcacggctcgccgcacgtgcgatcggccgtatanagatacgagccgcagcactctcgctgccaacgtcgtcgctctctctcctaatcggtgcctactcgagcttactcatacatagtgangctcgcatatctcgatangatatcgtctgctcatgtcagcgatacatacgtcgtgnggcgtacgtacgcgccttgctgcagcctcatccctctctcactctcatctcacatcgcatcaatcggtcactcgcgaccgacgtgtncttctcactgacatggggagtgataatggggtgtgtgaagtgcattagttgagtctgttgggagcgtgtgaacgggtgtaggtgcgtctgtgctctcgttgtcatattcgcatgtggtttagtcatgatagttggatcagatagngaagagggatagcataccgtgtgacgtatcgtgcatctcatgtatacacgtcaaattagcgtcccgactcggccgtggtgggattgtaggcgtagtgcgcattggagatcgtgtacagaatgataaatatatgtgcaacgatcgcgatccggtgtggacagatnggactgtggtaactattacctctgcattctgatgctgcgctgtgtcactcgngataacagtggagtacgatgaagaaaatgtagtactagtagtaatgatagtcgactgggcacattgtatggcgngtncttctgcgncaatatgagcnaanttgagtctgtncgcgtagctatcgtcgtaactnctgtatctcttgatcagtgtacgcggacgttg

SEQ ID NO: 11777 - DNA, 1407 bp, Homo sapiens
  misc_feature (1)...(1407): n = A,T,C or G
catcaatcaatagacgaagttatatagacaacagtcggacgnagatagtcgtgcaatgnttgcttagttatggctctatnanataatcaacgtagctcgatacagntntgagcgtcagacgagggtagcggtcgcaacaaaatanttatattatcatatactcgataagacatgtgncantgacagatantgtagtactgacgatanagactctacgcnttacatgctgctactcctatctatcaatcacatagagttacagagagtgagtgtgatctagaagctagcaacgagtaagagatatcaagtgatacgcgagtatagctaatatattatctactatactcntaccatgactgagtcacacancgcncaactatgnatagtcacaactccataatntacngtctattatcgcgacgttaatatgatatatgacanatacatgtacgagtacaacacgntgcgacgntgtcaattatgctagcgttggctaancgcggtacaatacgaggattgaagtatagtatgctggcacgtctantctacgacgaatatcacgtacgcgcagantaatacgcanaagagtacagagataatgcatcaggancaaagataccggccagctcgacattagctatatcatatgtgtagacagtaaatatgataccgatatntatatctatcacagattgttcacatttttatctagattcgtaactggacttgttaccagacatcgtaataacaatatgcctcgtcttctctaatanttcatcgggtgacgctactacagcgctgtctgatgctgacagacagaagtatcttcagtgactgcgttgaccgtatcgcgtgcgagcagcgcttgntcactgcaaacagcgatgtattgatattatatacgcgtacggatatattttatgatgtgcggtgatggagcgtgaataagaaacaactgcgatcgattacatcatagntcntcacatgttcacgactctcgacacgtctgtntcgaccgtgttataacacgcactactgagttcttcgtaatgcgatatatcttagtcataatcataaatngttgncgtgacgtcgtcatacacatagcactaattactccttcgctccgagcataggcgtcgactcgagaagcgtcacacgatcacttattaatgttatagaggattacggatgtgcgtattacattcgatagttagcttatcacgaaagtgtcgtctgcctagcatgagcccgtatgtcgtccgcggactacaaaagatcaatatatacgatacaggcgtgttatagttcgtcactaaaacagtttagcattttgtctgtttctctaacatgcaccacgtgcctctcgcctctcagattaacgacgagattcattctagaatcccg

SEQ ID NO: 11778 - DNA, 885 bp, Homo sapiens
  misc_feature (1)...(885): n = A,T,C or G
gtttcagaacaccttgctagaactaccatcccctacctcaatattaggacttgcacggatgcagaagacctagtgtaacgaagaacctacgaacctcctcatacatgaaatcatggaggacccttgcatatgggatgaccatccttgacaatggatagaaaaaacgatactgggtagatggccatacatgaaaaggaaattatagattaaataccatcccaataaagctaaaaatgaatttacttcacaaaattggaaaaaactactttaaagatcatatggaaccaaaaaagagaccataattgactagaaaatcctaaccacaaagaacaatcctggaggcatcatgctacctgacttanagttatattacacggctacagttcccataacacgatgatactggcaccaaaccagagtatatccaccactggaatagaacataaccctcagaaataataccatacatctacaaccatctaaacttatgcattattttattctcataatatcgcacatttctaccttgtcttcaaaaactattatatggtgcgaagaccccgggctattgtcgccatattagaattccaaatactctaactcaaacctgcacgtcaaaatttctaccacttcttcaaacatcattcctgccctttaccttcacatgacccccgactatcttatactttacctcttacagtaattcacattcctcctctccatttacttgttccaccctgctcagcatacaccgcatcacttattctccgccctcctcaccaaccgcgcatacattttcactcctcctactacacacatccactaatatctactcaacaattaatatccaccgcttgagtaatcaacgctcaacgacatatacat

SEQ ID NO: 11779 - DNA, 1208 bp, Homo sapiens
  misc_feature (1)...(1208): n = A,T,C or G
gagcgctaggtgggacaagatgttatctactgattgccttataggtgaaccagtgtacttgttgtgtgtatcggngtcactgctttgatgcgtaggtatttcccctaaatgataacataaaggcgcgcggcgactgtgatggagtgggatcattaggaggattaagggagatgggggacgggatctgtggagttgtgtcttctataagaatatgtctcttcattacaataaaagatagaggatgtgtacgtatgactatatgaacatatgagagctctcgctaccatggatcagtgtaccgacgtatagagagcgagtgccggagcgcacaattggagcggcaagagaagtgacgcggtaaggaaggtagtcgcttgacgtgcgagcgctgtagtcagagcgtactcgagaggttgcgaggaggagcagagagcaaagagataaaacggggactaatagttgatagacaacgcaaaagagtctatgtgaagacacggaggaaggagaagtcgtggttgtagtgtagatgctgggtagccagggaggtggggagggagataggaggcgaaagtagttggggatgttttctatattaaacggaacggggtgctttcctggaacaggcgcgcgactcgcgacctgtcaggcgtatcctaggctcaactaggggcgtggggcgactgactcaatgacacacagatctggtattccttgagatacgtgagttagactaggataccgtataggatcgatacccacactaccatagtcaaactcacaataaagtgagcggaaatgataagttaagtgcgtgtgtgtaggaggccctggaggcggggagcgttgagaaatgtgatctgcggctggcatggtgttgtgtattgtgggctgtgatgtgcgatcgcaggccagctctagaacagtgagtaaatagagctctgaattaactggcttatcaatagaatgtaatcacaggtaagtggggatgggctaggcaaaggtgattgagctaaaatgcaagatgtgcgnatcgtaggagagtcgcaagtactacaaaataaagcatactggacgttgacgatatggaatgcgattgtatgtgtgagtcgcgccgagcgcgcgaccgcgcgctggtgggtactgtggcgcagtagtccgccagtagagcggaacgcaaggcggngacgactggtagatcagtctctgta

SEQ ID NO: 11780 - DNA, 1287 bp, Homo sapiens
  misc_feature (1)...(1287): n = A,T,C or G
ataaattaaacatgtaagcatcatctacgccttgtattcacattcatatagagcagatatctcctaaggtcgtaagttacttgtatactgatgctctcccgggtctctnctatcgcgcatacgcgtcgcactcactaccatgnccgaagcaggagtgtactgctcgcacttcggcgcgacgcgaaaaccacacctcactcctcaacattacacctctgtgtctcattcgcgggtctatcacgcaatagactactagatatatacgcgatcataggaagagcatcagatgatatatagcttatgcgattacatcgagacggatggatcaatacagatgataataatatcctctaatcatatagcagatacgagaacatcantcatctacaccgacgacgcgcgagcacgagtagcgctgcatacatactgatctcactcacntaatgctacctgagatataatcttacacaatactatgtattatatctaagattgaagttagctatattctctatatntgacgatcgtcgtgatttcgaaacggtctgtcatccgtgatcatgttattatcatcgtctctcgtgctcaccaaactacacatttcaatagaatgtgcacgcctgatctcctctctcgtcatcttaatacgtccggtcgcctcttacgatatcctatatcgcaagcatgagtcacgtcgacgttcgcacacgtccagagatgaaaataattatttatcagcacgtatgctcgtagcgatgccgtgtcttacagtcgatgtgggattctcgtggtaatctgttccgttagtacataacatatgataatatcagtagtgaaatgcttcncctacaccctccgtgactgggctgagtgaggtgcaattaatgtcgtttaatgtctgctattctcgacccatcggaacctcatactgtaactcaccatcgtcgctcagacggcactaaactctgacgtaaccagcctgagcggtcgcgtcgcgtcgagcagtagctatgcactcgacttgagcgatcattgatagataccttcgcactctgtcaactatacctacacgcatatgcgagacagcacccctcactcggttcttctgttacctagttcgtatattaattctttccaatcgtgaactaaatagattaatagtgtgttgttattacataaactcattgtgtgtctatggtctccaatccctaatanctcttatgcncccctcacactcttattcctctcccgtatcacactcccatattacctatattctcatatctc

SEQ ID NO: 11781 - DNA, 1468 bp, Homo sapiens
  misc_feature (1)...(1468): n = A,T,C or G
ccgtcacgtggtataccccaaagacagacaagcccactttctagtactgtaagtatcgcatggagtggtagcacatctatagcagtaacacatgactattgacatacgataggctnccgatgtntggtagactgtaatcgacacacatngtagagtagtatctattcttcatagttcttatcttttttagtatgattcgacgcacacgcacgtccatagaatactcgggggcttgtgtagaacacgagagctctanataatcatattgcacacacatntcacactagcatctncgtgcgataactctagcacgagcaataggctagcgatagtacncctatcgctacatatggaattattcgcaacacttacgcacactacttcncgcccgactctaccgcacgcaaggcatatgngtatgcagtcattctcgtacacgagcgactatctttcacgctcttcctacacagagtagattatcttctacgctcacgcctcgccgtcttagtcanatcgcacactctctcatcgcttctgactctctgccgccatccaccgcctggccctctcccttctgatactacactatagtctatcatgactcaccgctactcatctattagtgccgtgtactcgctcacgcgcgccaaccatccgcgacattcatattctattatcccactcttctctatcctcaccatctatcacatcacacgcgcgangcagcgcgatgataacgtcagccgactcctatgtcacccacatcatcaagactcctactcacacaccnacctctcgctactcacgctccagcctacatctccaccacaccactactcacataatacgcgctcacgcacttctgaccaccgcatacacactctcacgcgcntanatactcaccgtctattgtaccgtatcaagtgtctcgtactcccctctcttatttgtcttctcactacacccactcctctaaatctctctctcgtcactatctgctctctctccgttntcgtatatactatattctgaccctacatcgtatctctatgagtataatctatacaccgcatcgccctcccaccacttcgctctcacctgtcggcatacgattaactcaccacgtgtgtacgctcttgtactactctgatcctcactattctctccatatcccactcaacatattcatctcatgctctccctcgcgtaanccgcaccntataattacacattacgcttctccgtcctcacctcctctacatctcactcntgtaaatctcgtattngatccatcnacgtcgctcatcnacactaccgtctcctaatacttacaccntagatcccgtatcattctactactactnaatcttcacacgacattctatcacccacatctntccacgtactactctcgntcatcatntgcatacattcctgctcatccacgcacctcgtacactccatacat

SEQ ID NO: 11782 - DNA, 997 bp, Homo sapiens
  misc_feature (1)...(997): n = A,T,C or G
cgcacaggtggcgatcgctacgggaggtctacctcatacagccaacaggaaccattaggatggaatgtgtggggccggtagtgcccgtttactctagtatcgtactaccagtggggggtctaggaagtgcgagggcaggggatgggaagtacgctgagtaggggtgcagtggcgggcggggacagggttgatgacgactggtgtctacaaacgcaccgccaccctaccatccgctctctttttcacaactagtancggatgaatgctctggtcgtcgctgtgttggaggctgggggtgcgcggtttcgctgtgatgctcgtgggctgcttattacttgaaatgtgcgtacgagagctcgtgtgggccatgtccgtgatatactcatcactcgcgaagcgcctcagagacttatttgtaagaggcacaggaggagacatttcttacggtacgcgagagtaaaaggaagtaaagttggacattgggtgtgggatgatatattaaacaccggccgcatacataacaaatggactggggcacgtgcatcgggtacaataccttgcaaagttccctctcgaatggtggcctgctgcactagatactctatctacatcatgatgcagacttgcctttcctattagggtgggctggaggattggctgggtatagcatatcatcaattttcagggattgagtaagaggtggggcaggcgcggggcgctcgcgcctggcgtatcactaggcgtcgaggtcggtttttatccgcgacacggagcataaacataagtgtttgcgccatacacctagataggactatggagttgggtgttagtagattaaaagtatgttgaattcctggtgccttgnggagtcgctgtcgtctctaccgagcgcgggctgtgtcgctggctgaggtaatgcggtacgggccgtcaggcactgaggggggcagcagatgtatactaatcgataaaattgtacgcccttttgttaaatcgt

SEQ ID NO: 11783 - DNA, 1861 bp, Homo sapiens
  misc_feature (1)...(1861): n = A,T,C or G
ggactggtataacgtcgancgagtggcgcagtagtancangntgcgtcgntcgtgctatacatgtgacatatatcgacctctgtctgctgttgcngactcgatgtacacggaagtccgcatnacgcnacgtcgtgagangagtagtanncgtgctagtagagcgcatcacacgacgtatctaacagtgtgacgaacgcgcantaattccacagcgtatctctacgcacgnctgatgtagganaagtgtacgatgctacgcaatgatcnagntangtgcgggcagcagtngtncacatcacagcgncgccgctcacaggtcgatatgatgtnagtcantaaatcttacantacgcggcatnantnggcgagacgntgtgcgagcacgagtcgcgacgtgtangncgaggacatggtctcagagatcgtactgcgtngagcnggctgtcncatacgntcattaatggntatagtctctgtactgntcgtctacagtnaacttcgcggattcttcgtactgagatnagatacgagagcatcgtaacgtatgctgtacgacgagcgagtcatgantgagagcgtcgcatgcatgagcgtgacaagtgtatatgagatcacgagtgcacaactgtctatctcgagactctcactcacagtactntntacatgagcggagatcgcgatacgtagtcacagtgtaagntagagagattgcgtacggatcgtattggtcatcgttaccgcgatcgcgagagagtatagcanatcgntgatctngcgtgcgctgatgctaagtcagactacantgtatcacagagctcacgacgctagcntctagcatcatantcatcataccagtgtatgcgagtgtagtgagatgagtgtgcgttactctcttgtgagaagtatctagtagtgcgatgcagtaattanagacgacgcaccgtgcgcagatgctgnctacgcgtcgatgctaatcgcagaggagtactgtctntatcatgtcaactgcattcgagtctatcacactacgtgtataggtgcacggtagtcactgcacctatatcacactctgacttgcgganatacacattgtattgtanatgagtattagatcnancactntcattgtcactangactacagtgcatcatgatngctgttggtctgcgtcgtgtgattcagtgcgagtaggactttgtgtgtactatgtcgaatnactcgngtgacangtcgntgcntatgagcgtgcctgtgcgagcagagggtaagagattacgagntcgcgtncaggtangtcgcgcaatcactactgcagancgctctcnctgctgctgtcgcagttagctnggagcganggtagtgcatcgcgcgcactgcgatctgccacatttanncatnanctgtgcactacgtgagcagccatcacggcagagtngttcgagtagtacgtctcgcaatgatagantatcatgcgtcgtatcgctgcactgagcagcgctgcagtgagcgactcgtgagcgtgcgtgggatggtgatgtgtccatatgtgcnttcnanctgagtacgtcatgactacttgcntctatcgctgtcgctgacattgtatgtgacgnataccgacagtgcagtcgaacacactctgacatggctcatnaacagacgagntcacagaggctntatactcatacaggtgcactcctcgatcaaactacgacgngcgagcactactagggtctgcgacaatcgctatacgagnctgtacgctgtactcaccgctctggtcacgtgctctgtagctgctgagtacatcgtgagcgtactgtggacatgtgtacaagtcatgtactagacgtgccagca

SEQ ID NO: 11784 - DNA, 831 bp, Homo sapiens
  misc_feature (1)...(831): n = A,T,C or G
agactaatagattaagattaaactataaaggcagttgtgaatattggagactgcgggagaagtggaagtgtataagatgcataaagttttagatctngggtgtgagagttgtcagaagaatggataggctgcgtgtagagagggagtggtgacttactgtgttagtataggttagaagaggtgatatctgaggtaggtggggtaataggggcgggagaaagtagaggacgtaagctggtggatggtgtatgggccgtgaagggtatgagaggcattgagagagaagaggacagagtaaggagagagaaagacgagcaggattcgaggtaatgaaagtggcggaggtagcagagaatgattagagcggagggagtagagagtagaggggttgtacgtcatatcctatggtagtattgtttaatagggtgtaagtaaaaaaaaaattgggaggggggagggggggtgaaagagtggtcaggcagagaggagcagcgccggcatgtgggtgagtatgggttaggaatgtcggagcgagggaggctctttatgggttccatatgaggtttaaagtagttttttccaattctgtaaacaaagtcattggtagctttatgggaatggtattaaatctataaattaccttgagcagtacggccattttcacagtattgattcttcctatccatgggcatggaattttcttccatttgtttgtgtcatcctttatttcattgagcagtggtttgtagttctccttgaagaggtctctcacatcccttgtaagctggattcctaagtattttattctatttaagcaattggacaaaccag

SEQ ID NO: 11785 - DNA, 884 bp, Homo sapiens
  misc_feature (1)...(884): n = A,T,C or G
ttaggacaaatgaaacaatgaaaaggtgaactgaaagaagatcccctatatgctgggagcaagatagtattttttaccaacaaaattgtgtcattgaatttggacctgtactggtagatgctgtagaactaatgtgaagaagaagttgctatggatccaatcaatatatggagacctgggagaaagcagcttatcatagattcattgctagacaagaccgttacatgtagcagaatcttttaaattatcactaggaattccttcaacagatctgactacaaatgacaatgttcttttttttaaagtaggttgagatcaagtatatttataattcgggctcacaagtcgtgatgatgtgactttttctctttgtcttcatcattagggggtaatgattgtatccactttatttcgcacacacccttgtgcaatataactttattgggacatattttacatatcatatggttcacttattttcagcgcacaaccggacaaaacgaggaaattatccatggtgtgcaaggatccatatgggcctaaactcgtattaaggccaggagatcgctcttgctcatgaactcttactcctcgctccctcgctatggactaacgcctacaattaagtgggtggcctgactctatggattatgcctaatccggctttgcatattggtaaaacactcattatggtggaaaaacatcaaatataattgccgtatctgtccnccttttggatttttgtgacccgcctttttgtagggttcgtactggatcctctctctgctgcgccaccctgcactgggattatggaggtctcaggtttaattagcgtggattgccgagtcctatctctggaaagcgcgaggacatggagaatcggg

SEQ ID NO: 11786 - DNA, 1885 bp, Homo sapiens
  misc_feature (1)...(1885): n = A,T,C or G
cacgctnatcatcaggantagacttacagcacncctgagcgccaatgacgagaccacacaacagacttatcgacacgcaagacctatcagacgtgcagagtgtcgcgtgngctcagacgtgatgtatatctgtacgatctctaatatnctcatcatatnacacatnataacaatcatcacacaatgtggngtggcgacgatatctaacgaggagcgtcatgacancatcacgtacatctagaatgcntcgcaactgtgngtgagngataagtgtatcatgcgctcagtcgtagtgtgcatgcagagtaagccatcgcgtcgtgaccgcgtcgcgcantctgatcgatcacacagcaccagatacacatcacatantcagactataccgatatctacgatcaacgncagtataatgantntctcgtacgcgaatacaagacgaacgtgtgacgacatacatactcgcatactagttactgcaacgacttatcgatatngatatcacacgctccatcagatgnactctgagatgncgtcgaganacgagactacatatcatantagtatatcgacgtgacacacaacactcaatacaagatntgtgattactcacatacgagctgtcatagctgtctagtctgctgatctctcacgcatatagtactagttctatgtagcagcgatgtcgttatatnacgatatgggtatcataccactcgtgacagcagagtgacganggcgactgtgcgacnagcgtgcaatcagcgcagatctcagcgggacacgcacgcacacgtgactacgacntcatactatacccgctgcgctgtatacgtgcgctgactggcgcctcactgtctctcatctacaccgtcggnntctatcatcagctatcataataaataaggtagactgtcgcggncgctgctacagtgagcnctagatagtagtacatagtgtgatagtcgtgggtatctatcggtgtctcttctagctctcgtctcggacggtgcatgnggcgtccgtctcctcatactcgacacgctcgcccgcgtcactctcgtcactctncgcgcatacgaggtgccaggaactgtagatggangcgttacactgacgatgtgactctancacacntacagttgtacgcatctangcgcaagatngcacactatagcgcagcgacgtgcatcgagccacnanaacactactacgcncgtcgtctcactctgtgatgatgagtcnacctccagctntgcaccctgtcgtatccactatatatgtcaagcngtgagtcatctcactctctaatgacnaaatatnganagcacgantnacactnggcggcanaaagtggcntagtagngcgtgcgtaggtagtgcantcgtaagtangtgnanactacgtgtanangcagatgatacagcggcgcggcagngngcngaggattcagtgagtgcnatctangagcgatatancagacactcatatgaatcgtgcatattattcgatcatcanantanangnagatcatatagcatcgcatcanctcgacantncgtcactatacctctcctgacagccagctaggacaactgagttacactgcgtgcactctagatacatcgatactagcgtatgctatttgagacgcgaggtatngtngtctatctcagtaacgcgtctagtctacgccagtctgtcgctcgncgatctctagctatatctactatactccagccgcgacgagaatatatatcgtagatacatactntcgcacgatcactntcaaccaaaccatgnatnagaactgcacttctctantacnataacgctacctaccacgacaactcatacatantcgactccaccactcataatatc

SEQ ID NO: 11787 - DNA, 1698 bp, Homo sapiens
  misc_feature (1)...(1698): n = A,T,C or G
cagcactgtnctcacgagtcgtgtagctatcactgtcacctctcgacatcatatactttctacagtctcgacatctcncacatatgcactgatgtctcnncactccatgacacagtgcgacacntgagcacggagctagcgtagatgntgtctttgtggtcngatcgtantatagacacgatatatgcgcatacgtcatagatctacgcacagagcaagtcncacacgaatacagangaagacatagtcatgtgtagtgtgtacngcgtaactatctactgtgtatgtgactacactnagtcctctatcatatctacatataacacagactcgtatctcgtgcatacctacgcagcgtactgtatcgaagacgtttgcctgttntcagttctcntgcntatatccaccattctctcacgacgnactacgtctgtntgagtctatgatctcattatagtcagaataatacatgtgagaggaatcgatattattaatttcacatacagcacaagacgacntcaacatcgagtcataacgcagcgcgcgaccacactcgtgtctcgtcagacacgtgttnacgctcgagntgacacgatcgtgtactacacaatgaagtcaatacacctcttctctgcgcgtgtctaggtaantaagtntanagtcataaccgcagatcgcntacactccacngaacatacatcatctcatactcntctacatctcacacagatctagcactcacacacaccatctatatatctttatatacanatcgatctgttgcacgtcgtagcatctgactcacagataagttgattatanataatgttagcgttactacacaagtgaatattgcgctcactgctgtcaccatgtcgcgcagcatacagtatantatgtaagtaatgatagcaattcatacgtaatcacaacacatccgtcagagatatgatatctatctgaatcgaatctctaagatatatcggtagacaaaacatagtctatacatctacctacgtntcatacacatcatataacactgactcgcatataagtcgtctctctattccatatagtactgtgactatcataagatcgctaatatactgctatgtcaatctantccatacacatactaatataananatgtgctgcgacagagcagagatcttcactcnctatatcagtcactacgaactaccgatgaccactcaatcacacctactaccgagtatcatacanggcatcgcgcagcaatagactgatatcgtgaccatatatacctcgagactagtcgaagagagtcgtnagtacgtacgcataagactattatgattgtcatctgacgtaatcgntcatcagatctgtgatatataattaactgatacacagagtactactatgtaatgacgtctgttgtacagtcgactgtttgctcacctctgntggtgcagcgcgtgccagcgtgcgtgatgtgctatcantctcgtgcacacactgtgcatatcacacatatcgacganaatttatagattctcgcgtcgatacagtctgtcagactactcacgatagaagcactatntagtttccacacgtacaacagacactcactatccactctctaatgctccctatcacttcatctctctaatntatatcgtcactactctatacctactgtaatatcatacaagtca

SEQ ID NO: 11788 - DNA, 1479 bp, Homo sapiens
  misc_feature (1)...(1479): n = A,T,C or G
cgccatcacacgttgtcgtntncncgtatctgctctgcnttcgtgtccccagtnctgacgagtcatctctctgtcgtccgtcgtacgtctcnctttgctnacttcgncntcgtttcgctgntcttcgttgctttcncccgactgtctagtgctgtctcgtcatcagagantntcgtagctgattctcgctcgtgctgncactgcttgcatgtagtgtcgctttgctctctgtcgtctctgtagtgtgctgctggtgcgcgcgctctgtgctggtctgcgtactgtgtcgcgttcgacttgtctnncgtcgntctctgctccggcgntcgcttgcgcgctcgtgtgtcgtctctgtctngttcggtctcgtcgctctngctcgctgtctgctgctgtatctgtcgcgcggcgtcgctcgcggctgccgtgctgctgcgcgtcctcgctctctctacccgcgctctggccctactctgtctgctgtcntccggtcgtgtggctctcgtcgcggccgggtctgctacgcgcgtctcgcgctccggcgtcgggcggccagccttcgcgcgcgctgctcccctcctccttccgcggctgcgtcgtcggcgtgtggtgcgcgcctcacctcgcgtgtctcgcgctgctgcgcgtcttctcgcctctggcatatgtggccggcgctccgcgcgctccgctgctcccgcccgcctggcctgcgccggtcgtgcccctgtcctcctctctccccccgtcctcctctcccctcttgtcttcctttcttcgtttcttatcataccttcccgggcctgggctgcccgtgcgctgtccgttccgacgtgtgtcctctctcggtctggccgtgcgcggcggcgncgccgtggcggcgggcggccgggtccgcggcgtccgcctagtcatcgtcgtggtgtgttgccgngatctgccgccgccccggcgcctgccgcgtcgtgtcctccgtcgtcgctgttgcggtcttgtcggcgctggtgtgcgggccgcccggtgtgtctctctgttcctcgctctctggcggggtggcgttggggctggtggnggcggcgccgtgcgccgttctcgctctgcgtcgtgcgggccgtgcggggcgcggtccgttacggacgcgccgcgcctcgggtcgttggcgatgcggcgtcgcggtgcggcggcggttcccgcacgcgcgtcgtgctcgngtgggagtgcctctcctctggtgctgtcgtgtgcgggctgcgcctgccggtgcgctgtctgtttctttcctgtcgtctgccgtggtccggtgcgctgggtgtcgtcgccgcgctcgctgtcccgtcctcgccctgcccggatccgcgcacgcgcgccgctccccgcgctcgtgtccttctccgtcccccgcccgctccgtggggttgcctctcctcttaaagtttcctcttcctttctgttctctccctcaaactctttttctttctt

SEQ ID NO: 11789 - DNA, 1298 bp, Homo sapiens
  misc_feature (1)...(1298): n = A,T,C or G
gcgcgtatcacgctgctcatcctcgagaatgtcactatgggcattaatttgggtttatggcaaaacattagtcattgaagaatactcacgagcgcactagtattgaacagtaagtactcagtgtcccctagaatctacatactagcgaatggataagtccatagcacctaattgcaagaagaacaactctctataagcgcctcactatcgatactagataaaccaacaccttntatgacaattggttgcatcgaccttataatgnccatctcttctatacatcgatcgtgtatagtccattcaacctcgcgtcgctcacatncttcatcatacactactgtccatagcatcgacaaaattatcggtaatacaaacaaaaaatttaaaataaagcataatcaaactaacataccataaaaacaaagaaagagacaaacacaacctaacatacactatataacaaagtaatagaaccaaccaccataatatattcttggctcacctcaccgcgaccctagatgacggtgtgtcctcttgcactcggccccttttacccgtctgcagcaagggctacaatcgaccatccaactctcttatatcctttttcactatccgcgccctcgtctctcgcactggcgctctcgcgccagacgccatcgacactctactctcatgagcgcgccgactaactcctcccatctgcccgatatacatacgtcgggcatgtgcgctcaccacagcctcacagcgtctaacattcacctatacacggcacctgtctacatgagtctcgctcagcctactacgatatacagtcatncaanagcactcctcgctgcgtctcctgtccctcgctctactacgtacacgncctagncacacacatcacgctcctcgtccatagantctgcatgctgatcttatatggtgatatcgctcgtccacatctcctccactcacattctancttgtgcgattgacatacctctatcatatcatctcctatatatctcgtccactcacgtcacaccctacctccgtatcgatatgatctgtcgatcgctgtattatcatctagatgtctntcaacgtacacttacactctgctctctcctcgcagngcgnacacatagaccacctagttcatgacctacacagccacgctcgaccatctatgcgctcagcgantcgactagtcttgtctacanatgctctacgtcatgacattctattacccgatcgacgcttgctcactctccagtcactcactccgctcttctaccttcactttcatatcg

SEQ ID NO: 11790 - DNA, 1364 bp, Homo sapiens
  misc_feature (1)...(1364): n = A,T,C or G
ggtcggtagttgttgagtgatgtgggagggtgttagggggagaaatgcgtaagtgcggtgttgtgaggtggggggcgtgtggtcggattcggtgacgtaacggcgagacgatgagagagagtaaaataatgtggtgcgccgggatagaggtggcggtggagcggcggatggcgtgagtgcgtagagcctggggaccacggagtagatagatagatgctatgtagtgtacaagagatcgatgtgtacaaatgtgctgttatggttgttaatgtttatagtatgaggtcgtagggaacatagcgagaaaaaataaccgaattatcgatcgggtttgtggcggctatatcgaagatatgtagttaggaagtcgctagataaggcaagatgatagctcatatgtgtaggctttgagtggtggggtcggatgttagtatacacgagcttggttgtatacataatgctatattcaggcagtgaatagtctctatgaacataattatgtctattcgagatcacgactggctatacgcaatagtacgtgtatgtctctactcgtgtattgtattgtgagcacatcagagcngtcgctatatctcatgacatgtcggtagnggcagttgtgtgtgtgctcgggcggtcngcgaggtgtctgtttcggtttagtattgagtgatgatttncatcatacacatgtgtgtttgtgtctgtgagatcctctagttaatgtcttgcnacggtagggagggcatctgtcgagtgcatgtatgtggttattagataagggagcgcncaccgatctgtacttgtaggatgtgcgagatggtgatgtgcctgtatagaaatgtcgtgcgtttggtgttcgtgtgatttagactaagtgtgtacagcgtgactttatacttatgtgtatactcatcttggctatantattgataatcgacatgttgggaactagtatnaataatgcagtattcaggataagataacacatggcaaaatggttaaacgcgtgaggcgttgctcaggttggtctgtacgacatatgagagaactcatgaattaagagtctgtgttaatgtgagagaattgagctgacgcatcattatatagttattatttaacgacactagtgacgattatccgacagtaggagagggaccagtaacgtgtagtggtgaggttgcgtcgntatacagtgttgagttatgagttatcattacgctcagtgagaggcagcagataggcaggtgtgtcgatggctgctcaggagtggctctgctgcctgactgagatatatacgtggtaaacggtatcgtcagcctaagtgcgtgaaatgcgtagaatgtatagtgtgtatcggtgtc

SEQ ID NO: 11791 - DNA, 208 bp, Homo sapiens
aagaggagattatgacacaaggagatactctgcttgcagagaggaaagaccatgtgagaacacagtgagaagcagctatctgcaagcccaggacagaggcctcagaagaaaccaaacctagcaacatcttgatcttggctctttagccttcagacatgtgagaaataaattcctgttttttaagctgccaaaaaaaaaaaaaaaaaaa

SEQ ID NO: 11792 - DNA, 1550 bp, Homo sapiens
  misc_feature (1)...(1550): n = A,T,C or G
tctgtactagtctggttgtctaagntacatctgacgctgtgactatcagtgaagtatacgcatcagatatcctgattcagcgtctnatactatcgcgtntccatattctgtttcgcgtggtgactnagtacgtagatattgattatctatctgctcacaatattacgcgattctcatttaatatcagtcgataatgtcgctacttccacagtatacgtcgcgacatagtggtacggtagaggcgcgcatctaacagcgacatatacagcatcatgagtgncgtgtcttcaacacttattgtaagtcggctgatgtgctgcctgcgccatcgctatagcacacgatcggaagtgtaacggactgctctagtagtctgcggtcgtccttagcgctgctgcgcgtcgtctattagatatatgcatgcgcgactgangaccgcacgagcgatgtagtatagctagtacacatacatcgagttcgaatatacacatagccgagaccggtacgagctgacgttgtctatcgcgatcacacgctagtctcgcacgcgtgtgnatctacggcacgggcggatcgtnactgttagttactgctagtcattgtcctacatcacctnacagtctcacttcactgctactgctggtatgtcgtagtagttgacacgtgttatcgcgntcgatgcgacgtggtgtagcggagctatctaatctgtatcgtatatcactacacactagactatgagctttcccatacgatacattcataatatctggcgcttatctacctcatactgcacatcgcgtcataccatngtgcttatcgtctgaccacgcgctattctgctaccgcatacactcgctagtgtctcacgntagatagatgagtatctggtcgactctatcgcactgtacacgtgcgacagtccttaattactacgccgtcccgccatcgtcagcacncgcacaacacataacttcgcaacgtgtacctagtcgagactgactacatatagncaccgccctactatgcagtagtctgtctcataacccaagcaaacactcgtattgccacnctctatgtacgtcgcacccgcacgcgactcagcgcgtcagcgttcgcntcatctgtatactagccanatcgcgcaactctacttacgtgttatacctactctagcatgcaagagtactccatcgaaagagtcagaagangtgcggcagagtggtgcgcgtacgacggctactatgactccgagatatatgccattttgtctcaccggcgctcacacggacaacaccaaagcatcggcactaatactccacgttagtgtttacatcatagccacacttgcacaatatcgacactagtttcagagtcatgaatatttccgatctcgtgccttcacatgccctctgcgtctcagagtattacaaaancgagatgattattcttactgtagaacgcacctaatccagtcagcattcactctacctgtgaacgcttaggactcgttgatacgcatcatgtacgtttcactgcttacttgtctt

SEQ ID NO: 11793 - DNA, 1155 bp, Homo sapiens
  misc_feature (1)...(1155): n = A,T,C or G
gggagtgtagatatcggtctaaacagtattaaattagacaaacccctccgatatggtagcccccatggtgcgcgttccttttgaatacacgtaaacttttagctatctcataatgtcccgcagcgtttgtcgcaagagccgggaaggcgtctgcacacagaccactaaccattgccagcgccgaccgtcttgagctatacaacttttacaagagtaagtgaggcggaggaggggacatccccgaagttaccttctttataccgtccgctaccatgcatacggtcctctgctcgattctctaacgcgttcagatgcgactgaagcctcaactccacttgcgccaggcgccgtttcacgtatccacgtcgaaggagatgacttttcgctgagcgcattcacgagagtatctcataacaatgtccaaattattcaatgtccatggactgccattcttcacgacgaaccttacacagtcatgcatataccaccgcgcggcggcgtctctctatctctccatggttgttcgtgctatgtcgttcttccgtagggctggctcgcgtcactatagagtataagaatgatgttgttaacttgtcgtatattgtattgttatcgacgagccgtccacaccaaacttccatattgattcgcgcgctcgtccatcctccctaggcaactggttcgagtgtttaacgtatggactatagaattatattctaccgctttatcctcttccccatcgtacactgatgaaattgatatgttacaggacagtaacgcacaggnanatacatgggttcataactacgcgactcgagattaatcgctgtatatatgtatagagagtcacccactgtacgatactcttagctcctctttagtcgtcctattcacccaaaacaagaattgcatgttgagcgttgcgcaagcgactaaccgtattttttaaaccatcatcgctagagataggtcgggacccaccacgaacacgtcaagccccgctccttcgctgtcgcgtattgaattgtaggagtcgtacagtaatgacatcgtcaataaatagtatcacgggatatgctgatagtatatggagctgcgcagctacttcgtaattaattgtgtactatatattgccatattctgactgtacctctg

SEQ ID NO: 11794 - DNA, 1094 bp, Homo sapiens
  misc_feature (1)...(1094): n = A,T,C or G
aagaacaaaacaaacgcaagaagacacaaaagcgagaaaaaaacaaaaaacaagaaaaaaaaaaccttcaaaaaggaaaacagcgcgcagaacagcgttgcaagaggacagaaccccggaaaggaccgagagccacacaggcgcaccaagcccgacctctggaccgggccaaaaggagaggcggagggacagaggagccaacgaccgacggacgccgcaaaggagaccggacacagagcacggccgagcagacgggaaagcaacaggagagaaaagaaacgacacaccacgaaaaagcaccccaccaggaccacgcgaacaacaaagcaacgcagaaccaagagaagaacgaacngccgaaccgcacacaccagcaaggaagacacccgcaaccacacaacacaaaagcacagctaagagaccacgggcagaagacagcaagccagcaagagaagacaaagagaacggagaacgaagacagcgcgaggaaacacacacgcgaccggacagaaaaccagaagcgacaaacgaaaacgacgagacatacagaccgcaagaaacccgaaccgccgaaacagacacaggaccgcaacaaagcacggaccaaagaagaacagaaagggagcaaagcgcgccgcacacggaccggacccgcccaaagaacccaacagcaccacagcaacgagcgaaatacacccccggccacgaaccgacacgaacacagaaaacaaacgaagagacgccaggcggcggcgcacgaacaagaccaaccgaccgggagcacgggcaccacccaccaaagaccggcaagcgaaagacccagcgcaaagacccaagcccacacagacgangaaacggcgccggctcgccccaaacaaaaaaagcaccccgcccaccacacaaggagcccgccgaaacgaccaacacacaaaaagaaccgggacagaaccagaaagacgcgccggcgccccaagccgcggaccagcccgcgcccgccaacagcccacgcacagcgccacacgcaaacgcgcaacaaacagccgagcagcaggcgaagacccacaacgatacgagcacagcacgaagaacccgat

SEQ ID NO: 11795 - DNA, 824 bp, Homo sapiens
  misc_feature (1)...(824): n = A,T,C or G
cattcgccctctatttcaaatctctaacattcataaataaaaaaaaaaaaaacttaaagagacgcnccgccncttgccgggcnaccaagaagccagacaccggagaacnccctccttggaccaccaagcggcgggaccacaggagacaggacgacgaccccaaaagacggcacgacagccagagcggaaacaacagaagcaggaagaacacgcccagcccacccaggccccaggccccagaagcagacgagaacgaagaagccgaccggcttttttttgaaaccttcattccagacatatcctccctatatccaaagaacatctttatctttaaagacacagagatgttaataagaatctgaacaaacaggctttgccagatcccccagtttactaatattgaaccatactctttaggtcttctatcatacttctgtacgatgcccattataatacgctatatttccctaatcctttagggattttattcccgaatgcttctgtgctatgtataacttacattcaacaaatacgtccgctttacctgccagaaccctataacgcgcaatatcttttttttcgttatagatcacgacacaggtaaaatattcttcctttgtaacgtcctgctcatctcacccacaggtattataccttagcagcacaccttttacagtttttagcgctggtctacgacgcaagtattaatatgcaattactatctaaacactgacagcacctgagtcatccactaccgcgattgctgttattttattttccacccccccccaccatatttactttccaccacattctaatacaag

SEQ ID NO: 11796 - DNA, 1145 bp, Homo sapiens
  misc_feature (1)...(1145): n = A,T,C or G
ctaactgtgttcttctctcctctctcctcgtctccctccgtactgtccctattatgctacttctacgttttgctcgttgtgttgagttggtatgggtggtggtgtgcgtctactacgtctcgctgatgttgtgtgtcgctgtgtactacgttagtttcctgacttattcggtatttagactgtcactagacatggcgtgcgtctctcatggtgtctctgcctgtttaccctgtctctgcatatgttgatatatattcttctctgtcgctcttgttagtcggctattttattcttccgtcgccgcgtctctctccgtcttcagttgtttccagaccggcggctgtgggtatagcgtctgtgattgtggctgtgtgttctacgttgatatcgggcctctatcactccctcacgctctctatctcatcttggaatcagtagcgtgttgctgtgtcacgcgcggtgtgtggatagagtgtttggtatctcgttgttaacgtatctttctatcagatttgttctgagcccgattcttttattcaacgatagttgcttgctttctatctgatctctcgcttcgtcccgttgcctctctcggtctttgattcgtctcacctgcatctatctactctcgcttctctgatctcgcattctcctttcttctctctgcattagttcgcttgtgataacacctccctgtccgttgctggttatatataatgattaaagtgtttggtttattgatgttgactcgcccccaccccataactcgttagctagtcttcgtcttcggtatcttatatgtatacgcgtaagttagtaataaccccacaaacttcctcctgcatggcttgctcgtcggtaactcctcacccagctgcctgtaactgcataagctaatatagagtcgtctaaagtgagaaaaattcttaaaacttctgaattataataataaaataaaacacccccccacccccataaataaataataaaacaaaataaacaaagataaaaagaaacaacaaaaagaatgcggctctcgttcggccctaccagcggtgagnagatggtttcggcgccagaacgctnttcttcttgcttcttttcccctccacctccccatctcctctctctgttctctctcccta

SEQ ID NO: 11797 - DNA, 1142 bp, Homo sapiens
  misc_feature (1)...(1142): n = A,T,C or G
cttgtctgcgttcgtgtctggttctgcgcgccgttccgctctcctctcggttcctcgtttcgctccgccntgcctcgccgtggtgtggcccgttcgctccgtgcctgcgtctgtcgtgcgggccctctttttctctggtctcttctgtgcgcgtcccgtgcgtttcttctcgcgtggtctctcttctttttttcgtctgttngtcgtggtcctttcctcgctctcgcgcctccgcctctgctcctctctgcattcccctctctctcctgtctctgtctcgccgtcttcttttctctcttctctttcgcgtcgccttggccggtcgctttctcctccgttctttctgtctgctgtgtggctcgtgctctgttctctctggctgcgtcggtgtctttcggtcttttctgctcttttctcctcgccgttggcgtgtttctggcctctcttcccgttctctttcgttcgccggctccttgtggcggtcttgcgctcgttctttctcctcgtctctgttcgctggccttctgttctttctctcttctcccgcgtctcgctcttccgccgccccgtctcgtgctgcgcctgttgctctgttcttcttcgccgtgccgcgctgtcgtttgttcttcgctgtgctgcttcttgtgtgcggccgcgcttcttgcctgtgcgcgtttccttctccgtctctggtctgttcgccgctcgctgtcttccgcgcggttggccctgttctgtgctnttggtgcggtgtgctccgtctctgttttgtggacaacccgccttcttgctgtcgtttttgctctttgcctttctctctttctctccctgcgtgtgctgtgccctcgctcgcctttccctctttcttgtgctcctctcgcctttgttgcctcctccggccttctcctctctgcgccgtcgtgccgtcttcgtctgccgcgctgcgtcttttccttcttttctgtctccttgtttcttgtttggttgggctttttgcggttcccccgtcaacagtcgtgcgtgtctgcggggttttctctggtntgtgtgttctctngctggccaacagcggtggtgagtcccccctcacgctttttctttttgcgttcttcgtgttggtgctgccgcctgttcggtctttt

SEQ ID NO: 11798 - DNA, 1224 bp, Homo sapiens
  misc_feature (1)...(1224): n = A,T,C or G
atgtaatcttccttagcattgctcatgctatatgactacttgccagctacccgtcttcaacgntatattattaatagctgtacttcggtgcttagaatggtggacatcgctgcttacgtctatactctcttgtgactctatcgcatgtccggctctaccatggagtgagtgatctgggaatactgcctccttcattcacgagagtntgagagtggtgtatgtaagcgtgcgtacggtgtngctaactctcacctaggcagcggtaatctgtagctgccacgcatggtgctacgccggcgaacgacgacgtggcagctctgaatcgacgtgtgataagatattctcgctcgttgtgcccatctcttatttaagctctgctgccttcgcgatgcgtcacgtcgtgtacgtatgcagtcctatacggagtcggacgcggcgcgttgcgatatccgtcatgtagcatcggatggggcggaggtaaggagtctgactggtgctaacattgcgtggtggtggcgctgctcggagggcgttttagaggataggagatagggatctgcgcgtctctcgtagtctctcagtcgtcgcaacaccctgttcgcgatatcatacgtaaccttacctatcctgtctgcgctggctcatacttcactcgcgcgcgctgcatgcaacttattttatctctacgatgtgcactcgctctacgctcaatactactctgatcgcggcaatatacttctctgtggagttgtagttggtgtcggcggtacgatctatgtacatcttatcgctattcttggtcccactcgcgagacgtttacatcaggtcgaagaataccgcacaaacactctcatataactttatttacctactctccctgtcgaaaatatgtaaactatatagataaattataaatttaagtcttcgtattatgtgcattcgtttcggttagcactgcatatattactacgatatcaacagcacaacgtggagagcacgattcctcatccccttactctcattttttctctctctctctctcacaccttgccctacncaancacttaccagacccactcacnccacctctctggtttccnntcttctctaaaattattttatttttttgtttntcttttttaaaatttttttcttttttttcattttttaacaacaccacaaccacccaaaaaccncctaacaaaaacaaaataatcacttat

SEQ ID NO: 11799 - DNA, 1331 bp, Homo sapiens
  misc_feature (1)...(1331): n = A,T,C or G
gagctcagtctctccgtacctgtacaagccgtnnatctgtgtgttctncgacgtgtcngcgtgcgcgtggctccgncagtacataggaatagtaatcgacaggcgagatgctcancacgatgatgtacagcattgtacacatctatgactgtagctatgtgtacacgtagagttactgcagatanactgcatcaacagatacgcctagactcatggtatacacctcagactgcgagtcctagccagtagtgtcatctgtacgctagtacaccgatgcaacccccaacccagctatcgcccacttccaacccggcgcccctaccccgcttcccccactgaattgtgtctttcgctcttcattttagtataacataaactatgccaaggcacatttgaatgaagttatatactctcaactattcagttacgaatagtggtacattgtatagttctagcacccaagcgacgcactcgtantacttcggatacacgtgtagtaacgatgaacatgcttgcgcggtacccacctagaccaccgcgcacccactacgagcatgaatcctatttcatcgctcctatccaccccgcgctccgagagactcttgctactcacacacgatacgtctcgctgccacagacacccgaactcgcccgccgcaacaacattaacgataagtattacgncataatacctcgaanactgtacgatatacgtatggtgaaggagcngtacaactagatacttagcgagttaactgtcgcgcgatcgagctactcgtacagatctattctattcttagtggcgtccnatcgttcgcgcgcggctgctggcgctcgatttcactatattaaatcacgcaacgacaagtactattatgattcgaccgctcccgtctcaccgttcgcacacactactcgcgaatgcgcatgcatcttgtctnccgtcgatgtgagaatactcgtccacgatgtcgaattctcgtatgaacacacgttattgtcaacatgacacacttgttgcgtgctacgcgcgcacacgtataggccgcaccaaagccgaatggatatatagcagatccggaagtgtatgatccgctctcttacctttaatgagcctacgttcactctaccccctcccaccagactaataataaatgcacctccactcacttgatacgtaacaccgctattcacacacttctcatagctattacgctaccgtagtatcgtacagacaacaagggccctttgcatataataccgagtatacaccacgcaagagtaacacagtcaccacgaacacgccacgccttgacgttcgtcggtttact

SEQ ID NO: 11800 - DNA, 1315 bp, Homo sapiens
  misc_feature (1)...(1315): n = A,T,C or G
gtgnaggatgctgagcagtcgggacgtcgaaacagcgagtaaggggtggtctagtgacaatccgcagttgtcctatgcgtctcgctgcgtgtgtgttgctgncgtctcgagatgagcgggcgatggcggacacacatacataatgatatctggcggtcgtggatgaggcgagagagcgagagcggatgctatggagtaagagagaggtgtgacgaggccgcgtgtcgctgcaccgagcgtggcagtatggagagtatagagactgcgagtgcatagttgcnggtnaggtcggcgtcgctgtgcagccgtcgtcactagatatacgtgcgtgctgctcggcgcgagggccgtagactgcggatcggcacgatccgctgcgagtgtgctgctgcagagagtgggtacactgacgtacgatggcgagtgtaccccgtgtcgatcggtgtcggccagatacatcgcagtgtngacatacagagcgcaagagtcgtactaggtggctgggctcgctgtgctggtgagcccgtgtgttgacacgcataagtatattcggcagtcctgcagacaagtgtcaacatcacaagacacgaccgagacaccctacgcacgtcgtgccnccttaagagggaggaaaggagcggagatttctggtcgtagagtgcgacctgtctacatctggcgttagtagtagcggctctcgtttgatttgtaaataggatcgtgtcgaagcagaactgaatgtaacctcttatctcgttgaaatatagcgcttaatccactcatctatatggtctcagtatctttttgaagaggataagaggtctgtgaggacagctcgaacgcacgtcggcacagtgcaggctaggggcgcgcgagacagggcgggtgatgtggaagcgtgtggtcacttcgagcaccgcgggccgaaacgggccgtacgacagagatcgagtcaccgagaccgatctcacggcagcacacagagctgttgacagttggtgacgggcaggtgcgggtcggacgcggaggactcaggaaccagaacgggtgaagagagggggcgaatagggatagagaggtctatgcgcgtcgctgcgtggtacgagcaggctctactgcaattccgttcactagcgtgcatgtgtacgctgcggcatcagcatcgaggtacagtggcggggatggatagcgtgatgtctgtgtagatccgtcgctccgagtagcagcgggcattgtgaggaacagcggctcttggtgcgagggacgtaggatagctgtagcccgcggcaggcgctcctgtccgacctaccgacat

SEQ ID NO: 11801 - DNA, 1594 bp, Homo sapiens
  misc_feature (1)...(1594): n = A,T,C or G
cgtcacctcgagccgcgctctcggtagcctcgtattggtactagatgggtctgtgcgtcgactgctcacatataatgtgtgtggtcgcgcanctcagaataagatccgtaaccagctatcggaccactctcaggcgcgctctacacctgcgcgtncgaccctctcgttaatcgtccatctgtccatgatactccgcgtgagccgcgcacatcgagcgctctgactccattaatantctcgtactcatgacgcacgtttctctgtattncgacgatntggtgtcgccatgattcgactcctactgctagtcccgcgggacgcgagtgatagcgacacaganattnacacatctcgagacacgatctcgcgtnatctgagtcttacagccgcgacgccctccgcagctatacgacgttagcatggttctacacggngatgccctctagttgcgtattcttctataatatgttgacagcccgtcccgcgatccnacgctccgctctntcattccatcncacacgtcctgtgacttagttgtatacgtgtatatagtngatcacgatctcgatgtgcacctctactatcntcgtcattcgtatcatgactccactctcatcaactcgtgccttccatgctgtgtgtcacgtgttatattacacgtgactcacgatcactgctatgatctctgcgtatcgtcttagtacatacacattgacgtgacgacgtcgcgccgatcgagagcacacgacgctctaagaacgtatgtgtgctcgcgttcgatgtactctattctacagtatatatgctgtgntggtgtctcgtccctcctctctctctatactatcgcaggtatatagtggtacatcgacgctcgtgactcactcacgagtacacgctcatcgcnacgcttacacactgctatnactcctcatacacgtatggcgctcacacacgctctcgtcgtgcagaatggtatgcatagtcgtctcgagtatgtgagctagttcattgatcaaacagcacgcaacgctgagacgtacgatgtctgctcactacgactgaactacgtcaggctggcacagtcatgctagagtgatgtcagcctcgactantgcagctattcgcgcncggctccgntcgtcgcgctgatgcgtctacncgactngcatgcgcgtgtacacgcnatctacagccgattgatgctcctatagactagagtacataatagtcacgccactacgccgcagtcagcgcgcagtcgtcatctgatacagtttgacatatctattcgncctgtagcgaccgcntcgtactgtgnttcgtgtacgcnacttcgcncgtcgcgntggacgtcggagtgtgantactagtgcgcagttncttacagcngtcactantctacatgtgactgtctggtactggtcngtagcctctcgtcgagtcttgagtntacactgntcgctcgtatagtgctcgtcctnanatagacacgtccgcgtatcgcggacgtcgcgtgtcgtgctacgtcgtccgtctctatgctgccacatctattactcacatacgacgggntgctgtgcggtactggtggagg

SEQ ID NO: 11802 - DNA, 1680 bp, Homo sapiens
  misc_feature (1)...(1680): n = A,T,C or G
tgaatacgagtcgtatgtagtatatgatagtggttgcagtatattggtngagtgatataaggagtatatgatggagtgtatgtgtgtgtggtgctggtcgagcagntggtaatgtatgagctgcgcantttctatcgtctacattacacacaaancacaacntacagacacatggngtgtgtgcgtgcatcgcagacgntcagngnacgccagtcatatgtcgtatgacatganggtacgaatatcagagtacngaacacgtatagacagatngactgcgtcatagcagagaattnatgaggagtcgagattggagcatactgagcgctgtctcgggatacgtgttcacntgaatcatactcgctacatcgtgataatacagatcatacagattaaatattatgtatacagtagtagataatcgcgatatagagagtacgactgtgcctcctctgcacaggcgcgtgagtacgtaagtctctactgactataatactcctcatcccaaataccaatcaccacttactctcgtgcacctaactatgtacactgtagatacctcgagcggggctcctcgcactagtacgcgtgtatgttagttggtcgctgcgctaatgacgatggcgcgacgaaagggacgtagaggcagagagagttagtgcgcgtatataaacacaatccacatcattagaatatgaccatatatgagagattcatgtatcagtactagcgaggatgtangtcgagnagngtattaccatagagatacgttacgagggtagtcggcgagcgcgcgagtgggagctagcgtacatgctcgccgggattagtagcgtagacgtacatactcactcgcattatgtgaacgacgctactgcgcgacctcggacgatangtcaatntaatcactgcagtagcgcgtctacgacgcatactgcgcgcacgcacgcgcgacaacgagtgctcgtacgntagactatcatcactatgatagatctgtatacaccacgtgaccgtgagcgancgacacagatactcgacgacgatagatgactatacncatagtgactctgtacatcatcatgacatganaatgagctaattatgaactantatgtagtctacanttctgatcanagactatgagcgcatgctacctgactgacaggcgacatattacggcgaacgacgcacacgacgaggactcgaggacgcacagagatcgtgagctnacgcancattagtagcgctgtgantcgatacttntgggagacgaggacactgtagctatgctagtctcgtaactctgccctgactcgtcatgcgatcagcgatnagcacaactcactctgtcatgancnacatatagactcggtccatactctgtaagtcccatctantnatagaatggtacagncagcatgagtagtagtagagcggacacanagacatagtcgagttgagatgctgacgcgtactgtagtagagcatacagatagactgnctgctgctacacngatgtnatatgatagacatgncagcaggcagccattctcgcagcagcgagatacatagcattacgtgtcgaaaactactacctcacaccatatagcgatcacgatatagtacacatactctgtgatcanaatcagacatacgacgacagacgacacacaaaaa

SEQ ID NO: 11803 - DNA, 1610 bp, Homo sapiens
  misc_feature (1)...(1610): n = A,T,C or G
tgtgtactggatgtgtgacggacagtctgctggcgcgcgtagctacctggtcttgtcagtncgcactgcgcggagcgagtactgtgatgtagcaggccagacgcgaccgtcgtgcgtcttcgagtcggctgccatgtgttatcgacgtgtcgcgagagttggagncttcagtgctagctgttgacaactgcgtgatagtcactgagtctcacatcgactcgagcagttagacgcgatattcagtgaggatatggttggtccgagtaccagtcgtcacagtgagtggtatgcgatagtaatctatcttcagggaggagggtaaagatgtctacgagtacgancaagagaactacagaagcaaagcaaagtgaggacgtattaagaatgcatacgtaagcgtccacacagtgcgtcngcttgtgtcatatgactgatcacgtacgaattgcacacgcgtgtcgtcgtatctgagtaggtgtgatggacagtgtacgtgtgatatactcagaggtcaagggtcgcagccacgccgctacggacagatacacagccgacaattatatacgntggatgagaagtagagtatgagagttagggaatcaggtgtcacgcgtggctgcggnatgttatgatgcatgcatgtactncgcgcgtactagtgaacgcgctacgatccctacagagctcagataacgagaatgatcagtgttggagatgcgtactgggactgtagtgtagatactgactgctcgtaggtctgantgcgaattacgtgacgctgcgcgctgtagtacgtgacaggagtgtntgagtctggtatgtgcatgtatgtagatcgagnagagcaatactgctcttatggtactgnatgcatgttaagtgtacacgcaccgcatcgtgccctagaccatcgagacgtgatacggagacagtcgtaccatatgtcgccgtgtgcgcgctnagtgcgcgtataatactcanctgaattatgttgtactatttacattgactcgcgctactataatgatctgacgtcatgtctttatcgacagaggagcatctctgaacagctatggtgactaaataccgacgcgcgccgatcagagagagatcgccgtattatcagtagtagccggatctaatagtcatacgttgatacatgtatgaatagcatgatcattctactatcactcactctgacgtcgctgcgtgtcttcgtgcagtcgtggcttggctgctcagtatgctcgaatgagtgccgcgcatgnacatatcgtgtgtatgaatagatgcgaacgggtcgaggcgcacagcgcggcctgtgatagataggactgcatcatacgagcagctccgagtatattttatatagcatgcaatggtgacgagagngagcagagagtggaatataggcgtggtacttatatgccggtcgattcgcancacgacaacgtacagacgtagggaaggagagtactaggagtgggtttaagagtatacgaaagcanaagcactacgcacgacactctcgagacctggtcactcccacatatgagagttgtantgctggtcagagcgtccggagcgcagatgcgtagcggccgacgctg

SEQ ID NO: 11804 - DNA, 2264 bp, Homo sapiens
  misc_feature (1)...(2264): n = A,T,C or G
catcgtgcattagncagactgaagtnacatctactagnactnatgctaanatcgatgagnacancctacgactactactaggacatgngaacgcctacgacnacccanatagtcatnannagnantanatcactgtccngactgggnacntantanntntcngtnctccgtcacgatcgcnatgnntcctgtgcatgcntnactaatncgcacaatcagtnggtnanggtcgtcnnctganttnntgcctacagngcntcgatacgatnnannaatacatncannccgtacatctnaacntnccattaaatcatgttatttacggtgatctgcttcgggantggtaccgnaagttagtcgtnngacgctgtcgtnttganngncgangtacgtntgcgtcgngtcgnctggtcgtacatcagactggactnnctcgcagtatgntactatcagttagntgaatganngatnaggttngntcgctncnntnaggtgntactnatcgantcanganctgtnatncttcagtancttagangtcttatgacgnacntgaccangacnnactgacnatnctgcagcatncttcngcngatgcagcagtcagccgactnatcgacatacctagcnatccaggtacagactactgctatagtagctatctaccgtcatatcancgagtcgatgnacntcantttactacncnagcactgatcgatcgagngactancaccangtcatcgncantnntcttcngtgcagctgagtcacntcncatgtatcgatcantannancatcgcngcnggcatcgtncngtcttagtanctncttcgcagacgacgtgangtcggtgtcgatnatcgaattaacgacagcacngntcagtngtnacggancgcacgtncacatancatcaggagcancgtnacgacgtnncgnctgttcgtgtcctgctgtcgctgntaccgcgatcacatatcgctagtatcgatacagtctgcatcacatcgctatagtgtgcaggagtgtagtgttcgttngtgtntgtngagcgtngngtngangntggatgtcgtgctgcagtatgtgtcngatgatctgcagcgtcgtcagncntcctgacgtncnacgagctacgcgacgtggacgcacgtcgncagcacgaccancgctcgcgcagtgcgtgtatcgtcgactgctcgtcacatcgtcanagtcgtatagagcntgcgttgcacacnacgagcgctagtagngagacatacgttagagacatanacacgtaccacagcagtgatagtatatagtgctgcagcagtcagctaacgacatatacactactntntncatcatatataaatgacgagatagtgacgcgngcacgcgtcgatctggtgcntaccgtgacggcgtatctcatgcgttgtnggcgtgcggctagtgctatcacgcactgatctcgctctcgctgctctgtgctagtgtgnggactgtcgtgctcgcttgcgagctgtgtctgcagtacgtgtntcgatagaaaatgctacaaagatgtagtcgctcacattgcgcgtagacgagcgtcgtcgcgaggcacacaagatctagttcgcctgcatatcatgtccatatatgttactgagtntgtgactatnagcgcgtgtacgtcgtgcaccgagctctgacatcacacgacgacaccgacgtacattggatctacgtgtgtacantcattcgtacgatgngcgtgagactgcantangtgctccgcngtcgcgtcgtagtgagtgtctcgtagtcatntcacgttgtccgtgagtctgcgtgtcttatagctctcgcatgttctcctactctacttgtcgtcgctagggtcgcgtagancgtgagacgcncgctgtcgattgactgctatcctctacgcgctgtgcctatcgcgngctcgatgtcctatgaacacactcgcgcacgccacgcagtgggtgcatcgcanaagccgtgcctctatagtcggactatacgctaatatcattaactgcactacctcnctattatgcaatcgtcatatacttcgttgtttgacgatcaatgcgtgtgacgcgcgatatcgcggtgtngatgatacgcgacgcggctgccgagaagtgtagcgtacagtctgcgttctcctaagttnaagtgacacggaatacgccgaagtggtcagtctgtcatcacgtcacgagcnctccatgacctgttcggantcgaactatagacgcta

SEQ ID NO: 11805 - DNA, 682 bp, Homo sapiens
ccttcgccttcgccagcactcaggtggggcgggggcgtcggaatggttcttttgctttcgtgaatggcccggaccaagagaggccgtgccttatttttctatgttggcagtgattatatgtggggggcctcgttttcttggtggtgttctacggtcccacacgtagtccaggagagccatgttggaactgacccaatcggcgtgatggttttcaccctcagggcagatgtcaagtgctgggggccactacagcccctgatcttttggctcccgcattgattagcgccagggagattggataggaacattgattttagcctgcccgatctagagggtcggtccctcatttttaagattcccgctcgttcaatgagtgttgaaagagacatcagttttgaactgttagcccgtctgttgtccgcatagcactggtgctgagattataagcgtctgcacacaggctggtatgtttgccatcagagcacggcgaaaaattgcttccgagaaggatttcttggaagctgtaaataaggtctttaagttttatgcacaattcagtgcccctctccgttacatgacatgcatctgaaccctgaaggctttcttagtgaatcttttaaattggtttcctttcctttttatattcttgttaataaccaattcataaacaaataaatggatt

SEQ ID NO: 11806 - DNA, 1392 bp, Homo sapiens
  misc_feature (1)...(1392): n = A,T,C or G
gtgcgggctggccgctcgtctcggcacggccgttctgagtccttccctccacttgtttttgacttttctctttctgtgggcgggcccgtggtggtggtctgcggagttccgcccaccatccggatttgatggtccaaacccaacgcctacatatttacttatccttatacgttcgttcctattgtaatatgtccgaaccctactcccgattcgttcctctcctcaaaccccactcaggcggcatcgcgtgtgaacagtctctattnatacatgcttttcgtatataacaatctctattacgcaccctaggtgcctncgcgtctgctcgagttcgtatttaagggttttacaatatagtgtgtggggcttgtattgctcttgtgctctacattcctgcccggcatctatgtagtatatagtacacagactacgcgaaggcgatgcgcgacatatcagtgtgtgtttatagtgcgaagagtcgagatgtcttcgatatctgacgtgcagcagtacatacgcagatgagaacgaggatgtcatgtactactgtatatcacatcactttacctcagagtggtgtatgctggagatgatgtatagcgactgtaggggcgcagacttggatatagcagtagacatgtggactatccacgtcgtctgatgtgtagatatggtgcgcgccgacaatagcacgatgcgcagatgtaacactcagctatactctgcgctgcgcgcagccgccgtccgcctctaagtgcggcagcgcgacctatgactcatcgtagcgcacgccgtcttcgattcgttactctacatcttgcgttgtcgtgtagtgtactcacctctggtaaatatatatcgtcgctggtggtagcggtatcgtgggttactcgctgtgtcgctacgctactacgattactnctactagtatagtctcatcccgttacgtattctgcctgtgtgtcgagctactcacatatctgtatctaatncggtcactatggtatatgtgcgagacatcatcatatacacctgatgangtgactccgatnactgatgggcacgtctgacggctctgcccgcanctgctgttgtgtggtttgtgtaggccgtactatcgtcgatctatgtactagagnaactgccgcacaatactacgcctcttgtcactatttactggtactgtgtncgtcttaatatcatccgatctatcttgcataatcgttcatactcagtcatctcatctatactctnctctcacgcgtgagcatccactactgcgctgtaaatccctctatctgatatctagntagtctanactgcaccacggtaantatattcacgaccataaccaagcaccagatgactatctcgctatntatgtcatcnctg

SEQ ID NO: 11807 - DNA, 1800 bp, Homo sapiens
  misc_feature (1)...(1800): n = A,T,C or G
gctgtgagatgattagtggaagacggcacgtcgaagtggctcatgacacagagcagggtccgatagcgacacacgcacgtggcnacaagagagatgaaggcaccgnttcgtagaaagcctacacatgaggcgaacgtcattaggtganatcactgcaaacagacgacaacgagtgagncaaggaccgacactccaggcaaccggnanaagaggaccngacatatatatcaagaatcagacgcgtcctaagtgtacgcatgcgagcacngtcnttatgatccgcactcatcatctctgatctctctcagacgaactcncatatgagagcgtagtatatcacacatcgtccgcccntacgcagtgatgtantaatgatatgaatgtngtaatcgtggtagactgaagaatatatgtcantaccatgtcgcacgcacgtcgcaggcgcgctctcacacacctgcctcaacaagctgctcgcgacancgagactggttagatacacatacgccacactcctcgatcacacccatccatgccagtcgcgtcttctgaccggcatatctgatgaggctntaagcatgtgcgcgcacgagcgaactgagagagncatcacggcctctccctaccacccatcaatgtaagatatatagttgtaggtgttcattacnttaaacattctgcgactcaacacctgcagagctcatcagtcagtgctcaccctctgcgtcccccgcacgcccgcactgacgacaccgagacatatataccaccncgtcngcacatcataactcacagcgacctctgataagagacctgcagncgcnccaacgtgtatcgtgccgtgagtcgtagtacacagnctccgtgcgcgcttccgtcagcgcaacgatacactccgcgacagctgtgagtgccacagatggtagntgcgcnactntcgttagtagtcatgatggtataccattcgcgcatgacagancacatcagatcgcatgctgtaagtgcgcgaaganatagtnataatgtcncnacgacgattccgtgctcatccactgnatgagcgcgacntcanatgacgtgacactggcgcaacaactctgtactcgagtcntactncgcaccncgcgctctcctcactcgtctatgcacacgcctcncntatcacgatgtgtgtcacgtagtagattnctatcctatcatctgtacaccgctgccgctcgctgactctgtatacgtagcacactcngctaggagcagatngtctactgccgttctcacatctgtctcgaggtgggatgcngcgcgacganggcgcgaagagacgctgagcgcgacgactcaatgtcagcgagcgcggtcaactacagctgatgtagccacagagtagtagcangacgacnttcgacgtcacaagagaattgtgacnacatacgtatacgactgtcgcgctgtgagccgactcgatgggtatatctatgtntnatagatgcntcgcataagtagagagcagagcataggagtatacnatcgagtaactcactctcgacgaacaactaacacagtccgaatgacccnacgcaccgagatacgacnccagccacancacacccgcagaacacgatgcgcacacgtcacacaacagaccaccnacatcgcnacgtacatcaatccgactcccncgcaccgccgcacacacacacgcgaggccgctgcctacacanctctctctgtcancacacatagtgtcgatctctatacatacatagacagttgaccctcgcatacgtattatatcactag

SEQ ID NO: 11808 - DNA, 973 bp, Homo sapiens
  misc_feature (1)...(973): n = A,T,C or G
gggaagacgcagacgacccagcgacaagcaagaagccncaaaaaaacccttagagcaaacgnagcacacnnctgnagagggggaaccgaaaancaggcacgagggaggggcgcccgagcagcttagaaggagcagagaaacccaggcggcgaccacaagaaaccaggcaccgagaacacgcgcggcaccacgcgaccagaccccaggaggacaagagcacgcacaagacgagaaccagcagcacaccggccccagggacggcccaaggccgaacggcacaaggccagaacaggcgctctcttcggacgccccgcggacgccccaacacccgagccaaagcgcgccagcgaccgaacaaccgacagccagcggaaaccggcagcacggacgcgagaccaggagcggcacgggaccaacgcaacacaaaaagcggcgcgccaccacaccgcacccgacacccgggccacaacacaccccacccgcgccaccggcccacccgcgggcccacccgcagaaggcgggcaccgcaggagggcgcagacacacccccccccgaagccgccgcagccaacaaacccaggagcccgagcaccacacagagaccgaccgccccgacgcccccagccccagngcgagccacccacaccagccacaaccagcagagaacacgcaccgcacgcaaagcgacaccggacccacgacacccgaacaacgaagaagaaacgcccgcggccacgcagagcggaggaacggaccgcacgaaccccgcgcaagagacagccgcgcgcccgccccccaggcaacccgacgaccagaacccccccaagacaagaccaccgcgcggaccaaaacagccggccccccggaacgaggcgcaccacccgcccaccacacgcgcaacggcgcccacacgccaccgncacaccacgagcaggacgacaaagccagacgacgcaaaacccacgggagcccg

SEQ ID NO: 11809 - DNA, 902 bp, Homo sapiens
  misc_feature (1)...(902): n = A,T,C or G
ggcccgtacaagagacgtagcccacgtaacaatccaccctnnntnnaancaccttgtgagccnactnnagcacacgccttcncacggctggaaccgaaaaccatgcctatggagggacccgccggaacccagaacaaacagagaaaggaggcggccatccatgaaaccagcacttgagaagactgcatcagcagttccagctccatgattacaagctcctcgaagacatgaaccagatcacacctctcctgtgtggctaacgccaactgcacatgtagaacggtgtttcttctatgcttgggacaaataaatctcacacacccccatataaaaaaaaaaagacacaagcacgagagaccaccgcaccccacaagacaaactaatcccccacccgaccccacaaagaacacgtacccccacaccccgctcccggccatagccgacttccgcccaaacggcgaccggcgccgaacgcccgccccgcgtgcgccgcccacccgacatcgagggggtgcgccgcccggcataccagtacaccccatcaccagcggcccaaccctggcacatacgtgtacacagacgggcgccgccgaagaccccgccgccgcaactctggcccgcgtgtaccaccagaccgcccgccccggccaaaaggggggacatagcagaggtacgtcatcaataggtaccaaacctataagtatcccgccacccctatgacgcacgtacacaggaataagaaggcccacacgagcgcacacgcgcaaatgagtgtgcgcgaccctcccaggtggactcaaagaaaacgccaccatcgccctcgagccgccacagccacggtcgctgaccgcgaactcccccaccccgccaaacaacactacacnacaaccacccctgaaccc

SEQ ID NO: 11810 - DNA, 1820 bp, Homo sapiens
  misc_feature (1)...(1820): n = A,T,C or G
cgtgactatacagtactnttccactcgtcactcgtcctcnacgcgctatattacnnacatacgtgncgtccgcgcgtcgcgtatggacgactatatnggatcgatgcganggngntgtgtgatagacagcgcgtcatccgcaggatcaacccatacgcatcgtgagcgatcggtagaggcgtagtgcgtgcaatcgtgtatagggtgcgcgcgagagcgtgcagcattgactagtgtgtatcgctcantgcgcgtcctcntgtntgacgcatcgtagactngcgtttgtgcgacgagcgatgngctgactgacgctggcacgttcttgcatagctnagtnnnccacggacgtgctgacggacgtgctagtcgtgcgnatatgacactgntcacgtcgtanctgnancgacncactttatcactgagccgtcgatatatctcgtcagcctgacgncgtgagcactgacgtggtgcgtnnannactgcctgcngacgcgcgcgtgctgttgncntagctgntctcgctgcatatcgcgcccgcgtcgtgtacgcgtgctcgacgcgtccgtgcagcgtagcggcgtggagtatctctgccatcgtcctcgcacctgtcggctgtcagcgcgctcatcatacgctcancncctgtctgcggcgagcgcgccgcagagcatgtgagacgtactcgatgtggactgtgtgtatgctggatctcgcgtgtcgtggtccgttnggtctncntgagtgctagcgggtcgngncgngtcgngcgcgtccatgcgtcancccgtcgcgcttntacgtgtctgtcgancttcttatctacacgcagcactgcncggactcatatcgcacccactnaanattactanatcatacatcatcgtactgtctnactatatcttatgtatntacatactcttaccatatatatatctacatatgcgagtggcgatatacacacatgacgagagctcgacgcgcgcatgcgagatgcgcatgcagtcccacgngagacacnaacttaccctgttagcgaccgtcgtgcggcatgcttgtgcacttctgcgctggcgtgatncgccgtgacactatacacgtctntgcactccgtantacataccgagtggtncgngaggcgggtgtgcgcgnctgtcgctgacggcgctcacgctcgtcttctcgctgctcctgcactgtcactacacgtgcattcgctctactcgcgaacacgtctgcgcggcttcgtgctgcnctcctctacncgcgagtctcgtagtntgncttctgtntgctcgtctatactccgtatccaacaacacacacagaatatatgctatatatagtgcaaatattcgtcgtcgtccgatctcctgtgtctgttcgtcctntctcagtgtctccgtacgtgtagtgacgcggnctctaccgctgcgcgtgtcgctgctgctagccctgcacatcgagcaatcactcggctgcgactgcgccggcggctgcggcgcatgtgtctctnnttcttntcaatcnataccatctcaccacntcatcgtcacactatctcagcatcacaccactcaacctacacctactattatatattcnattcttcactacttactattctncagggttactntctaaccncntctcaagaacntccatnntctttcaatctctgatttatcttctatnncaagggattattttactatatctattacattatctcctcatatctcatactccactactacaccacctatctctactctctactctctcatctctctctnancttctctacatcctctact

SEQ ID NO: 11811 - DNA, 1416 bp, Homo sapiens
  misc_feature (1)...(1416): n = A,T,C or G
agagatgattgggtgtggtgccatgtatgaatgtaggtgtatgtcccagtcgttnaaatacttaggctgtaagttagtgaaaggggtgagagagagagtgtgtcatgtgtattcaagtggtccaaactgtcaagagggcggaggnagatagagaatgaccgtatagtgaccgagaagaggctactctcntttacatagtaccgtgtcatatacctagtacgagggtctcctcgagatctcgatgacgatggtcatgatttctgttcgcctattcatgttctacgagacgtagagtgtccaataataccccaccccggcgtaccacactgtaaagtgttggtgcattactcgattagttcttctatatgctacacatacgtctcaagctggtttcttacgcgcgcagataaggcgcagtacgcattactaaatatgcatgactcttacatcacggagcgaggtcgcgtgcgacatcacttgaaacgacctnctacaccagacggtctatatgtaacatggaacgagcaggacgcagtgcgacgaagcgtctccaacatctatgactacgcttctcgtgtacgagtaagggcgtgagttatcaaatgatccattctcttgtattgcgcctctagtctcctactctgtcccgctgcctgctctgactgagtcagctccgtatcagaaccgtggcggcacgacaatggatgtcgtacggcagcgccccagaccacaggtaaccaccgtgtatcggtccacttgcatcgatgaccaccgtgcagcggacagatcaaacgcgcggcagtagattacgagatcatctagtgtnccgcgncacccacactcgcncctnttccgctcgacctatatgcctacgatggacncacacgacgtctctgtacgcgcccgagactggcatagaatatgtgtgtgatgccactgcacgctctcagcgtangccgtcanaataacatataagaatatgacacatacagtaacatctgctcgagatgctctcctagtccacgagcgactcgcgcacatagtctatccatgctgaccttaccgtnctatcgcttacatgtgaattacagtgcagttatcctatgccacacatacacaccgacctcatcatatcntatagcgcgttctctgtgagtccgccatgtttacatatctactctagttagcacataccacggttgtatatgcataangctgtncttagtctaagaatcacncatacancatactgcaatggagagtacgcggataatccgcagtctcactccnctcatactccatacttatacataccctccgcatgtgcagccacacgagacgccgtgtcgctcgaaccgacactcaaagaggtatagagcacactatatgagagtcgcgcgcgagtgattaagttat

SEQ ID NO: 11812 - DNA, 1223 bp, Homo sapiens
  misc_feature (1)...(1223): n = A,T,C or G
tttaaaaacgaagannnnnnnnnnnnccncccnnnnccccctcccncccccaaaannnnnncctgcatggaaacgngnacattncctagccagattccacgactgatctatctttgctttgttaaaatgaacttcacttggctgtggtgctatccttttattcattgctaggttgtttttgcttgtactttatttgggattttcatatcaatattctcataaaagattacattgcacagctaaattgtttttaagtgccactctcactcatcttttatactaatgttattcttgcttcataaagataattcaccaaggttcactttctctgttctgaaatacttttaaactgcctaagagccatctgatccttaataatttaaaattattccaacttggaaactgttttgtgccttggatttttttatgataacctgggcttcaattttctttctgccaaataatttgggtccagaattccattttttttccaatttctttttttggagaaccctttttcttttattaaaaaagcccttttttttatcggtaattaataccatctctactataatttgcgggcccttcaccttttggcccccttcaaaccgggttggtgaaagcccttcttgccagggacccgccttttgccccttttttacatcgaaaggggcgctataaaatttccaattgaaaaaaccccttccctcttttaacctttggaaaccctcctactttggctccccctttccgggttcccagctcttccctggtccttgccccacgacctgcaagcccgcggttaatcacaacgcgctctcccacctttcaaaaaaatgggtccgcgtccaataaataacacccgggttttaatttccccaacccatcaaaatttctcccaggggggggctttttaacacgccccccgggctataacaggtaaccccccttggttcggaagtcccaataaatacgggtccccatcctctatataaaggggtccccacaggaaaaacccccttttacaacaaaagggggtcctccacaatttttgcactctggcccctacttttttttcctccccctttaaaagggtctttcccgctacacctccccttttttcatcctcataaggcttcttttcaccaataaaaatatttttcgcagtccttttttattaaatcctcaaaacaaagtgtaagggccctaaacacacccccctt

SEQ ID NO: 11813 - DNA, 2018 bp, Homo sapiens
  misc_feature (1)...(2018): n = A,T,C or G
gcgggcagtacgagaactgatgccagtctacgtgagtancactgncgtacgctncacgatatcgctgcagatgtacactgcgcaccatcgtgcttcgctaatacatatacgcagacngctcgcacatgtnaggaagnggaggtagctgatgngtgtaacgagagctcgtaganatagtcgatgtcanagtgctagtagtttgatatgcgctatcatctcactgatgtcccggtgtgctgatgcatcgctgcgtgccgcgactacttccagtagtgtatcgacggtctagcatatactcatatctaaatcnctccaactggatgactcattcactgnagcgcgcctgtgtggtctncctcactacgctgcgctcacacatcagcgaccgcatcgtcacggggtgcgctgtcgcgngcgagtagctatccgagtcagtgcgaagacgtgtcacggccgtgactgcttacagctctcggacgcgcgacgcatggcgcgccagcgctacagtggtgacatcgtcatgctgctactcacgcgcggactgtggagtcgtagctggcgcatgtgtcactctatgcactggcgacgagtgtctactacacgcgcgcgcgactcgcacaccacagcctacctcctacacacctcgccgtcgacgtatggaaatctcaagtcgtcaacgagtgctctatatctgatgatgggacatcggncacctgcgacgggcgcgngtgtctcgtgctgtcgcgactctcacggtagaagcgcgccgcgctagtccgcgaatgttccgtcgtgatttgggtcgtactgtactgtggtgtctgcatgtactgtagctgntcganactgacctgtcgttgctatgatcgagacagaacgcaggagtccatcatgcacgnagcagcantnacgatgacgtcgcacacgnatcatccacgtcggtcgtngngntcgtgagcgcgccantcgcgtctctactcgtctggcgactctagatcgtgtgtgagtngncagcgtgccgcngangntatatccggatggacgaggagcacaatcgctatgtacnagcgcgncgnaccnagagcgcgggtgcatgacctacgagactgctgatgtgagatatcnagagtgnatnatgagtcgcaatgctanctgagatgatcagatgagttcgtgcagctcagtcacngctctgtcgncgcgacgatcncacgctgnatngtcgcantnanngtagctcgcactgcntactccgtctctcatcatntcaangngangcnntcacttcngnacgtcagcacgcatcaacggcatctgcctgcattctgcngntcnaccatctgagtcgctgcagcngcgcatcatgcgcngantcncatactcacangtcatatcgtacgctgctcacagntaganatgtgatgtganatctgagacgtgtcgagatatatntanaatcatagttagntcacagctgacntanatacagctgctatctgagntgtacgtgagcagctcnctgctagatatnccgttantcttngcgtacntgtagctagtgntagtatatgtatatgacacacgangcgcatngncagcatantggatgantcattgttagangagngacgagcgatcgtcgagtgngacgcgccgcagtctggagtagacagtagaccangcgtgtagctgggtagctncctgtccntactctgtattacgtataatnatactgcgattatgtcttcacatctctcctacgcaccacgcgcgtccagcctagccgncntcgctcacgaccgtcaggtcgtgtgtagtcagtgcgagcgcacaaacaanctgctaggtatgtcgactgatcntccctgcggaggnatagatagcacgacgagtcggtagnagtcanancgncgnatcgtcnaccagaagtgcantcgntcataatggtncactactcatcgnanncncttanacnanatcantgtgatgcagccgacgagtgcgtcatctgcgntgcc

SEQ ID NO: 11814 - DNA, 1248 bp, Homo sapiens
  misc_feature (1)...(1248): n = A,T,C or G
cttatgatgttaatttttgtcatttgatacgctcctagatagtgatgacatatatagttttatactgcggcggtggtgcgtggtctgggggtattagctggtaatagtatatatatttcttcttatatgtatagtgtgggtgtgagcagacncgactgtagatattgagtacatgtagaaggtaataactgttgacaggtgatgatatgactgttactntgtcttgcctttattgatagtatcgtttgtactatttataccttatctagtctactctaatgaatctactattgataaatatgatatggatattcctatcatccaacatcatcaggtattgaccctgatccaacccactcacctatcgtcatcttacgtgcatcgtaggtgcttgcgtaagactttagcgttgctcttaccgctccaagtctctatctatgactttcaccgcacagactataactttgatcggtgtatagtattgttatgaagcatgcaggcgtgcatgagggaggtggtatgtgtatagtgtagtcgttttaggtagtatgtatggtgaggtggcacgatctagccactcaagtgcggacatcagagatgttatagtgtaaagatatactgtaatcatgtcgcgcagataatcatattataggatgtgatggtataatgatccgccccctgaccgtgcaggtgcccgtgactctaatatgtacaagagcgaccnaccgtaattatactatctatcgctgcgtgtatatacatgtctggtattagagtgtntcatctcgtacgtcacgtgtcatcaatctcaacaacgtactacctacataccactctatgaccgctactccactctatacactatagctctccactgaccacatcnaaacattgagttaggatatctcagacaggacgaagaatctgcgcctcacttactaagacatctcgtcgtctcaccgaccgcctgcatcatcgctcgtacgtcactctcatgnggctatagctgtatacgtcgcgcgaggacttgagccgtagatgtgactacagcgttggctcagcgagtctcttcaatctaccgtactcctgactagtgggagaggtgtctgctgccacgcgactgaaacggatatcagtactctcacccaccactctgccagtcttagctgaccacgaggaagcgaagtctgaagttgaagtgccaggcgaccatacgcgctctgcacccagtcagcagagaacaacctc

SEQ ID NO: 11815 - DNA, 1784 bp, Homo sapiens
  misc_feature (1)...(1784): n = A,T,C or G
agataattggtagtctatactaatacgctcgtgcatcatcatttaagaagatataatgacgtgacgcagctggaatatatgaacagttcatttacagatgttcagatatagctatttacatatctagtgtaaatatgtgatacaagtctcattaccacctgataagatatgtacaaaggtcaacntagcacaatccacacgccaagaggccaccacatcacgatccatcctattatacgactaagtccatgcatcaaccaagatgacccacacgagcgctcttcgatgtgaacacatgactgaggcgctatagcctcagagcccaccctcacgcgtcntccgcgaatgtaattntaatagagagatcatcacggcagctgcgcgaggatgtagctntctggtaagcntatnacattatataccntactacagataggaacgagtgtatcnctctcttgaagatanttaacagagtgcgggtcgatctgccgcacgacgcacnactatagatgagttgcacaggcgtcntaataagagagatgtagtgagtaactaatacgtacataccntcatgaacgtatatacatctcgcagagcgctctcctatcgggactagctattcgatcgtcgcactcacactcgcctgctcgacgcgcctcatactcatggcctcctaatcatcggacgatggtatagatacagtagcnntcttgcaacgattatgctacatagaagatataaacgatctcctaatctagtcgtcaacanctcactatatagatgtattgatatagtatgtgtaagacncanacactgcagtgtacagacaacactatcgcccgcgcggcgccctcatcgcccgagtcgtcgatcgantngtaatcttccagtnctnctacatatactacgccgacggacagctcgagcactcgcgagcatcgcaacgctactgctcgcaatcttacaacatgatcaccacgccanctcgcaccatagtcttcctatgtcntcctagatgagagagncactatgatgactatgcncacgatgtactccagcctagagcacactcacgngnccncancagtatcgtagcgtgctcatcgtttcagagtnacacagatgacgtacacnctcagggtgtacagatcacgntgcgcgacatatcatacgtcgtgactcggntgtactagtgcgccntcatctagagcatcacactatgtctacacgctntcgatantcgagntcagcnaggagtactnatctatctcnttcactcgtcgacagacgacgatgctctactaatatataacgagcaccacgactangactacacgatnggacacntgagtagatggcncgactagngagtatcnatgctactagatctcntagtgtcatgtgacaaatngtgacacactcgtctaatgcggtgctcgatataagcgaacgcgatcagnactagtcgnctcgntancgcagntgatagatgaactantccatagcgcngtactatcgtcatacgataanacgangtacacaggcagagacncgncagcatacgttganncnnncnntcngcactcnntaanatgaangtgntcatcagtcagtnnncncangagtaagnagagngcgnacgnagttcgtagtagtagatcatangcnagacgtgangnatgacagcagatcgncnnangctacagtagtgagaagtcatgantacatacgatgcacgatgcgacgcgcncatcgcgtcganagctgtgnctnntgntgcatag

SEQ ID NO: 11816 - DNA, 1361 bp, Homo sapiens
  misc_feature (1)...(1361): n = A,T,C or G
cgtctgaggacacgctcgcacacataacactgcgcatcacagcgtatgtactccaccgctcaccgatatggtntgctgtacttgagcttatatgcacctatgtgtactgtgtgcgtactgaactgtctacagagctgcgcatctacagagctcactggcggcagctatcgagtggatacaacagtctcatgcaccgtctgtgcgcgactaccgactctcgacgtacagctggtgaccctcctctacccagatcggcgatggaggatgcantntgttggtagagtatccgatactggaggtagtgtataatatatgctggtgaacaatattgatgtcgctgtcatgagctacgcacctagctgaccagaattgagagtagtatcgtatacatcacagataatcactattacttacgatctcaagtattaatgttatatcgccgcgcgcgcaccgacaccacacatgtcattacgcggccacacacatagacaagtacagacaggagtatgacgatcgacctctcgtgtttttagtttcgtgataccgagagctcgacgcccacagtcgcgtgcatgtgcgtcctattttcatgattctatcaggtgtatcgacatgacccactcaggggaacgtgaagttgtggtgcgcgcaggcaatatgtacggacagttggcagaggattggaacgccagacctacatatatatgtatactctccactactgcttactctctcttctctacctacgttgatatccacacgtcaacattacccatggtgcgttagaagagacgaacgacagctaacttatattccaagcacgcccctcagtgtagtttgtagcatcagcgcgtactactgtcgctcgttgtcgtgtggtgacggccgatcagaagcatgactggggtgtgctatatgtgcagctagaagggccgccatgtcaagtagtatacggtatgcgcgcgtcatacaatcgactctcgtcgtgaccagctcgcgcacaaatcgagcgtacgttcttgccacgccgttcgtaagagtatgtacgaataacgatgctcgcgcctcactgcgtacaactgtatagtcacacgatcgtcgaccaccgcaatatgcagaggcgcgcatactctcgcgacacttcactaacagctgtgacgtccgcagttngcgtnagcgagacacgttcatgatactcggcgactatactcacgtgtctgactatcggtcgcgncgctgcatatngtagtatcaacgtantgttgtgttcgccggtgtatagaagtatntccgccactggcgcctgtggagtttgtcgctgccgtcgttcatatcactccacaccgtcgttgtctgcatcg

SEQ ID NO: 11817 - DNA, 872 bp, Homo sapiens
gggggatgtgtgttgtaatgagtgagactataggggctcagaggagttacggcgaaggtggtggtaggtttggctggtttatgagtaggcgcagcgcgttgtaacactgaaagtgggggggggggacacaagcgaagtagttgagggtattgctgaggcgatatatgcagtatgcgtaacagtcccagcatatcctacaacacggcgagcctgttaccgggcagtggcgggagataggggtgatgggtcgattgagagaagaacggggggtagaggacgatgggcggcggtcgagcaccgagccatacgtccgaccccgcctcgccccgcgggcggcgggcggacaggaagagagggcccaaaagttcgccaggtgtacccccggtctcaggggctgctcgcagatctgggaggcggcgacggtgtgccctgccaattaagaaagttgtctgcgggcaggcgaagacgcgggcacagggcccggggatggggctaaggagtgtgttcgaacggttatagtcaggatgggtcaccgccgggtgggccgaacatgggtaaacaaacgtcggagtcttcgactagtaaatctaactcatcgaagggcggcggacgcggcgccccacgcctcccgtgacggggggggagatggggaagggagtgaacgggcacctcagcacttatctggctctccctcatcccgtacgggggtagaataggctaagttaggagtctcaagtaatcactcgagaatttatggaaggtcccgtcccacgtcgctgatccgtgcgctggttgttacctgtactgtgtgtgggcgggggcgagggcgtggacgtgaaggatagcgaggtgccggccttggcaagggaacg

SEQ ID NO: 11818 - DNA, 1016 bp, Homo sapiens
  misc_feature (1)...(1016): n = A,T,C or G
catctctccgctcccatcccactctttccccccctcccttcacgatcccgtcgcatgcgaactactgatagaacacgcaccactggaaacagctagaaaaaatcagatggagaatatccataaagaaacatcccttctccagcgagctgcaagatttggacatcgggtatttaaagattcacaggaaagcaaggtggagacccgagactcgccgcatacactctcttctcgtacacctatctgctctacacaccaattcgtcctgcgcctcactactcgaccgcaccatcctctaattcctagtccaccctatacgcccgattctacttcatacgtcgaatcgcccccaaccgcaccacattgatattgtattccccctatcttcgctagctctgccttccattcctctcctacgcattctaccccccttcattctcccctcccatcctatatgcttcatctcccttctcccccacgccgccctaatcaccacgatacacaagttttgttctgtctcccgctctcactcaccgcgcctttatcctgcttctctctctccccgcctcccctctctgtttaatgtatcccgcgcggcaccctctttatgctccctcccgcttctcatccacttcatactttactgcaccccgccgcttcctaccatcgtgtgatacgtttccgcttcccccgctcttcctcctctcgtttcccttccctcgcctcccctctcatccgctcgtttctctcagatcttccatcccgtcccgctcccgccgatgctccacccgctttccccctccgtcttctctcttctcctctccatcactttctcattctctctgcttttctcgcgtccttccctgcatcaccggccgntctcgcttttactctcccttgcctgtactgtcctcgcccacatgtgcgtgtgtctcgtgtattcccttctggcacttcgacgccgtatatatctttgtaatccgctgattccgtgttactcctacttgtcttcccccccg

SEQ ID NO: 11819 - DNA, 1734 bp, Homo sapiens
  misc_feature (1)...(1734): n = A,T,C or G
tganagatatatagagtgatnatatgagagatggatagtacatatgaagnaagagtaaggtaagtagaacgagagagaataggagtggcgggtgagccgagagntgactatgacgtagtgcagtatacctcattgtagatacgttatatntacacagactacttagcnanactgcgggctgcgtatgcagcaccgcgcgatataagagagtatatatcaagagtnatgtgatagcncgtccatcgtactatgtactttcgcgcgcgtgccgntgcgtgtgtncgtgcggcttccgtcatgctcgcncggctgcatccatattatnacatgtcctcacgagatagctcttaatcttactcttcttacanatcacagcttaacgattaaatcatctcagcagaancaagagtatatactatatttcatgttactacttacttgttactatgtcacntgctttattcctctntactacttactacggcagcgcgctctaggaatcgattctacgaactgattatacgtacactctgatatcataattacgatcgtgctattttattatatcagtaattgataattgcaactagcgagctgcgatactattatatggtgttagtttagaactcagagattgcatctaacttgtcgtcagtcggncgacgagatcgtatcgcacagtagtatgtacggtgtgatcgacaagaaatgacgctgcgaactgtcgtggaaantgtattagatcgcgtgcgccgcttcgactctggctgtacgctancatgcntgcgtatcgatggtggtatcgcagatcacgctatcngcatgccttacgacggcagcgagcagaacacagacgagatagatgtcacgattcgtgatagtgtntatgtgacttgtggtcacgttctgtgtngcctctctacgtcccgtcgcgattgtacgccgcatcatcttgtgtagtgagcctagagtcgagtcacacatgctggatatgtcgtagatactactncctcatcatgtcnttagataagtcttcggacagtactgcgtacacgcagatctacttcacgtgaactatctntcgnatctgtgctactcnctcgtatcgcgtgatgtatatcgacatcgangatgagtctatctgactcatctagtctcaagtagatacgnnactgctcagtcagcagaacgcangtnagcgctctataagatncgtntggtgcagtcatgncacatgcatgagtgtgacataagactgactaantaagcgatcgnttatnatatcctctactgcgtatnancgccatgtctgctgcacatnanagtagtaattagagcagacgagactacgacgagcacacgtgtgtgaggcgacttggtacntatgtcgacgactgacgtgcgtacttttggcgctggtatgtgtagttctataaggcatntactcgagagacgncgacgagtgaaatcgtaacacagatttcacgtgacgatcaggtgtgtatattgngcagtaggcgtgtgtgtcagntcgagcagcgataccggacgtcataatatatcgagcgtatgttagctgtatagcgagctcagcgangagactcggcgagacagcgcntgcgtgatcgctgtacactagtagcaagtacagctaagttagagctctaagtgagttggacngtctgctacgtcgtctcaactcagccactgagactcactacaccaccacatcag

SEQ ID NO: 11820 - DNA, 903 bp, Homo sapiens
  misc_feature (1)...(903): n = A,T,C or G
agagcatagaacgcgacatacgacgacaaaagtagaggacgagaatagactatggtgagttaagatagcgacgagatcgagtatatacgcgtagggcgggacgggcgggggcggtaaggtggtgagtggggcgcgaaccaacacgcgcggctggcaagtgcagcagagtggggacataacnacgccctctatccgcgtgacgatagggtgcaccatggcggtcgcagcggcgagaggcgtgggggacgggcagaggctcggagcggggagcagaatagataagagagggggggggaggagataataacgagcgaacgagcgggagggcacggggcaggcgaaacgcaagcaggcggctggggggggcgggaggtataacgggaggcggaggcggggaccgaggcagctcactccacaattactanacaaattaaggtcctctcactgacgtaaaaccacgcgaagaagaagacgggagggaggtgtgtgggaggagattgatagggtgcggggggcgcgggcatgggcgggcgcggggcgctagagcctcagaagataatgtatcttaaataagagacgatagttaaagtaacagcacactaagacacagtagtcgcagtcaatggctaaaacctatatactatcattaagtgtcggccacagaaagtattctggtgtatgccaatagggcctaccaaagatatgtgcttagcagcagatgtggtggtctatcgggcccgctctccggtgaatcgtcttcacacaccggattcctcaatcttccaagctccatggagacaggccctgtttctcctatgaattttctacagacatgatttttttctagctcgttttccgagttcctgcgtgtctctcagtgtgtgcgaatgctatcagtctcat

SEQ ID NO: 11821 - DNA, 1139 bp, Homo sapiens
  misc_feature (1)...(1139): n = A,T,C or G
actctctttccactccctcaactcccaccccagtgtgtgttccacctctatcacttccctccctctttccaataagctcatacagcaataaacggaaaaatcctaccagaatattcgacaatctggtgatgactcgtctggtcctcttaccctctgccctcagagcagcgaatagcaaagcgcccacacaggcaccctttngtagaattctcattgtcgccacgctagcaatgatgtgatagaggccctggattacgcctcacattccgcccccggccaacatactctcctactcattcacctactccccgcaccagtatcctcttcgatccttgccgatgggctagactcttgtcatgcacgcctcgccactcactaaaccttcatcttcgtcccctcaccgtcactaaacgctcttgtcccccacctattcgggacggattcccatctgtgcccccgccccactcttaccacatactttccacgccgcgcactccccccccttacctcaccccccctcttaccgcacactcccaccacgtctctcccttaatccgctcccaccagcacacccgacaccaagacgcttcgttaatcttgtctctctcctcccccctcctccccccactccatctatctccgctcgcatcctctcccccctctcgattcccctctctaatactctcctccgtcctccgtccataatcccatcacaccatgtttctccaacttccactcgtctccaaccccccccccctccctccctcttcctcttaccctctcgcacccacatcctctactccttaacatgactactcctcccagcccatccgtccccatcccccttccaatctcaccaccgaccctctcccctttatacccgtcccgacaatctctctcaccaccactatcctacacatcgactcccctccttaactacattaaacgactatcgcaccgcgctctcccatcacgtcagcaatcccatctcgtttattcaataagactcgcccgccgctccgtcctttcattattatatactaatccacctctagactccccccgctcctataactatattcttcacttactcacacacccttcttcctctcaccttctcatctatcgccgccgccgcg

SEQ ID NO: 11822 - DNA, 1554 bp, Homo sapiens
  misc_feature (1)...(1554): n = A,T,C or G
gtatagagttgcgagatntattngtatggcagctgacatcgtgcttacgtgcgcgtngagcctatcatactatgcttcgttgtcgtgtgcgatgctggtcgctcatgtcgcgtcacngtgctatctcgtcagagnacactgtatctataattcttcnactatcactatcaataggcggatgggtactactncagtntatatgatcgcgctctcacagagtgatgagacgactanatcacataataactatctgatnagaatacaaacatgcatagcantacacatancgacatcttanatgacaatttcactcaatcactgagcaatagctacatcattagtatcatctatgatctacttgtatntctgtaatcagattgtatctatattatgttattnctacaaatatcttcacataacacataaaccacagattgtatagactcttaatngttactatagtgatgtagcacttctcgtaccatcctcccactcatcatacgactcgataataacacataacatntctaaatacctgacgtaactacatcagatctatacntacatactatgtngcagtatacagaagggttgcgagtaacgtcgaagatcgaantgcattgatgttcactacgctcgtgcgcgtgctactagatgctgtaggacgagtangtagtctgatgtgacattagtattgtagctgtctgtgnttagagttgagatgcgtatgcatttagagtgaccatcagcgagccaggacactcttattgcgatgttcacctataccaacacgatcagcacactacggccctccgcggcctcgtcgcggctgtcagacggcctcatagtatgagtaacttcaccatccccatccccatcagatctgtgctctcctgaactctgaagcaaatcactcacntctctaccgtttagagatgttatgacgagctntgtgtctacaagtcctgangctatctgactgatagtgtacgtacagtatatttacttatttaccactcgtgttaactcactacctctcaacagagcgctgcagccaccatcaggcggcgcccgcatacaccttatagtcactcctctgttacttatgcctcactcgcactcagttgaagcgangcagtcgatataagtcagtcaccacagacagtcgacaaggtcatctcatntaatacgctaatacgtatcgacgcacttcggctatcaggagacacgagagccgcaacaacgcactagaggcgtacccgcctacgtccaccgatctgagattcatagccacagtgacacgatacgatcttcgggtcaaggacgagtagtgtataggtgagtgtcgagaaagggaggcggggcaaggacagggcctaaccagagccgcgtcatcagtcagcgtgccagcccgctgctgtcgtagagcgcgcacatgtggtcgagtccagacagctagacactacatgtcatctacatcatataaagggacgtctaatatactatgcgcacagtacgcgagtgactantgagacgacatcgctactaacagcg

SEQ ID NO: 11823 - DNA, 1086 bp, Homo sapiens
  misc_feature (1)...(1086): n = A,T,C or G
ctggtcgtctgctgtgctcgggcacggcttgtgtggccttctcgttgatatcctacgcgctgcgtggaccgacgggctctgcgaggcgggcgtgcgtgcgtgtcgcccctgagcggggcgctattcgtccgtgccgtcacgtccagcgtgctgtcccactcgtgctgctctcctactctgcggtatcgtcgcgcgcgtcccatccgtcgcgcgaccgctgtatctgccccttgactccgcggcggggcggcatgggggcgcggcctgcgctcgtgtcgccttcgcgctgcgggcggtgtggccgctgcggcgctcgttctctgtcggctgtgttgtcgtgacgcatccgtgcgcgtgcccctgcgcgtaggtcccgtcgcggcgcctcccctcgctgttatgtcgcgcgggggggtgcggttctcttccctctctctctctcgcgcccctgcctacctcctcttgtgtgctgcctgcgcgccgctgcgcggcggttcgtggccgcttcattccacgctctactcctgcgtgtgtgtgaattatctgatttacaattaaacggcaaccgtgtacggtggccctcgcgggcgggcggtcgttcgtnccgcgtggtgccgtttcgtggttcctctgtctacgcgctggcgcgttcttgcgcgttcctgtgtcctccccaccccactcatccgtgtgctggcgctgggcggtgcgggtgtttggtgtctcggtgtcgcttctccgggccgcggctgcctatgtgacgggtgtgttcttcgttaggtcttgttgtctatgtttttatgttctgtattgcccatccctcatcttcgcatcttccacctccgttcttctttctcttttttttggcctttcggcggccgcgctgtcggtcccgccgcggaggctctttggttggcctacggtgtctcattctccttgtcggcctccttcggtctcgcgctgcgtcgtttccggtgggtgggggtacccgttggcagtttgtggtcttgggtcataattaaacaaacacaataacactcccactccctccccccacctctcctaatcacaaaccccaccaaaaaa

SEQ ID NO: 11824 - DNA, 899 bp, Homo sapiens
  misc_feature (1)...(899): n = A,T,C or G
ataccccatcaaccaaaactcaaaccctattcagctctcccattcgctaatggaccaaagagagccggttagttgcttttcaggctttgaaagaaagagaattattaactcaccaaaattcccacttgattcgacatacacaacaaaattcaatgcaatctgaagcgcattctactatattcaatactcactggactgccattatcaacatgataaccaatgatccacaccatcctatcgcacaatactaccctcccctaaaattattccaccactcgcctcatactcacaccaataccccccagaatcctattccgctacatctccgaaacaacaaaaaacaaccgcatctccccccgacacattcgcaccacataataacaaataacctcctttcccaacctccccaaccccctcacacacaaaacacacaccaaaacaacttactacacctctcatttcaccatctccctccccttcatccacttctatttcttaacccactccccttttacttttactaacccacacccaaccacatcaacccccccccctacatctacaacctcctccacccccccttcccacactcactattactccatctcccccaccccccctccctattcatcactccctccctctccctcgacccctatcccctcacaagcctgaccccctcattctcacatctaacctccctacccccccccaatcncatcctaacaccctacatctcaacctcacccctacccccccaccctccaccacaccaacctccatacctttgttcatgcctaacccctcccctattactacacacatcacccctactcacgcagccacacatacttactacccccaccttgcacaatataccacaccaccctcacccaccg

SEQ ID NO: 11825 - DNA, 1751 bp, Homo sapiens
  misc_feature (1)...(1751): n = A,T,C or G
atattagtntgtatagtacatagtanatgtantgatgagcatagnngatanttagtactagntgtgacgatgtcgtgtatatgtagaagaatagactngntcaantagagtgtgttgacgngtcangntgantngtggctagctgtatcagttctatgacgaacgtatgtgtctcaatcgctactcatacactactatacacntcttgacggtctgtagangangtagantaatanttcacagttcacgcatagagactctagcangnagtgatgtactatgatancgctcgtcntctgatctctctngcacactactcgtactgaatgnantgtagtcatatgttgntgtngtgtgcatagtcagtagtacatacagtcttgatatgactncnatgacatcgttagacagcatactctatgatacgnagatacgntgaggttattagntcnctcagcgtactctctctgactngtnctgangtgtgatgctgatctcgctgtagacagttatgagcgtgtggacgtgagtgaactactactcatctcacgatgactcantatatcatacgtngtactgtatgctgcttacgcatggtgtacgccgcgccgtacgnagtgantgtgaagcgacagtgactaacatcatcattacctgatagatgggcatccggacgtcgntgaagtttagtgtagagctgcatctcactatcacagatgtcganccgatatactcccacgtagatgatatcgnagtgaggactccgttgctgcacancaagtagtgactcgtggtgctgatatagtcttcattgatcagagacggatgattacanacagtggttgacagcgatcacgctccgcggtcgcacaccaccactcacaataatgaagtactgtatttgtatagtttgtgttgtgttgatatcagagccggagcgcctggcgtgtgcgtggagacacgtcgtgttgtggtgtcgatgtncatcagcatcactcatctctatcagcncagcgcgctacggcgccacatagcgacgtcatggcggtgcgctcatgcagaaccttccaccgtcatcgatctacatctctctattcacgatcgtgacttacagacactgnctatgacgcgctgcgntctgatgacgtccacgacgtcgtncactacagatancatcctcagtcgcgntaccagcgtcgagagcgcacgtcgcgcngctntcgatcagcgacacagaagcgatctcngtcgtacntntantcnccaaccagcactgtagactgtgataacgtagtggcgacgcacacgncantgtgtagacgatcgtgagggcgtgtgcgtgtatgtataggtatgcgcatagttatagattatcgcgacgaaagaagangtgtatgagttatngngagtgactacgtancagagagttacacggacaagagcgtgagagacgtagtatgtattgatgtgatgcactatcgaatcagnagcgttgcagccggtatggcgagcgacgtgctctgctcgagcgtgcgacagctgtgagtgctagggctgngatcganagtgtcagtgcatgaccgcacgcagtacagcaagaagtacgctgtcagtagagcgactctgcagcatagacaccactcgtgaatctatcgtgtagtagtatactagtagtaacgacaatcatatttgtcactgatcagatatactctactcgcatgactactatcactgacactactacacggatc

SEQ ID NO: 11826 - DNA, 1041 bp, Homo sapiens
  misc_feature (1)...(1041): n = A,T,C or G
ttttanggtcagggcagtacgggactgcattgtgagccattgggacagctgttctgggaacataaccacgggcgactgagcaatagtcgctcactgccatatgggtagcccatcacgtaggagggactcctgagtgcgatgcacaaaagaggactcacggatgatatcgagaaagatctacactagactgaatgtttgggtaccattgtgtgtgtactgggtctggccgggcacatagaggaaggaattgttgacatttaatgacttgacaagattataatggagagcagggtcatcgattggcatatagaatgtcctggagaacgcaatgctttgactgggcgctttatatctggagttcactctatttgatgatagggggacggtctgatcgctgagcaactagactcgtatatatagaacacagatttgcatctagtaaaccgacccaccacaaaaaaacaccatggcactaaattgaactaaaccggaggagactataaggaacgataaccattaagagagggattaatacaagacaacttgatcactgactacactgcgctaccgtccataacgatgcaagccagcggtttctctctcctctcgagggcggtttgacggggacccaccgaatgaggggggaaacccatggaagccactcgccgcgcatcaaggccaacatacgggcctgggacaccgtcggaagggctgaatcactccgcccggacttggcatacccctaactcacccctgtgcaggacgtgtcaccaccccccagtatatcnccagtaaggcggcgagcactcccacacgcacttcaaacacacacatgcgtcttcaccttgaactttcccatcgtcgccgcntcctcgtcgcgcacgcacgccacctgctcgaacctccgctgcgtctgcgtccttccgcgaacgcggtggcgatgacagagtcatgctagaggtccctcatcgagaggcagcccgtatactcaatcttgctcgcgcgaccctcccctttcgcccctcacgagcgggcccgccc

SEQ ID NO: 11827 - DNA, 919 bp, Homo sapiens
  misc_feature (1)...(919): n = A,T,C or G
cgttggatctctgtgtcgtttggtagcgtccttgcgtgcgtaggtatgtggaggtgtggccgtgcgtgctctgctgccgttggtccgcggtctaagtctatttcgtgcttggggtgtgcggtccgtcgggtggtgggtggtgtctgttggggtggttgcggtcagtggtggatgtgtgcgttccgcgacgccgtcggtgctgcgagaggtgctcggtggctcgacggtcggggggtgtggggatggtgggagctggctcgcggccgttggggcggccgccggcgcggtgtgcgtcgtgggcggggcgcgaggtagccggggcgcgggggtggctcggagactgggtcggggcggcggagggggccgtggggcctgcttgtctgggcggcgcgtgggtgtccgtgtttgggtgtggggtctgtgggtgattttcttcgttttgtctctgtcgtaagtgatctctgtttccttggggcggcgccagcgctggccccccttcgcccgcgacaaagcggtttgcgcatgtcctctttcccgcgcgcggcggtgtggtgtggtcaggcggggggttgtggccgagtctccgtgttggtcatgatagcccctcgaagaattccgggtgcgcgctctccctctctccgttctgttctccttctcgcgggtacgactgtctcgtctctccttgtccgggtgttcccgcgtttggtaggtctgtggctcatgtggcgtgctccttggtggcatcgcagcagggtccacctgctctgggtccttacgacatgacactattctcagtgtcctggtagctcccttcgttgtaccatggcagctttcgagccctggttcctgccaaggnntttccttccttctctcccccacctaccacccctccacactcttcccactatctcacctcata

SEQ ID NO: 11828 - DNA, 1469 bp, Homo sapiens
  misc_feature (1)...(1469): n = A,T,C or G
accacctccgcctgtgcagtcgcggtcgtcggggcggccacgcgcggtgacgccactcgtgcggtgntgcgctacagcacgcgtgagccgtctactgcagcgactctcgtntgtctctctacgagaggcagctctctaagtgnatggcataacgagataatnacaactcacaacattcacacactcttcactccgcactacgatgctctctccatccacactagcaacatagtagagcgcccgatcgtgcgngggagcatgtagatagggacgaacantacaatgcgcacacacaagaatcaatacttacgacgtcttnanggctcgangagaccntgagcgagcaactacagaagcaccctctacacactacatgctgaagaccaatacacgagggaggagacaccgcattagagggtcnacaagactacctatactgatcaactacatcgacacaagtgcatacacatgcgatgagaagcgacggtagcgcgcggagacgtgctggagccgattacantatactgcggcagaggagagtgttgctagtcacagagtagcctcgcgtcgtcagcactgcgtctcgtccgtgtgtgttgcgacacccattggggngatagggtgatactctctccccacaccttacttctctcgactnatccttcgntactctttgacacgctcatggacattacgggcngcactctatacgatgggcggcgacgaccaacaaccacatacgatgggnccttctcgcctcctctcgtccacggctntcgtcgcgcgtcgcgcggtgttgctggtgtgtcgaggcggtgtgtggactggtcgcgtcactccctgaggagatcggatatgggcgcgcggcttccgcccnnnccactacgcggttccccgccgcctaggcccgcgaccttccgtctctctcttcctccctanacgcggccgccccatacttactaatatcaaacataaatataanaaactaaacttcaacatacccacccacaccactctcccatatannnaatactatacaataatctctacattagcgatatcggtngaatagtacctaattctctacaggcactaagaggtgtcacgtggngccaccctccgcgcctgcagcacacgctctaggtggcacgctttcttcttcctagctgagctgtgctctcgcgtganacctcctctctctnncnncctactctncaccttctctcttnnnnnnnnncctcccctcttcnnnnnnncctttccnnntgnnnnnnncnnnnnncacctnnnnncttttacnncttcnnnnnnccctccatacctnnccctctcacnnnccncccacccttncccttncccccttanctcctctnctatacctatntacacacctctctatcacaaaaaccataaaatatcattnaatntncaaacaactcttatctntattactnctacttcaccccctt

SEQ ID NO: 11829 - DNA, 1813 bp, Homo sapiens
  misc_feature (1)...(1813): n = A,T,C or G
agatttagagcattgcgtgaagtcgtcgatgatcgtgtagngcacgatgtaccgtcgtagcatcantgggcatagtgtgntgtctancccgcgctgacggtctagtgatctgtgctgnctcgactgagtctatcantcgttctctttgctatnacagcgtatatcactgcctgacggngatgctcactacgtcatatcgcatntanacactattactantantagtcgtttgctgcgcgtcgatgatcacnanatcagcgtcatacatncgttanttcatactcgntatatgcagcgcgnctcgtatcgctgatgagttagtgtagactgngtgcgctancancggacgcacangtcacatagacactacacgctcgtgctccactcacgatacgactatgacganctactgcagtgcacgcgcactcagcgncactcgtatcatactctgagcntcgagcacagnatcactatacaactcactgcagatnactanagtacntacgtacgcancgctagtcnactcgantagagctngtngtgatgactatattatgagtactagatgagtngctatcgatanatgaatccatgtgtcgcgactgatgcacgtacagagtgtacttantgcnagttacttactgtnctatgagtgtagcagtgctagtgatgatacatacanaatcactgcacgtctagcagctncactagtcgtctgctncancgtatgtacatgtacantgagncntggattatgactaacctngtatcgccatcgcatcatatgacanagatagagacagcacacgatgtcacaatcatagcagntgtgacattgtgaatgatgagctgatgntgcgcgcggtacgaacctgtcacgtcatgctatgcacttanacgtctgactgtggagcgatctctctcgtgctgntcncgtctgactctctctatcanagacactgtctcctactacttcaagatagacgcacggtctgatatactcaanctacagtagtctgaactcgaagtgtgntcacgcgtcggatcatcaacagagctcantgtagagccatcngcgtatcacgagtgcatgtctnttcntcactccacgtatcgcttantgcgctcacatgtgctactgtgacgacgactcgctagcgtgcgtacgtagacgacattacggcactgaacagcttctctatatgtttcaacaantgtgcgngcagtcgatactactgtgcgttggcngactgacgtagataatagtagatagngactgttactagcgtgcaacatgtgatggacgcgaaaggtgctagggtgatctgggtgagcacgcggtgcgctgcagggctgatgcatatggatcgacatcaacgcgtcacactaatcattgtgtgtggtagagncacgaccgcggtacagctgaggctcgcagccgtgnactaggtagtcacgccacctcgcagtgtgcgcgcgcgcggtcgatggtcgagctgacatcgtcagtccagtgcgaatgctgacacgcaacgtangatcatcacatggcagtgctacatagtacgctganactacatgagtagagtgagaagctcagatgcagacgcgtaggcataaacaaggattggctgagctgagcagcctagtggtagttaggctgagtggaaatcgacgtgggatatgagagacagtggatgagcgaacgtgtgacggtgtgcgtatagtgcgcttgcaccgatggtgtagagatagcatagacagacggaggagtagagattatctgacgctagcagagagtgcgtggagtaga

SEQ ID NO: 11830 - DNA, 1217 bp, Homo sapiens
  misc_feature (1)...(1217): n = A,T,C or G
aggaggagagcgagaggagtcgagctgcgtcgtgtgtggcccgtagacgaacggtattggcagatggcggcgtgcccaagaagggcgcgggcgtcgtgggaggcgtgnggacggagtgagcggatgtgcgatgtgattggcgggtgagaagcggtgtggacggtggagggcaggcgcgcggcgactgagtgantccgctcatgtatgatgacttatgtgtgtggaggcgagaagaggggagnggcgtcggggatgcgtggactgctgtagnnatggcgtaggcggatgggggccgtgttggcgaggagggaggggtgggcgggggacggtgtggcgggctcgcgtgacgctgagcgcggttgagtgntggtgcgagcgtcagcggctgcgtctctggcgtagcggngcgctgagagggggcgcgtcagcggacgtggagcgcgtgtgccgtgtgnatacggcgggtgcgtggcgcgcgttgcgtgtcgagagcctcacgagtcgcagggggcggcgtgaccaggagcgggtgtggggcgctatgacgacgtgagcgtgcgggtgcgactgagcccgaggacattatatcatcttcgtcatggggctgttgagaggagtgtgcgcggagtacgctgttcatgttcgtcatcatctcctngnggtgctgcagtcgcanccgaacgcgcgtaagaggtacgaagacatgggagcgcgngcgttggtgatatctgagattgccgcgggtggctggggtgcgcgggggggggcgggggagccggtggcgtgggcttggatagggaaggcgggggtgtggcggagtggtgatggaagagacggagagcggggaggaggtgggaagagactcacccccgcggggtttgatggtntctcataaccggtgttacgcctcatcgacggacgggagcggggtggttgaggcggggggcgcttcgtggtgggcgttgggggcgggaggttggggggcccgcctaaggaccaggtgaggagaggagtgaatgggaagagcaatacaagtaaggtatgtaagtgaggcaccccccctcccccaggatagggaagaaaaaaggaaaacggaggaagaagaggaacgccaatgcgcctctgttgggcctacgaagcgagtggcagcttggtgccgtgcccgcgctatctcggactcgtgcctcagctatgaagggacttcacttgaccttgac

SEQ ID NO: 11831 - DNA, 778 bp, Homo sapiens
  misc_feature (1)...(778): n = A,T,C or G
tttttggaggaaccgagtcctcaagctaatggcaacttctccccaaaaactcaaaggggaggggctcttgatgttctagggactggattaaactcctggagatcggatggcatgcttttaaccactacgctgtacagccaagactatcaaattcaccttggctggtctgagaattataaagaccactacctactcagaccttttaaactgagaagacggtcgaacttgactatctagaggaagtagaagtcgtaacaagggttccgtaggtgaactgtgatttcccattacattctctctctgtgatttattcaagcctatcatggggtcatttgcctgtgttttcactctttttgtacttctcacagnaaattgtgaaagtgtggcatgcgcagactaatagaaccataaaaccattaagctaaacttatattactgtcacagctacacatctcaatcttttaagggtggatgcacttaaatcattcacctccatatagcaaccgtgtcactcactggagcacctaagtccaacccttgccaggagntctccggaaggggaaacatcatnaaatgggaccgaatgggatccctattgactggaaacggagagggccatcacctaatggaatcccaatggaaacatcatcaatggggatcgaatggatcatcatcaattggaatctgctggaatcattggacaaaatataaacagttcgacttacgcccacagctgccactgagaattcatcaacctgctaatccaaaaaaaaaaaaa

SEQ ID NO: 11832 - DNA, 730 bp, Homo sapiens
ttgatagaggggctgtgtatggccacaccctattttttgcccccccgtaagcccaaatcccaaaaaaaaattggtaaaggtggggggtgggccattgggggcacccccggggttttacccgggtagttatttggggtggtggggcaaaaagaaaactgttttaaaattacggttttgcgataatattatttaagcctagcccggaaattcaggggtcccaaaactcaaaggttttttttttttgggggtcaggggccccccccccatgagggccaaaaactggagttttccctgagaaattttggcatatgtttatacagggtcctttgaaattccctgccccttttttaattttaacaatttgcctaaaagcccttttccaattgccttaaggatttcaagggttagaaaacccttttgcccaaaaagcccttggttttaagatttcctgaaaaaggcccgggttttttttcctgataaaaaaaggcccatccgcctttggttcaggtgaaaatcaaagggccctttaaaaccaaggattgttttttttgtttaaacccccgccccatgtttcctttaaaaaacttttttttggccccttttttgtttcatgccttgtgggggggcctaaaaaaaacaaaaattaataaaatgtggttttgcccctttaaaaaaaaaaaaaaaaaaaaaaaaaaaaaaaaaaaaaaaaaaaaaaaaaaaaaaaaaaaaa

SEQ ID NO: 11833 - DNA, 907 bp, Homo sapiens
  misc_feature (1)...(907): n = A,T,C or G
ttagatcatcttagagaaggctttccacctgtgcacagtggaacacttacagtatcctcctaacttcttttcctgactctgggctctctttctccagggtctcattctgtcatccaggctggagtgcagtgatgtgagtacggctctctgcagcctcgacctcctggactcaagtgattctcctgtctcagcctccaaagtagcctggaactacaggaatgtgccaccacacctggctaatttttgtgctttttgtaaagatgggactttgccatgttgccagactggtcttgaactcctggcctcaaacaatttgcctgccttggcttcccaaagtgttaggatttcagacatgagccaccatgccccagcctgtgncctcgaacttctactgtaaaaccaaaaatacctattttgccctttttatcttacatgtctgtggtcactctcccctatccctcccttaagaaagagaacttcttcaagaaaaggaccagcctagcacatagtaagtgcttaattaatgctgactggaaaaatggatgatgaaagatacagaacaaattttggatataaattgaaaaggaaccggggtgtgtaggaggcatcatgaggaaatagtggacccaagagagaccccttgccatgaaatccaccatgattcattttcaattactctttctgggttaaaacctataagtcaattcaactgtgcccaggaccaagtaaagcccaaaagaattntaaaggaagcccttagaaagaaaatcacttacagggtaacaatgaagtctttgtgttctatataaaaaaattctggttcctgataaaatatcnaaatcaggggcgccccgccaacccaaaattgaattttatattatccctggagataataagcaaatatctg

SEQ ID NO: 11834 - DNA, 865 bp, Homo sapiens
tttaggttaacgaagaagaatcatgggagtctttattctttcttgctctcctcatttaccgctcattagctgctgtttccaacccctccaggatcagagcaaaagtaaagaagaaaaatgaagggtatagaaaatttcctacttgatggttacctcttaaaagagcttagcagattctggattttgaaaatatttaaagcttactgtcgctctcacggaccgattttgggcccatcagctaaaactcccctgacgatgtttattttgatgctccctcagccaacaattattttttttccagaagcttgactttgcagcagtccactccacaccaatactatgtacttccctgaagattatcctcttagcttggacagaaacataacctcctcctggctttttcccaaaagaagttaattttatagaactgaatgtgctgctttttccgcccaattggttaaaaaaagagtctatctcatgaaattacttaaaaacactttgttttgtatccacctgactggaagggggccgtaattctcttttttggtccattcatttatatggttatctttttacccaatcccacattggcttgattcctggggttttataggaatcccaataaatagaccggtgctagttcttaaaacttggtcttcggcttcaaaacggttcgaatataccattgtcttgaaattgcctatttttctgggaatattctgcttatttttttcaagctcgcgggggattttgacaagatcacaagggccccctcaatcgcctgcggagaaggcagctatctaagagtccagctctgcttcgcttcggaacagttggttcttaaaaacagctaaggcattaatcg

SEQ ID NO: 11835 - DNA, 1811 bp, Homo sapiens
  misc_feature (1)...(1811): n = A,T,C or G
ctatagtgctacgtatgagagtctctctcgtatactgctcatgcacgtgctgcgantangccgactgcagcaaacgtaatctagacagtatctacactgacatgcgctcgtcgtaggtagtagacctcggtnatgttcgcgtcagtatcatgcagacgtntncgatcgacgntncngtctantgnactgtactagaaatcganacatgagagcgttgacgcggcggtcgancgtctgcntgacgtcgctgagagagaccgtnanccgngtatcacacgctaagctntacgtgtctacttgtcgacgtagcactcgcancngnatagtncaggcagcgatgcancactcgnccgacgcacacacgcgtcggagcagcgagctagtagncgcgcctggganaggtatgagacganagcgtctcggagacgagangttaggtagttgcactgtacgtcctgtcgtgngactagcaactaanggtacgatagtacgttgagtcagtcgatatgctgtacgagcgctaaagtatgtgctacagtganagtcgtgccgcgacgatgtgctactagangacgcgcgaccgtcgaagcacagcatatcgtcgcagcgtagatatatgcttgatacttgatctacgattactgtgagtgtggagcagctcgatatgctacagangtcacactatcgtcatagcgtcgctcgcgctctgtcttactcgtcttgtcgctggcatgtgtggttctantnttctccctctcactcaccacatcgctcgtgcgctgacgtcaccacgtgctcatactcatctcctcgtctctatattattagagtataatgatangataagtcgtgtagtatagcgtagagagttctcgccgcgagcgtagttcgcgtgcgacgtgcagcgacaccacacgctctgaatatattcgtacatttatcatagcgnctgtgcgcgtgtnggccagcagtgatgcgctgagatgccagcagccagggccggagtgtgcgagccagagctctctcgtctccgtccgtcagtatctactagagccatggtactgaacttgcgccgcgtgcgntgaacatctatatatacgcatatcacacgtcgnctcgccactatctctgctcctacttctngtgcntatctacgtatctacactcctcacaccaccatgcagagtctgcnaatgcactgtgataggagcgcgttcgggtatgnaccgtgctttgctcgtagtggcatgatactcgtgtctccgtacggcgtgcgatggacgntngtgtctcactctcaccatcagctctaacgcactggcgagcgtgaccatatgcttgtcagacgtggggtcgtgngacgcggcgctgacgcacacgcgttaccgagcactgagacgcacgatgcatgccacacgccgcgactgcagccgcagtcgctgatcgtagttcagctctcgtcgctatggaggagtgtcggcggtatcgcggaagttcgagtattctggagaacgtaacgatngcgcancantcacgcgnacagcaccngccacttctcacacgacagtcgatgccagcgcgacacatcgagcgtcctgcggtcgngcttgcgctcgncgctcggcttgtcatacgcgtctccatcacagcgtntgcatccgcttcgagcgctgtgctgtagagccgtagcgtcatcgtacatactgaatcactcgatactatgatatgtcgtactagtcatcggtcgagccngcggtagtgcggtcgctgtcggtagtctgcgctgatgtagcgagtgacgacatcgattg

SEQ ID NO: 11836 - DNA, 1228 bp, Homo sapiens
  misc_feature (1)...(1228): n = A,T,C or G
actcagtacaacgagcagtcacattacaacttacgatacatgtacagtagacgaacacagaatctacgcactgaaattcagtgttcgtgggccacgtccgtagacgtgtgcgtgtnagtctttctnggatacgtctactgtaggagcgcagagtccctctttaatcgatatgcacaggtgttaacactgncgagaaatatccagagcgcactattcgctaattgttactcaatataataaataggggaacgctacagagtgtgagcttaaaagtgcggaacggaatataatagcggcaggcggctggccacccacacctacacttactgagttcgagatgggctatccaatcctccctccacgcgcgcacggccgcatcagtctgatcgcgacatgtggtgtcggccggcgccggcttctctagctgcggatagtttactcgagagtggcgagcacggacccgcgcggtgccctgccactatgtcgtgttcctaggcatttaactacgacctcccacggtcccctcacctatcacataaggtcttgcaacgcaaaacaataaatcggccacattaggatacgctctgacggccgcacgagagagagaagcaacagatgagagggtagagaagagaacgctaatcaagagagcattaagtacttaacagcttgtgaaacgtctcatatataatcgacgaagtagtggctcgacttagcggtcgggtcacgcgttagcagtagtagtgagaggtcacggttaatgaagtagaatctacctgtatcgtgtaagctgaacagccccccacacacccgcgcggcacacaacgctttactaatctctgcaatccctaacctcacatactccgtcaccagctcacgtaatagtaccgctaggtgagcacaggtgagggccgaccgagtggtgcacgggcgtattgatgcggtcttcactgccttatatncaacaagaggacgccgctcacatatattnaaaccactacttgatcatattacaaatanggcgaatgaacggacgctgctggaccgcngtggaaggggcaggagagctattcggcgtggttgcatgtggagacctctgaaaaggtggagagaggttcttgatcgccgcgacaaaccccgtggggcagcactgtaacanctcccccacgccctcttccacctgctccctctgatcacttancaccagcacaaacccgcgcccatcacc

SEQ ID NO: 11837 - DNA, 856 bp, Homo sapiens
cttcaggacatcggaactggcgctatttgtttccattcatattctgctagtgaaaacttagtcacatggccactcctagctgcgggagacttgaaaaatggggtctctcctggacagccatgtgtcctgttaaacttgtgtcagcatcactgcacgaataaatgaggaatgctgagacaacccacagaccctctgaaggaaatggacctgttctgcacgacccggcacacatgctaaatactgggtggttcctgtgtctctatctaatccaccactgaggcttcccacctgtctcacacccccagagaaggagaagatgggaaaatcacacacatcttggcaactaggactctaccagttcctcctgcgatacccgctctactcccccgctctcattacgaccgtactctgagaacgtaggactcgaggagcccgcacggccacctcctctctctaacccctgcccggctcactctcgcccccctccacggacgcgccatcccatagcacctgccgcacacaatcaaccctatgcccagcgagcaactccctccgatgggttcccctctccaccacgaaccacgtgacgcccccctctctcgcccgccccccgcgccactacccatttcctccccccccactccccccctcgcccatgcgcgctaccaacgccgcacactggccaacgcaccactttccggccgctttccactacccgtccgccgtgcgcgcgacgcatgcccaccgagacccgctcgcccccgcaccaccaccgtctccgtgaacgcgggcgtagactagcctccccccgcgacacaacacccagcactcgtcgtcgctacagactattatgtct

SEQ ID NO: 11838 - DNA, 2274 bp, Homo sapiens
  misc_feature (1)...(2274): n = A,T,C or G
atgtgcaacagtactgcnggagtgcacancanctcagcgagacgacggtntagtaacgtgancanacatggtagnggcagcgatgnatcatactgcgcgtctnacgagcaatnantcatcgtangcacggcngctagtatcgtantacgtcgactcntcgtctacgattngactagcgtgtcgctagctgactgactgnctnctgtagctgtnctagtatgaaacatctgaacagtgtntgatgtagtgagtnagtggctgtgacgaacngccntcgcgcacggacagctgcagcgtgtgagactgataacgntcgntgncttggtgatagtactatgtactacacagtcatatactacgatgctactangtacagtcgntnctaccatncngtantactatatnncnnaacatcntcacnagatgcnatgtcncggatncgtgtgcgngantagtaangatcacagtagttggaatatcgtcantagcgctcancgatgctggacgtcctgtcagtgctgcatcanagtaganaatcnnangcgatcgagtcantntcgtncactagactantnagacnacngctcatacantacgantgntacgctacgaagncaagtactnatcgatatgtgangatgacaacgacncgncactgacacagtaacgctacnacgancagtctncgncaagtatcgatacgagatctagttagnntcgagngttgcctagtnntangagcgagnttngcntnagtgatncngatgcagtnnagtatgctnntgagtaatngcatantantatacgtgatgatcatgtatcatttgttgtgactagntacaatcgtgagtgtntaggtatagtgntngtccgtatgcgcatacacgtngagtagtcgancgangatagtcgactctngangctgacacntcgacacgcgcgacgcgtcgagcgtaagcacgtgtaggcngntcagagagatcaaacgangacacgaatgangcgatggcagccgtcgagcagaganacgtgcagacagtgcgttnctcgctganccntcgcctncactctcgtgcatactgnccctatcacntctgatcagctgtagttngcatgcatatcgtcagcntctaggttatactgatgagtactacgcactagctggtatgcgacgctctgctctgtcntgctagaagctganntgtactgtgctangtagtagnantgatacgacgcctcatatgactgtcgattaagactgctagtactgtatanagcgtcgatagtgtcactggantgananangtgtgctgattatcttananttcangtactcnagcgtatcagcngtcanatncgaccgtcgatcagcancacntcagtcgtcacatggatnatgacagagagtaganactgatgtcagcgnattgntgcagcagacgcacacgcagtcgaggatagcgagacacngncgcntcacagtactacattactgtcagacngnagagtacngtcgntacgtgncagtatctncgtgtngcgngcgtnancgacgctacatagtgtcagacngatctacagcgtnacgggtcgnagcncntacagtcgtatcganctgatcagctagtatnagtacgtagatanaagtacgactactagntcgcanngnagacgtcagcgctcatcgtcgattctcagatacatgntagcaagcagccgactgtagctgctgantgatgtcgtcggatcagcaggtntncgtgcancgcaccgacgncgngcgatngctgcncgctgatangacgtgacgctacacgactgcacacngtggtgatctcatgctncgaagcatgctcatcgcgaccanganatagtacgtaatcatagactgcatgcgtagtcgtagtagtatcattgatgagtacgggnacatacntnagatgantatatgctgnntgtctactctnntctgagcacgcagccgtgcatcntacagtctactcagncanctgcagtgccacgtgacagagctgcggacagcagagtatgtagctgntgcactatgtcactcgangcngtannacagcactgtnctgtgctgctatacacntgctgtcagcatgttgcacgtagtaganagtnanacacnagtgtntgatcacactggggtacgctgagatcgcatgcagtgacttactgttnatgcatatgactgtactcacgcgcanactgcagagtacattctatgacatatgatnggtatctactagtata

SEQ ID NO: 11839 - DNA, 698 bp, Homo sapiens
  misc_feature (1)...(698): n = A,T,C or G
cttccccgcgcgcggggtgatgtttaaattttacggataagcccccggggccggagagcaccggggcggggggttgggttctttattcccccaggggggcgggagggggaattggggtccccttttccttttggattgggacagtttggccccggggcccccccccccccccttaggccctttaaaaatgggtttttggggttccccggaggggccttgttccctgtttcccgttccccgcgcacaatcacacaaagaatttgggaagncccccccccccctctaagacttaaagggttttgccgggccccccggggccccgggaaaaaagggggttttcngtgggctttccccccccccgaaaaaagggctttccgggtttttcctttttaaaaagggggaaaaaggggaaattgggaaacttttttcatttttgggggggggggcccctcccccccccccccggggatgggccccttttttttttttttttggcttttaaccccgggtttttggggtttaaaaggggaaaattgggggttaagggttttgggtttttttttggggttctcgcccccccaaggggggatggggggggggtttttctttacccaatttcggttttttggggttttttttttttaaatttgggggttttggaaacccccaaaattttaggggttttggtttttttgttt

SEQ ID NO: 11840 - DNA, 1444 bp, Homo sapiens
  misc_feature (1)...(1444): n = A,T,C or G
atatgcgcagcggcgtcgcagtgcaccgctcttggcacggacccatattcgtaagtctacggttatagancgcacgtgtgtggttgagcgtcgagtgtgagacgctcgcgttgntagtctgcgctgcgnctggtctcgtcggtgtacagcttctccggcgtgcgatagcgctgtctgttagactgcatgtcgcgtatctgctcgtnatctntatcgggagtgcgcatgctggtgtatacatggctgtcgtgccgtctcctgcgcacgtcatgtgnagcgtngcggcgtgcggctgcgcatggagcggcatgcgcggcgcgcgtcgtacgcgtcgacgcgcgatacgggtgctgcgagattcgcgtcgcgacgcgctgcggaggcacgcacgttgtccgcgacgtctactacagctncctcatgtgcggcgctgatcgtcggcgagggcggtgcggatgaggttatgcaggcgggaggccggcgagcgacgacgttccgtcggcgctgcctgggggcgtagagtgcgctactagtatgcgcggcgcagcggggccgccgcatgcgcgagcgacgcagaggcgcagctctggacggggcgcgtccggtgcgcgcgtgtgtgcgcgcgtagtggcgatcgcgctgtgtggtcggccgctctggtctcgcctctgcccggctcgcggtcgcgcacgcgaactcccacatgatatcgggctacctctgactcgccggnggtcgcagacaacatgcacgangtctacgctatcactgctgctagtctatntcgtcgtctccnatnctgcgtgtctctttactgcttanctctcctcgtcctccgtttccgttatcctcaatgctggtctgtgtcgggcgtgcggtcggtccggctcgacgccctactacgcgtctagttaactcgactcctacctgcctgctgagctcctatcggagcagacgttgtaaatcactncgtatcacngtactactcttctataccatatcctttcagctcctcacttatttatgatatgttatataaactcgnctctccacgcccacgctcgggcggagcatcgctacgactcgtgcttacgagtatcgtgtgctcacatgttacatacttctagancgtctacctatatgtgtctcgcgttgcgacggtcagtttanacantantcacctcacacctcatctaatctctccgcttcaccctacgacacacactctcattctactctccatctctactcttctcacaattatctcttctacctcatncgggttctcactatctncaagacaagaatatanctttccncncantggtgaccanctctacacaaaggcncctctcnnatctnnactctctcacaccacttactaccctctccccactaaccacccaccttttnncnacnaaccnnaatatnaacaccatattat

SEQ ID NO: 11841 - DNA, 1381 bp, Homo sapiens
  misc_feature (1)...(1381): n = A,T,C or G
cgtagtgtcatgtgcgttgtattgtntgtcagtgtagtnagtcgtttactactcgtcggcagacangaacagcagtgatacgcgcgcgacttgcgctcggcgtctggatgtgtgttggcgtctggtnctgtgtcaaacagtgcgaacagcgacgtgngacagaaactgcgaatgatatcatacactacaagaggcgacgcattaatatcatcacgcgcatctgcgagacgctcaacacagactgtcatagtcattctcgtcttgctcagagcgcgtgcgtacccgactacgctgcacaatacatactacatcgagagtcacaactcgcgccgtcttcgcgtacntagttcaatggcncacgtagtcgagatctagatacacacgaccttgacgancagtgcacaccgtacgatacgataactcgctgatcgagagtgctttgtatgtcgtgacacgatgctctctctatcttcggtatctgatccttagtcccatggtcttggacgtagntacccacacgcattctacgcgtcagtcttcatcgagcgtgagatagttataggcgcatcagtgctctcttcgacccaaaactagccacacccaacacatntactctgcacgtgacatcgctcacttgaaagaataatatgatcaataggagacagagatgatattggttgaggcatatggtgcctcgctctaattaatatataaacgctcacacatcgatcactccaagtgcccccgggtgcagtacgcgtggctgcaatgatcactatcatcgagtctcactctaactaaactgccntctcgacactcgcacancgcgacgcgagcacgaacagttgacctgatcgtgtcttccggcgcgtgccgacggagcgtgcgagtgagggtaggtcggtgtagtgatgaagtggtagtgagttgcatgttgcgattagtagctctcttgctgtagtacgcatctgagtatactaaacgcgagctgcatgtcctatcttggcgtacgaagcttgntgtgatgtnctcgcctgccgtccacgcgtgnacgcagctatcggcgacgcatgactacttcactgttgaaatggagatagtgttggttgcgtcattagctgaggttctcttgtgatgcgcttcggtctatgttagngatacagaaatananagacgaagaaggatagtagtcaacagtctnacgtnacagtatcgtgagcagcaggtctgcgactaggtcgcacagctcgtgagctactgattgatagataggcagtctctactgtgacgatcgtatcccggcacactgacttacgaaccgccacaatccatctagaacataactatcnatctactgttgcacgtagtatgcgtatcagac

SEQ ID NO: 11842 - DNA, 895 bp, Homo sapiens
gttctagatcgtcttggagagaggtttccatcggtcagcagtggaacactacacaggatactgctaacttctttatgtgactgtgggctgagtttgtggagggtgttattgtgtcatccaaggtggagtgcagatgatgtgagtacggctctctgcgaactcggcctcctggactgaagtgattctcctgtgtcaaactccagagtatctggaactacaggaatgtgccaccacacctaggtaatgtttgtgctttttgtaaagatgggactttgccatgttgccagactggacttgaactcctggcctcaaacaatttgcctgccttggcttcccaaagtgttaggatttcagacatgagccaccatgcccagcctgtgccctcgaacttctactgtaaaaccaaaaatacttattttgccatttttatcttacatgtctgtgttcactctccccatatccctcccttaagaatgagaacttcttcaagaaaaggaccagcctagcacatagtaagtgcttagttaatgctgactggaaaaatggatgatgaaagatacagaacaaaatttgcatatgaattgaataggatcggtggttgtaggaggcatcatgaggaaatagtgacgcaagaaggacccttgccatgaaatccaacatgattcatttcagtcacctcttctgtggtagaacctaaaagtcaatcaactgtgcccagacaaagtaaagccccagagagattctaaaggatgccctttagatagataattacttaccaggtaacatgaaagtctttgggactatatcaaagattctggtacttgataaaattcagatcatggccccacgcaaccagaattgattttatatatccctgagattattgcgatatttg

SEQ ID NO: 11843 - DNA, 1554 bp, Homo sapiens
  misc_feature (1)...(1554): n = A,T,C or G
cgacgagctatgtcatntacagtatagtgtagcgtcngtctctgctcatcacagacgccacacatctcacacagattctcttcncatctatcgcggtccactgtaatcatgtacatatnctgacgtctcagtcatactcagcgtgctccatgctgtgttatcgcatacagcatcaatgctgtggcttcatcttcagtntctgcgtcactctagcacgtgtgcgtcgtnctatgagctgcagcgcgcttgtgntgggcgcgctcacagcacagctgcgtcgctatcatcacgctgcgcgcactctctctctgtcgtgcgagatagtctacagacaatatcaaagactctctcatcataatcgcacactgtgatcacactatatatngatgtcttacacatgtacatcatttaaagatatatatcgaatatatgactatctatatatcataatcaatatagtagattctattagagtagtgcgtacncgtcgtgctatantctagattacagacatgctatacgaatnaactactacactcctantcatctgcctatacactctatattatacgaatagctcagttgacgtgatcgcacttcgctatgcgantgtctgtgtacatccagnctgcgcctacctcatagcgtcgcgtgactgctcgatcgacgtgcacccaagagagaactataacagcataagacagagtccttcgcgaggacctgataaccgtgatcctcgtggcacaagcggtgggcttagctcgtacgatcgcgttgctctggtctattgtatcttgctggttagggctgcgccgcggcacgaccggctccgtcatcgtggggtaggacaggcgtgcgccctgatctgtcgtggactcgctctgcttgtcatctgtgactcgggagtgagagcgttgagtgtgtgtcgtgctctcgaggcagcgttatctgtgcgtaaattagactgaagtgacgngtgtatagtagagttacgactgaggatctgtctagcattagctgtattgttctcctctatattccctgtccgccggatctactctatgcggtcagagctgtctcatcactgtctcgcggccgtatcgcatcgcattcgttctacgtgtagtngatgtcgtctcgatacagggcgtgtgcactcgtactctctgttgctagcctctactacgaggcggtcgtctgccgtgacgaacttcgagctcggcaacgacctatcgactgtgcgcgantcctgctactgctcctgctactaacngtactatcgaggtgtactgcaacatcggcatgacggtactctgacgctgcagtgcatcancgcgctgacgcgatactcatggctgacgagtacgaagctgtgtcgctgtatacgtacactgcgcctgcgtcgcggaggccgccatctactgcaccgcacacttacgcttccatgtgtcacgcgacagacgtctgacgtcgtanttcgccttccgccggacgcgttgtcgagcgagcgcgcgacagagttcgtaatctcactgttgtaagtccccgtatcct

SEQ ID NO: 11844 - DNA, 1469 bp, Homo sapiens
  misc_feature (1)...(1469): n = A,T,C or G
tatattagatcatcttagnactacttatacaatcagtgattgaggggnnggcactagttatgtcgtcncgacgtgtgtatatcatntngannnnnncacctatagcactgatacgtctcatacttgnnaaatctatactctgcagtatatagtagngcgcatcanacgcgtctgatctactaatctatcgacgttatgnggngtggctctctcacntgtgtatatcgncttgcagtcactctcttgcgtggacgacgnactgatagcactcttctacgtgcgcgtgatcacangnnnaatactctagatgatactagtacttctatacatataattgaacgctnggnggcgttatatantgttctttgtatnttatgntgaactactttctctctcaccgtggcacgccaccgagcgatcagtgtacacgtagaagcgaactgctaanaatatgtacatgtgtgnannagagagtatcgagaacgcgactacgngagcgagtgatgggacaatagactcgtggagaggtgtgtctgngcggcgttagtagacgttgtagtgatgagtgggtatgctctatgatattggtaggtctagaaatgttatgtgaagaggtggcgaggcgcatgcataggattatgaggatacgcgtgtagcgtgtggggctgagtgatgactccaccacntnacatcatagcctacaaaccatcacaataatnatacataagacatatctatatatatatataaaatatananagcttcttctacgtcgctgttctcgttgctttgatttatnnnnnttgtgttggcgaccgtctgcggcgtcggttcgtgctggtggcgatcgtggtgcgcgtgtgttgnnngccacttccacttattttctataatttgtatggtntatgcttgtggnngacgactatatcctgggcggggttgtatgtggaagcgacagagannnattaggcactaggcgatgcgggtgtgcggnggnatatatatntacgactatcatggactaccctcggacgggagnganggngtgtggcggttaggtagtgtggttattggtcatgtgtattatttgttgtactgtggtacggcgcagcgcgcgactgacagtttcttctaggcctcctcttcgtgcgtctctttgcgttggcgctggccccggacagtggatgtngacgtacggcggcganaccccatcgctcgtgctagggggatatgtcgcatgngtctcctccctctcttttcccttcttnctctcttttccttattccttacttctnnctctctcctttccacaatctcccacttcctctctncctcctctcattattnccctcatctacctccctctctctctcctanctncctcttnnnncttcctctnccctctttctnncattctnttcttnnnnnacctctnccttnctctccctatctttnnnnccccccccccc

SEQ ID NO: 11845 - DNA, 341 bp, Homo sapiens
ttagagggacagactaaggctcatagaagtgaagtgagctccaagatgtcacactgaataagtggtagggatagaatctgaagtcagggctgctgatcagagaccacaggcttttgccacatagtacacagtctccaggaaaaagaagcaaaacttcttgccacttgtcgacctcccccttaagccctggactgagcaaagagaagcagagccattaaccagcctctgtaaaatcaaaatcgggggggaaataaaaaatcgaagaagaagaaaaagagaggtagaaaagaaaaagacaaagagaaaaaaacaaacgaaatgggctcgctggcctcagggga

SEQ ID NO: 11846 - DNA, 1368 bp, Homo sapiens
  misc_feature (1)...(1368): n = A,T,C or G
tctctcgctcccccccccacacccccacaccaaaatttgtagggaacacacgcaaaccttttactgaaagaacacgcagnaactgcaacacagctagaaaaaaatcagtctggagaaaattcagacagacacagtcctctctccaggcagctggaagatttcgggattagggtactctaaagcattcaccggtaaagctaagtatgatcgaccacgaacttccacgcgccaaaccacatccccactggcctacaactcctactcggtgattacaccacgacatatctccctcgacgtccttttccttcaatcgtccagatcgtatcagatttctacacacacctccatccccaccaacttctcacctaacctcgcaatcacctctcttacagtaactgctctcacctcacagctcgatcatcgtcatgactcctctgtcatcacacatcagacatctgttcagctcgcttgctgatccttagncagacngaagcagcaccgcgtgtaatatagctcccacccatacaaccatcttcgccgcacgacctccacatgcaccacatactgctacatagtatctcctcntcggcatgaacgtgttgaccggtgaccaccccattgctaggacgtcgacgcacaaccgcagtattctctacctaccgttcgcgccacagcactgatctaccatgctactcgctgtttcacgttctctcgctcgccgcacatattgntcccatcgcactcatctcccgcgcgctcgcacccatctccactacacaactcacacaccactcactcatccactctcacatatnctacgttctcctatcaccgcatctgcctgctcctcatgctacgtcccacatgagctcacgatagatacctctcatactcctcaccacccctacacntctcgcntctactcgctcggcgcatcgaagttanagtatacacaatacatactctatacgcgcagaccaattatgactcnagcgcactgatcgcacgaccataantctgagatcgcaagcgcatacatgantcgtgtcgccgcacgatgactatacgcacgacacgtcaactatcgantancgtatgtgacctcactacagcgcnctcgcgtgctctgcctcgcagcccacactaagcactctacacanggctatctctatgcactgcacgtcctcacgcgcacgtcctctacaccacctacacctccaccgacacatcccacgcncgcagacncgtcnaccgacgtactcaccacgtatgntacaccctctactcgcgcactctgtggcatctagaccacggacaantacagtgcgcgtttacagtgaccatcttacatacatacatgatctcact

SEQ ID NO: 11847 - DNA, 1824 bp, Homo sapiens
  misc_feature (1)...(1824): n = A,T,C or G
cgcgggcgatcgtagtgtgctgctctgctcntagctatgtcgcanacacttgtcttcttctgagtcctgcttctctctgcatgannnnatcttcgttctactcgctgccgacggangnctcgtgttgtggagtgtgtgtgnngggcgcgtcgctctgcagtttgtcgtgtggtgtacggtgtgtggttctcgcgtcgantcgcgatctgctngatgcttcgtgacgctgtgttcgtgtatggtcgttgctgtgttcttttgtgctgttnnnngtctatctgcgtgactgctgtcgctatctcgtagcgcagtacaacttgangagtgtttacgtgtttcgctctgacgntacntgttgtcgttcagtcgtctttgtctgntcgacgccgtgcgtctgctctcttgtctcgatgccgtggctgtatacgcnaggtctgagnggnnagccgtcgcgtctgagctgttcgcagtctgtccgcgcttctcgtgcagcacgtgtcgaggtacgcgcgatgtgctcgaccgatntgtncgtgctctgtcatgaggtcgngnggtgcgtcggtgtgtgtgtatgtntntatgtatgttgtaggtacgtctgcgagtgcgtgtgtgttattagtgtactgttgttgtctgtgtcgctgtcggnnatcgtctctgtcgtcgtctcggancctctagttgtgtgtgtgtcgtgtggccacgtgcgcggtcgtgtgnctctcgtgaggctgcacacgcgtncctncnnatcgctctctcgtntgtcgtgcctcgcncgtgtctcttctctctcgngnnacntcatctcntncncctctcgtctcctcgtgcgcattcctatgtncgtgttctcctnctctatcgccgggagcgtcctncgcgtctatgtgttananatacatcctccttntcgcccgctactatantntattctgtgtcatcgtgtgtgtaaactcttctctcttctctcttcntntcgtcctctnannnnaccgtcgtgagctcgtntncggtcngtgacgtcgctgatacagacagacgtctgtctgcgacggatctgtngcanagtcactctgtcacgagngcagcataggtggtagagtgngaagtatcgtgcgtcgcagctgcgacgangacctgtgttacccttctgcagggcgtgaganacgagagaacgcgcgtgcacgcattcgggctgnggncaactcngtncacttgcgctatgtcgtctcggtgtctgcgcctgatntggnncncttcttcactgtgtctgggggtntcngatcagngccgctcncgcttgcgaccccgtgctgatcactgcacgcttgngngtgcggtgngagcacttctcattcgcgcttactgntgtcnatcagccgtgnnacagtcatgtatgggcagtgtgnnnannnncaccntcctccctatcctcatnacacatnatatnaactctctaatctcatncnatcatantcatctctgatatactatntcttctannatctctatatannacactcgctaccacatcnttatcactctattcgatctatacactataancatctcactctctntctccttacttactcacactcatcactnaaacaaacgtcnctactctatatcnctcantnctctctctgctcatttattctntctncnnattacannatnnnccnacntanntcnctcanncnncatagttcnntcanttntncnctctnncnttactncntcctntnnnnnnnnnnnctacttttttnncccttnnnncccnnnnnncnnccccctttnnnnnnnnnnnntttt

SEQ ID NO: 11848 - DNA, 498 bp, Homo sapiens
agaccatcaagcttcagaagatcatgtgacaaatgatccagccagttccagttgaagacaccacccctggccatcaagaagatactctgcctccactagacagagcagggtgacagttccgtgatccccaataggtagggactttgcttcaagccagcatgaggcagttacagaagaaagaccattagtcactccgcctcccataaagatttatggggatgacatctctcagagaggaaatgaggcaggaaaacaggatccggaggcatagaacataaggcctattcacacttcagctatgccgggaaatattatctccatttacatagggcatacacaaagtaaccaatggaaacctctagagggtatttaaatcccccaaaattctgtaacaggacccttgagcccctatgcttgggcccactcccacactgtggagtgtacttccattttcaataaatatctgcttttgttgcttcaaaaaaaaaaaaaaaaaaa

SEQ ID NO: 11849 - DNA, 1579 bp, Homo sapiens
  misc_feature (1)...(1579): n = A,T,C or G
gtncatcaacgtgatgtantcgtanctgtgactgtactgnatcctcatctatntgngaacgtacttctgtgtngatcacggactcgacggagcacgaggtcgagcancgcgcgccgcccgcgcgcgatgcgcgatagtntgatctgtcactcgggcgtaggtgacactgacgttcgtctanctntagtatactactgtagtggcgtcggcgtcgtgtagagangagtgatagtncgcngntgatgatgtgtgtagtcgctgtggtcagtgnggagacaggcgacgcgcggcgacgngnacgncatgacgtgacgatagcacgagtgtacgtctaccgacgtngtctgtgtctntgtgagtgacgagactgtgtngactcgtatctcgtgcgagctgtgttagctgtagacgtcgttcgtgatacgtcactcgtgtgagcgtcgatgtggcgcagatagtgggtatcttgtgtgaggttgtatgaaggatgngtngtcgagcatccgcactacctgcgtgagccactagcacggtngntgtnagtcgacatcagtagattagggcatgccatgcnaccgtgtcacacntcgtctctgtganggcgctgcgtcgcgagtaggatgagctacgagttcccactgtcttgtggncacgcatttatacactaatacagntctgatgcagtacanagctgnanaggagtacacaangaaggcgcgctgtgacagctgcaactgcggacggacacatgaacctgaatgtgtgcgcngctcaccacgaccagncacaacttcttaagggctacgtgtacatctatcgtgcgcaacggcgcactcacaanttgattagttggtatcgctgtactcttgtgcgcacactgctgtgacgtatcatgtagtcacatgagggcgcgcggagtcacgtgcggacgtagcgtgctggttgtggctctacgtgcgcncgacgcgcgactcatatactgtggcgctacttcaccagccaacgcacaccgtcctgacaccgtagaanctcactgccaggagcacatgtgtactcacaggtcgaactatacgctctacacgcaccttctggattaataattgagttatgtataagatatgcattcgacttaggaatggttgggagcnagtaccggggggcctcggccgctgccgagcacaatactcctaacanagaaccaaagatggcgcccgtcggaactattttagaatgactcgctcctcctctgggagtacgttgacatgctcgacatcgggtcacttgggcatccgggctgacggaacctttagtctgtcattgctcacatatgtatatcgcatatgagactatcaaattcgacctctcggtcattctgttaacctgtcacctatganactgacgatatctactcgcgctctcgactatacgagccgcgtatagtttattcttgcatttgcacgtcntaacgtactaatacgaatatatatctcgaacacagtataattatttangtatagctcgatatacacagtctacttcaactccagtctcacggaatctctcagtntgcactcactcg

SEQ ID NO: 11850 - DNA, 1356 bp, Homo sapiens
  misc_feature (1)...(1356): n = A,T,C or G
agcagagcatcggatgacgaagtcgcctcatcagctgngngccaccacatcttcctcctctcatcagctctcatnnnactcatcgtcctccactgnacacctgggagctgcgctcgatatctctcggnagcgtgtcgtacatacttgtgagtgaactgactggcgggcactccttctatgtgtgggagcgtgggcatctgacatgnatacgaactttaatactcatacatcttatcagtatnaanntataactcatngcaagaatatataaataatattctgtatgngcactcgatggtcgtggtcgggcgcgatatggacctacaagtaggaggagagagatgcattacgacactaacgaggcggaggagagaagtgggggaagactgcggcacagttgagaggggacgccaaaacantaacctnngagcaagtcagcgctatcgcgccgggtaacgtcaggagcggagagagcggcggactaaagtgaataacgccggncgtagacagcgtgaggatgtgagacaagtgtggtagtgtcgagatggangctgacgtacagtcggagngacgagtgcggtcagnaataacagaaacatcagacacaactaccactaccatntnaatatntnnacttgaccacttcatgataactcctcttgatatcagngngcacaaattacttatttactatttcattcctcgtacatcgctctctntatgatatgtatannnanctcaaacctacactacagataccaaccgtcattgtccatgcctanntacgtcaattcgcgccgtctagngacctacgatcganagttcgctctatnnnnaactcgcacatgaangccgagcctggataagtcgacttccctccgncacactagcataactcggcatccactgctcgggtgtgccgnacatctaccgggactggtgctgccagtctactatacagaagtactgaacgntacaccgcacacntgcccgcncacacacatacctgctgcgaccatgcagnanacgcaatgtgattnnacttctaatgcactgcncnacngcatgncatatcgactgctagatacaaacaagacgactagaatatatnnanacgtcgcgccctgctcccatcctctgtgtnncctggtcatccgtcccgtncnnnnnccctctccctatcctncactatttctactatatcactacacttcaccttcacttccatacttcagtcatnnatattcaaccctttatcactcattattctcattaatnttccataacactctannaccttaatctctcttcatcctctatttccacncctcacnccctntctatcncntctcctct

SEQ ID NO: 11851 - DNA, 1398 bp, Homo sapiens
  misc_feature (1)...(1398): n = A,T,C or G
gagacnagatgtatggagagtgcgcgtgggcgacgatatcggtacgagcgctcaccgtccacatcgtgattgtgntgtctggttacagaaggagcgcgtctcgtatacangcacacgatagacgtatgttagtcgtagatcaatatcgacagtagagaggagcgtggacgtcacgatatgaacgggatgtggaagtagacgtacaggttctgacatcgagacgtggtgtgtgcgtgganatgcgtacgtgtgatagctgacatgatgctcgcgacaggttaggtggtgcaggtgacaaggtgncctgtagagcgctcttcgtcgtcgccgccgtgctcaggcgtgaacgagaggaggcagctgcgcggtacactggacagtgagcacggctctgatctcatacgcacgatggcgcggcgtctaggtnggattatgcgcgcagaggaggcatatagcaaagnggtagcagacgacgattagcgcgtagagagataatggagcgttcgggggaccttggactgctatgtggcgtctggcggaggtagagtggagagtgatgttatctggctctgggtcgtccgaaagcagacaaggcgaccgcgattggagcgtagctagccaacatatatgtgccgtcctcacccacacactaacatgagtcaagcgttcgcgacagcatatgcgactaagtctcgatgagctatcgatatacaggggcgtgcggtagagcgatggaaacgtaagtagacggcagagagaacgcgcacctacctgcgctggtatgaggngcagtaactatgaacggatagtaagttgcaatacgagactagcgagtgccataaatatgatcgtagacactgagcgacgatacgaagactagaagtagtcgtttggcagcgagatatcgttgcgtacgtatataacagnactcgacattgggagatctcgtgacaagtaggcatagtngngcgtggcgtgtctggctgagtctgtgtgtcgctatagtngatagtaaatggtgacgactgnanatagtngggctcatcgctagaactgtgagctgcgagagcttacgtgnggcgccgctgaanactattagtcgancatgaagcagtatgcgngactgagagatccactatgtcgactgtgtcttctggtgagcagaacagcgatagatatgtcagcgacagtctactctctcacatgtattgactgctttgcaatatcaacggtaactagacaatagaatgtaaatgattaatggatgactctaaggattgataacgacattggcaagtcactctacatgacttttattttgacatgtcgaatctatgagatgaagtaaatgacagtaagagtatcttaacacgtttactcttttatatacaccacctg

SEQ ID NO: 11852 - DNA, 1243 bp, Homo sapiens
  misc_feature (1)...(1243): n = A,T,C or G
ggggagaaaanggggggggngggngngggngggcggggaggnncnnnaaagggaggcggaggggcggagaaaagaaagagaaaaaacctgngaggagaaagaaccaaaagaagaaaaaaaccctcgagggaggggnngggaatccccccgncccgggcgganggacggaagggagagagcaacgagaaaggggagccttagaggaggggggncgggcggcgcagcggcnnggcgngggnngggggcggggcgncgcggnggcgcngccgccgccccgcgccgggcgccgcacgncacgcngcacccgcncccacgccccgccgcggcgcgccgcgcgccccgcgcggcgcnggcgccgccgcggggccgccgccgcgagggcgcgggcggcaccgcgcgcgccggcgccgcgcgcgcccgccgcgccgcgggcaagaaaagaaaacaaggagaattctctcggggggccnncccnncccgcggccccgcncgggcgagccggccgcgcggcgccgcgcgcgcggggcggcgcgggggccggcccgcgccancgcgggcgggccgccccccgcgcgcgggccgggccccgccgcccgacacgccgccccccccacccgccccgcagcgccgcgcgaccccgcgcgcgcgcgccggccgacgcgggccggcgcccgaacggcggcgccgcgccgacgccgcggcccgccgggcgggggcgcgggcggggcggccgcggcggcgacggcgcccggggcagcgccggcccgcgcgcccggccccgcgccccgcccgcggccggctcgggcgccgcccgccggcggcgcgaccccgacgcccccgcgcgcccccccccgcccccgccgcaggccgccgggcgagggccgcgcgggcgccgggggcaagccagcgcgacctccccgccagacgcccgcggcgcgggcgccacgccgcgggggggcgcgcgggccgcgggaggacgcgtcgcgcgncacaccggggcaggcaagcggccgccgcggcgcccgcgcggcgcgcccacaagagcgcgcacggcgccccgccgccccctaccgcgggccgcggcccaccgccggccggacagcggccgcgacccacgcacaccggccgcccgggcgcgccgccgaggccgcgacgcggccgcacggcggccccgccgcccgcggcggccgcgccgccgccgaccgcggcaccggcacaccgaacggcgcgaccacgagagagg

SEQ ID NO: 11853 - DNA, 264 bp, Homo sapiens
gcacactgaagagaagaccttcatccgaacccaaccatactggcaatctgatcttagacttccagcatccaaaactgatgatggggatgaggagacaatagccccagcatctggtcataatttgtaaatctcgacattctccctaacaccagcctggaaatatctcatgctctagcatcgttttacaagttgctggcaaaaaataagcatccatcttatttaaagactgtaattaaacgagaaagatgaataaaaaaaaaaaaa

SEQ ID NO: 11854 - DNA, 1748 bp, Homo sapiens
  misc_feature (1)...(1748): n = A,T,C or G
agtacgtagtctgttatagtgtgtttatctcgctgtcttgccatgacgtctgctggntctctagagatatcggacgtcatcgtcgcagatctgctcatgtgcngggcatcgactggtntccgcgcgtcgtcttgcggcacgcacgctgctgctgcctctgcttancntcntctcctcttctatattaacactagctatgccgccgcgttgtantcgtctgcagtncacagtnagatacgactatctaacctatntagaatngtntatgattcgtatatacgatgacacnctacatctccgagggcggtgcgcgtgcgctcagcgctgtatggncttctgcgcagagcgtgagatngtggnacaggtatgcgaggagatgacgatctggaataggagcgagtatctatgctcgtctatacatatgagcagcgtgaagagtcgatctgtgaaggatatcgaggtnacgcngctagtcgagcgcaccgactgacgtctctattctctcgtangtcactntctgctaggtcacgagatgatgactgntnctcgcatgctcatngntgactctactcacancgcgattgcgtatnaatacactaattttgntgtatatctctatcacgccgagcgcgacgagtcatagttgatgaagactcaatttgatngntangatcntagtgtagatctctgttgtgtatcgacatgcattcaggatcagataggaggagcacctgatgcgaaagatgagatagtaggangtagtgtagtgtcgtgcgtgagtgagagttgatgagtgggaggtggtaggacgggcaggagcgtagaggcgcgcgcgacgcaaaggtacanaaacgacatagatgatgcgatctcctatgtgcacgtaatgaattagagtgtctcagtctagagttgcacagtgttatagangtcgtctcatatactctagatcgtactactngatactagctagcgcgtgcgtgcgccagccgcgagaggtanggcgacgctgcgcacaggtgagnagtgcgacttagcacgtgaggtcgcgcgcgcacacggacatggtaggtngtgnngnagcgtagggagacacgcactgagcgancgcagtacgagagctcgncgantctatgatagacgangagaggnagtgatcgcgagtgacgagttacgtagcatgcgtgcggtngtaggtgtgtactgcacgactctcgtgtaccatatcgtcgacatgtgcactagttcgcgcgcgtggtgtgctctctgatgtgntagtggtaganacgtactcgggtcacgatgcttgagatcncacggctgatgaacgcgcggctagtagtgcgtgcagtgctatctacatcacgctcgttatgagctgcggatgggtagtgtgtgtagtggtgcgacagtgcggtggtggtgtgcagtaggcagcggacgctcatactacaatctcactcagagcgttctcctggctctgcgtaggcgcctatatngccgcgctgtngttatatcggatatctcaccatgtattcactcgtgccgcctctgtctcacgcccgtcttgcgcttatgtntttccctgacctctacattttgtatgtagtggtgcttggtttggagttcgtttgctctcagncctttcactttacttctcccacagacctcatcctgtcaattttaatttactgcccacgaacaaccaatcctttaccataacccagcccttctgctatcacacacat

SEQ ID NO: 11855 - DNA, 1697 bp, Homo sapiens
  misc_feature (1)...(1697): n = A,T,C or G
caangactagtactctatcactgcactcactctctgcntgcgtcgcagctggcggacgcaggcaggagtatgccanacctacggtataganttactgcctcacgaagaggtgcttgacgttctntgttctacgcgcgcggtcggtgagcgcgcangatatgatacctcancgttagcgncggcgtcgtgtcagaggagatcgactgncagagatagangtgtacgtgtgtgtactgattgtgttggcagagagtgtgcacgatctagctgtgagagcgagnatgtgacgcacggagagagtagcgcatcactacagatagtagttgatatagtatgtgagcnttgttctgcgntatagctcagtcagctacttantncatctgacgcgcacgtctagtagcanctagtcatngtcactctcgtctacagcgacgcgacgacgcgngcgatgcagctaacgtactgtgtcgtgtgtagtgcggagctgagatgtgtactgtgatgtngtagtcggtancatgactgtagcgntgacgagtggagngnactgcatgtgtgtgatacagtcgagtntngcgggcgtatatcgcgncgacgtatgcatccanctgcgagcgcgagagatgtattacgngccgatcgcgagtagtagcacacgagcacatcactcgantctcatcacgtacncnatacttacgncgaccgtatgagcgatnagaacgacatngcagctggtgatcagacacgcntgcgaccgcgaagcgncnaganctgactgactgcgtcancgacttnatcgggcgatgngtaggacnaagcagatagctcagacgactgctctagcngagtgtacgacgtgagataggtgtgtgaagcagtagngtgnangngctaccgaagaanatancgaatagacgctaagangttgctagtcgtgtgataatatacacatatttgttccgctgtgctgngngtcgttgtgctcgcactgtggtcgatgcgtagttgctatatgaggaagtatcgactcagatctatgcccactcatcatctatcttcgagtgntncggaggccctctcgacgcaccgactgacaactggacgtgcctgctcgccgtgacgtgataagacatcatggcgtcgacatatatcgggcgcgcangcnacgacacggctagtaggtgtggaacgagcatagagacatgcgtgataataatngagnagantatgtggatatcagagcggtctgggtgtgtangngggattngcgatatgagatgttgtctgtgtatcatcgtggtcggatacgtnaggagagtcagcgtcgggagacaagagaaggagtcgtgtaggtgtgcagctcatcgcgcactcagtacacatgtcagagctccaggctactagaggacagaaacgaaattaaacacataagtgcataatggcgtcgcggattctntatattatcgcgtgtnaatttantacgcgtgttgtgcacttgtggagtgttgtatatgggaaatggacaggatgagaatgtcgggtgagatgtgtgaatgttcgagaacgtagagattgcgaagtgagctagacggagagacgaggccgctatgactcgtgagagtatgagagaaggtatggtcttattctgaatttgtacgtagattgactacctcttgtgttcctcttgacatccttgc

SEQ ID NO: 11856 - DNA, 1171 bp, Homo sapiens
  misc_feature (1)...(1171): n = A,T,C or G
tcgtcgcgctgtatcctacaccgngcgtagcggtgcgcggctactagaggacaccgccggcggtggcccgccgccgtgtgtgtgtgtgtgtggctgttgctcttcgccaccctattatctgcactcacgcaaacgcgaggccggagatcgtactctccatgacgatacaatgagtttcatacgataaagggcgttatgtacgcagcgagtagggttgatcagcaggcagatatgtatgcgaaatagtctntgggtgattagattgttgcgggctcctagcggctgtgtgattgcgagccttattgtggcagttgtgtgagagttctctcgcgtgagtcatattcttggggatccgctaatangagacagatacgcaggtaaaatctcaaaagactagaatcgtctcccagagacgccgagtagcgtgagcattcagacgagcgctgttctctgttcgacccagtggatatagcaggtaatgttatgggagtaacgatcgactggtgtgagagggagatctgtgtggttccgcgcttcatcgtgcttgagctgtcgtggtgtgtcacatgcgcgtacgggcgtctcccatgaaggagtaggggagtgggggggagaatggggagcagtgcgtctgggagactaagcactgcccgcgcgagcaggaggctacgtcactatgaggacctatcggcgtattgtatcgctagagtggggagggtatggagtcacgtgtggggtgtcttcttgagcccgcggcagtgagcttatggtatatgcatatacgactattagtgtcactgcataggcacagaggtcataagacttggcgtatctgctcgctctctagataatgcatgcaatcatgcggtcatgncattcaatcgctacggacccgacgacncacgatctagctgatgtgtactcgccaactgggcatagaacagaagcagccatgcacagtcacttctacaaccacattcacaatgcacttctcgtgcctaggactttncatagtctcttgcatcgcaaccacggctcgtgagcctgatcgtgatgcacatgatacattaactgactctaatcgggacaaacttaggcctggcgactgatgatacactacattacatcagctattactccacactatgccactttactactatcgacaatt

SEQ ID NO: 11857 - DNA, 1136 bp, Homo sapiens
  misc_feature (1)...(1136): n = A,T,C or G
ctgtctcagtgtgcagagctgtactgcacctttggngccatcttactggtctcattgcttgcgnnnactattaattaatgaggctgggagtcacgaggtaggggngccttctcgttaatggacgtgacgcggaggccgacgtgacggtggagtgggcgcgggagagttagagagggcagatgcactggaaaatanngaatatggcgctcgtactgggcatacttgcggcacgtcttctatgcggcggactgtatgtgaaatagtaaagtgagggctcccggatcaacgcctcccaacccctaacggccaacagcacggtgagagagcgttcgaggtatgtggactcacgggcgcgggctgtaaattgggggcgaggggtattggtgcggattgaggaagctggggtgggcggtggatcgctgaaggagagaggagggccgtgtagagaacggacgtaacaacgggaactaatggctctacgccatgaggggatatgtaattanatgtgttattgtgctacctctcgtctgtaanacaactccccatgtatgctgtctgttttggtagtattattgtatnnaatttactgatctggcgagacctctcgtcgacttcaacggacgatgactttgtgggccttgttgatcngatcgtcgggntctcatctcggtctgagctcgcagggagagaattctggccggtgcggtcttagtgtcgtctgtgggtgggtgcgacagtactgagaagacgaagacgaggggtgggagggggtgagaggagagacagagtagagactatatntcgaaaacaaggaggactcatacgtgtgggtgtctcagacggcgcgggacgcgggtgatcgtgggcatgggctgggtcgtaagagatcaagagacgtgtgcaagggtcgggctcacttacttccctacttaccatctatcatctgttatacttgtgagagagatgtanaaatgatttagtttatgtcctgactatactactcatancnnnggatatnagngtccttctacttcataggtaagtctaagtgttttctacnataagatncaaccaacncnccccattaaactaacatcaaacctnncnnncacctancccnncnnnncacacttttt

SEQ ID NO: 11858 - DNA, 1445 bp, Homo sapiens
  misc_feature (1)...(1445): n = A,T,C or G
agaagtccaatcacanttacatactgatctcgtgttgtgtatcgatctcttctcacgatctcgtanacacagatcatactactatgcgttctcagtggtgacgcagtgcgcgtgcngcacgactttgtatgcatcgatgcgtctcgttgcactctcatcgttagtcatatactcacacacgtacgagttgtcgagtgcgtacgtagcgctagagtaccggtggtgtctcatgcgtgcngacgtactcctgcgaggctgcgtnccacggcgctcgtacagtacactngatggaacgtaagnttgtatatgcatccagtgtctactcagtgtattgtgtggttagtagtgacacggcgcgcgngtacacgagtagtacgctnacgcacttcaatgcggncgtgcacatgagantgagaggagtcgctagatcggcaactcgcgctctacgcatctgatctgcctctccatcagcgcagtgtagtatatgagtccgcngntagtgtattntgttatacgcaaatcgccatatcgtggtctcctgacgtcatgctctagtagtgttgtctcgcgtagcgtctgtntctatcagttctggcgtcatatattgtctcgtgtgngatgcatatacacgtatggttaagtgttgtcggcgtagtgagagctgtcggcagtagatgtataggatgatatattagtcatagtatgatatggtacgagatgtcgcgccgtatagacatgtcacgtgtgctgagtgtggagtagatcaactataanagacatatagactgctgagtacgctaaggnttgcgcttgtgatacgttctctcgcggngcttcttctttcgttatatatgtttgnggcgcggtgcggtgtgatgtaccgtactggtgtctaggtgcgtgtgtgtgtatctggcgtgctttcgctatctcaggggtgggcgttcgtagccagtaggggcatataagtagattgcagggactatagtgtgagcgcccatgntccatgggtagtcagaatgcatgggtatcgcgtagcattcagtatacagtgagaacataatagacacgattgttatgaatcgatctatagtattatgcccttttatctctgctatatctttataaggcgaggagtgtgtgaatgggaggtattgtgagaacggggtaattaatctgagggacatcggcgccctgatgtcaattgtttagtaagcaacagtcgattctgcaatacactgcactcgacgaagatataatgattgaagcgacggacatgggtcagagagtcagtaaccgggattcacttaccacgccgtcatgttggcttattataatgttataacatatcagacgggaggagtggcgtaagaatgtgcgttgcctgtgtgttcctgatgaagatgcgtcagacacctaccaccaactgctagtatgtcattttg

SEQ ID NO: 11859 - DNA, 1133 bp, Homo sapiens
  misc_feature (1)...(1133): n = A,T,C or G
agtgagatgtatgattgagnttgagaggtgaatgtagtangttgatgagagggaatatcaagtgagaatgagttgggagattgtgcgacggtgtaggatgcgcgatatggtgtgagacgtggtaatcaaatacattatcatagtggtggtagtaaatgatggccagtagtcgcggtatgatgagttaataaggcaggggactggtgcatggcacaatcggacgtagcgtcggctctcgagctgcacaccacgtgagagacgaatgtgagggcagaggcaagtttgagcttatacgacccgcacagcgtctctacaatatcgagtcaacagacgggaagaaattaatatcaatcgagatagaatatggaaagtatcaaatcataggggttacagatataagcgtgatatattgttggttccttaacatcgtaacattcacatagtgtggtccggtagtgcgactctagtgacttgtacttattgtattgtttgtctnctgctgtaccagcaacagattgccgcagtatgatgcgagttgttgtgctacatatgacaacacgtaangcacacctcgttttagataacataaatatagcttgagtagaatcagcantattanctctaactattgatagagacactcgcttagngctggcgatggccgaatacgttcgttagtatagatacgcttggtgtctgttagtcatattgagtcgtgggtgcgtcgtgtgttaataagatggacgcgcgatactgcttcacaatcgcattacgtatattcctcagtatctcatcaacaatagagagtaggcaattagcccactactgagtgtattatgtggagagtggagagggtgaagaatggtgatgtcggcgaaggaatggtgtgggtatgtggtgcaagtgtacatgtgcaatatagacattgaaatcgaataaattcggtcagataatagaagaatacgttgggataatacgtaataggaaagaaggatattaagagatgtacgatcggagcaggttattatataatatagtgatagagagtatgtgggagtgtgatcagcatatatattaattattagtaatattaataatgacttatatgacacagatctatgatactatactat

SEQ ID NO: 11860 - DNA, 1696 bp, Homo sapiens
  misc_feature (1)...(1696): n = A,T,C or G
gttctacgcgcttatcgtacacgcngctgactaccgacatgatatagttccaaaatcaccctcgaacagagtcataccccatgatgatggccacaagtgctctcacccgcgtgatgtcacactcgttgacgacactatgccaccatacatctgccacacaacgagcgctgtgtatgtancgagtgttatattgcaccatcacttatngagcatatccacactgcagcntctctgacgctcctagaccacaatcgcacacctccanattcagatcacagcaattactaatgatacagacaagatgtggcgtagtttagtcctccgccgtcactgtgcacgcagtctcgcgtcgccacaatctcacatgatctccgagctatcacatgagcattcacttgagtgatgcccacgagagagataagatagagacagaagaacagantacgncactgatgtcgacgtaagaancacagtttcaggatatgctgcaacactctttgtcatcatatgtngcgatctatatatagtgagtttgtgtcgtcagcgcaggaggcgccctctcagcgatagaagtgtgtagacgacgatgatactgcngaacacagtagcggcgtgctttgttatatctactatcgattagtgtctagntgnaccgagacgagtactgtctcgcatacactctgagactcacgatgagctcgtcagagctggtctagtcgtactacccactatnagtctgtctactattatgtaccctctccgcgnccacgacaatctntaagcttcaactactcctctgccctgacggcacacgctacgacgctctcacgctgcgatacgagtanatnacgatgactttgatgcagtcncgcgtatntggttctattttctgctctcgtatccaatgatcatgtgatatggtcactatataganttatacatctcttcgcttcacncncgttgagtagatatactntcgactatgtctccgtgcngtggatacactcaactcaactgantgtatctgatactctactactaatttaatatattatgcttgtacctcgctcgcatatatcngatgtctcgccatacgccgncagcaataccacgcgatagttgtgtgtagtcactcacgacagctcatacacccctcagatcgtatctatgaancncttnagtatgcgtgtncctcgtactatgncaacttaantacatgttcatcgtcagcgtagagactcgctgctatctatctctcacgctcnatcttctatcactntcntacantacttctcactcgctcgtgttatntncactgcgtactagtcgaangtatagtagagatgcgcgcagactgagtgcatagctctatgacagagtagtatcgcgtctcttgcgangtcgctgcgcagcggtacgatacgagtacagtgctcgcgtacatgtcacgtggcacgcagacacggagagtacgtatcttatcgtcacgggntgccgatagacgttgcgatactgaataatatntctagtatagtcgtcatctnatctgtgtaatatgagcagcactacgatatcgaatatgtacgcagtactacagncacagtgtagagttctcactcgatctctacttcgactacatcgncnagntcgttactgagatctagtcgtcagagtcatagtagtatgctacgcatat

SEQ ID NO: 11861 - DNA, 869 bp, Homo sapiens
  misc_feature (1)...(869): n = A,T,C or G
cccccattcatcccctgtctccgtaatatcttatacaaatattttacatctacacttgcccanacctttacttcaaatttggctttattttcatcattgatattgattaaaatgaccttcacttgctccggaaagtaaaagaggtcttcaccacaaaatattgctaccaacaagcaaagcctaaatcacttgagattgaaatgtccatctatcttccatcggccaaccacatccctctgcatgaaaattctcaccccacagcacggaactcactttcttctaccccaaccactttcccactgccttctggtactgctcactcctctatttctggccactattttattccatttcaccactcccctcccttatcccggccccacttcaaatctaacatcccccatttctcatcacttcacccgacctcttccatcacatttcaacatccactttatctctcaccctccgaacactcttttccatatcagcatcttcgtcccaaaagctcaacaatccgctcctcccccctccccccccttgtttttagacctctcaatcttcccatccgccctctctaaccattcactttaataacccatctccgtcttccctcccgctcctctcccacttatccctcacgtagacccccatttcctgatcgaccatatcgcctcctacccatccacatcgtcctccacaacctccacgcaatgttacgagcacacacccaatcggatacatacacaacaccaaactaactatcacacacaaataccacacaactttactcacacatcatctcctcgcaacctatcattctattatttactacttcacattactctcttaccactcatcccccctctacg

SEQ ID NO: 11862 - DNA, 1217 bp, Homo sapiens
  misc_feature (1)...(1217): n = A,T,C or G
cgtgggtaatgtttggggacgagcggacggatatcgactgcatattcgagaatagtgattgtgcatatgagatagggtcgcggtagggaacgtatacgcggcgtggggattattaatgcagactaatcattggcggcgacgggtcgctgatcggtacggtgttgcgcttcggtggacagtgattatcgtctcctctggcctatggccgcgtcgggnaggttaaaaacaagatgttatctcggtccctctatcatgacggcgcgtgtcgtaggcgctatccgggtcggcggtaatatcacatgggttggtgggtggccgcaggtgccggataactctaccgcggggcgatggatagggcggattgacgtctcgcgagacggtgggtaataatcataacgatgtgcgcgccgagcgactgcagatatctcacgcgcgactgtgcgggatttatcgacgcgataataggcggggcgagctggggcgcggaattatgaacgtggcgcggcatcactgcgaattttaggcgacgggggcggggacgaagagggcaggttgattctgtgcgatatcgcgagctctatgacatggatagtattgatataattgcttgtggtgtgggcaaataggcggggtataataacaacgcggacatccgacgcgatatgtggcatggtgatacgtaattaatctggtatggattcgagagtgtgatggattctatataatgggtccgaccgcgatgaacgctactctgcaatntcttgaggcgggatcgctctgcgcatgatcgcgcgcttaattcgggcgcgcgactgcggcacaacatcgtgaacgagtagtcgtgactatacacgacatatggcgcagcatacacattggtccgaggcacatgnccaccagccgcgccgaaccacacgggcgctaaccggtcagtcatgttcaattataacacttctagtactacgcaaagatcatacgcaccatatgattctaacactaggaaataataacaatatatntatgagtagcaacataacataatagaagatacaacacacacaanattgtgcctctncagtgtgagtctctactangtctgtgtgagctagttagtctggtcagggcccgggacacacgctcactacnataaactcgtacgtcgtgcgtctacgcgtcncactactgctcgttctcttgacgcgtcacacagcgcacta

SEQ ID NO: 11863 - DNA, 1395 bp, Homo sapiens
  misc_feature (1)...(1395): n = A,T,C or G
gggggagagggaggngngaaaaaagaaanaaaagaaaggaagaagaaaagaagagaatnanaaaagaaaatagtggncatgaaacttggagcaaagagtatcatagattcactcgccacctacaaacattactgggacatcaaatcgatcactcgctgttctccagcgcgtccggaagagcacttagggaatgtaccaggcnacgcatggcggcgcactcaccgcaccatgcagctacatacgcgacaacataccatacctcgcgcagtgggcctgacggaacacaggccaggtccgcgagggaaggcacctcgacgtgtggtggctcgttgctctgcttgcctcggacgccgagctcgcgcccttgtctcaagaacgggacgtgtcctgatgcactctaacagtccccgtgggccaccagccgagcacgcgcgcacggcgcaacatcgcccagcaccgcgcggcgccccaaaccacggtggttcgaaccgctcnccggacggcacacccntcgcccgccctcagtcgcccgcgaacggcgagcccgctccccagagcacctccagcaangagcccgtcctaccanacgcgcaccgcgccnctcgccacaccgcccactctagcagccaggancgagacggngttgcaactgtgcnctcgactacgcgccacgagcggagcggagaagagcnagcngtccccagggcacatgacggtggaggcgnacggggcgtcgcgcgcgcgtgccnntcgtcacgaggagagagtaagtatcagtatcaccatcgctaaccactcgctccactccgcactctatcgcctcacagcgcgaatccccgacgcgctccgtctcacacccgcacactcacgcgatcaccgctcgtcntcccgtcacacgcacgcacacacgcagacacgcgcgactagacnacttagatngcacaacacgcagacatgagtagttncacactctcccagttcgtagagtatagacgcncgcgccgtgatgcnctccactggtgcgtcatgtacgtggagcgcacntgacggcncacgcgcgcgtcacagantgtgatcatcactctacgacaacaangagatacagagntctcacgatataggcgtcggcagtgacacagcacncntcgccgcgcgtctgggcagcgcngacgacacgagaatgagatgngccnccacacgcgcgtcagagcgacgtcacgcactcgtacacgacgtcggtcgcgagcncnctctggctcncagcgcgcgccgcagagacgcagatcagtctnacgctacgacgcatcgacggcgcaccgagcgcggcgncnngcaccaccccccgtctcnacactcaantacacagagtctcgagagcagcgcgcacacgatgcc

SEQ ID NO: 11864 - DNA, 886 bp, Homo sapiens
  misc_feature (1)...(886): n = A,T,C or G
agnagtgngannnanatnnnaggatagagaaggnntaatgtannncnnnatangagaanangatntnnnanatncanngnagatnggagacnaaatatngnnananggtatnnaannngcngnaagagagtngnaagagnatggagtananagagantaaggannggngnnnngtngtntnaatntgntnccgngnagntnagaagccaggattncnagggacattatgcagagtgccgcgnggggtctngangaggtaaagangtgtggtgngaccagncatgtangnaaactttgaacccntgaggcccanaaattttnagggccaanantattgtcaggccatttggtngatatcaagcnttcanggntagtttggnntggaaggtcttcntcccttctttcctncagncancagttgggaggnaggcaagtgaaacctttcctgnaagtnagaaccatagcaaancnttcgaagcncctnttcaantcngggctggagtgcaatggcngtgatntngggntcncnncaacctccgcctcccgggtcctggttcaagcagttgtcctgcctcagcctcctgagtggctgggattacaggcacatgccaccacgctcagctaatttttgtatttttagtaaagatggggtttcnccatgttggccaggctgctttcaaactcctgacctcgtgatccgcccgcttcggcctcccaaaatactgggattacaggtgtgagccnccgcaccctgcctaatgtccctaaatatttaatggtttttaaaaaatttattgtgtatggcagcacagcacacttgtaggaattagtatcaacagtacatcntgcgttttttaagatgctgcattttttaacattttgtaat

SEQ ID NO: 11865 - DNA, 438 bp, Homo sapiens
  misc_feature (1)...(438): n = A,T,C or G
anncannngtgtagnngatanancnnaattatgannnanaagtacanngagaaagagacgcngannganggtgananannanganggagantagagantatnntngagnaagnagtgntnatcncnaganatnggtnnatnancaataanaagagatgggtatatanagcnaaanagtnttggntnatgactaanagnganattaatnagnagatcaantngggtntncnccgnnggtnaaagtgcncnnagaggtnnatnngagantataagannganagagtnaannnnaagancanggagagtttttannttgaggaaaaaanngtnacgntattaaaagaacnnccnngtaagggntnnagtngggaaaaatngttnannanaaantnngannnatgncncnaaancncagtnannnnganagtgggcgttata

SEQ ID NO: 11866 - DNA, 862 bp, Homo sapiens
  misc_feature (1)...(862): n = A,T,C or G
annaanaagnnttttaggcancggggccctnnnggcnggccangttntgaacccccnggaaatgggnncccatacacngggagaaaagncaaancgggnagctttnanataagngaagncntnaaataaagaaaggggggggctnnaaattngtgaggttcaaaaacgtacgcnggttccnanncaaaaaantcngaaaattaaggatcngnntagntaaaaggggaaaaaaancnggcnaaaantttggatccaaaattaaggtnggatatacgggatccaattgnnaanaaaattgccttntttaacnnaccctgaggcttccaaaaccccatgggnccnaattcttgncntncccccattaaattttgaggttcnanaaaaattttccnntccataaagttgtnggtgttttaagcaaacangccattgntcccaaanttggttagaatttctacctaaagggatttcatnttttggttggtgccnctgtaatggaatgtttttanttcaaactctaantgtgcattgttggctatgggaatncaattgatttttgtgtgtanaccttgtattttgtgacantgntaaactcataaattctaagatttttgtagaattttaaggttttttacatagncattcatgtcatctaaaaataaaaacagctttatttttgcatttcctattttctacttttaagtatattttcactattctctgcagatctctaactctgtgatttttcaggcattattgaaatagagattttgtccnatgnactatcattcagaaatgtaatccatgtgatttgctcctcntaaggaaattagcaatgatattaaagtaaatcaaatttaat

SEQ ID NO: 11867 - DNA, 889 bp, Homo sapiens
  misc_feature (1)...(889): n = A,T,C or G
tttcccntngactggaagtaaatgattacaagaccctacgggataaaagattcacgaaagagaaggaacctgaatccctgaatcaccgtatggaagaaaactgccagccaaccagaaaaatctatcatggactgtcatagaataaagcctaaaattaaggctgaatattacgtgctgctttgacatctggtaaacttggagaaccctcgaatgacctagttgcaagctttccttctcactctgctcctgtggataaggtgccatagccaagcaaccggtcttatcagagaaccnagtcacagtttctgagcaatggcgttcagtttaccacccacnccacagaattattcaaacaagccaatgacatcctcttcagggaactagggagcatctttccctactgatcctacaaagcctgcctcccataactcctaactattcacctccggtctcaagggaaaccccatatgggacttgggaagcatgggcatgtcctactccctcaaggcctgtgagtacacgtaaactaataaaccacccccgaatcccactcccctcccaccccatcataaaactggcatccccagggcattgtgtttcctcctccctctgcctgcccgatctctacatgtcccggcgccgcccccccctcaccacccccttcttcatcagcctcgtctacagatagagccacccccacacccgcccgtcagccccgcactcggcaccgtgctcgccgcccctccactaccctcctcttaccccctcccgcctctaagcgggagcccggtattgtctttctgcgcccccctcccgcccccacctcctaccccctctgcttgcacttttcgcccccaccacgcccggccccctcgctcccccctccccg

SEQ ID NO: 11868 - DNA, 415 bp, Homo sapiens
ttttaggagatttcttcaagcgagatgtacacttcactgatgctatctcttctgtgcttgagctatgcctctctgcctcatcctccgagagctgtgggatcatggaatgaatacccatatcatcgatagcaacctgcattgggagtgctgaggaaaggctggcggatgaaaatggactggggaactatctcttcattgttaatctgttttctttttgtaaatcctgtgtattagtatctaacgaatttgctaaaagtctagttccacctttgaataacattgtcattgtgcattgtaggtctcactataagctatccatattttataccataaacctaggaggtcttcttatcaactatatgaatatatcaacttaccaaataaaaaaaaaaaattggcccctttgggctcagct

SEQ ID NO: 11869 - DNA, 906 bp, Homo sapiens
  misc_feature (1)...(906): n = A,T,C or G
acgttagggtgggatatgtgggatcgtatgnacagtaaatgagaactacatatatatnnnatcactatctctaattcttacataaatgtatagttgtggtgtgagaaatggggaagggagtaggtgatgtggtgggatggatttgaggtcatggaaggaaggaggatgagggggggtgtgggngaagaattgggtggggtgagttgaagatggngaaagaaagggagagaaaaggagggaggaggggaagggcggtgtagataagaagttcgtaagaagggggagtggaggggttatgagagtgttaagaggaaaagagcgaggtgaggagaggggaggagaaggaagaagagggggggggggagaatgaagaggcgggggtggggttgggttatgcgtgatgagtgtgtttaggaatttcctatgtgattcataaattttgtgggttagagatagagaaatatataatgtgttgagtgtataatgagaanntttattaaagtgaataggggttgggagagattgggtgtaggttgttataganggtgtagnggtggtggggtattaaggtaagtaattagggaagagggggacgggagaaggagttggggaggggagtggtgtaaagagaaggtaaaaagagaaatagtggngctagtggggaagttgaagggtaaaggagaatgattgtgggggttggggactttgtattggggtgtgggagggnnntgatggaaaaaaatatataaactgaaataaagaaataaaaaaaaaatacagtaagctctgaataatataaancggaatttatanacaaaaacaaatatccacaataaaaactaaaatattttttactcaataaatcaaactcnnccaactcccccccaccccttnnncccaaacccc

SEQ ID NO: 11870 - DNA, 1660 bp, Homo sapiens
  misc_feature (1)...(1660): n = A,T,C or G
cgagcgagtgacgcgacctggcgtcggacgtgcgatgcagcgggtgcggcgcagtgcggcgnggtagatcccgagagtnggctacctacgcgcggtccacgttgtacatgttcgcgtcgancgtgcgtcacncgcatncnccgtttgtagantccgtcccgtgcgtcgtcgcgcaacacactactctctntgctcagtactcgagtcgtgcgctcgtcgcgcgcgtgtgtgtgtaggcgtgcgctagcgagncgcgcgcgcgggcgtggtcgggggtctnagtgtgacgcgcggctggtgcgttgtctgtcgcgcgcgcngcggcgcangtgtgtgggtgacgtcaccgcngagtgcgctcctgtanttgtccacgctctctatcacgatccgcgcgtgtacagcacgagcgcgcangccgcgtcgctcgtagggtcgctgcgagctagacgcagtgccgggcgcgctagagtagtcgtgcgtcagagagtcgtgtccgtctgcacgttganggccgtcgacgcagctctatntgtcgcgtatcgtcgagacgtagcgtcatgctcgtggcgctgcgtcgcgcctcctgagtgcgagccgcagctctgtagcctcgacgcctcgcctagtacgtaggcggtgattcttgaggagcgtggcgagagttgctgctagcgtgcgtgacgtggcgcctgccatcatgctcgcatattgtttacgtctccgcncatcacgtggcgctgatcgcgcacagcgtcgncgtcactacgctcgtctgcatcgtncgcctgacgggcagagtccgtcgcctcgactcgctcgtngntgcgttgtcgttgtgcgctacctcgtgtgtgcgtcggccgtagcggtagtagcgagtngttangtgtacgtgctctgcgatggcttcgcgctcgtgctgcgacgganggtgcgcgggagagcgctagttctcggtgtatgtgacgccccgcgctcacatcttcggctactcatactgcgcgcttctggtctctngtgtgagatctccgcngtactctctgtttagcctcgtggcggtgcggcgctcgcgggccgcgcgcagagcgggagtgcntcgcntctctcgccgtcctnggcgtcgtgcggcgcgtcggcacgtgctggcactgtnttctccatcgctncgatgcgctcgcccgatnctcgcgctcgcctccgggtttctgcgcgtctggtctgtgctcgtctgcgntggttgacgttagtatgtgaacgcnttacctgcagcgcgcgctctcgaactcccgcgcccgctccgcgcgtccgctgcgtgcgcgcggagcgactctcaccaccgcgacgcggcggcgtctctccgngcgctgcgcgcgacgctgcccgtcgcgngncgcttcgcgggcgcgcgttcgtggccggtgctggtagggtggtgatgttgtgtgtgtgtgtgcagtgccggtgtgcgacgcgtgcgccgcggcgatgagccgcctctcggcgcgtgggcgccgatgcgtgtctcggcgcgtgcagttacgtggcttcgcgcgcgggacgcggctgtgccgcctgtgccgctctcgacatgtcgttggcggctcttccgctccttggtcgttgtctgcgctgtctcctgcgcgtgtcggtcgtcgct

SEQ ID NO: 11871 - DNA, 1194 bp, Homo sapiens
  misc_feature (1)...(1194): n = A,T,C or G
ctgaagctgtggagcatngggcagattgcaacncgcttacattcagcagaacgctccagtaaagtccgactagccgatcgcttcgagagtaccgcgaccgggctccttcttattgtgtgcatctagaagaggctncgcagcacgaccngcgacgcaggtccgaacagctcttctcgtcattcctgtcgcttacgtcgcccctctgtactcactagatcccgcaattcacctcagtcctagcctagcacgacgtctctagtgatctccgcgctatcgcacgatcggcatatactaccgctcgctctccgcgtccacgctccgccgccagtccgcccacagccacgacacagatatttcttcgcgcgctncgccacgcccgctctgccgccacggcgcggcacctcctgtcgtcagctctctgcgtcgtactcccntgcgcgtctatccgctctcgagccgaacgatctccgactcgcctacaccccgcgctatcaccgtggtcgccacgccgggctacctcacgccatttatatacaccgattctacgcactgtcgtacgcccgccctccacctccgcgcgattttcctcgctgccacctctgccccctgcccacacagctcgcaccgttcgcccgtgcttccgcgacccgcctccgttgctactgcctgaccgtccacgaggcacgtccgtccgactacgtacgttgattcgcttatccaccaccaccagccgccggaatgtctttccggcatattaactgcgcgttgcattaaccttagtgtaccagcgatgaactatctcgtcccgcacatcgttgtacgtatgtttgtgttcgtcgttatgatatcggtacagtcctaccgccccccgatggtccctgcgatgtgtatcagcgcccgtcgggacacccctactctcgatccatgcgactccccaccgccatcctcggccttcncctgacgtcgagaagacccgccttggtcagcgcgtgcatacacccccgtcagcgtaccggcctgccgttggcagtttttaccacgcgccaccccccgctcggcggctcagcgcgctccatactcgctattatccgccgaccccaccgccccagcaacctgtgtcgtaccactactcccttgcgcgtcacgatcccgcctcccangccttgtgcacccgccgcgcgtgtgcgtcctccg

SEQ ID NO: 11872 - DNA, 1537 bp, Homo sapiens
  misc_feature (1)...(1537): n = A,T,C or G
agccagcggtcgtgtgcgcggcgcgcggggcggcagttatcttgtgtgttcgctgtgctcgnangatatctcgctcacggtgcgtaactatcacngcacgagagtgcatgagacagtcacgaggcatatgtgactgtatacgccttctaacttacatctagcatcataatatcactctgcacatctaatactatatgcatctatctaagcngtgatatgtagatatgagtganggcgtacgcgtgcgtagtcgctacatcatcatacagactgatcaggagagaggcagcgactcatgttgttgtaataatatacataattactatgttgttactattagtacanagtataaatattactctcaaggaatgtngcaatattgananngcggtgaaagatacagcganactatgaggaactggagaccgaagaggaagagagtaacgataatacgtagagcaacatatggtgcacatattgncacatagtagataccatacaactaaantggtggagagacagtagtatagtgtagctctaatatgataaaatacatatatgatcaagagagtaataggccgatacatctacgaccgggcntctatctccgcgtctctctacggaggtggactctcacctactaataacgtcattntcttactntatcctcttattaacccttcatactatnacgtgcacgtatgatngaanattgcgtgtagagaatactgtagaaacgaaatgatacactaattcatagaaagtacttaaactacatattantctgaatagtngatatgatngtgagtacatatgagagaaatgtataacatgcttaacgattatgtactctcgtaaggagggntatatgtatagagatgaagctcagaacccacaagagggatacgtgagtgngcggagtacgagtggtaccgggaagaatatattggcgcagaatacgactcgcttatatcgtntagttnttggannntggatacaattantactacactttatcttatacttcatnntnctacaacttattactataacatctcctacactcaataantaacaannacacactactcacaactactacattcatttctcacctcgtggttcatgtttctctattgcttatgttagccttgtgtacctgatcatctgctcactctacagagcgtatgcgtntgagcgcacatgggggtcacctgctacttgcagcgccgagggngacgtgttgcatctctgnncccancctgctttnnnnnctcttctcttcgctgtcctcttttngtnnnnnnacttctctgctcttnnnnncgcgcctgtcgtctcnnnnnntttccnnnccttctntnntattttcttcctgcttcnncacttntntactcnnctccttcatnctcnnccctctcccnctctttcatactttattcctctattttatacntatcacaccacntccaaaacaatatattaaaaaatataatataataactctatanacaacatataacaactaaaacaaaaa

SEQ ID NO: 11873 - DNA, 1272 bp, Homo sapiens
  misc_feature (1)...(1272): n = A,T,C or G
actatatctactattacagctgtgacatcacagcgattaatcgacctcgcgcgatgtacatcactctcgtccgnnnnctcttcagatgcttctacgtacgantacacctcctntgctccatcggtnngcctaccactactacganaactcgcaacgtcgagnacacgtgcgcacataacacggagagcgagccagcagacgacgagagcgatatacgctctgcgcaccagtacgcngnncccaacgcacagcgcacacacaccgactcganacagagggccgacaactggtggggcgaggctggcgcgcgaatcgaggtgtagatggcgatacccggcgcgccacgcgctgtctaancgtgccacangaggagagcgagagacatccgtaatgacaactgatgaaaaaggatgaatctcaacggacaagttaatggagagatactgagctgcagccatcgcgacgacacactgctagtacgagcggcgagtcagcgacgcaatggggacaacgatactttacatacgtggcagtggagccgcggcggttgcggggccgaagggcacacaaagggaccagaacgactacttatgagtacaaatatanatcactatgcactatacaatgactcatatannnaacataatagctctattgtgtgtggctagagttaagggggaggtatnttgttncacactaccactcaattatcaatcagcgcggcagcgccgtctantccccacgtcgagcagcgtgacagtattgtggatgcgtaagtgnntnacggcgcggtgggcgggcgctggccgggtgangtgtaacagagagcgtcggagacttacctaatggttggggtggggatctacacctagtacaagaanaaaaagaacgagggtgagtgcggacgcgcggcgcctgagcgagacgggggtgacacaagagaaagtgntcgttgttgtgttgacgtctgtagtgtgggggctgtgctgccctcgtgcgcgagtactgcgaggagaggggcgtggcgctcaacgcgcaaatggnatccacagcacggggncgttctctccatctctctanccctatgtctatttctttctccgacacacaatanaacaataaaatnctacatcctattattaacatcatcagctgatacacttataaaaacgtacaccattctcagctattatcataagannncctcactnncctcacacactcacatcactnnnnncctnnncccnnnccccctccnnnnccccnnncccc

SEQ ID NO: 11874 - DNA, 964 bp, Homo sapiens
  misc_feature (1)...(964): n = A,T,C or G
tgctgcgttacttcaggtcatctgttccttctgagacaacatggccaacgtcttgaaaggagtgcttatagaatgtgatcctgccatgaagcagctgctactgtacttggatgagtgcaatgccctggggaagatggcatcatcgtccgacctgttgcgcactcacgcggttcatcgctgccgcttacactcctcgccctcgctcctgcttcggccccgccgccggtggcgcttttttttcttcccgtttgtcttgcgccgtctctctccgcttccgcccccgcccgttttcgtttccccgtggactccctttgctctctgttgtcctctcccgggggcggcgtgtttctctctttcgcttagccccctgcccgcttcttctctattgctgttactttgtctcgttctggatcccccgcccccgtccgcctctctgcctgtatctagttgtctggtctcgttgtcctgtctctttcgcctcttcggcgtcggcgcttgctgtcttctgtaggctcgcggtttgccgcccccttcttttctgtgccttttcctggctgttcctcccgctcggtgcctccgccctttcctgcgcgtttttgcctggcgtgtggctttttctatcctcttcctcgctcttcttattgtttgtatgttcgtcgttttattcgcgcgccgcctgtgccgtggccgtcggttcttttgctcgtgttcgcctggcctggtattgttttggctggccgcgttcttgttgttttcgcccagctccccgtcncccttgccctgtgtccgtctttgcgtctctctctgtccgccgccttttgactgtctccgttgctgcctcctggctccttgcgtttcgcgctgctgttttgtttttctatctccctgtgcgagagttttgctgtctgtctgatgtcgctggtcgtctcccgcttttactgtgcttaccccctcgcgacccgtg

SEQ ID NO: 11875 - DNA, 856 bp, Homo sapiens
  misc_feature (1)...(856): n = A,T,C or G
cttcagttctgcaccccaggaaactcctcggtcccagacaaatggagaagattgggcatcctcctgtaggagtttacaagctgatcatgttgggaaaaccatgtcttttaaaagtatgtatcccaagactctgctgggcatataataaatagcaaatattcacttatcctggacactaactggaatgctttcaaaagagactgttttcccagacaattcccaaaaatttactaatactaccctcacatgattagaattatctcagaagatcttttctctggcaaaaaataaaattgcttatcgttaaaatctgactcacagagatacttaagtaaccaaggattagggnagtncagaaggaagaggagagcatagtgacctanaaagtctctgtgaagggccatgaaagtcacaaaacatcaaagcgaggagaaggcaatccccttatttatttacaacgactacatcttgcactccttcttgaagggcagaactggcgcccttgttttttttgggcacaatgcctgaggcgaggcattaactctggcgcaacgcccgccacctcaggttccgttcatattcacgctgttgatgcctcgtgcgctcgctgcatgttataatcaggagggccacatagggtcgctctaacatcgccagtattggagcagtacctcacgggtgcgtggctccggcgcgctgtcgacacggtgtgtcaccgtcgcagagtcacaacgcttccaccccgcactccctcgcctgcgatttcatgtccttactccccctgcgcacacgatcagccagcccttaataactgcgatagctgcgtcgtgggataggccccaatcacatctcctcg

SEQ ID NO: 11876 - DNA, 1831 bp, Homo sapiens
  misc_feature (1)...(1831): n = A,T,C or G
gacgcgnagtcgtgtgatntcagtcgtagtcgcgacaagaacgcgacacgggttgcgtancacgnagtacatgaagcatanatgtacancantagtacganctgtgtacgatnatgtctgtctangtcgtcgtagttgcgcancgtagatgtgtnatagtagtgagtagatggatcacgcactagctcacanatacgananatcatnctaattccatannttgnntatntacgcnggcgcgacagtgngtantatatgatntngcgctaganttgtntgacngcagcnngtttgctgnagatcgcacngnacgtcgaatatgagantgataggtantgtcgttacgtaggtatacaatggcatgcacgngagtgtagttagtaattagcagataagtgatatatcatgcgcataagantctatatncgantcantacctgtgatacatcntaagtntgagtagactgagtntactctattagctgcgatanactcattacagtgtgatagtcgtgggtatagntanatagncgtgntatagatatatatacatagcacacatgtatgagantacnatcatcnatcaaactatcgagtttgatatcgntctatcataatctataactacacgacttgaagctcatantacgtcaanaacgtagtactacatatcactcgatacataacatgatanactacactaagagtatgacnttatttaatatcagtgtgcgcantctgagtgatatatanacaagttaactgtagtatagtntnagtcatcncatatacatantctgatagagatgtactanggacagtatcgcgacgccagatcacaggtcatgtggtagacagatatgtgtatgtactgtcgctaatagtcgctatgatcngacatctcatgactcgcatctacgactaaanantacacgatcaactacaacagacancagtagtatgtataattcatgtacattatactgttagatggacgntgctctgcgnacatatataatntggatagatagtgagntattgtgtatncgtatganagnagcgacatnncgcagctatagatgttctaagctgctcgtgcagtagagccatcgtcatgcattgagatgtagcacgttntgtntgtcatcattcgtcgatngntcgatgctangtangtngtntagtacatgtntcantatgttgntctgagtgatcatatcgtncntcangantagtcacagtangnaactcttcnacgtnctgatagcaatagtatatattantgtcacttctgtacatcatctgatcagtctagagtgactatgctacgatgtctagatnatacacatactgactctagcctgtgtcntgatgttatgtctaagctgctcacgagtgtgtactgtgcgatgatcgangagataagtacgcatagtgtggcgntngtggtgtgtgcatagtcatgatcatactagggctagtggagtgcggcgtggagtgatatgtagaataagacanacatatganagaacgagtaggatgctcatataccgtctaaaatgcacaagtagcgcagacagtacantgaggtgtgtgatggcgtagatgcgagacagcgctcatatctacgaagtcgtagatctatgacgtagtgctgcgtgagtctcgatcgcgagctgntgggagtgtgtatgtgagatatgctagctcactaatnatttacaggaatatntgtagaagtcatcatgtggagtactgttgtanatgtatgatttttagaggacacgtcggtgatatattgttctagatcgatgtatgttgttagtatata

SEQ ID NO: 11877 - DNA, 763 bp, Homo sapiens
  misc_feature (1)...(763): n = A,T,C or G
ccccccaggggcccagccctttncctcgtctcaataaacccccatnccgtccccccttgncaagcacccaaccggccagccctttttcttttcgggccccaccctccgcagggctggtatttaanacccgtacaaagcccctgccccctagtntaaggttttatattcactttcctcgcccccaatccccgtccgtcctaggtcccagataaatccaggcnaaccattctacctgtattaaaaataaccaagtatatnaagtaaattattccaagtccagtccccactccatgccaaccctaccaaattctttccctccccatagagaactgctttaaatagtttattgtggctcattcntgtgtttctcttgtgcaattcatgcatatattatatataattttttcaaaaacagattcattcttttctacatatatacgtgtgcatatatatcccagaactttttattattactataatatagatttccctcattacttttcntagattgaagctgtaccatatgggtgtaacaatgtaactattttctcatctgtgtacatttagttcgcctctaagtttttgctgtcactattagtgctacaaagaacacacgtacctgttttactgtggtattgaaaggtaggtggattttaaatttgatatattcaattactgtgtttataaatggtgtatttttttggagggcaacttgggcagtatccccgagcccctaaaaagttgccaacctggcagggaaaag

SEQ ID NO: 11878 - DNA, 1532 bp, Homo sapiens
  misc_feature (1)...(1532): n = A,T,C or G
cttatcagatnggcacgtccctctcgcatcttgtatgtntngcncgcaggccccaggaagatgacaggtgggatgtagaacgttcggtctctacagcgatacctagcactctccccaagtggatcaatggtgatggtcatcctcgcactcgacgtcttctagagagtgatgcntgtggcatatacacgtgctgaccttgcgcactcattgcncaccaatatgaatattatattggtcaacttttaaagtcacgaggcatcgtggngcntngcgacactagttgtntngngcacnnagtagctacgtgtgccttccctcncaccacctanncatagtgngactcnatacgcacatccgctcacttttagagtacttctcacaacacatggtacgcacttgngatgaatattaancatgtgacancttggaangcacaacaactanncttctctacgtgcttcctgtgctgaaataagatagaaatatccatttggtgcatttgantgagagtgtcacgnanaggtcatacgcacgtatnaacacagaagagcactaccactnnttnagagctatcattactttcacgcaatnntactgagngcggatgtcaanaaattacactgcangcgcagaagactaacgacaataacctnctancgattaccactcttagttcttctcagacgacaaagaggttcactatggcaacattcttctacataaagatctatntgcanctatctncgaggcgatggagcgactatacacagcaccctgtgcccagtgtcaattcactctcctagtaagcacattgacaatgcttctgtagcagacaccataagccttctnagntacaatctacaaacgtaccactggtgaatatccccattgtcactctgatatagtaggatacgcctccatctcacctgcgagcgccggagtaccacgtctcactctatctggatctatgangtcatctcccctcctcccttcgcgtatgacaggagactctaaatcctactttaccacntgcgatgaggatgcacactgctctagctacgtatccgtgctctacatcgatctnacatattattcancgcgcggcgcgcgctactgtgtcgtngagctttattctcaatctcgctgccacgctaccgcgcgantcgtagatagtccttgcagctgtgcacgccgactccacgcgtgcagctgctctctcctcacactgctcactacaagaccgcgctatctctcagtcacgcaacgccataccagacgacnctctacgtacgatcgctcgtctccgtcacgcccgctagcantcatntacgcactcgtgacgtgccgcgtgacggctcaacttcgagatctcagtgccctatcgcgtccacgctgtcgctcgccnctcacatcgtgcgcgcgtctctgtgtgacatatgcaagaacagcgngcttgcgcatcgatgtcacnncgacccgactgcggtcgtctgcgtgccttgagcgagcgtacgcgcgatgtaacgcttgnt

SEQ ID NO: 11879 - DNA, 1444 bp, Homo sapiens
  misc_feature (1)...(1444): n = A,T,C or G
ttatgaagttgatgtgtatatttgtggagtcgtatctatgtgagtaagtagatatgancgatgacgatatcgtatngtcagtgtgagtgcgtgtagtgtgngcgtgatgagtgtgcgctggatgnagccgtgtgacacgcctgtatgtgtgantactatctctantgcgcntggcgtnctggtctactctgtgtgtagacgccctgcgtgagtagggctatatcatacatatacacattctatcctatagtgttcttcgttcgtaggtagcgtgtgtcacggcgagctggctatgacgctctagtgcgcgatccgatctntgtggangttgagtgtgtattactggtagcgtaatggtgagagctatttatatatctacagatgtatatcttatantactagctgctgtctctgtcgcgtgcatcngtctgtcgttgtcgcgtattcgtctcctctgagatcagtgatgtcgcgtatcgtcggacttcgtgggacaactggtacatgtgctgttacatagacataacgtagagtttgcatatgagtattagctagcgtagattggtgtagagagactgtatggtgagctgggcacggtgacatagtgatcatgaagggtcatggtatagacttagagaggtcaggaggtcgtgntggtattagcatnctattaactgntgtattatcgttgtccgantgtgtattattgcccaatcttaacccaccatagaaaacatacggtgagagtaacatatcatgtataattacgattacacgtgtcttgtctccctcatcatctctgtgcgtcacgggtgcgcgcgacgacacagtcctcgctcggtgtgcgctctctgagctgacaaacatttcaatgtatattagacctggaggtgagcacacttcggagtattaggatccataggcgcatgtatcaagctgggtcgcgtcacgactgccgacgacattgtcnaatgatacaacgtaggctgtgtaatatccgganctatcgacgtaagcactacatgcgggctgccgggtcggcttctgatctgtatcggcggtgtctcgtgtctgatgttaaccctcacggcgtctgctccctgcgcgcgactctccctaggtcgtcctcgcccactagactgtgtatgggcagtgaggatggatagatgtcatgaggcagcgtaataagcatattgggatgacgagctagtctgatcgtacagttctctgtgctatnagtaatcacaattcacattgaacatattagataaacagctactaggtgaagatggcgatgtgttatacggttgantatatatctttactngatgttctcaacctgtgtacgcgcaacagatctgtctcgcgtcacgttggtaanttagatagatgagcgttggtgaagtcgtggcggtctgcgagttgtcggagctgagttgcgtgc

SEQ ID NO: 11880 - DNA, 768 bp, Homo sapiens
  misc_feature (1)...(768): n = A,T,C or G
ctcagtgatctgcccgcctgggnctccaaagggtgggattccaggagagccccccctccggccttgaatgggatcttggatgtaatcaccggaagcgataaggggttagtttcccctatgggtcccaaggttcaaatattaagggttctagaatactctgattccttatctttaacaggagtattgcaatttttttgtcttgtcttttggctgtccaataaaaatggttgagacccccttaaagtataaatttctaagatcaagtccaagcttagcctaaaaggatcgatcccattgatagtttaccttattctgtgacttggaaatagtattatgaaactgatatcctcccactactgaagaaactaatctcacagggattctgaatcacaaacgaattttgctaatttatttaaaagcaaatgatttggttttcataatttcatttagaaattcagagacaatgaaatggattaaattctactgacttgaatgcaattgttttataaaagagcagcatctttccaagctatattactcatctaaaatatgtatattcttaacccctatatttggaccatgctatttctctcatgcagaatataaaatgtgagaggacacatgaaaccttagttttaaaaacatccggatattttctcccattgatcagtttcttttcagatgtcagaccacaaaaaaaatgtaataaagtcaatatcattcatgattaaaactcaaatgttttaaaaaaaaacaaaaaaaaaaaaa

SEQ ID NO: 11881 - DNA, 1100 bp, Homo sapiens
  misc_feature (1)...(1100): n = A,T,C or G
ctcgtgttgtgtntgtctccttgtgtctgcgtgtcggttgngttgtcgctctccgtgttcgggtgcgtcggcggangactctccgctcgttgttgcctctgtagcctcgcgtgggcgcggcgnggcgctctcgctctcttgtgtgttcgctgaggaggcctcctccgtccctcttcttgcngccgccttctggggtgcgcgccgctgcgctcgttgtgcggtangactctgctgggcgcgtggcctggcctctgacgacgcgncgcgtgttctntgctgcggggttagtatgcggcgcggcgtccggncgcgtggtcggctggtcgtccggtctgcgcgccgcggtangggctgtggtgggtggctctgtctgccgtgttcgttgccggtttcgacgccgctgcggatcccgcgcggctcgcgggcgccgtgttctgctgggggtcgcggcgtgggcgtgtnttagtgccgtctgctggccgcggccggcgcgcgcgtgcgcggtgtgtgtgtgctgtgtcggnggcgccgcgcgatggtcttngttccgctgggggcgccctcggcggcggggcggcgcgcgcggttcgtgtcgggggcgggggcgtcggccgcgcgggggtnanttcgttctcccctcgcgtcgttcttctgtatttctcggccccgcannctcgtgcttcttctggcctcctcttgtacgcttcgaatctcccgccgcgcggtagtgcttcgttctcccctccgnanccgcgctcgtncctcgcgggtttgtctnctctcttcctctccccgnctccctctctctaaaagagtcccggtgtgtttctcctgggcccgtgtctggcgggccgcggctgtcgggttccgtcctcgcggctctcccttccggggcccccctctctgcncctgctcctccctcgctcgctcctcgcgcggcgcgnccccgcccgcccctccttgccccttgcggcgtctnccccccccctcctcctctctccccccctccttccccagnccccctcnccctcncccncccncnttccccncctcttgggttttttcccccccaacgtctcttnctttggttnccttttagg

SEQ ID NO: 11882 - DNA, 873 bp, Homo sapiens
  misc_feature (1)...(873): n = A,T,C or G
tttcagttaatctctcttgaagatatatagnnactgctgagaagtgaacaaaatgtatcaaggctgcagataaaaatataattgtgaataagaaaacaagcagcttatatcctggatattttaaatgaagccaatgagaatataaatttaaaattacacatctctagactgcctaaagatttcacaaaatggtgcctccaactttgttacttatcctcttttttatatcaaagtatttctatgatattttaacttttcttaaagtgtattggtgggtttctaacataggtaagattacctgtgttcgatcgatagaaaatcattttttatctcttttttattttgcttctactctagtctgtgtatttttaatttacaatatatatacatttataaatttataatttcacccatcgagggggaaaatactgtacctagctatgtactttaagcgatgttgatcttcacgcggacacttatctcggctccacaatagggatttccatctaccaaagctcttatcccgctcttaacaaaagaaagaaagcggcctcgttggccccacgcggcgagctcttgggccgtttacatttaaaagggacaatccctcacccccctcatccctcagtgacccgcccccccgctgcggaagcgctcccttacctcaccggatcaatccccctcccgaactacggccacatctacgaacactgtcaccccaagtcccccccgtgcgcgtacccgcccgggccgccccgccaatcttcgtcgcctgtacattaatcgtatcccccgcgctctcgcatctgcgcgatgagcttgctcaactcgaacccccgtctcatcctatctcctaccgcactccattcccgc

SEQ ID NO: 11883 - DNA, 1388 bp, Homo sapiens
  misc_feature (1)...(1388): n = A,T,C or G
cgacgaccacgagtgcagacgaacgcagagcacagcgaagcgaacgcagaccatcaacacccgcgcagagcaggcagagagagagagggaggagaaagacacagagaacacccacacccgacccccacacaaagacggggggggggacagaccagacacgagaaagacgcagcacgacacagtccaacaaaaaagacaacggcagacggagagaacacgacgaaaacacgccaaccaacaagaagaaggagagaacaagcagacgacaccgccngagagcacaacacaacgccgcggaccacagcaagaagcacaaacgtcaacgacggaacaaacaagacgacgcgagcgacagacggaagaaccgacgagacgacccacggaacgaggacatgagaacagacaagaccgacacacccacagcagcagacacatacagatcaaccaccacaacatcgcacgcagctccacacnacacccgcaacgacgaccaacgcacagcacataacccgacaagaacactaaacgacaagcaaacacagtcagacaagagcgcgagactccctgagacaccgacacgncagacgagagagacagcacaaatcacatacaaaccagcacaacaacgaaagagaagaaggaatagtaataccagctacacacaacaaacaaaaagaaaggaaggcacacagaaaaccagggagagaaacagaacgcatagagtgatcagcggttgtcgtaatagtgattagtcacaaggaagaccatacacacnccacgagcactacgcacgacgcgaccatagacgcggaaagagaggcacggngagcgacacgcccggcccgcgagnggacaggatggcggcgcggaacggcggcgcaaacggagccccgcgctccgaaccgtgcggcagagagcacgcacgcgcgcagaccacagagcgcgggggcggccccggcgccagcgacaccacggcccacatcgggcgcgcacagtagaaggcagcgccccaccaacacgagcggagaaacgaggcgcggacgagcaaggaggacgacagggagcgggcgcgcggcaggcggccgacagaggcgcacacgaaccgacccgggagaagacggacacgaggaagcgcgcggccgggccgcggacgagcgcgaaacggccgacaagcgcgaaaagaccgcagacccgaaccgacacagacggcaccgagncgcagaaggaaggagcgaacaacgcagggcccaggaaccgcaccgggacaagggcgggacgcggacgcggagtggcaggcgcgaccgcacgcgaaccggacggaccgacgcgggggacggccagaaacccgacgccaacgaaggaaagcagaaagaaagagaacagcacac

SEQ ID NO: 11884 - DNA, 469 bp, Homo sapiens
attaccaagaggaattccacgaattacttgaaagagaggacttttttccagattatgaagaaaatggaccagatttatccggggctggtgatccaaccttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattcccctgtcctggctgcaataaaatcgattttgaaataaaaaaaaaaaaaaaaa

SEQ ID NO: 11885 - DNA, 1320 bp, Homo sapiens
  misc_feature (1)...(1320): n = A,T,C or G
cacatgacgtgattatcgcgcataatataacggtaacgatgcagtagagatgagtaaactaacgttcttgtgttgtgagtctgttcgttgttctcgttttgggcgcggtccccacacggtctataggtaggcgancatgattaagcggaatgcggctggggtgcaacatctcagatggccgatgtcgatcgcgcacatctgagacactgcaatagccttcttgttaccgtagtcaaccgtcacctcacctaaaccataaaatcaacttcttgnactattcaacgcgatgttcgtaatatctatgttcgtatgtaccatgcgtagttactacgattgtgcggtggagaagtcgaaccatcctgacatgtctngtactctctgtatccancgacgcgacgcacgcccgcgcgggtggtcgtgtgggaatgcagtagcattaagatagtgcctaagcgcatattagatggtatgatatatgccgtccgaatgattctgctgtggcgtatcgtagatatatagtagatatgacgagcggatgggacgaagaaccgcgataatatgtaggtactgactgcgagatcgcacggatgtgtgttgtatttcacatagcctacatgtaatcctctccgtgacctttgacgtcttaatcgtcatatcgctcatcactgctacacgtatagcctctgctcataagagtagacgcagggagatagcgcgcgaagagagatgcgacgagcgcagtgccgaggangtaggacaaaccctcatacactggatcgcctcctgcacaagaaagcaacgcgggacggctggctacggtggtgagagnagatcgtgatttatctatggaacaaagtatggtgntacttgtgtctgaccaaggagcgtggtatatcaggaatacgctggtctatcatgtgtacggaccgtctccaaggtagaggacgccgcgcgcgccaccgagcgcgcgcaagacgagagaacacacaaacgacagaccaaagacaccctactgcaagtattcacagtcttggcaaggttttagatgtgtggagtgtggtgtacgttgagttggacagcaatagtgaacaacgacgaaatataaaacaaaagatgcttcacaatcaccacctgtgggactgtcgacggacaccgcgctacgcgccgcttgctgggctgggcggcccgggtgacatctcgatgcaagctgctgtacgcgatacaacgcgcgcgctcgtcgtcgacgtagtttgggatggaacgcacgganacggcgatcgcgactcggagcgggtaatagcgcgcgcccggacacgacgc

SEQ ID NO: 11886 - DNA, 1453 bp, Homo sapiens
  misc_feature (1)...(1453): n = A,T,C or G
aactacgccgcgcatgcggacgcagctacgagcgccgagtggtncncacacgactgctcgcgcccgcgtcgcactgtgcgtgnggngcgagtctgcacacgccgctgaacgcgcctaatagctcacatnggactcgttntgtactctacananatctcctaccactacggggaacacatcatatagattctgttacagcacaaccgancgcnagatgtgnngtctatgtgtcgtgcgtatgctctgtgnnagtggctgtggtttgtatgctttgtnggacgtagtgtntcgtgttgtcgcgtatgacacnctcactcatatcggcgatgagcacgctctgacatagtgagangggtgtctagtcgcacgagtcattagtantgtctcctgcgtacgatgacgtgcgccagtagactgcggtgcaactcgcgagagagatatcctgtcatgaactgtataaaggngagcgcgaggcagtgtgttgcgctccacactactcgcgcgcgcagacacaaacaacgcnattcacacgtcgcgcgcacgcggtgaggtttaccagagaatactgagtnggtgcgcgcccgagcgttcgctgtgcgtaatgaatgntcaatactgagacgcacgcgctgtcgtcgcgtgngaaagtgagaagaaacggcaatattgtgggtcgtcgggaactgcaagagcagaacgagcngcacacgtcgcacgacacgaaagtgtgtcgctgcgacggcggcacggtcacgatgtatgtacgtacggagagtcgatcagctagtgtacgtgtggtgtggcaatcccacataagacacgactggagacgtgaccacatgcacacactacgtcgcgggcgcgtctgcgcgcgtctacacatgacgagggcgaccgcnnnacttccatcgtccacacgaaccnacacaagtngcaacccgtcagaatctcggcgaacattgtgggtgttgtacaaaatcctcgcagaatgggcgattctagatcacccccccacgcataaagagtagggaggtgtgcgctccacgccgctaggnaccgcattgcatctccgtatgtgcgcgtaaaacacggggngactctctcgactctgaggtccgcaccagactgtgnatcgctatcaggtgnagacctcgcgagctgatggctcagagtcacagagataaagaggggcatgtgggattcagtttgccgtacgggcgcaactactgctcttcatgacacgtcacgtctccccgacccgcgccaacatattgggatgctcatgtgttccgacgaggctgttggataaaacaataaacaaagaaaatgtgtactccgactgcgctctatcacctggtgggtacgctggcttatcagctataacactgcagcaattcgcgccgcagngacacatgactgtgagctcgctgcgcgtgtatcacgtccgtgacac

SEQ ID NO: 11887 - DNA, 288 bp, Homo sapiens
tgctcagcaactacagaatctagatgagtagcaacacagaaaactggactgtcaacaaagaagacagaagtttgatatccacaagaactaagaagaaatcactaaggaatatataatctaatttgtatttgaacaaacaaaccgctgaaaattaactcgacttaaagacgtcaaattatcgtccacaacgcatgccaactcagctcctatatatctcacaacaaaacgccccgcaatccatcctatccacctctctcaccacatagaagagcctcaactaccccctat

SEQ ID NO: 11888 - DNA, 1473 bp, Homo sapiens
  misc_feature (1)...(1473): n = A,T,C or G
ctatactcantnactctctaacgctacgctacgatctcttgcgntcatctcgtctcgtttgtgtccgctcacacngtatcangctgatctngcatantctgcgtcatatgcgtgtcgtccantatgctgcatcgcngcgcacgntctctactccgtgactcctctccacgcactactgtgagtgacatgagacatatcatacttcgagantgctgctgcgatcanancatctatagtcagtacagaatnccgtagcacanacaacatctacactctcgctcgactatataatctgcgagatgagatcgatcctattgtcctacagtagatgacattatatatacaccgtagacctcgactctcagctgcgcacactcaacatcatctgntcanagtgtggtcgtactgtgtcagagatagactcgctgcgctgcgagacgtgancnacaatcgatcccagcgtcctcgttctcgtactgatacgctcctnctctcgcaccgagcgcaccctacgagtaccgacagcgtcgcganctcgatgcagtagccatagtacncacttctcncatcagcagcgtgagcgtacacgctacttatgctcatctngactacancaacataccactatcatgattgtcgtccattccgaaatanggacacctagcaattcgtnccgtgacggctcgcagagaacagcgaccgtgcgtcgtcgccgtcgaacaaggtgaggaacgcagtggcagatcgccgtgcggatatatagcacagacgtctcatcgctcgctctggcgctcatcagtattncacctagcaggtgtgtctcttctacacgctctatcgacgccgacgcactaagtcgatgtatgatactgtnctgtcaataatagcatctgcgtanataatgacaatgcgtgcgntgatcgtaggtaggttcacgagtagctttcagctagtaggatgaaantgagcgagatgtgcgctctatacgtaagatntgangtcccagctcctctgagagaccgtcatacactgcgtacgcggtcagtgcgcagtccagcacaccacgtntgcgtgtcgaatcatcagcacgcggggagccgcgaagcacgtacaatcgaaccgacacgccccaatcatacttctcatatatcatgcatgagaacagagtccgacttagcatgctgactactactattctctcacctactagctagatagcatgcgaattggtgtagtcgtttgctatcctagcacaatccccgacgtgcttgcctgcaccctacacctatttcaggtgggctatgagcgattcgatatctttattaaacgcggtgaactcttatgttagcgataggtaagcgcgttatagttagcgtttgtcttttaactttctaaagcggcgggcccagcggtgatgaacgcctcacgtctactacgcggaatcacgccacagctgcgcctactccgatcggc

SEQ ID NO: 11889 - DNA, 250 bp, Homo sapiens
  misc_feature (1)...(250): n = A,T,C or G
tctctttgatcagcgcacaccagtgcctancatgnnctcactgcccctcaaacttctgggctcaagtgatcctcctgcctcagcctccggagtcactgggattacaggtaccaggcaagaatacccacatcaacaattggaagcagtctcgtggagtgctgtggaaaggcggcggattaagatcgacttcggaactctctcttcattgctactctcgcctttatctaacatcccgctccctacgagctaa

SEQ ID NO: 11890 - DNA, 686 bp, Homo sapiens
gccggctgtcgcgcgggggggacgcccgtgtgtgtcttcgtggcgccgcctgggggtcctgtgcgggggtggtccgcgggggccgtcgtgggccgcgggtgtcgcctcgcgtcgcggcggctgtgtgggcgcaccggggtgcggggctcccgtgggcggcgctctcggggcggggtcacaggggcggccgggcgcgccccgggcggggctgccctccgtcctgccgggttttaggccgccccgggggcccccgcccccgtttgggtgtgggggctccttctttggggggggagggggttttttgggcgggagggggcccgggagtgttttggggggggggggcgccgttttttgtgggtctggggggggcgccacaacacgcgaggggggcgtgtgggggtggggtttcggcgggcccccggggggggcgcgtttttggggggccctgcggggggtgttttggtcccccccccccccccggtgtggttggtgggtcccttggggggggccgggttggggggccccccccaggggcccgtttgggggggggggggtttttttttttttttgggggggtttttttttggggggggggtcttttttgttgttgttttgttgttttttttttcttttttttttggaaaaaaaaaaaaatttttaaaatttttatttccagtttttccctt

SEQ ID NO: 11891 - DNA, 1542 bp, Homo sapiens
  misc_feature (1)...(1542): n = A,T,C or G
ctggngtcaatgtgcngacagtagcgtctctactcacgcacgtgtgnacgctcactcctgctgccgcttgcctcgtccgtcacgngnnctcgncctgtcctccatgcacantgcagcgcactcactgagccatcggtatngagtgcgtgaactctctcttctgcgagacgtctcagcgattcancacttaccgcagttcntaagaacgacgcctgcatactgctnnnnttcttgtgtgtcttattcgatcttgcttctgcgcgnnncgcacatcgcctaagacgcggaggaaatcgctagagttanatagatangggcgatcacaacgagcttagagtgtgagcggctactgtagagncgctgtgtctgatgcgagaaggcgcacatactgcgagagagttgaggcacgcgnaanttgtgcgggtcgngncgtggacgtgtggtagtcactgatgcggccattactgngcgcatgggtgtagcgatgggggtgagcgcgctcgagagacatgagtgggcgagagagcggtcggtcacagtgantatacgcttatctattgaattnaactgacaagttcgtaatcttgngtatatacacagatgatattgatgantgtggngcgcggaggtccagcgagggagtgtgtcgcgcctgaggcgactgatgtgcttgggagcggtggtgcttaggtgtatgacatgagactagtgctcatcatacagatacttctgctccgtcctctcatacgngagaactcatntgtctctctcgatacttgccgttactcgctttcgttcactccaatcctatgganatactaagacaatactaatatacatatcgcatcgtntgcgtgcctgcaatatcgacaatgcgcctcgcgcngattcactgctgccgtngcctgcgacgntnnngtgtctcctctgggnncgcgaccgcgctgantccacgcttctctgctgcaagccaggcgtgcgtctcgtctcgctcgtgaggngtggtgtgcttcttgggcgtagcataggaagtagtgagaggaggagagtgagagaggcagagacggcggcgggcagcgggcgcagcggtgccgtcgtcgagccctcgcggcttcctcatgtcggngcgttgctcgtggggctggtttcggtgtcctgttgctgtgcgtgggtgtagattgtgttcttagaggtgacactaatgntcagcggagctatgatcggagcaggtgtggattccgcggtcccatattctatattccactcgagacttatctgcaattgtcatttctatctctaganatatactctaatnntaccataataacctcttcttctctcattactatatatnaacataactannnctgcatataataatatttnnaaacattaaattncacatnaatatnttancatctaatattaatnnnaactataatannnnnannnnaaannnannacatananncataatatanacncantcatnnnnnnnnantctttaacatannnnnntannaactctttnnnnnnnnaaaa

SEQ ID NO: 11892 - DNA, 234 bp, Homo sapiens
gcctaccagactcactcgcccccccaacaccggggcccagagggaaccgccggccccagccaccggagccacagcgcaccacagcgccccagcccagagtgcccacaccaacagcagaaagcagccccgcgcagaagccgcaaaaggtggaggacgaagcaagacgccccaccacccccaggacccggccagccgacacggcaacagcccccccctcaaaaaacggcgagcgcg

SEQ ID NO: 11893 - DNA, 2133 bp, Homo sapiens
  misc_feature (1)...(2133): n = A,T,C or G
cgacgtgcgtcgtataccgctaacttatatgcgtaacgacgcgcaggactctcacatacatcaactactcagtggacgtggatcgcgggcgaggaggcgctgacagcgctgctcatgtcgccacactctcctactctcacgacagttatacatatatcattcctccngcgcgctgccgtacactgtttgtgactatggtggtggatanagttattctcgttggtcaatcgtcgagtcttgcttgatgcttgagtcatgcgcatctagtcgtattagtgtactgtatgtatacgactcgacctcaccgctagncatccgcgatgcatattacagtcacgtagagattgatctancggtcggtagcaatgacacgtgtatcagtcgatgacggacacggatagantatgaatcagtagtttgacgagtacatagcacatcttgcgactctcaatacaactgtgctattcgtaggcttatattggtgacagagagtgcgacantgaacggaaatnatantagtcagagtagaganttatnatagttattgatatcagcgtcgcaccttgactacgtatgtgattganctctctggactgttactcgcttacgcacgnactgagcgtagatgagtatgagcgtgtagcacgtcagacagcaacacatcactatctcaacatcaacantacacacacacanagtcatcgncatgacatccatatgcgcgacancgtctctgaccgcgctatcagntnatntttgatatactatctagtgtgtgntnttatatctatgtagtgtgcgtanggtgtgactgacgacgtactacgagctntacatcgacntgcganacgagcntgcgtcagngntcantagctctcctntcancgtcgtacagtnatctgaacgangnacgcgatgtagnatgctgtggcgtatcggncagatacgancgntcgtgcagcgtcatagcagcacacagnganacgtagatgnacgtaagntgtacnangncagactacanantatgcanctctatacgtcctcangacngacctcnagatcgatctcccgtcantgctacagatanttantgacgagcgaangcntngtcgcgtagtacngtcgcagtagacnanttangatgtgtagntgtanggctgctgtcgttgtgtactcgactacagatcagatgttctgcagtcngctcngcnctacgtatnccctnagtgacgtacgctactcgngcgcncgangntgctgcgangagtcactcancgtgcacagcgcatnctagacnagcantagcaacatactgctactccgnctgcgacggctaggacgacgatctacgtcagtcgtacagctgtcccangcgctacgatgacagncactgtctatctgagtattcgattgcgtgtcgtgtacnntntnagtctacgctgcacanatncngttngcatctcagcgcacntnatagagagntgnantagtgcagntcgacgcantgctagcantcatagtcgtactgtaccatcngcacatcctatgtancacgactgcnacgtatgacgatactactantcgacacatcagctncnctacagtcgacngcacatatgngtacgcgntcatgctgntgacccatactagatgcgctatagagctcgacgcncgcgggctataggtntatgtgtagttgtgncacgcnatagntatgccancatgagatantgagatnacacatngatagcagnaagactccagacagnacagctgcgncnggcgacctngagcgcaacaccgcacgntgntagaacggaatctagctactgactatctagtgtatacgntgatatntcngcagtcgtttatctgtatgtgtatgacgatagcntactatncgatgacgcatctctgttgagntgactgactagccgtatcgtgtctgagtcanccccantatgatatcgcatactgncactctcgtncagtacgaactactngtgtgctggtagtgctgntangtgctngcgtcgtacantcgctgtcagtantactacacgtcatcagatgctactgctgctagnaatgnacgtgagctgagattgtnctngatgagctgccgttcagtgc

SEQ ID NO: 11894 - DNA, 1091 bp, Homo sapiens
  misc_feature (1)...(1091): n = A,T,C or G
cttggtcttgtttgacgctcntctgttcttcttnagngttcctgttctggtgtgtctctacctctgtgtgnncttctgcgctcctcctccttcttgtgcccttctggcgccctctgtgcgccttcctctctccgctccctagccccctggancccttctttcctccccgtcttctatgccttctgcggttgctcctctctctctcttttcttggtctgtaggncgtctcgccgcgcctatggcgtcgtgtctccgaccctggcgcgtccgtgtcctgttggcgctcggttctgcgcgtctgcccgggtactcgggcctgctcttcccgctcctctcccgctgggctcttgtgttgccgtccctcctgctcctctctcctctcggctctgccctggccttcgttgctctcttctctctctcgtccccggcgcgtggctcgttcgtcggtcgcgcgctatgntttgttggctgtcgttgtgntatttgtatcggttctgtctgaagtcgccctctctccggtgccttttccttctctccttgccttgttttcttcttgttcgtcgtctacattcacttttactccttgcgttgcattcgtgcttgttatnanatttcttggccttttttgttttgctcgctctttctcgtggctctttcgttggctgttctctctcttccctctcccgtttgtgtgcttctgaattggtctttcggtgtgctctgttttgtttgtgctttctatccgtctttcccttttcttcgctcttttttcttcttccgtctgtgctgctcttcctagngtctcgctctgttccccgtccgctctttctttctctctctgctcctccgtcgcctctctctttccctttctcctcgtacttcccgttctctcttctctctcctcctctccttctggttctttttctctctctctttcttcccttcctctcgctcgttgtcgtgctctcttttctggttcggtgcttgtttntctcttttttttggctnttttctttttttctcctaaaaatttttttttaccttctctctcctctttttntttttttnnggtttaatatctannaaaaaca

SEQ ID NO: 11895 - DNA, 1630 bp, Homo sapiens
  misc_feature (1)...(1630): n = A,T,C or G
cgggggcggcgcgcgccgcnnnccncncnnnnnccgngcnncnggnnggccggcgcgcgccgagcgcggggcgccngcggggagncgccgcgtggggcggcgcgnaggnncgcgagcgcgtaantcgcncaccgnaccncncaccgntcaacatctcgcgactctttcngatatgtcagccgcgatcctccgctgacgactacaggttnatacaatgtgctgagcgatcttttcctactattagtagacgacgtgattcgaatgataatttcgagtcacagcattccttagtggttgtgtatctcagcaggcgncaaaggccagataatctacacatcactacatcgcactcatactggcagcgctatcactgccgntccgccgacttactctacctactacactnacacagcacacacagatcatatacgtgtcnaccagtagtccgcatgagtgtagatgtcgtgtagtgcgccatctatccgncagtactctgcgccacgtttcgtctcacttcatgccgccagactacatcctcacatgtagtccactcgtcgtagcatcgacagcactatcgaagcagcagctagagtatcagcagactcgananttgatcactggtcgcgctacgtctatcgatgtctggtgaggagtgagttgtgtgagtcgctgttatttatatatttaatttcttctgataccaccgtcaccaaccatgcggtcaagtccagcagccatctcatagacgagcgtacgacggagcagccggctaaacacatcgccacgtagagctcacaataacgacagcatcaccaacagtcatgatatcacatattagaatatatatgtcctagctataagtagtcgatagtatagcgcgatggtcatttattagtgttagtccgacgcagaacatctaacagacgcattntgtacgaagagatgaatggtatgccgcatagacgcgattcgtgtcgacgcgagatcagagaatctcaacgcagcaccgacccgntcgatcagcgcatcagcgatcagntgtntatacccgttctatatgatcgctctatcgccgccatccgcgtcacagcggcgtcangnatcgagtatgtacgagcgctccgttctctcgcacatcnttggcacgtagcnatcagtctgattcgatagaatcagatcgtagccatatgtatgcgatcatcatatacccagtgtattagaatcgcataacgacgcttctcggtattgcggtcaatgcggcgcatcggacatgcgatgttttaatagcttctcttcgaccgcttgtgcatcacgccaagtgatcaccgagccacgagtatgcatngccatcgtgtctcatctctatccgctatgaagttgcaatncgtcgcctgcaggtgtatgactctagaaggtcgtttcagtgtantaacatatgcgagtatgctcgatctctccgcggtacatgtggacttcatacgagtnatcaattcacctctcacagtcattatatagtcncagctactaagtgtagtcattatctttagtgccagatggatacggttatctcattagagttggtgatccttcataatntatatgctcagtattgtattcgtaagagctgtcg

SEQ ID NO: 11896 - DNA, 1653 bp, Homo sapiens
  misc_feature (1)...(1653): n = A,T,C or G
cgntgatcgatactgctggatggacgtgataggatgacagctgnccatgctgtgtanggnntcacacgagacattctgtgtactcagtctcagagatgatgaataganangngnacngatgtagtcantatgagagtgatagtgatgantnagngagtatgagcgaagacggacaagacgncngnngncactcagacgaaattactagctgcgangacatcgagcgtcatcttacgacgacgcgtcgcgcgcgactcgacagcatgaggaancgtggatcagcgcacgacgagagtcgcganatgagnagaggacganacactcgagatgtgaggacgatgagacatagcgngannnnatgagtctatgtccggtggtgcatcagcgacacggctggtccggtagagctngctgctntgnnggagactacgctcatactancatgacttancttagtcgatgtctgtgtagatgtatggatcacagattagaagcagtcgcgnacgagatgtncnagcgtacacggaactagaggactacagngnatacagactaggttagnggtgngcggcgcgaanactataagatgcatcgcgacagcgaacacgcgtgagacgacgatatgaagagagacgacacgtaggtcgtagacatcgacaaagctacagtatatatagtagtaggagagtgcagagatagcgtatgnatacatacaaantatcgagtatanaggtancgnatagcaggcaggagngcgatacgnaggcatnagacgactagnagatcagataaggtacgtgnnagatcgcatgctagagtgcgactcgcganactagttgcgtagaggtatgggngtggtcactagcggcgtngggcgtcgcgatgtccgataggagcataaattcacanagatatnancgactgatgatcatcaggccacagaccgctacagaganancacatatancaccgctatcncaacttcgcgtgacactactnatttatantatactgccagagggaatgcataagctagacgttcaatagaagtaactcagcggtttctgctgccgtncgctttcgatcgtgttccgtcttncatgggtgtatactnntcctgtgatatttatacttgttgggtncgtcgctgcgcgtacccgtacacacataccaataagataatataagtagggagatgcgaccggggacgcgaagagagaagacaacacagggactgatgagatacgaccggtagtcacaccaaagcactagacgcagaacgcgaccacgagggtctcgtgaaaactacacggaaggaacatctcttcgcgcggtgttggtgtggtgtgacctgggattgacggtccgggcgggcgttgttgtcagccacggctgttcagtactgcatcggcgggggaggtgaagncccacaactcaatccacactantccaaaaaccgacctctacatatactaaccaacantanacatacaaatgtacaaaagtttaatgaacttactggagctagtgcaataaanacaaaacaganaccgtgaataataaactcgacacagaaaatatacaccatacactaataaaaaaanacacaatnnnnnnaatatatatanncnnaaacacttnaaaaaaanaaaa

SEQ ID NO: 11897 - DNA, 897 bp, Homo sapiens
ttcagaccagacgaactgattgctatcgtagaaaattactggaagggttgcagcatcctcattctcttcagatagaaagaaagcatccgcttttgtaggggggatggactaatttatgtctgggatgtgaactaaaggaagtagcctttaccagatttgctgatgaaggcagtttatatgatattaagcattgacacatctaggaatggacagtatgttgcttgaggttctaattgtggtagtggaaatatggtgcaatcaagattgctcgactccaagaaacaaacccagagccaatataagctataacgaacttggttacaggtgtaacttctctgaccttcaatcctactacagagatcttggcaattgttttttacacaatgaaagaagcagcccgatcggttcatctgtcttctctgccaggctttctaaaactaccagtcattacactaactatcttcctcatgttcataaccatggattttatccgacaagtggatcttctgacttgggcaatgaaaagggcgtacgacctgactgttaggtcgcactatgctaatactctactagggactttctcgctgtcccggaagctctcggatacgcctggtgattcatacatcttcaatcacttgcctggtgtgtagctgtgtattgtgattgcctttagatcttcgctgtatcgaattcaagtttgttggatacacatgggcaacagtcttggataaaacgtatgtcatggcctgaattcatcacagtcgcgtacggggctctgtcgtcatagggggacataatgacatcagatattccttcttcccccgttcataggtatgtctatcattccgcaactatcttcaaactcctgcatcaacgtaatcagcgttgactacaatt

SEQ ID NO: 11898 - DNA, 1137 bp, Homo sapiens
  misc_feature (1)...(1137): n = A,T,C or G
aagccagagcaatttaatgctaattttgaactgaatcctggggacacagcttataagaagttgcgtgtggactgtcgtgcgtgtattgttgtgagcgctgtgagcgtctgtccgcgacgctctagtctatcaacttactggtgtcgcaaatcaagcacgctcacgccatctagagcaatcggctgcaactcttctagtgtgagatcataacgatcactagatcttactcaacctactcaaccgagctcattaccgtttagcaaagtgaaaattattatgcacacactccaccataagccatagcatcatcacgctacactctcaattaagctctacaaataatatatgtcatccacacacatctctacgaagtatacacgantccgacaatatatatgcgacatattcattataatttctaattcctaatacagtatatatctgctatacacaaataaactgatcatctagtgttatattgcccggagtgctatcacagtttattatatatgttattggcgcggtntgtgcctacgcgagcagcggatcgcgtcgaaccgcgtcttaatagttcgtatcatgattagtcatagtcgctatcattaatgtgagtcgttgtatattacgggtcatatgcaaaaggcgataaatctccccgtctcgtcacgcaccggcacctcgtcgtctcaaaatatgtaaaacgctctagctgaattgttatactctagctcataatgtgatcgatatgcgaactcaagcaatgaggtatgatcttagagaacagaaaacagagaaaagatacgtcggccactctcatgtctgcacattgaagagcagcgatgacattagatagtgaagtacaggtagtaacttgcgtatatttttactgttccattaataggcatcgtcggtctggccctagaccgaggcgcgatgcgaggggacttaatatttctatggttcgtgaaaaatgtaactccatatgtaaaggagtgtataatatttcccaactggaaagaagatgagagtgagggaggccgggcccgggcggccgcgagagcgtacgcgggtccggggcggattatctgcgcgccaaacaactcgacttaggttcgcctagataagttaaacttgttc

SEQ ID NO: 11899 - DNA, 756 bp, Homo sapiens
cgggtttcacatgatgccaaatggtctgatctctgacgtcatgatcaccggcctcggcctccaaaggggtgggatacaggcatgacccaccatgcccggcctctttttactttttaatgtgggctaccagtttgaaattacatatgtgacttatagcagcaatacagcgggataaatggaaagtatctagttaatctagattaaataatcgatcccttttccactaaatttaatggccatcttttacctatattaaattactttattaaataaaaatgtttcctcaactttctgttttcttctgcttatccacttccctatccttattctaatcacacaccattaacatgaaagggactttctaatgtgaggtagatataaatgcttcatcactattgaccacatttttgttccttttcttaattatttccatatatttattcttctatatgaaattacatgtgggcctacattttcttttctttccaaaaaatgtctgtcagctggtgatatgattcaaagtatatttttaaaagtataattaaataatctgatgcttaatatatttggtaggaaacaacattttcatgttaattgatatcatgtagtaaaatgatctgttactctacttatcaagatcttattttatgctcttctataacttttttagattttatattaggtgcctatatatatatgtatatctatctatcttattaaatttatttttaagtattcaaaaaaaaaaaaaaaaaa

SEQ ID NO: 11900 - DNA, 1899 bp, Homo sapiens
  misc_feature (1)...(1899): n = A,T,C or G
atggtactgtcagtagtacttggcactcatcacacancttgnncccatcctgctccgtccgaaccacgtacacctcatgtgnactcctaatcatcgngcagtgcgactgtgcacaagtacgagatgcgtgagnttagttgcantcatcttactactacgtnactgagtatattaatangacgccgagtagagatatgttgtaacggtagagtgatcgaaggcagctagtagcttgtgtgttaancatcgtgtagtaatcatcacatacgacgatagtacactcatgatcagtgagatcgatgnctgatacgtgacgtgcgtgggcgtgagtntctatatacacgtgangagngagnatganagagtgcgcagtgcgagatgtagtgacncgctntcggatctctatcgtacttcttactgacttagtgactgcgtgcagctgtgttatggtgacagtcgatggatanggtactcgcacatctgtgtgacgtctgagcgagatacgacacgatagaacgatgtgaggttggagtgtgcgtaagacgaagagtngtgttacgtatatggttgactctcactnatgactacgaaggatagatcgtggtatggcgatggagaggagggagcacgactgatcagtgtaatggtgtgagacgtangagngacgtgaatgatngtgacgagtgtggagctagtgagagtcatantangagngcctagtatcatgtcatagcgctgncgntatgacgtcgtcaagatgnacatacatntcttntcatnctattctattatcctcacgcgcagcgtancntctacagctcatcatngtntnatctctgtctatcacctgctgcgcgcctantcagctccagtcttcgtccgagcgtaggtcggcgggctaggcgcgaggtagtcgtcgcgcgtgttaaagtcatgantacgtcgagtgcatcctgcttgttatgtctgcggaggcgggtgtgagcgtgcgtgncaggcgcgttcgacgttgacaccgcgtacatgnntatctgagtcgtgcttgtgcatctatgagctctatgttaatacgactataaatacgtaaacctctcgtatatagtgtcgcgtgcgagtgtgngtgcgngngngacgttgtgttgntgcgacgggtgcgcgcgtgtgtacacgtcggataggtgttnngnggaggcagtangtnanttattatngtatgtgcgggctaggtgtattgctgcntttgttgatatnactntagctgtcgtgtggttgcngcatctcgcatactgtcgcgtngnggtcgncgtgctggtattcgcgactcgctctgctntatgatntgctgcccngtgcnatacagtgtcgacagatccntnctctgacagtaagtactactaacatcatcatatgtcngtngatactgtctcgtancgttgctagtggnggtgnnangactcacnatanctnatnttntnagtctnntttacctgacttcatntttatntattatactactatttctcctatataacatnatnntnnttctantnnttatnnanctttattttacttctnatnatttctaatctattcctttttntnatnntanntntattanatntnnnngggattantnnnntanntntnnntnantnannnagataaaannnnttnattnnnattnnntnntntntnntnagggagganntnttnnntanatannntaaaaaaaaannntannnnntnnnnnnnaannnnntnnntcagttannnntntntnnnnnatnnttcatnnnnactnnnntnnntnnnnnnnnnnnctnattnnttannttannnnnttnnnnnncnnttacnntnatnnnnnnnnncnttttttttnnnncccttttcccaaaa

SEQ ID NO: 11901 - DNA, 1842 bp, Homo sapiens
  misc_feature (1)...(1842): n = A,T,C or G
agatatcagtgagtcgacatcgatncntaanacgcgagacgtactccgacacacgacgatgcgcagcgcgantgactatcgctacatctanaatangacgngatgacgagctngatnctgtngacgttcggtcgtacgtcggtatcgtcatatggtctgtgcgatatctgcgatagacgcatgaactacactcatgtttcactactctactnagtcactancgtcacgactactatangcgtcgngagtcgtgagctgtgatagactacatacgactgcgatgacgcnnggtggcgtagctgatatagctcgcactcntactcgatgaatcaacgatatcantntatgnagctttaatcnangtagnanangagattgacgaacatcatatntgcacantacatcantgactacgtgcatcgacgagcgcgttccacacatgcgactgntcagcctgtaacaggaggcgcagntacagtcatagtgacgtcctatcnactntgtcattagcgacagcanacggtccgtcgtgtgctntcgtcgtgatctnagtntacgcgatnntgaagctgtncacgtcagtagtgtgatacatacgtatcgtgngagtctgcactaacgaccacactactatcagcattcagtgaatnactactnaanngtctatatnnagtacgtgagntnccgaagtcgtttgtagtctaacgtggtatntgaagtcatgtntaagcatgataatangtantcgaacctcgatgtagtnatagtctctactatacgatcgtacgaatgagcactacgatgctcaggtgtgtcttacgtaccgtcgagagacgatcgacancgctagactaccggagcatcttctagctacacacgcagcacacgctcacgtcngcgcgctatancganaaatacatactcattagtgcgctagtgagatggagtagagtgttgaggatgtgcangttacgtagatacagatgtcgcacaccgtcangcanccgcgctnggcttgtgtatgaggttgaacgngctcgcagacancgtacctctagcccgtatgacgatacgtnttggtgtcagacaagatgcagcagggaatggacgcgtatgacgctactgtcagcatcttntcttccctcttctactcttacagctncttcttgcacgcggacattgtagaagtntgtactgagacgctgttgtcgtcgcgaggcgtccacgtacggtgccgcgtacgcgtaccctcctcctagatctacaacacactcctnatcactatagacaactgaggcaagcaaagcgatatgtaagcgaatgcgcagtgacgagacggagagagcgagtcgagcggtatgaccatcgatgatgggaggcgcgtgagtagtgcgctcagacanccacgtagagagatcaagatcgtgttgtgtcncgccgtctactgtggtgttgagatcgtcggtaactacgtaggtcaatgacgagacaaagggatagctgagcgatggcgcgtgagcgaagtagagatcgtgaggtagcntgtcgaaagtgtcgtgtcatcgctantacactacgcgaacacacgatgntanatncgggaggaggggtaggacaggccgaagacactccctgataagcgatatgaacgatctnagtgtgtagtctaagacgtgtctcctactagtgcacggcagaggcgcaacgtggcccgtcagctcacacgtngtgcgagacagattcacgctctgtgtgcgtactgtgagtgcttactagttatagagagtcgaccaacgcgatatgtatacactctgttaaacgcgcactgagcgtgtgataacc

SEQ ID NO: 11902 - DNA, 697 bp, Homo sapiens
atataacaacccgaaaatgttggggttcaccttccagggagaaaaaagtctatgttgttttaagaaaaccggggttaaagggggtccctcatccccattacccaggtcgccggtctttttttttcctaagggaattccggggggcccttctataagggggggaaaaatgtttaaaaagccgggaaaaaccggggggttttttttttgggggggtttaaaaaaccgtgaaatacaaattaaggggtttggtttatggagcaattaggcacagtataggaagccccttaaatgttttttctgaacccctgggggaaattcaccggggggataccaagtttttttttggccaaaaaagcttccccagaaacgtttttagggtaaaaaatagtttttccccaatttattgagcggatttaattttttacagcttatgtaaagagttccgggaataaaaaagcccttataaggggctttaggtttaaccaaaataaggggttttgggcaaagggggccaaaaaacaagggggtgcaaaatttttttagaccccccaattttattttctttggcccacccccggaataaaagggggggggcccctttctctttttaaacagggattggacccccctattgggccccataaaaatggtcgaaaaccggggggtttttttaaataaaaatttctttttttaaatt

SEQ ID NO: 11903 - DNA, 872 bp, Homo sapiens
  misc_feature (1)...(872): n = A,T,C or G
ttaccctccccataaagaaatttgacgagcttcacccctattcccttcccaaacttttaaaaaaccttccccgcctcccaaggatgggggggntaaccaatccnanctnnnttntnacccctccctccccancctaacttttaaaanttnccttccttccttaggcccttcctcccatcattccaaccactttcctccttaccatccattactttcctgtgatancctacatccagggggggggtnaaaatngtgggngtnctaaaactagcacccagangctngngcccttggggagtgcccgacccgaaaaaggggaatttaaaaagaggggcccctctagatccccaggtgnaggtaagggggccgtctgccgtggctacaaccccccctcccggggggaggggggtctcctgcgcccggccgcccgggagacgtaggctgaagcggtggggggaggccgggacgcccgcgtaagcggggggagcggcgggtgggccaggagagctcggagtcggcgggggcctgggagagggcaaaaaggaccagcgagcgcggcgtcgaggtggggcgcgtcgggggctgcggcgggacgcgcgagggagcggcacagggggggacgcgggcggcggggagcggacggccgcgggcgagccgcgggggagcgcgggcgccaaaagcggggcgcagggaagaaggcggccgggcgagcagggggcgggaagggagaggcgcgcgggcacgagggcgggaggggcggaggggcggcgggggaagggcggcgccaacgagggccgggcaaggggggcgggagggaggcgcgtcagcgaggggaggacgacgggggcgaggggccacgcgagaagcggagc

SEQ ID NO: 11904 - DNA, 855 bp, Homo sapiens
  misc_feature (1)...(855): n = A,T,C or G
cgggaccgggggcttccggcgagtgggatcgtgatgtcccgcgtagttgtactggtgcggagcgcctggcgggtgggggccgcctctatgtgcaccgcacgtgtctggctgcgtcggcgccgtgggaacgggtacgtgacgctggtggggnagctgcggggaagctccgctcgcgtcagcgtccactacagctgactcagtcctcgcagcctaagaggccccctctgcgcgaggacgcgccggtgagctaccggcggccgggaggccgtcatcccggcatcggctggagagaagcgcggggcgacggccgcaaaagtagatgaatgaaggctgtcgagtcagggaagggacgagccggatagagctggaagcgggggggccggggcgacgtggccctgcttatatttttttgtcatcctcatataggaacaaatccctctcgacccaaaaaatacgcgcgaacaagcacgctgagccttgaagccaactacctctcggttggcatattcatcttgttattcttctgaacgccccgataaacccaccaaaacaatgagggggatgggggggcgtgccgtcttccgcctcccttgccccccctcccgcctcaacgcccctgtgcttctatttgtgttcttgttgcgcggacttttgagtgggcaggggacttgacttagcagtcacttaatcgccttgtagtggaccattttatcatatcttcttccaagtccgggagtttttccaaaagcttcgtaagggaattagaataaagncatacatttgtcttacgcgtagccagaattttcattctttttatttttctttatatttctttttctattnntttttaacttt

SEQ ID NO: 11905 - DNA, 959 bp, Homo sapiens
  misc_feature (1)...(959): n = A,T,C or G
cgggataggagcacggagtgcgggggatgtcgtagatgtttgaaagaggagaagaggagtgcgggcgttagatcagggtgagttggcacgcgggtcagtactacgaaaatgtgagcggaggtgcacgattacaaaacaagagtctgacgatgcacgattatcatggcattgctaagtgttggataatgacagaaccgtggcgagagttgcgggggggcaataggagggtgacgagcggggtcgaggtatgatgggtggggggtgatgggtgcgaggttaggttacagcgaggcggcgcgcgacagggcgatcgacggctggcacgcgggggtcgacgcggatggaggggggggggtgtgtcgagcggaaatggaacgagtggtggggagggggtggaagataaaactnnggagatgcaataatgaacgagagggggggtgggaagcggggcgcgcggcgggaggaattccaacaatcctgtcgtgctcacacgncactccacatgcctacggagaaggatctgacagaaataagaattaaactataagatgtgtttgtgtgtatggattatgatgtgtggcgtgtgcgtacatgggaacgcgccgcggccacacttatcagataatttatatacagtcaaggacgcggcgcggtagcgtgtggactgtcgtgagacctctccttatcgccatccacttataaatgcgtttgtctcttcttcccttaacctccacggacccgtcgtaagaggcgcagccgtgtcaccaattacaacaaattcacttcaagacttgacagttaaatacaatacacaacacatttccttttttctcatatcatcaccaactcaaaattataataaaaacaaccataaacctgcaattcgactgatttaaaatttctatttactatattaaattattatntattcactttttctacctttntttttttttttt

SEQ ID NO: 11906 - DNA, 1127 bp, Homo sapiens
  misc_feature (1)...(1127): n = A,T,C or G
agaaaggtcgtaggaaggtagactggggtgataaggtgcggcagattaggagaccatgtagagtgtagaatacggctctcatacgcgactagagtcgcgtggtgtcgctaagcgactgagggatgcggactatgtgaccagtattgagagaggagctatngctgccattgcagacttccgatatggaacgctgtggatctgttctatagagtaatagttaagtaggttataatattgatagattagtacgaaagaggtgaaagtacagtcgtggatcatatgtatgacatgtggatgtgaaaagggaaggagagatatatnggtgtattatgtaatgtgcttgttagnagtgagattagggagtaaaagaaacaagaaagtgtgttgtgtgtgagatggtggtagatgcagtgtaacagttattgagttagaattcgacaaatgcaaatcaaacgacggttgggacttgggtgtataatatgattatgaggatatctcattattatctataaattgtattcataaatatttgagttatcgactttgtatcctatttatactcacgtaccttgcgacgtctctaacccaacactgagtgttggtcggtggctagcgtgggggagggggtaggtgtgtgggtggatgagtggtgacagcgaagaccggagcttgtaagtatgacggtgcaggatggagaatgtggggcgtcgcgcgtgcgggcggcttacacagtacaaatgcaatggattggttcctcaccatcctcttatttttcattttttttttcttttatttataaacttatatataaaataaaagnacactaaataaatatataaattttcttgtgatagttatatgtatgttggtgatgggnatgtggattgcactgggcgtatcatggatatggcatgtcatgtagccggggcacgactcagggaaggtgggtatanngttagntgtgtgaannangnnaaantgttnnnnatgttgtgggannngggggagtgggactacgacctnngctaagatacncccccnnntnncancccatncaaattctatctcaataataatataaatatataataaaaattataaatattattnantatacnataacccta

SEQ ID NO: 11907 - DNA, 1357 bp, Homo sapiens
  misc_feature (1)...(1357): n = A,T,C or G
cgacgctcagtatatatcaagtgagataagtattgagagacgagtcanatggacgccgagcgacgacgagcatgtgtgttgagtgacgatgagtcgtatcgcgttgcacagtgagtgtggagcttagagacgtgatgaataactntaggtctcactacattatattaggagggtgggctatatgtgtataacagagtgatcgtgtattatagtggcgtacgacgtggctngtcactcctgtgtcgtgcgcgccctggggtgcnggtcggtgcggaagcgtagagaccgcggagcgtncgcgcgtcggattctgagcgtgcagagagatgggtacgtgatgtgggaatgtatgaacgctcgcgcggagcgcgtcgctctgtatgtcgcgatgaatagcgtgtcgtcgcatgtatgtcagaagcgcgcatagacggagatcagctgcgtgcgcgaattgggacgttagagtcgcganagacagcagctcgagcacaacgtgtncacagtgaattatgnacagaagngagattgtacccgtgntatgtggaggactggaggtcgggtcgcgaggagcacagagtaagggcaggaagagaggaggcgacagcgacgtgggaacaggcgaggagagcgatgagacgacaggagcgcgtaggagggatagatgagcggtggagcaagacaanacactgctagactatactacgcggcacgctgcgcagcgttgtataagtgtcggtaacggtgatatatgaaagagctgagacaagagagactgcacaaacccgccgcgcggcgggcccgcgggtcaggaggnaagtaacagttactcgttgatcagagccgcctccttgacatgtgtgagtcggctgagggctttcagatgactcagcagtgcggtagtagacgagcggagtcaggtcacgtacgcatgtcgcgaaggcgctgagtttcgcgccatgacgagacgttagtggtatatcctatctaggtagacgaggtgcaagattagaagtggcggtgtgcaatggcggagggggagaagtggagcgagagtgaagaaagatatatcaacagcgcagaacgcgcaacacaattataaaaaacgagtcagcgcacgcgggcgttcgagattgagtggagcttgacagtacaggtgccgcagctgtataactagtacgtgggtgaggcgcgagtcgaaggttggaaggatgttgcagacacacaccacgagctcggattgagcggtgagcatagatgacgctggcgcttggcgcgaggggatcgaaaaaggacaacgccccaccgtggtgatcgggccgaggggcgggtggnatatgtggaggagagtgaatgg

SEQ ID NO: 11908 - DNA, 755 bp, Homo sapiens
caacccttttggaccagtacattgggtcacggtaacccaaaaagggagaaacacccccccttttttttaggaggcgctatacaagctgttaggaagacctttcccccaaaaggttccaaacaatttttctcgataaatctttttggtaattgaagcggcttttgaattccctcgaaacccatagggtgcagcccccatatctgttccctgtgttaaaaacatttaaagggtttcttagggccacatattaagttaaaccaagtgtttacaaaatcgggcaaaattggctctctctttttaaagcaaaggatggcattaagcccctgtccaggctttaaatttgtgaatttttaaggaacttcagccccctttttttcctaggaataaggagcttaaaaaattacattggattttttatggtccaaatcttttggtcccaataaagagtttccaaattaaagcctgcatgttagttttgaagggatttggtggcctgacatgataccctgccagctgtgaggggaccccgtttttaagatgcatggccaagctctctgcaaatggaaatgcttacactgggtgttgggcccccccgctacctcctgctatttttgtggttttggttctcccactatggtaggacccctggccagcattgtggcttgtcatgtcagccccattgactaccttttcatgctttgaggtactactgcctttgcagcacaaatttttaattctgtcccccaaaccagatg

SEQ ID NO: 11909 - DNA, 845 bp, Homo sapiens
ctcacggctacatgggacatcgccttgggtcccctacacagattcccatgaatctcttcatcatgtacatgtcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatttgtttggcattggctgcttacaagtgccagtccatgggactgttacctacacatgcatcggattggctagccttcattgagccccctgagagaatggagttcagcggtggaggactgctttcgtgaacatgacaaagcagcgcctggatccctatgccttcgggtcttacttacatccttccttcagcccgcggttctccccatcctcttaaactactccctatgctaaactgaccccctgactttctttcctttccggggtgaccgagctctctcaagccatgcccctcttccacaattacacgtaacttttcaatgccaacgctgaaatcacgctccaactctttaccgaaccacccccaccttttctagttagcaccctccccccctcccccatgcgccgtcccctatcaccctcactctctctcccttcccccaatccttgccttatccccccactacctcccacttccctcctaccctcgcaccgatctcttaccagtaatatagccctcgccatgacacctctccctgaacctcaccccacccccgcgaggctccgtttccatcccctactactacccaaccactcctcgcttctaacaccaccaccac

SEQ ID NO: 11910 - DNA, 1950 bp, Homo sapiens
  misc_feature (1)...(1950): n = A,T,C or G
ggccgcgcgggngtttncgangttatgcgngtgtgatggtggttgttgttgngtttttcatggtcttgtttttggtgatatntaatctattcttngtgtgtgcttcgtgttccgctatatctttgtgtgtctaggagctccgtactacctcctcctctctcnagntantatatgatagaanagaatcgatcatctgcacacgtatagngctcaatgtggtgggatcgctgaggtgtcgcgtctaccactgggtgtatagagttgaagctctacagantcaagaacagagcgagatgaggagcagnaaccctgtactctcnctcttatcgctcctacattcagtctccacgttccagctgctcatctgtcattacacaatgtgtcgctcgacgcaggaagagtgagtgcgtgtccangtttatgggttcgttatagctatgtgtggtntagtcgtgtgtccgcatcgtgtgtgttcttgttcttgcgtcttgactgttgtctcgattttcttgatcacgctctcgctctattgatgntcgtactctcacatccttgcttcgatcgagtgtctgctgtcgccgcgtgtcgntctctatttatatatttatttatttnatatgtttgtacatatattgtatttatactatgtaagagtatgtggtagtttgagttattaaggttattagttgttatgtgtctataggntganagttgggtgttntagagcggtgctatcgtggtagcccgccgcgtaccagacgcgtcacttntgacagcgcgggcacggactacatcctactanataatcatctctctttcttcttctcgtcctgcgctccgtactcttctcttntataanttactactatccatctcctccacgccacagccaatatantcatccctacctatcacgaactatacnagacaccacgctgtccctcccncgccagacaggccnagccgcttctgctgacacgatactccnantgtagacttgtattacacgttatgtcagagtattcgtttccgcatatacctgctaggtatgttatcgatcattgtctctcatttattatcctatatctctgtgtcgcgcggccccagcagttgatgtctagtttccatttctgttctatcttttcttatctgagtgtgccgcggctccgcaccagttagttcgttgtgtcgtgaaggacgcttgatacgaagatcaagactcacatgcgtccgttagttgtcgtcgtgtcgttagtcgtgacattagatcttctctatgcgatgagtttctcgcaccccttaaaggctgaataacagctagcactcttcgtagcgctcccgacgactctacactctctatattaattactagtatttggactttgctcctacgtttatgtttattctttgtactgtgtggcatcgaatttagcgtctacgcgtgatattcgtctcacatacgcgctgttatcctctgttatcatccgcgcggcggcgtagcctttcgtgcgcttcattattcgaancgtcggccatcgaacnccgtcggtctgncggttgttgcaggtgttgtatgtattntgttttgccacccacgccttgcaaactctgcattatatcttctcggtctaaggattttatnanactaatatactataatttgtcgcttgtttctttattcgtgtgtagaggtgattctagttgttccagcgatcgttgtttatcgtgctttctccggtctgtacagtgtatttcgcgccgcgcagcagtgttcgcactgactgcacgcgcgacgacgctatgcggtgtctctcgtatatagtatctctcgtcttctctatnaattatactatnatcatgcttgcgcgaacgttcgtcaacacgtcgtcagacattattttactattatctcataccgcgcgcagtatgcngccatacgactgtccgcgg

SEQ ID NO: 11911 - DNA, 1074 bp, Homo sapiens
  misc_feature (1)...(1074): n = A,T,C or G
ggggggggccccccacgaagaaaactcaccagatacttccacaaggagtggctgagtgatataaagaagagcctggtgtccctataactctnctctcaaccttggcaagggggggaccatctacaaattctaattacccatncaattacctccccnncttcggattttaaagagggatcttcgttctaactcttcacccccgggggacccaagaaccctatcttgtgctttcctgggaaaaaaggagtgctcaaagagaaaggggggggggggttccacgaggggggctcaaaaaaaaaaaacaaaaaatcctggggggcctcccggggggtgctttggcgcggtgttttatggacggctattagtaaagcaggcggcgcgtccggtccccggaggggggccggtgcggggcagtttcaggggggactatcaacgcagtgcacgcggacgccggcgcgcccgcgcaggcgcgtcggaggcgcgggagcagggtgttacaccttctgcgcgcggggcggtgaggcggcgactgcgagcttacgtgaggcgcacgacgaggccgggcccgggagcggcgggttggcaggaagggatcgcgcggagcggacgcggccgcgccgtcctcgtctaaacgcgccgaggcgggccgagcggaccgcaagcngcgcgccggagcggcgtggcgacagcgcagcggagcgggtggagccgcgacatggcggtgagcagggagccgcgccggacagcgcgcgagacgacgactgtgtgacgggcgagctagacgactcgacgcgcgcaggagcaggagagcgggccggaggaagtgaggacgcgccgcgcggcagagaggagagacggcgaggtgtaggcacgcgggagggcgagcgccgcgcgacgaggacagtgntgcggcggcggcgcagcgcgcgcgcgatcgtgcgaggcgagcgcagtcgagaaacggcgcgcggcgcgcgcgggcgncgccggagtagagtgcggcgacgagcggagcgccgtaggcggcgcggaacatcgagcaggaggacgccgcgcacgcggggcgtacgggcg

SEQ ID NO: 11912 - DNA, 1877 bp, Homo sapiens
  misc_feature (1)...(1877): n = A,T,C or G
aggagagcgcgttgtgtagtggtacgactagctcgcatcgtcgtgcgtgacgagtagacgagcgggccgggtctcgggtatataacgacattagtgtctgcacggagcntgctagcgatctccgctggacgaggcattatgnattgagtctagtgactgatagagcgagctgacggcagacaganggagtgcggacgtcgcgtggtaggcgagagcgctgcgaaacacgtctctctctatcgacgagtcgcgcaacgcagtacgaccgtgcatcgcactttgcgtgcgctgcgctcgctgnacagtagtctcgatctcgacacgatgtctctgtgtgatgtagatggcagcgctnagtctcagacgcaagtccatgacgcggcgcgttgttcagtctcgcgcgtgagactcacggtctcgctcgggacccagcgcgagtcgcgtgtgtcaccctctcctttgcaccgaagcgtcgaagctggaggaggcgcgtgacgtaggtggcgncgatagcatagaccgntaatatgtatatctatgcggtcatcgtaggtagttagatgtgtcaggtgtnggcgtagcggtgacgcatacattcttgtgacgtgatgacagcgatgtcggcaccgatacagcaggtacgccagcatcgcgcttaatgctctactagcgtagtcgatagtctatattgcgatcagattctggtataccacgaganaggacgatgcaatgtctcttacacgagtcggagactgagtgtatagatgtgatcgaatctgacgcaatgacacgagtgcacggagantcgcattctggacgcctacatacacgtaggtagtgtcgacgctgatcgctactcgngcangggcgatctgcacagacantgnctcggctatctcgcagcactcactctgatgactgcgctacgtgctcatantgtcgttgctccggctacgtagcacgcaaaattgagcgatntgtactactgcgccgcgagcacaccacntgtatngtgagtgaactgcgtgcgtcgcgccgcgagtcgcgtgagccgtggcgtgcgtcgtggtcgtgctactctnccgtactcgccgctcgcagcgcgcagacacgagtatagtagatagagtatactaatgacagcatcgtcacgatcgtgtatcactgntactgcntatgttcactacattcatccacatacgcttcancngngtagacgtcgagccgaggtgctgtagccgctactatagtacgagtcgtgtgacagcagtctgcatgatgtnttgttgatgatgacgcgtcgtgatcaggtagtcgatcgtatgatatcggtacagatacagtctgcagatagtgncgcgatncgcgctatgaagacgcaggtgtactgtgtggtccgtagtacggtgaaagtaacagctaggtactagacagtactcgaggcaagagcatcacagcagantctgctncatcgggcgnngcgcangtacngggcgtanacgtggtgtnaataatattgatgncttgagtgtngtnttgngtggtgtctgtgngtgcgnactgcgctngctcctctatgtccgtntctatgtctagtcatcgagtacgtagtcgacgatagctgtgtgatcagcgcngcgtggacgcgtctgtgagccgtcagctacgcgagcctgcggcacagttgctgtagagtcgtgtgagcgtgctcnctcagagtgatagcatgtatngancactgcgcatagaccgtgctgctcactccgctgacattgatccgcaantgatgctgtatgtactgcgctctccgacggcgtagcagcagcgcgncgncggcgcagnnacgncnaaccgtgtgtttgcgagcctatactgac

SEQ ID NO: 11913 - DNA, 752 bp, Homo sapiens
ccctgggagtccattttaatttccaaaatcatccatctgtttttgaaagttctgtcccatttccatttcccccacagagtacaagggtcccttttctccacaccaatgccaacacttccctttgggctttttgatagtacccattctaacaggcatgaggtgatatgtcattgtgattttgatttacatttccctaatgattgatgatattcatcatcttttcatgtatctgttggctatttttggtcttctttgtgaaaatgtctattcatgtcctttgcccatttttaacttgagttatttggggtgttttttgtttatttttgttacttgtttttgcaattaagttttatgagttgcttatatatttgggatattaacaccttactggatatatggtttacaaatattttcttttttctgtaggttgcctttttgtttcttcattgtttcatttgctgtacagaagtttttagtttgatgtagtcctgtttatttttgcttttattttctgtacttttgagatcaaatctaaaaaatcattgccaaccccaatgtcaaagagcttttccttcatgttttcttctgggagtgtcatggtttcaggtcttacatgtaagtctttaaaccattttgaattcatttctgtgtatgatataagagaaagatctgattttaaggtttgcttgtcaatatcaagttcctccccccccatttattaaagagtctatactttcaaaaaaaaaaaaaaa

SEQ ID NO: 11914 - DNA, 743 bp, Homo sapiens
  misc_feature (1)...(743): n = A,T,C or G
ctgtaatccaaggaggatgtatgcccctcagagccctgtgataatgcattaactgcacaaatgtagagcatgtgtgtttaccaatataaatttgggcacctgaaaaagaacaagatancagcaatgttaggaaacaagagagataaccttaaactgtgactgccagtgagccgggcagaacagagccatatttctcttctttcaaaagcaaatgggagaaatatcactgaattctttttctcaacaaggaacatccctgggaaagagaatatgtgcctgggggtaggtctatagatggcccccctgggtgtggtcattttctatggtctgtagactgtaggggtgaaatagaccccagtctcccatagcactcccaggcttattaggaagaggaaattcccatctaataaattttggtcagaccagttgctctcaaaaccctgtctcctgataagatgttatcaatgacagtggtgctcgaaacttcattagcaattttaatttcgccccagtcctgtggtcctgtgatctcaccctgcccccatttgccttgtgatattctattatcttgtgaaatacttgatgtctgtgacccacacctatttgcacactccctccccttttgaaaatccctaataaaaacttgctggtttttgcggcttgtggggcatcacggaacctaccgacatgtgatgtctcctccggacgcccagctctaaaatttcaaaaaaaaaaaaaaaaaa

SEQ ID NO: 11915 - DNA, 283 bp, Homo sapiens
  misc_feature (1)...(283): n = A,T,C or G
ctcaggtccatgaagactgtcatcttgactccctagaggattataacctctgaatggattctttcatgagtatttatcatgngggtaaccgcggataaatntatcaaatgatcatagttgcaacgtgcctgcttttgcaccattggtactaaaagcttctctgctatactgctgataagtattaacattaattttcaaaccacatagaatggcttaaaatcctgttctctctcacacaatggggggagaagaaagcctgaattatgctttaaaaaaaaaaaaa

SEQ ID NO: 11916 - DNA, 2026 bp, Homo sapiens
  misc_feature (1)...(2026): n = A,T,C or G
cagtcgatcactgacgatgagctgtntctacnacgatgtacgctaccacgtgcatcntctgtcatcagtcncactacngatanacatgaaacatctnaccaatatcagagtctgtatcgatgtagtacgcagcgnctcgtctgctgtgtnatacngcgtcangangtcgacggtccgaacngcnctgcncgccgaacntcacctgatctncatctcgactcngcatactctgcatcatatagctcantancatcgtancgaggngncacatcacacacgtcgancacatcgttagtcgtgtgtntntacgcttcgtancgncngtacgtacgctgctcagatactgaccantgatntngtctntactcntnttgactgcgtacagctcacatgancgagtatggtctcatagactantacctttccgtctantgcgatcgtcgtgtcgtaggtcttattatanctcgtgcgactaagtatcgatgacactactaaacatatatatantactcgcttatctactacacntcnacgtctatatatattcanttacatcatctaatacgccactccatnactgctatcactacagcagcacgtcactntcacgcttactcacactctcatactgnagcaatacacctccctacgacacnnacgtactctatacttctgtagctncactccatgctctctcacgacatctccaaatatattcacatatctantctantcatctactcactcctcgatacacgncacgataatgcgtgtcatctagcgngtctgatagtatagctagcggtcactctgatatacgagtcganactgtccagtccganctcgatacaagngatcganatgacgtgcgtnactcacgcagatntcagtgtagtatgagtagatgtagtagacgatgagctgcgcatagacagccagttactaacagtatctcgtagtgcacatcagctgagtangntgctaagagtcggtcactgacacactatcgaaatatctgagcgagtatcgatactctcgtcttccatctacgtcntcaattatncactacaactgcaccagtccatgacactcgatcgatctnctgcactgtgtagtgcatgagtnangagnganntgtgcgactgtgngatcgagtngtntatagnactngtcgcagcctgctcntacatgcgctatatccacagcgacacacatncgactacgtnnanaaatcntntatntaagcaccatcatagnncggtcacagcagtatcgctntgctgtgtagctnctgtcacatcgtgtagctcancgtagagtagcngttgtacatgctgcagtcgatctnatcgtcggaataccgagtgatggactcgngnnactgtcgaggacgtcgtgtacncgcgtactgncagtagagcatcacgcgctcaatcgtaccatatatctcgattcgtctgcagcgctgtcgtagtttccactagncagcacatatagtacggcgncactacgccttcgattgtcantgataccagtgactatacacctacactctcacgcacgtactcgacaccgtgtcactctgcntngacggcgacgntggtcgatcagatgtctcacgtagtgacgtcgcancagcagtngagtaaagacgcgcactcgacgtgtagctaatctgtgntctagatcaatagtagtatagtatcagattgtacaatgatatataattatatataacctctgagacttcgtatgcactggtgttatagtggcgtagtgctagtgatntcgtnctatgtagtgcatgtgtgctantgtgctgctctgtcttgtcggcactccgtcgactctgtacgccgttgatcgctcttatgttgatctagatagaagtatctggatctaccgctcgtcgagctgctgctatcgtctgttcttcttcgtatagttcttgtgagtnctcgtcagcgtataacgtcttagtctctagcgtcagcgcattctctcgatctacatctacatcttacgc

SEQ ID NO: 11917 - DNA, 768 bp, Homo sapiens
  misc_feature (1)...(768): n = A,T,C or G
tcagcaaccataggccgtacaacataccattagggcttttcggcatttccaggacttttggaaaattttgccgttaaaccggaaagaagtcataatttaataaattttgaaagccccaggcccccccttaccctaaagtcaactggttttaattgccattttcatgaaaaaacatatcctgtgaataaggtgttaatggcagataaaaaacatatttttaatggattttgacctacatctatgaccttgtacaactcaaacagaaataccccatgatttcattaacattaggagtctaccatgtaatcctcctccaaaatagctcaattctttaatcatttcttgttaaattttaaataatcctatggtntgatacaaactcaaatcaaaatatattgcaaatataacgtgcagagtattgttgtttacataatgataaacacatttgcttcagtttatttataaatttgtcctaacactaaattccattaaatggcttttatttgaaatagtccataaatgagatgttcaaattaatgtcatattttagactctttctagtttctatatatagcaatcaattagcaatgttcagatattcataatgcaattaaattcacttcataataaagctataatgagcataatttaggtggccataatgagtcagaaagccttaaagtatcttggattatcattacaaatataaaccatcatgctatacgcacttgaataaaatattgacaattggaaaaaaaaaaaaaaaaa

SEQ ID NO: 11918 - DNA, 879 bp, Homo sapiens
  misc_feature (1)...(879): n = A,T,C or G
tcagngcatatcttctgtgccaaggtatccagctctgaggtggtaaagactacaaaaatgatgtcagacaaaaagcaaataaagcaaatgggaaagattgtcttatatgagtgcaaaatgggtcataaagcagcagagacaacctgcaacatcaacaatgcatttggcccaggaactgctaacgaacatacagtgcggtggtgtttcaagaagtttgcaaaggagatgagagccttcaagatgagaagagtggtggctggccatctgaagttgacaacaaaaaaataagaccaatcatggaagctgatcctcttacaactacacaagaagntgccgaagaactcaatgtcgaccattctacagttgtttgggattcgaagcaaattggaaaggtggataaactaaattaagtggatgcctcatgagcttgagtgaaaattttaaaaattgcaagttttgaagtgtaattttttgttattctacacataaataaagaaccatttgttgatcggattgtgacatgtgatgaaatgtggacgcatagagtgagtggtgacaaccagatcagtggttggtaccagaagtaagtctcaaagccttccctaatgtcaaactcgactatagaaggttatgtctactgatggcggtttactgcacgatgcaatatttcatttctacaatgccgggattttatgcttaataaattgcgaggttattccttcactgcaatgcttactcacaacacttgatcccagaaagcgtgatagattggggactcctcaagcgtcactgccttacgtatttttatatcctcaattggctccaactacactcctaagatcctcgggagctttaaggtaactactcagcaaatgaggg

SEQ ID NO: 11919 - DNA, 748 bp, Homo sapiens
ctatctctggtagtaaaataccccaccccaggcctggagctactcctagcccaagaaagtacgcaatttccgggtgagccgtttaacaaagacgatacgggacggggacatctaaaagaaacccattcgtttagtaccctgcaacggcaagacagccacaggtcatcaagcctctatcaacgtgagttcaaaaatttaagagcagggtcctcatctgtttatttcctcatgagtctagtccaatctcttataatttttaggccattaaaaacctatttgctacagtgaattgagtagaaattggtataggcaacccagtatgtctggtcatcttaatctatatgttattgaccaatgtgccagctggaatctccttttatgtagtgtccttctcagtattctttttcctttcccatggcattctgagtcctactgctaaagtagaaaatttaagaaagcatgttttccatagtgaaagaaacataggtaaaattctgataaaaataaagcattagaactgaacattcaattagtaaatgctaataaatccatggactaaaacaaaagttatcataaaagtatctagcagtgcacaaggacatgtttagataatattatacaatttatgcttattttctttctccagtgctcattctttccaaatgtttgttatctatgcaggatcttgatgagaggaagaaaaaaagaaaaatgaataaaccatatcttacaaaaaaaaaaaaaaaaa

SEQ ID NO: 11920 - DNA, 945 bp, Homo sapiens
gcctgctcgttaccccgcgaaaagaaaaaattgtttgtttactcttctgaaccgtaggtgagcaacacatctggcattagaccgcgcaaactctactaacgaaaaaaccatctctagagcctgagtgctctaattataggactacatactaatagaagagagaaaatgacacacactgaacaatagatgctgaatgttcttaagagtatgcatactagaatcatagccacaacaggaaggcgaaaaggaactttcctgccctgtattttaagcgagggggcgtgctactaagaaggggtgagactgaaataatctcactcaactatagttctccacaacgccacatactagatcacaaagatgaaaggggccattaccaaatatctacgcgcgaacatcgacacctacccttggctccagggagtcttttaatttctatgcacattacagaccagccactgctatttgccacacccatctccgcgcttgttaccttcgctacgccgtgtccttccgccgagaacatgcggtggtacaagcgcgcgaatccgaggccgctgcacatgagaaattccgcgcgcgtgccggcgaggcactcttgtaccacatggatagggaatgaagatggttcgcgagcgccctacctcaccccccccagcgcttacccacgagggttagaatcatcagcggactgttgcctcgacgctcggagtcaagtcagtcggcgctgccacagaggtaaggcgtattgaccaggcacactagtcaccagccaatagatgcacgctagctacactgtataacatcccgcacacacgtcttcccttgcaactccacccttctaatcctatggacgcacccaccctactccgcgcgctagaacggaccgataagtggcctcagcctagagggaagaccacaactagtcccatggacaccgccctg

SEQ ID NO: 11921 - DNA, 768 bp, Homo sapiens
  misc_feature (1)...(768): n = A,T,C or G
ttgttaattataatccagtctaataatgtttttctctcaatagtaaaaaactagaggtttcctattaaagtaaggaataaccaagatatctgataacacgaccgtaatttgaaatttttgatgactttatattagtgccataaggtgtaaaataanaatataatgaaattacttgtattttcctaaactgaggctgtgtttacattcattctctatatacttttttctattcattttgtattatatttattgtcatgtttattaatctcttacaggacaatgtctaaatctacagtgttttgtttgttttaatttcagacattttagtctttattacaaaaagtttcagttagttcttttctatattttctatttctctcatcactgtgttcatgcatttctttaagaacctgttcacagtaataatggtatttttaatttctttgtctgcatgttctttcacttaatttacttctgagtctgtttctattgactaattttttttcttattacagatcatattttttttgcttctaggtatatctaataattctttggtgtgatgatggacattgtatagtttacattgctaagtgtcttgattttttgtttgtttgtttaaagcagggatgttcaatcttctggcttccttggaccacattggaggaagacgaattgtcttcggccacaaactaaaactaatgatagctgataagccaaaaaaattattaaaaaatctcataatgttttaaaaaaaaaaaaaaaaaa

SEQ ID NO: 11922 - DNA, 1947 bp, Homo sapiens
  misc_feature (1)...(1947): n = A,T,C or G
actcgtacntgntgattctgcgtngtctgtcnatgnntnatctgtgctgcactgctgntatangntgacatcgtgtcactgcacgtagactgctcgacgatcgtgtcgtctgatatcgtganganancgtcgactcgaatcgtcacgtcgcctagcnacacttgtntgatctctactacactantctantatcnattatgcncgactgcttagcgctcnnatgtcatatactagcatatcatgantacnactatcgtacagcngagtgtactcgtcgtatagtcgatctgacgtngnngcgtgntgngcgtgnagatgtggancttggtagatngncnactactangtncacctatactnctactactggtctcatagtcactgcngntgncnactacgtatacgantagcgccatgtacancatgtnctacncttatcatatcgagctcagactnacgtcgactcgcagtnctgtcgtatcgtgacgatgtgatngnntantgactagatcgtagtcgttatcgtccctgnatcgcactgcaaggagtgctganagctcgtagnctagcgcgacaaagnactagctgctcntcacgatntngtngaacgcgacgcgcgcgtgagcacgcncntgtntcagcaccaatgcactggcgtacgcgactcgctagcattcanccgacgtatctcatcgctnagatggcagtactcgtatnctgcgtatctacnaaccactgcncnctcgtctgacgcntgacgcnantgccagtcgcgcgagcncnacgcgacncgcgatcgancatcgcgancatgcgcngatccgtcgtcactcgngcagacgtcacgactgacgacgctaacnacncncgcctcgaccgacttgngnagtatgacgcantacttacttcatctcttacagtagtatagacattatatantatnatncgntgcagcaggagcatagtgacgctcnagtgtantcgntcctgtcacatacntanactactanantatcactctacgntntctcacgtctacgtcgtnccctcatactacgtntnnacntctctctnactncgatatatctntgcngtgttcgctgngtacanggtagtgtcgtggtgaggcacgcgcgagtganagcacaacnacgacacacatcagtatacactgtctgnttncgtcntactctcacgtcggtcgtgnctatcgcgtgatgctgtacggtgctacgctctactcgcacagcactacactgtganttcgacgtgtagcaacgtctgccggcgcgctgctcgctctggtgntntctcctagctgcgctgtttcgctctatatacgttctgtcacancactcgcagtcgtctgtgtngcgctcgtagcggtcgtcgacgcggcgccgacgcttgtgcatatntgtgtagattgtgagactggcgnntcaatcgccactgtagactccgtcacgactcgcgtgtatatcgcactgctgctggctctgaggagncntcctctacaggtggtgatggagactgtgtcacagtagactacagtactacaggangataggaagcttgcgtggagtgnntgctgtgntctntctctcgagtgtcatcatatatagaccctgtgtgatgcagttgcngtngtngtctcgctctactaatatnttataatatacgaggatattatntacatattcatacatcctttctattatcaaaaaaatntnaanatatatatatgtatagtatcctctatctattgatatntaatcatctatnatatantaaggtaatctnancccagtatttaaaaacaattaaaataaatacataggaanactaantnaaaaaaanantaaanacctatncttatnaatttataacattatnnnanctctcacatatnntanaanatncttaannnannaannnaaacataaa

SEQ ID NO: 11923 - DNA, 1122 bp, Homo sapiens
  misc_feature (1)...(1122): n = A,T,C or G
ttctttccctcccgccccatcatccgtttcagcgacccctagtttcttttaattcctcgccgccaagacaaagctgcatagaccctccagatcaacctattgcaacaggcgtcccagcgggagagttcgcccggtcataagggctgcacatctcttagacgtcacataagcgctagccaccattgtcctcccacattccgccgcgctctatattctctctatgtatccctccgcatcaacttactattcacgcccgaacatcctcgacttctcgccgcccatcattactctccgcagtgggggcaaggaccttccccacgctcgttgcgcaacgaccccaacgcacctcaccctatccacgcccgcatcgacgcctcctccctcccctcctcctctctctatctactgctcgcgcacctcgatctatacagagcaccgcctcacccccctcctccccctacgactgcccccgatattcgctacatccttacgtccaaccactctcctcgactccacaatcaatcaccgccgcgccccatctctatatgacgatcacccccaactagccaccacctccgtctcagtcacgatcaacgctccgcgccgccgcccgccgccacgttaacccactccatcactactccggtgcactaacgctcntccgctgccgcagtcagcgtcactcctgccttccaccgctccctcccactcgcagaacctcacttgatccgaccctaaccaactctacacctaacacaaattaaccactctgcccctctccgcatttctcccgcaacctcccccgactccctcatcatattttctacgtagcgccgcccctcccctccccgcccatcacattcaccttctatcacctgccctcctatcctccctccaccctatcactatccccttacatcccctattccctcgtagcgctctaatgacattctatacactccctcacacttctctgacgtctcaggcacacacacagctatacaatcaacatactacgcgcacgtacgcgcgtctctcctgctctcactcctctactatccgtccactatatcgctcgtccagcttcccttatcgtttctgacttcgtcccgctaccccttc

SEQ ID NO: 11924 - DNA, 1092 bp, Homo sapiens
  misc_feature (1)...(1092): n = A,T,C or G
gggggggggtggggggagggttacgcgttcaggagcactgagcagacctgtgataaaaggcgacagctgttctcagaatgaccaagctgcagtaggagcactctcgttaacgtggggggggtcgcttgatgaggaggttcacantananaactttgggtgacgtggggctaggcctttggcagaaaatgctggggacaatcccgtgtggactggccagtgtgtggagcgtgcttggagaaaaaatatatgtctagagctgtgtgggtaaatggctgcactcgtattcgtgctgggactgagaagattcagagagggggggggtctgaatcttaagagagcgtgacaggtggagagaaaaggaggaagtaggtttagggaggattggatggaatgggagaatgtgtgtgagggggccttggaagagaatgagggggggggcggcattagtgcgtgggggagcgagtgtggtcgtggaagggcaggggcgggagatctggagcgggggtatatatcgacgcggcgtgcgagtgagatagaggaggaggatggcggttgagtagggatggagaccagagggcgcgctggcgcgttggaagtcggagtggacagagaggtgggtgaggagaacgagcgctgtgtggcagggaagtgacttgagcgcgtgcgggcatagcgtagcagcgtgtgtcgagttgattggtggaagaggcgcgcaggaactgcggaggatggctgcgagactggtgcgcctagcgcatatgcgagtacggttgtttgtgttctgtaggagtgcgtacagagatgcgccagctcagatgcgtaaaggcgtagctcgagcgcgggagagagttgcggtctaggtgagcggtagaaaggggagccggggtggggagagtggagttgtagggcggagaggcgagcgtgtcgtagcgcggacaggcgcggcggtggtacgaggtaggagcgcgggtgcagacgcgaggcgcgcgcgtaaataagaaagtcaacgcggtgagaacgacgcgcgtacgggaggtggggtcgcgaggaaggactgttacgacaagggtggatggtgaggatgcgcgagg

SEQ ID NO: 11925 - DNA, 760 bp, Homo sapiens
gggtagcctttgcaagatgctggacaacccctgtgactcccaggtgtgagctgcttgagaaacatagttctgagcttcttctaaattccacacctagtctgttgcactagaaattcacagacatgttctctgctcttaaagaactgagggtgtggtagaagagaaagaggtgaggacaaataattcaatgaactgttataagtgctgtagtagagcaatgtgtgaggtcaggtgagttcagaatgggcttcagcgatataatctaagccttctcgaagttgaagttttcttccgtcaaaagaaaagaaatgtcactgacatcaagataagcagtttcccaggtgaggacaaactttattcgattcaattgccaggtgaaaattttctacagaattcctcatgatagacatcatctttagtcaaaactgtacaattgatatcacagactcccagagtggactctcccaataaccctcggcctgaactgaagacatcacatcaaagctccttgcctggagcattggctgcaaacactggcttcctgcctcctccgacctgtaggaaaccctcgccaacagccatgtcctactacagcatttggaaattgagggtggacagatgggattcagcatcagcagagggctgggcctggaagagcaatggatctggaggactgaggggacctgagttcaacattgtgaacagtgttataagtgtcaccaatagatttggttggacaaattgaaaaaaaaaaaaaaaa

SEQ ID NO: 11926 - DNA, 1011 bp, Homo sapiens
  misc_feature (1)...(1011): n = A,T,C or G
cggataagtgtgagcctttgtggtaaggaggagattttgggtgacatgaattacganatgtagtcgtattatgttgggttctgtatggagtgagctgtggtgaaatttgagggctatactgtaaggggtaggagagtatgttaaccggcgcggcagtggcgaccagaggtggagatggtggggagaggtaatcgtagcagtccgaggtgtactggtgggctggtaaatcggctggagtctagatgtgcgccgtaggcaagatatagcgatgatcatggtgtgttggatcgtggagcgtgcgttgtctctaggttacacgcccgttgctgtagaggatggggcgtggtgtgaggtagcgatgtgtgggtgagggggtgatttcgtattacttgtcagttaggtgtgcgggtgcgtgcgggcatgtcgttacgacgtgggtggtatggcgcatttggcgcgcgcactatgctggtgtgtagggggggagatcaatataaataaatatatttcgtatatttaggatatnaggcgttactatgcgttgggatatggtattcaatgagcgtgtcctccctctttcgattgcacctttttttttcgttcgtttccgttcaatcggatacgtgtagcgtcactctctgaatgttcaattcggtcatgttnanattatcacttaatattatttatagggcggggggatagaagggtgtttgttagttgttttgtactgttagtttagatatgcgaatatactatatttgaataatgagtggtgtgttggattggtggaaaggtcggntggatttgttgtgttttgttgtaatttgtatggttgtgtttgaaatataaaatataattaaatttatcacctcccacattaacagagtgtcctctgcatgttggtcattatgagatacagctgttgccttttaacgcagtnctgtcgtctgctataggaatattaatttattataaaattaaattatttatattaactattaatataaaata

SEQ ID NO: 11927 - DNA, 400 bp, Homo sapiens
agagataactccccgtgaaccggctaccgaccattgacgcctaaaggaaaatgcagatcacgcggcacagcccgaatggggacgccgctagcaagcacatgagcccgaccaagggagccgcggccccccacagcggggctgatccctactgagagtgaacgcgcccgcgcgccacaagtcggggaggcggcggaaggccgcgaggccgagaagaaccgaaaggggagcgggggcagcacggtcagggcgccgccgggggcagggcgccgcccggagaccgacggaggcacgcgagagagagagcgcccgcgggacgcgggcgggcgagcggccaagaggagaacgcgcgggcgggcagcggaggtcgggcctaacacgaggcaaccgacagcgggacacc

SEQ ID NO: 11928 - DNA, 781 bp, Homo sapiens
  misc_feature (1)...(781): n = A,T,C or G
ttgtataatcgtacgagttgggggatgtaggactggggcgctaatgaatagcgcgagagcggttgggatagggattgaccttatggctcgatgncagcttatatagtgtatatgctgaagacaatgctagttgtattttgtcgtgtgtgaggtgtatgtcgcggctccgaagggggaagattggtgaatgtatgagatagtaggtggagggggttagtggatgggactaggagcgcggagccgtggacgtggggggtgcgcgggaaggggttggaggcggggggggcgcgagcgaattggtagaggaggaggaaaatatatgggggtgtgaaaacttcgctcgcgcgcattgtgccctgggttaaaacacaacaaaaaccaacgagaactgtatctattgaantgggtntcttgctgcggtatggcgtgtggtggcggtagtgaaatgggcggctggcaggatatatgagcatgtggggctaggggggctgctccggtgggggggggggggcctgtggagtggatggatgggttatttggcgttgggttgtgggggggcggggggtggtgtaatgtggggagggaaggggagggacgggggcgggggggagggaggggggagatgtaagggtaagaagggggaagtagggtggtaacatgacgggtggggcgacagagaaggagatgcgagacctgggggaggggcacgatgtacaggacaaaacccagtcgatccttaccctccgattcgacgccagattcttctgtacaaaccataata

SEQ ID NO: 11929 - DNA, 908 bp, Homo sapiens
  misc_feature (1)...(908): n = A,T,C or G
cgtcagcatcaaagaactgattgttatcatgaaaataatatggaagggttgcagcatccacattctctctcagatactaaacaaagcgtgcgggtgttcaggagatggacaagtttatgtttgggatgtgaactcaaggaagtgccttaacagatttgttgatgaaggcagtttatatggattaatcattgccacatctaggaatgggcagtatgttgcttgtggttctaattgtggtagtggggggggggcagtcaagattcttgtctcctagaaacaaacccaaagtcaataaaagctataatgaacttggttacaggtgttacttatctgggcttcaatgctactacaggagatgttggccgttggcttcagaaaaaatggagtgaggctgacagattggtgtatttgccttcctgggacagcgtttacaaagtgtgccatgcaattgagagataggtagtcgttgtcatgttggtaccctggatatgttctgggtggagtgcgtgctgtgggcttggggagtgaggaggagctgtggtcctggactgtgcgggacggccataacttgtccctcttatgagcctgattgggtggcgaggggagagttgatctcgatctgcccgggagttgtccactgctattctgtcttgggtgcgaccctatacccgcgcgttgagttgtgggttgcggtggtgggaataacagattggtgtggtataggtgggcatgcggttgggatcgtggagagagcaatatgcgcattttggccccgatgttcacggaggggtggatggttcgggtgtgcgtgttaagaggtgcgtctgggtggaatggggagtggtgggcagtgcgntgggcattgcgccgtgggtgcgggnttgaacgggtatcgcgctgcgtcagat

SEQ ID NO: 11930 - DNA, 983 bp, Homo sapiens
  misc_feature (1)...(983): n = A,T,C or G
ccttgtggtcaaatggcttctcttttcgctcgctgtgcctttcgtgctacttggcttctgagcaatcttgggtttggatcggagtttgtgagttgaggctgttgggccgggggctgttgtcccgtcgcctcctgtcctgtgcgggatcccttcctcgtttcttttcttttntcctcacttgattctgggcttcggttgtgctgtagtcgatgcggcgtttggctccgtagttttatttttggtttattggtgcctccgggccccgtgttctcctaccgttttagnatctgtccttatcgcgcgtgcatcgctgcattagctcgtgtttcatggctcctctttggctgtggggcgggggtgcgcgcgccgcgggggggagctcctcagtcggggcgggcttgcgacccgaggcccgcaagcaagtacttggcttgggagctctctatggctttttatcttctctatttcctgtctgggtccaccactctgcctccatcaagtccgttcttctcctagcatcccgccccaccggtccttctttttcactgggatgcttttacttcttgtgtatggtgtcgtttatttttgaccttttctctgtcctaggctctctgcccgtgtgttcgtgcttttgctcggttcgtggttgtatcctttacttttgctccgtcgcgtcgtgtgtcttcttaggcttgattctcagtcccgcgtttttttgttctagggctgtttgcgtccgcgggcacctatactgatatatcttgccgcgtcgatgtacggggtttgcgtgaatatgtcagtttcgcgccttggtgtgtgggtgtttgtcggtttttgttgtgtgtattgtgtctactgggtgtggtgggggtctggtttgtggtctgtcctaaatacgcggttctgtggtgtgtcctaactaggttttttatcgttcaccttgtccaaaacaacatacatactctttattctttctttattcc

SEQ ID NO: 11931 - DNA, 1455 bp, Homo sapiens
  misc_feature (1)...(1455): n = A,T,C or G
agtcgctgtcgcncctccgtggcagagcgtagtgtttctcagtcttctctggttgcnctgtccgtcgtgtgctgtgttctccgtgtctcgatgtcttctacgctcgttgccgtgactgtctctgcgcgggggctcggccgtggtctcttctttgtttgctgcctcttctcgctctcctcctccttcgnagtagtctgactgtgcgctcgtcctgcgtnatcgcatgggtgtttatcgcgttctgcctccgggtgcgcgtagcgcgctgccgtctctctccagctctctcgcgtcctctggtctgtctgtgtttctctgccctttgttctcgccaccgaatcactgctcagctagtccgctcccctcgcgngagtgctctcgctggcgtggtcgcgtctctctcctctcacgtcctctcgcgccgtctcgttgctcgtctgctgcgcgccggacctctatttgcttactctcctcgtgcctcatgtccgccctctttcggccgcgtccccgctctggcgccccgcggtttttgcgtggtcggtcttcgtccgtttcgctcttccggccgctctgcgtcctcctcctctccgctctcagttccgccgttcttgccgtgtgtttgtcttcttcgtgcctcttctgcgcccttgcggcctcctgttgctctccttctctgtattgtgacgcgtgctgtcgcgtcgtgcatgcggttcctctcttggtccgtctcgtccgtgcttcccccttcatctcgtccatccccactctcccccccgcttgctcggctcgcccgctctcgtctcccctgggttgtttgttgtcttggcctctttcttctctcgtgctgtccttgtcctcctcgcgccggcgcggccgcccgctcgctgcgcgccgcnctccttccccctctcgttctcacctggtttcgtctcagctccctcgtcttctgcccgttttctgttgcttgctctgcttttgcgcgtcctcctcgcgctcagccactgtcgccgccgcgccgtgtgctctgtcggtgcgctctttgtcnctctcgttcgtgtctcattctagntcgtgccgccctgcctgtgttcgtccgcgtggncnctctctgctcctcgctcctcgtcggccntcccctgctggcgcctgctgtcttggcggctgcgtcgtgggtcgtggtggctctcgtctctcgctggcggttttgcgtgttttgcgctgcggggtcgtctggccctgttnncttctcgttgttcctcccgctcggccctcgcggccgcggcctcttcttccgctcgtnccgctgctcgcttgttttgcccgccctcccctcacacaccccttcggccggcttgttttgtcccgcgctcaagaaantcccgtcctccgtctctccttctgtcgccctcgctgtgccgcgccgcgccctncgttctctctctgctcgttctactt

SEQ ID NO: 11932 - DNA, 909 bp, Homo sapiens
  misc_feature (1)...(909): n = A,T,C or G
tttaaagagagngtnnngggtngggtgggggtgggagggggaaaaaaagaaaaatcttagggtaacaaacaaaaaggtaaggggactgccacgtaagaaaaaggaatgaaaatggtgttgntaatatgtggtgagtgttttttgttgtagnttgggacaaagcaatgatgttaataaggacgaaaaacangtcaaagaacgaaaaaagcggaaggacatgaatagtctgacggcgccttaggacttgttaacaaaaagaattgtcagtattggagtgtggaggggtttctatacccatagggtgtcgggcgcaccaacaagggacttaatgggggttggaccgccctccgtaccttttttcaccgccagcaaaagcaacccaagccccccgtcggccgggggcgcgccaccagacagagagacggaaagaaagcgagccccttgaaacgcacgcaccgcacccggcgcaccatccatcccacacccctacacaccacaacctcggacagcgtcgacacgtgcggggactgatgcgcctcatcgggttgcgcgtaacgagttttacgcaaggtttcttgtgggatgcgatgcaataacaggcattgtctggctgagtgtgggcgcggcccctctcccccccccgctcgccccccgccccgtgtcctaccaccacccaacgtcccccgcagagatcggaaccctcctgtacccgacggcaggcatcagacccgcgacggcgcatcagagggcagacccgagggagacctacgcatgaggcaggtgaggtacaaaagatgagtacgccaaggagagccccgtggtgccaaatagttaccccaacaactactccgctcccttaccctctctgtccgcctggcaggagggtgcctgaggacccaaaaagatacg

SEQ ID NO: 11933 - DNA, 920 bp, Homo sapiens
  misc_feature (1)...(920): n = A,T,C or G
ctcaggttacgactcctaggacatcaagtggtaactcatcattatcaccatcacacagcagctggaaccagcagcctcaccaggcctttctcctttaataatgacaaacatggtgtgcagtctgggccacttaatcctgctctgcagatggggactctgagacataaagaggtaaagatcatgcaggtgacaaagctagctgaagattagtattatgagatatgagaatagtaactgaagggttgatttgtaaatgtgaaaaattggaaatcagccttgatttccaacaatagggtattgatgtgtaatacaaccacacagtagggtattgtatagcgactaagaatgatacagcagtatttgttgacatgggaacatttttcacaatatgctttaaaaaaagatagataagtgcttattaataatataggtacagggactcaagtcaaagtggggatatattctaaactctggcgaccaatttcctanaccatgtagttnttgctatagaaaacatctagctgtgggtctacttgtaatactcagtatattaccttatttcatatgccatttatttnttcctttatgaaaatggtggcattcatctttattaatgaagttgaaattataaactttcttgtgtgaatcattaatcaagaacaatgtgctacggggatagattttatataatgggaatgaaatgaatgtttctttaaatatggaaaagttgcccatatacctaagggaaaccggtgggataaattttggctttcggaaaaaaaacaatgtggaggaactaaaattttgtaagagaaaaaatccccatggctgaaaaatggtagaggaaaaggtaaatgtcttctggaccttgcagatggggcatggggattttacccttctctatgtgcccgattctaaat

SEQ ID NO: 11934 - DNA, 626 bp, Homo sapiens
  misc_feature (1)...(626): n = A,T,C or G
cccttagttgcagtggaacagtgtatgccacccagtcagaagaccctcatagaggaatgaaatcagcatgagaattcaggtttttcatcatcctgtcccattacttcaccttacactctgaccaatcaacaatttccacacttcagcccagtccaaaacccttaaaaactctagccccaaacttttcagggagatggattcgaggttttctctcatctcctagtttggtgacccccagattaaacctttttttttgctgccnaaaaaaaaaaaaaaaaaaaaaaaaaaaaaaagggnccagagaaaataaagattcatgaaagttatatctttaggatagtctaaggcatatgatatatattttaacacttacgtaatccatccaaatgataaacaaatataaaaaagaagtttataaaacatcagtctagttggggcagtgaaaataggttttctgccccaaagtctctcctttgattattctagaatcaatatgccagacatttccttttttattcttacttcagtgtatgtgtacacacacaaaacatggaaaagaattagaccattttatgtggaagcatctaatataaagcctaccatgaaagcaaaaaaaaaaaaaaaaa

SEQ ID NO: 11935 - DNA, 260 bp, Homo sapiens
ttcagatgactaggagcattgtgtactgaccaaggcacaaagaaatttctgacctcttcagaccctgcctgtcaccagacgcctgcagttgttggttacctcttgatttcaaccctgtcctgttccccttgccttgaatataaaaagagactaaaatttgcactgacttaaaatggtctttgtgactataattcaccatcttcttggttttgctgacattctgaataaacctgcttttcttcccaccaaaaaaaaaaaaa

SEQ ID NO: 11936 - DNA, 633 bp, Homo sapiens
  misc_feature (1)...(633): n = A,T,C or G
ctcagnagttacgcatttgcaaatagtgtagacaaaacacgtgcttgatgacccagaagatgctgtttttgtgatgtccatgaagagatcagtgatgactttgacctctatgaactgggacacagttccaacacgagaggaaaggtaccttgaagaggaaggcacagaaacagctcaaatgctcacagttacactgagataagccctggtatttctagatatcttagtggtttnctgntgtatattaaacttccctgtgacttagcatattacatacttacaatgatattatttgagacatctaaatgtaaacagaaacaccaataatgaaaaataattcctacattttaggtttttaaatgtaaagttgtttaagtaaaattgtgtacagaaatgtataaaattcataagtgttcagctcaatgaattttcaaaaattgaacatgtttatgtaactggcatgctagatcaagaaatagaacattatcaggactctgaaactccctccttcctgtaccagtcgttactcacccttccaaagtaatcatccgtcctgatttctaaacaataaattaccatgtctgaatttcaaaggcatttaatggggatcatagaacaggaaaaaaaaaaaaa

SEQ ID NO: 11937 - DNA, 195 bp, Homo sapiens
ctcaggtttattaggatgcagccctagcgtaagttgaggagcagctgaagttactgaggaatcatcatgactaaatcaacaagtttgattcctgagcaaacactttaacattaatttggctttattatccacaatttgtttttgctgtggtttatattaagtaagactacattccaatattgaaaaaaaaaaaaa

SEQ ID NO: 11938 - DNA, 277 bp, Homo sapiens
  misc_feature (1)...(277): n = A,T,C or G
cttcaccgaaccaatcacatatcaatcaacatatgtaacatgacacccatttcctccacaaaacattcaaattaaccacctgggttaggggttcttatnaatatacaccccanctcgacctactcaaaactgaataattccaataaaataattcttaaaacaaaaaaaaaaaacaccacaaacaaaaaaaacacacaaaaacctcccccccaccaaaaaaaactccctcccccggggggggggcacccccccccccgcccccccaaaaaaaaaaaaa

SEQ ID NO: 11939 - DNA, 677 bp, Homo sapiens
gtgggttgttctggtgttgttgcgcggtggtgttgtgcggtcccgcctttcggtctggagggggggtgttgtctctgggtcgccggtgcggctggcgtccgtgcgccgtgctgtccgctcggtggtgtttttgttgttgcgcttttgtgctgtgttggggcggtctgggcggtggtccccggtttgttttggtggttttgttgaggggggcggttttttgttttcggggtggtgtggtgtggtctcgtggttttcgtttggtggtgccggttgtcgtgttcttgggggctgtttggggggtgtccttgggtgggcgccggccttccttggtggtggttttggtggtcggcggatggcttgttttttgtcttcggggcgctttccttgcttctctcgggcctgggtcctgtttggtgtccccgggcttggtctgtggtgtggggggggggtcccgttcttgggtgtcgttgtctcggcttcgttttcggggggggggggtgtttggcggtttggtggtgccggggggggggccttgtgggtcggtccttgtgtggttttgtgggaaaaaagttggttttgtgttgggtttttggggcgcccctttttttgttttctggggcggggtcggcccccccgccggtgtttttttgtggggtttttttttccctgagatgttt

SEQ ID NO: 11940 - DNA, 1138 bp, Homo sapiens
  misc_feature (1)...(1138): n = A,T,C or G
cgcgacagacgtgaagtcgcatcgctatacgatcccgcacacacttcgctaatacagtngncacataactactcatgccattaacaagactggacacacgatgcagtaaccaataagaacaaaaacaaaatcacgcttcgtgagaaatggacgtggaaggcagaagacgctgagcgagcagtgaccatgacacgagttgnacacatcaggcgcgagtacgccacaaaccatcacaaagcgaactatagagagcgaacatcctctgatatatcattcggtagaagaattgccagaagcagtatgcagataatatactcattgatatccatatactatacctctatacgacgacgattaactcaagtgacctgcgcgatcatgtgatatcgctgatgcgttcgcgcttaccggcagcgtacagcacgctatgtagttaacggaggccgagggcgacactggaacatagaagtaggngctgagaggcctgcatgacgtatcgtggtatattcgtgactacaccactcaatcctggacatttaaaatatttaaatatcaaanagtgtagactataaaccattataataaacgtcttacggtggcgcggaggcgccacgcggcgcgcgcgccccgcgcgaactagcacacgaaaatcggtagacgctcgagtacacaacagccggctgttncggtatagatcccatccctgtgtttcaacctcacgtctctcgttgtttctcacatttcagaaacataaactttgagatgagttgatgaatagaagggaatgaaagtaaagagatganaatggaagaagagagaaagataatagaaaagaaattaaagctctcagagtgtattgtcgaatacccgacgcggcaccactccactccgcccgttgacagagcgtgactaatcgttaatttttggcctccggagccaactaatcttatattggcattttcttctatctttttaaaaaattttatgtaatctctactatcttaatttatcctttattcggtacatccataaaaaaataataatattattagttatttcctcaaaactaatacaatataataaataaaatttcataattttatactataatataatctaatattatatataaattaaa

SEQ ID NO: 11941 - DNA, 786 bp, Homo sapiens
  misc_feature (1)...(786): n = A,T,C or G
atgccctcgctgttcgtggtcggcccctgcgccgggcgctcgccgttcgtctgctgcgtcgggtccggtcttgtnccgctcgccgtccgacctcgcgtattgtncactctcttagctcaggatgcaggcttgcacgccgctggtcgccgtgcgggccgccgtgggcgcgcttgtggctctctactgcggttgcgctcgtgcgaacgcggtcgcgtccctttgctgtttgtctgctgtctgtggcgctcgccttcgtcctctcctcgcctcgtcgtccccgttacctcgtctcgctgccgccctgccggcggcggttgtgtgggtcttcgtcccgcggtctccgtagcgcgctcgccggcggtggtgctccgttcccccttctcagtctgttcgctcgcgctctcgttggtgttcgcgctgctctctggccgcctcttcctcctcctctcttgtgctgggaccggctaccgtttggcggctccgtcgctgtcccgctgcggtggggttctccgttttggcgtcccgcccccccccctcctcctccctcccctccccccccccctctcgctcatccccccccgcccgcggccctcccgcctaccggcgccgctcctctccctttccttttgtctcctttccgtgggtcgcctctttgtttgggtgtgttgttggtcgttgtttgttttgggtgggtggggggttctattttgtttcttttttcttttgcgttttttggtgggggggtgtgtctgtgcccctcgtacatataacataccctcgacggac

SEQ ID NO: 11942 - DNA, 985 bp, Homo sapiens
  misc_feature (1)...(985): n = A,T,C or G
aacacttcacactattattatcaacttcccacacactannccccttccacctntcactcccatctccataaacttatgccactgacctataaactcntacctcctaccataatcaccacctcctctttcacaatcatataagagccttggattgccattattaaatcaacttctttagaatttcccccaccttcacctataccaccaaacactccattttcccataccaaaaattatattcatcaccttcacagccccaccatctttcacactctatcatcacgacattcatactccacaatatatatattgtcccatttattttctaacaataaacaaaaatttaatacaaatcaacccatcncattcgtctccttcccctcaaaactaaaactcttcaaccccttccctttaatacaaacttaattcatcaatcttctctcactaactccactaacctaaataattcnccttatccccaactattataaatttccctaaaaatcaattcataccctctatccactaaacccacaaaccacctcccaaattccctttaatcccaacctcccccaatatcccatcacactaaaacatcacctccttatttaatcnctctccataaatttcacgccacctaacaaaattccaaaaatcncaccattaaatnatataatatacaaatccatnnnctttaaatatccaatacctcncctttagcaattttctctttccatttattnaaatatttaacatatatcaaaatcttacatttttatatatattnntctcccctntctatcacccctctcaacccccttccttttttcccctcactttaatacnnnatctttccattcctctatcataccactcctccactctcnctaatttaatacaacaaacaaaatatactttcnccatacttccatctttaacaatttcccaaattcatttaaacactctaatctatccaccactacct

SEQ ID NO: 11943 - DNA, 889 bp, Homo sapiens
  misc_feature (1)...(889): n = A,T,C or G
tgcgtagtggtgcctctgtgtcttcgggctgggtcgtttcgctctatcgggtagttgcgtttgagatgggccgtgcggtcgtggcttggtttatggatttggcgcgtgtggcttgtgcttcttcagtgtggatgttgcggttcgtggttgtggtttgggtttgtgtgtggtgggcgggcggggttggggtgtgcgatggtgtggggatggggtggtggggtggggggggggtgggagggcggctgcgtgagttgtggggggcgtgtgtcgggggcgcgctcctgggggcgtgcggtcggcgtctcggttggtggcgcgggcgggtgcttatgtcgcgcgcggtcgcggtgtggtctgttcgcgcgggcgcgctgggggtgcgggggggggggggaggtgggggtggggggggtattgtgattcaaagtgcggtggttttcgtctcgcttcgcgtgcggctccgggctctggcgctgcttgttttgctggctttcttctgcttttccgatccggcggggggtctgctcttgtcaccttgttgtgcgtgtgtggggtcttttagtgttttgtttggggctggagagtgttgggggtggtcgtgtcggtgtcgtgccgcactcaccccctctcctggcttcgttacggctctctgttcggcgggtcgcggccgcgtgggcgggggcggtgcggtacctggtggtcgtacccgcgtgttcgcttcattatggggattacccttctccatgaacccaaaccgtcctcttccatggtagcggtcgcggttaggcccgcgaaccgttctgtaggtgtttccacgcaggttttttttttttctttttttttctttatacactttttttctctatccataaantatatttcttttttt

SEQ ID NO: 11944 - DNA, 741 bp, Homo sapiens
cccggcgtggggcgtcgcacagggggggggttcgccgggggcagcggtgtaggtggggtaggtggtgggggggggggggctccggcgcggccgcctagcatggcgggtctggggggcgcgtgggctgggggggggtgcggggcggggccggtgcgatggcggggaggggggggtcggtcggcctgagggggggccggggggggggccgggctccccgtggcggggggggggcgggggatcccgccgggtgggggtggccaggcggggggcagggggggcgcgccccgcgcccccggggggggttggtgtgtttggggggggggtttgcaagggggcgctcttccaagaagggggggttctcccccccccccgctgggggggcggggggggggtattggggccccaaaaaacccccctttcgtccccttttatggggagggggggccaagggggggggccccccccccccgggagttttttggtttttctttgggggggggggggggtccggggggggggaggggtggggacagggcccgggggccaaggggtcccccgcccccggccccccaaagaggggggttggtttaaaaaaaaagcccctccccccccaaaaaggaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaagaaaaaaaagaaaaaaaaaaaaaaaa

SEQ ID NO: 11945 - DNA, 460 bp, Homo sapiens
  misc_feature (1)...(460): n = A,T,C or G
tacgtgagttaaaccttcatccagcnttggcnctaactaccaaaaantttcattcaacttatatanattccatatnaaatgggaatccaaaaaggcgtanatatttctgggtgattcaatttcctgataattcccaattacaataaaagaaatgggttcataaggactcacatctctaaaagaggctttcgatataaaatataaacctcgaattaaatttgataatagaggctttttcataaagcataaattaaaaaatatttttctggcatttttttcctaaaaaaaagaagatcctgtgccaaaccaacccttccggaggagggctattccttgtattttatcattcgaaatcgaaaatcactctaatctcggcaaataaaaacattttcgggttttttctttttaaagaaaaaaccaaattcctaaattaatcggtgcccaattaaaaaaaaaaaaa

SEQ ID NO: 11946 - DNA, 1450 bp, Homo sapiens
  misc_feature (1)...(1450): n = A,T,C or G
atgtgtatgactgatgtatacgtcacgtatctgtattctctcttgcgtagtgtgtgtgtgtgatatctgtctccgtgtatggtcggtccacatgttgtggctctctgtacactcttctatctctgctcgctgggcatagtgtagtgtacatcacttagcgcgatgccgactctcgtatcgtggcgtctaagtgctcgatccgctcgngtggctggccgagtatgcgctgttctgctctctcgtgttccctccgttttcgaggtactatggtctacggtggtggacacgtcgtcgatcttgtctcgtgcgttgctcggtgacatactgcttgatgctgtctactactgacgacgtagtgttcttcgctgctcttcgacatgtcgcgcgctatctacgacttcgcctgtgtgtcaacgnccgancagttatatactgctcctgcttctctttcgatctctgctataggtacgtggtcacgcacgcgtgccagtcgcgctcgactagtgctctgcgtcgtgtcgcacgtgtcgcgtggagttctgttatcttctgctttcgtcgtcgggccttgtccgttcttcactcctatcactactgcttcgccacgctccgtctcctctgtatagctatgcgttacttgtattatgtgcgcggtgcgccgcgctgtggccgtgacgctagtataantatctatacgtgtctcctctgccgtacgctaanctgtggttcgcttgtctgatgcggctgtngacttccgtcgcgtgtggctcgctgcggccgcgtgcgtcattagcgtcgtacgggtttgctgtcctcagctttgtctctctgcggtgtcgtgggcttatcgtgtnatcgctttctttaattcagctctnccctgtngcgcgcgtctactctataattctcctttcattgttgttactctgaagtatgcgggtggttgtcgtgtcgtctagatttgtatttgtctctgactcttgtgcttttctgtttttatgttgtcttctcttttcttgttctttcttgccaacgtctgcaccaggcactcttctaatagactatgtagccgtgagctcttagctgctttcgacccgtgtgctctgtgcgattgtcgtntcgtcgttggtcgtcgtctttcgcgtctcgtattccgtgtactgtgtngtgtgcgtatagtgngttgattatcactgggggatatgttctttctcttgtctgtcatgaagaagttctacttcattctcaaacttcttatagtcttctttcgtatcctctatcaatgncggatgttacttctttttctcaaaactctaaattcacctatgtaggtatctatcatacataaaganttnntcctcnatcnnttctcttttctcccatttcctcctcctcttccntctcttnnctanaaactcacactttaaacaccncatnatacacacccaca

SEQ ID NO: 11947 - DNA, 634 bp, Homo sapiens
ctcaggatttacgcatgttgcaaatatttgtaaacaaaactgtgcttgatgacccagaagatgctgtttttgtgaggtccatgaagagagtcggggatgactttgacctctatgaactgggacacagttccaacacgagaggaaaggtaccttgaagaggaaggcacagaaacagctcaaatgctcacagttacactgagataagccctggtatttctagatatcttagtggttttcagttgtatatggggcttccctgtgacttagcatattacatacttacaatgatattatttgagacatctaaatgtaaacagaaacaccaataatgaaaaataattcctacattttaggtttttaaatgtaaaggtgtttaagtaaaattgtgtacagaaatgtataaaattcataagtgttcagctcaatgaattttcaaaaattgaacatgtttatgtaactggcatgctagatcaagaaatagaacattatcaggactctgaaactccctccttcctggaccagtcactactcacccttccgaagtaatcattgggctgatttctagacaataaattaccatgtttgatttcaaaaggggtataaatggagtcatggaacatgaaaaaaaaaaaaa

SEQ ID NO: 11948 - DNA, 390 bp, Homo sapiens
  misc_feature (1)...(390): n = A,T,C or G
ccgcactcatcaccccacaacgagtccacaaacaccacaaagacacctccaccccaggcccggcctcttgcacgacctccacccctcttacaccaccacaccccggaagtggcctcnagttcccctaccacaaacaccaccaccccctttgcctaggggtcgatacccaaaacnacctccctttctaacaaccctctttaatctacccttttccacctcctaccccttcttcaccccattccgtcacctccccctttcccctattatcctcctcctttcccctctcttctctccctctggggggggcctttctcccccctcgtaaccaaaaaaatactaaaatccccccctccctctcctctccttctcccttaacacgcccctctctct

SEQ ID NO: 11949 - DNA, 779 bp, Homo sapiens
  misc_feature (1)...(779): n = A,T,C or G
ttcaggtgatggactatttatcaacttgctccataatccgtttagagttaaagaggaccacagaaactccacctccaggtgtcacaggttactaaactaataactaaaacaaattaaaaaacttatctcagattccctcctggagtctactgccttgcttatacagttggaggacaaagtcagccactgcctgaattcatattctgcactatgcgattcaggaaacaacgttatgcttctcctatgttcccaatatgctggacatcaggtgtagataataacagtaccatgattttcctttggagactccaaatcctcagtccaaatgactttattccacttgtaactccatagaagccatgaaatccagacctcagtacagacggtgacttccatgaacttagctaaaatttttggacaaagtttactccctctggattctaaatggatagggtaatgttgctggctcagtgaagcaccttctgagcctactgaagcaggagccgatgctgaggcagaactgaaagatgcagaggcagagtccggataacgctgtctgaacacctganaacacactgaacactgatgaattttactgttccgttttagcccaaggtcagtaagcatcttctgtaaagggctagattgcanatattttaggttttatggaacataaaggttgggtgcaactattaagctccagtgtcggatatggctgtgttgcaattaaacttgatttacaaaaacaaaanaaaaaaaaaatgggctcnttgggctca

SEQ ID NO: 11950 - DNA, 885 bp, Homo sapiens
tgctccgcattggtcgattctcctcccggtgttgtctaggtaacaaacagaacttgtagtggtttggaacctaaccaaggacacacagctagcaagtggcataaacaaaatatgacataaagaatggctggagacactagagatgtttatccagaagaaggaaattctagaatattatttgaagatgtaagtttgaaggaaacaagttcgaactatttgtaccttccgacgttgaaattataagatcaacctataaaaaaaaaaaccaatgtgcagggggcgcctcttctttcgagtttgtctatatagagagattggtcgatctttctattttacatactcctgcttgcgcagcctacattaacctcgcagttgacggcgcctacgccccgcgcattctgccccgtatggtcgttggtctttttgccgtcttctgttgtatacgtttccgtgcatgccgattattttcggattttgtatctccccagcaatagctatctgtttgtaagctaacacaggctgtatactgagagtactcgcccgcgatctgccatatttcatcctttgatgttgcttggccgacccccccactaatacacgctcgttctctgttcattgtctgtttctgcggtgatgtacgtgtaaccgcggattaatcaccactcttgctccgagctcgctaatttagtatatcgtcctattcctttatgagtctccaatgtgagtcttcttgtcgtttttcgaatcctgctattgcgccacctgataggaatctattataattctgtccggcgctccggcgagtttttgagtctccactattatctctctttttcgtagctatacgtttcagtacttaataacttatagtgtttaccacggctt

SEQ ID NO: 11951 - DNA, 414 bp, Homo sapiens
  misc_feature (1)...(414): n = A,T,C or G
gcgggcgggggccgggccgcgcgcggccggggnngctcgaggtggacaagagaaacacaccttggtgataactatgcaaagatgtgaggcgagaaggatataaaaaaaacttcccacaatatggacaggggggcaggaatataacattaatttttatttccaccacaaaaaacacgaagacgtgggaatttttggttggaggggaatgggggaagtgaaaattctgctttattatagatcttatgattgcgttgatagaatttatcattttttttttaccacttatctaccgggggggaggggacatttcttaaaacaacataacatacctttaacttatcttcatatcctctgtatggagggtatttgggaataaatacgtcacagggggaattgatattaaaaaaaaaaaaa

SEQ ID NO: 11952 - DNA, 934 bp, Homo sapiens
ataatcccaacaaacgcgcgaagaagattaatctcgattctacaatttgtggatttagagacctgatccagccctctcctttcaaagatgaggaaacagaaacacacagagaggcgaaggggctagcccgaagcacacaagttatgtatttgcatgtacatataatcatcatcatttacacataggaccctaaaaagattgtgaaaacgcggagaatttaaatgagaaaatggcgtatgctcgctaggtaaagtaaaaacgctcctacccactaaactaacataaacttaaggaacgatagagacaataatgtagctaaaacagtcgaagatcgataaagagagcacacaaagaagtagcgataccggacgtcatattatatagccttaagatgaataatcaattttattgatacggaaaatataatatttaaattaatgtactcacattctttagatatatcccgcagtatgttctctttgcggagcgtattctatcaagatatatttgatttatgatgtacccgtcgtagttgcaaaatatagaaaaggtgaacgctaacacacaaagtgggaaaacaacgaactgcaggcgacattttctgacgagattgtattaaagtcgcagctccatatgagtaagacacgaggtactaagagtagaacagcaatgtgattgtgctcacacgtatagatcagtaaaagtaccagtcgcgagtgaaggacgaaatagaacgtcactgagtaacctctgccatacccgcgaaatggtagaattatccattacataacacacagcgacatgcgctcacgcactctgattgataacgtacacgacgacgcctatcaccgctaagttatagccgccgattaatctagatgaacgttggtactctagttcgcgtaacatagcatagacagataaacggatagag

SEQ ID NO: 11953 - DNA, 1429 bp, Homo sapiens
  misc_feature (1)...(1429): n = A,T,C or G
taantaactagctgtagtatggaatgatggcgtgctacaatgagcgtggcgcggactatgtagatgggaagcagtaagtgaggacgacgccgcgctattgagtgacatcgtatggccgcgtataatgcgtgtgatatgcatgtgatggtacgacgtgtgaggagtgttgctgtggtctcggcgacgcaagcgagcaccctaangagaggcgaccgcttcgtgtcgcatactggtgttgtcgacggaggctagggttgtgcgtcgtcgtggttactgtgccgtgaggaatccgtatgtgatgaccgggcgcgagagagagcggccgctgtggcggttcacgcttgttcataccgtcgcgagcgcacgtcgctgcgtaagcacgtcgttggcgacactgagcagacagtgcanctgcgcgaggccggtcgatcgtgaaggatgggatggcctgtgtgagggtaggatctacgacggcgatgcgatggacagntgcgcgagcgcgacggctacgcgggcgcgagcgtaggcgcgtgcgagcggaggtgtgacgtggagcaagcaagctggacggcgcggtgtgaagagggtgcggaggtgagcgagagagtcgagaattaagtactagtgcaccgctgttgagccggttctcctgtaggtgctccgactattctctctacnttactcgtntctttctgcgggagtgtctnctcgagcgtcttccgcgccgtgcgtctnctctgctctctncccttacaccattcattcnaccctagtatagtacgactacgcgctcgctctcgtcccggccgaggcatgcggagcgcaggcaccgcgcacgagctagactgagctacactctgagaaatgctgaacatagtcccgacaaagaagagttcatcacgcgctccactncgctccctcacncgaatccaccacgaatcccacacacactactagcatccacgctcccctcctatatcagatgacatactctattattattccgtatatattatctcacacacttacgctcaccttgcggtcactcagctcagcgtcactgctacggaacgagctatcgtntccttctcctcactctcactatctctcncctcgagtctggtcgagtcctatgntcgttaagtaacatctactatcctggtctctcanctcttcctatctcttcttatcaaaacacatacaccctctacnctntaatcaccatctctcntattcaactatttcctctcctccgggctcctcctcnccccancttcataacacttctttctnttttcttnntctggtntncctnctctnnttaaancttctcctctctntctctntcnttctcttcttactatatcatataaatacatcctatatcacatcacttaacatcttcacacatactnatacacatcattat

SEQ ID NO: 11954 - DNA, 449 bp, Homo sapiens
ccaccacattgtatatcgttaattgagtgtaaggttcgaggctaactagcagttgaaaaggaagaaaaaaagaagacagtgcctactttctgagacatttccaaatatcagtgtgaaagaggactaccagaggtcagcagaacagaagagtttcttcctgctgaaggattcattatagaagagaataaatgattatcaagaggactgaaagcaaactggctattctactggttgccgagtatcaaatatcatggatggtctggcttttgggaaggtagaggggtttccacaaaggagtttccaatagctttctgtgcttattacgatgctaaacattgacccaaagaaaataagccctcactaaaattttactcttttaaagcaccctaagcattttgttgcttcttggtaattaaatgtcttatctccctgccacaaaaaaaaaaaaa

SEQ ID NO: 11955 - DNA, 814 bp, Homo sapiens
  misc_feature (1)...(814): n = A,T,C or G
ctagtcaagactaactttgaaaagaaatggaagatgataagtggaatggcccattttagtgatctgcacatcatcacacatgaacgagttgatctaaagctaaagctactgaagaactcgctttataacctataataaaaatagttaaaactattattacttataaggaattttttatatgtcaacctttgagctaataattgtatgtgtatggtgtgttttatgtacatgagcatacatatataacgtatatatgctatatataacatagatgtatatatgtatataaatgtgcatgtatataatttaatttatttctcatagatattctatgaagatattgttataggtacagaaataaatgcttaacaggattgggaaaaanaaaaatttataataaatcaaaccatcgatgaaagcaggggctttaggtgaggggaaatggaagttggggggttnttcttgtgggggggcctgggggccatcggggggtaacttccgggcgcttctttttggaggagggggtaattttacaccccccctcaataccgcacagggtgcgggaggtcgggtgccgcggggtgaatccttttatgagtggggggagcaggggtttgacagacccggggttacccgcaaaaaaaaattcggcacagcaaggtcccaatcaggtggccgccctaggggggacggggggtgtggttcttgtgattttccccgcccgataagacagaaacaccacactaagacgggtggccgtagccatcggggggaatatgtggtggtgccggcgtggcgaatcgcgcgggagctc

SEQ ID NO: 11956 - DNA, 693 bp, Homo sapiens
  misc_feature (1)...(693): n = A,T,C or G
ccccgtccgctgtgctgtctattctctgtagtcntccgcgggtagtccttccctcctttgtcgtcctttgtctcgtccgcgcgtttcacggcgagtggcgttcacaactgttggttgcgtctgtgcccccctttcactcatctccccttgttcttccccctattcgccctcacctactgcgctagtccgtttgattgcgcgcgcctcttgtttttgcgctcccctcttctcgcgtcacgctccagcgtacgattttccgttcctcgctcctggcctcccacgtctaatcctcgttgtgatgccgttctcgtgcgctattctcgttgcgacgccnactttgtgcgtcgcacgtttcccctcctggtggtctctttttgctgccggcccgccccgtgtcatcactcctttttcccgcacggaataatggattggcgcgtacatttccgtgaggacctctttttctggttgccccccttcgttttttatctccgctggcttcgggtgggttttattctttgggtcgcaattcaatacggtttttgtgtctgtatttccccccttgttttgaaaaaaagaattcccgcggtttctatttgttttttcttctctcgattttttttttaacaattttttttcggggcctaatttatggctttcctgctttggcgtcaaccgattgttggtgtcaccatc

SEQ ID NO: 11957 - DNA, 501 bp, Homo sapiens
atcccttgcgcattctcgagggttccctacggcgcatgtataacctttctctttggcaattgacacacgtgccagctcgggttatgtatttcccgcaaagcagaccgcgcgcgctttgcgttcccgcgtgagggttcccgaggcacgagcttcagcgcgcgggaactgttcgataagaagggggggtaaacaacggagatctcttttcgttgccggtgtttaaaaaaaaggtgatatacacggacggttagtcggagcagtcccttgcccatacaggtgacatgcccccctattatattttcaaagccccgtggtcacccaaacagcgagcggagccctggattttttggctcagagagccactccctttccgggttagtgcagggcttcatttctcccccattttccaggccgtattaaaagagaacttctgtggcgttctctgccgggagtggccagactttgggattgaggaataaaaacccctttaaggggggcgcg

SEQ ID NO: 11958 - DNA, 746 bp, Homo sapiens
gacattaaattaatagctatatcatgccagaggcgcagaccatattaagtaccctgacctcttgtgtaccatgtcaacaaagaattttccaaccccagagatgtgtgaccctcatcactttctggatgaaggtggcattcttaagaaaagtaaatacttcatgcctttctcagcaggaaaacgaatttgtgtgggaaaagccctggccggcatggacttgtttttattcctgacctccattttcagaaactttaacctgaaatctctggttgacccaaagaaccttgaccccactccagttgtcaatggatttgcctctgtgccgcccttctaccagctgtgctccattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgagtcagttaaaaaaaaaaaaaaaaaa

SEQ ID NO: 11959 - DNA, 136 bp, Homo sapiens
  misc_feature (1)...(136): n = A,T,C or G
tcttttttctctcttcgcccctcccccctgcctccccccccccccctggtttccccccccccagcctttttctttccccncncccgcggttccccccagcccccccntgttcctttagttttttttttttttcctt

SEQ ID NO: 11960 - DNA, 269 bp, Homo sapiens
  misc_feature (1)...(269): n = A,T,C or G
agtaattcagaggatgaagagatggaactaatcttttccacttccaaagaaacccgtgattgggggattccacacacgaagaattgggcttccccaaaaggcaccatgtagtgcaaagtgattgatactaaaaatgggggctttcaatgtataagtccgaaatgcagcatgccgttttctaaggcggtggtgacatgcataagaacaaattattggagcttggtgtgtgagtgtgatatgggggtcttccntttggaaaaaaaaaaaaa

SEQ ID NO: 11961 - DNA, 287 bp, Homo sapiens
gcggcgggagagaattgtatagagatggcgcgggctccagtactacaaaatgtttggcaaacagagacctgatccagccctctcctttcaaagatgagaaaacagaaaacacacagagaggtgggggggcttgaccgaagtcacacaaataatgtatttgcatgtacatataatcattaatattcacacgaggacccaaaaaagattgtgaaaacaagtgaatttaaatgttaaaatggcaaattctccctcaataaagtaaaaagcttctatcgaggggaggggaa

SEQ ID NO: 11962 - DNA, 246 bp, Homo sapiens
  misc_feature (1)...(246): n = A,T,C or G
ctcaggtcttctaggatgattccctaatccaatatgatcgtccctgggaagaagaagaaatctggacacagacgtacatgagcagaggtaggggcatgtaaaaacacagaaaaaaagatggtcatcagaagccaaggagagaggcctcanaataaaccaaccctgctgacacctggattttggacttccactctctagagctgggagaaaataaatttctgtggggtagggcaaaaaaaaaaagag

SEQ ID NO: 11963 - DNA, 184 bp, Homo sapiens
  misc_feature (1)...(184): n = A,T,C or G
actagaagaagctnatcttgctccagtaagcactgcatcaccaaacaaactttaaaagataaaaaacacttgaatcttcattcaatatggtggggagtattataagacaattcatatttatattatttgtcaaattgtatggccgatatacaaacatggcttacaacttggaaaaaaaaaaaaa

SEQ ID NO: 11964 - DNA, 814 bp, Homo sapiens
cctgtattgagttagctttaggaggatctatttatgaagtgattcactgccatataaaggtatatgagcttttaaaagcagcgcatcttcaaggccatgaaagaccacggaatgcagtgcctactgtatacgaaaggataataattgaccctagcaaatctcccactcgtcctttcatgcagctgcgaattcttttgatccacgagcgcatcccagcgattcacaagtcttctccccccagactttacacttattcctaggattttgatatagcactaataattagctttttgaccacatatttatcttccaacttaaacttttaccctttcggagtgccatattcaaatatcgcctaaaccactcctccattataccaccatgcactaccccattgtataatctatcaggcctatagaattccatcccctcctccataccctagccaccatccactgatacgcatattccccctcaactcctttgacacacctacatctagacccctagtacactaattcccattccatctcaatatattcgcttctcccaccagttagtctcgatacccccttacatcctacatcaactgacacccatataaatcaacttctattctatcacaccttccattagaaatcccgatttcagttaatctcccacgaataccttaatccttaaaactcacattacccttcttccagtcttttgttcataatccatatgcacaatattcatatattattacagccgaaatataatactgtgcatcccgccgcataagctacaactctagaataagttaatggtgcgt

SEQ ID NO: 11965 - DNA, 575 bp, Homo sapiens
ctgctgtcgtgaagacaatgattgatgatcattaggatgacccactttcttgtattgagatagaagtgaaacgttacactgatgagagtgccgtacattacacttgccagagagacaatcactatactgaagacactgcctggagattggtaaaatgaactttgcaaactgtacatccaacaagatactactctccagaatatacaggatgtcaaagaaactcaactgcaggaacagacgggctgagatgactctcctgagaaactagatcataccctcctgaataacatgggggacagagaatatgtctcatgtgatattatactgtattacgaacctcatgtaatgtacctgatgcacaatatacctaactgaaacgcaatatatgataatttgtgggatattgctacagctgtacttacacaaaatcacttacagcattacttgtatatattacaaaagcataaggggtgaatgtttcccctatgaaacatgtaacctggcactgatgttctctctccccagttctgctggtgttggactacagctctatgggaaaaataagtaagaactgt

SEQ ID NO: 11966 - DNA, 366 bp, Homo sapiens
  misc_feature (1)...(366): n = A,T,C or G
cnaaangcnggtccataaangttttttgggngnttttncncagtnaatttnttaaccagtnagggtttttncacaacagntttgaatttaaggnnaagngttttttttttaacccccgntnagntttttctcaanttaaagcangggtttaggttntttggnnngcccctttnctnntaanaaananggngacggntcnatttataaangtngtcacattaacntngcaaagaaccattcaagngattgaagagccaccttgtagtttgnaaaaaaaaattttgcaaaactgttcatccaacaagagantaatatccagaatatncaggaaatcaaagaaactcancagcaaaaaaaaaaaaaaaa

SEQ ID NO: 11967 - DNA, 656 bp, Homo sapiens
  misc_feature (1)...(656): n = A,T,C or G
atatttctccatccctctactttgagcctatggatgttgttacatttaaggaaaaatcagtgttcttgaggcttgctttgcaaaagttcattgctttaacatgcacccacttcagagatgtgaagacgtcagagatgctggttgcaagtaaagacggtttgttgtataaagaaaatacttcatgtcttgctgtctgaagctccagagggctctgctttatgtgttttccaacaaagatgacatttagaagaacaaagaatattaaggcagaagacctggttttttttcttggatgcaacaactactttaaatggtctccctgactctaatcttccccgaacagtctctttacctcctatatttagaaagatctttntaaaaaggaaattttctatctttaattatctgtttaactaaacagattattttttttactgtctttaacattaagtccaaattcctcatcataatttacaaaactacttaagattcttgttctattactgcttcctgttcactccttccttttgcagtctttgctaaagcatactgaattgattcaactcctaaacaagtcatattggttcgcaactctggggccacctttatagctctccttgtccttgagtttctaacccatcccttatttgataatc

SEQ ID NO: 11968 - DNA, 804 bp, Homo sapiens
  misc_feature (1)...(804): n = A,T,C or G
tttagtcagcgtcacacatnaaatctccttcctanacccatccacccactgggaaaancctaanccacgtggagcatctacatagaagagggccggggccacanctacatccatcagctccttccatccacgtaagagagctaccttgatgttccaacctgcagaagctaanagcttccagacctctacccccacggacacaccacctgagccaatgtcccacagagtcatggggagataataaaaggctggtcttcttccacaaagggagaaacgaaaaggcgggcggcgacaaaggataaaaaacaggcgactctcgggccttgcagcctcaaagcgtgaggccccccccccctttcgctgcgcagaggaagagattggggctctctgtgcccctaggtgggggcgcttcggccctttccctttgttgaggggatataaatgagcccccgccccttgccccctttcgcccaggcctacgggtgcggagggcaggtacccctcccccagagggccgaattccggttctcacaaaataacgggctacccgctaaagatcctttgaacccgcccccccctaagggcctgaccgccaaagccgccccgtccggagggttttaacccgttccccccccccgaggtcgagcaggaaaagcgccctcgtggttggggtgcgttcaccccccaggtgtaggagtccccaccgtttcccccgttaacactctctnaccccttccctctgtccctctcgcacccacattacctggaccttttttctcttaaagacaaggcgctcatttacac

SEQ ID NO: 11969 - DNA, 934 bp, Homo sapiens
gtgccagggtgtggcggagggaagcgaggaaaaaattcagggagcttgctcttgggagttggccaccatgctgtaaggaagtccaggccacatggagaagccatgtatagatgtgggggcgggggggcccagctaaagtcctaaccaaaagccggcatcaaccaccagatacataagtgagaccttgagatgactctagcctaagcaggatcagactgaaactacaagagagatttgagcaggaagcaccaagttgagcccaggccacctgcggggggggggagataataatagattggtattttacataactagggttagagggtggtggtacactggagtggataactgataggtagggggagaggacagaggaatgtatcaagggcttagactttgattcagataactggtaaagtgattggggatgtggataagagagattgtttatgcagggggaagaagctggagcgtctgggaagtggtgagtgtgggattttgagaggggagcaaagtgggccaggatgctaggtgaggggcgtgcgagtggggtagaggcgatgagggcggtggacggaagagacgaaaagactagatagtatatggacaagagaggagggagtgggacgatgcgctggtagaggtgcggaagtgggcgggcagggggttaaggagggctaggtgagcaaggtggttatgtgacgttgtgggagccgtagggccccgggtggtaatagaaggaaaggggggggtcgggggagcgcgggcgcggtggagccggagcgtgatgagaaggggagatgaaggggcggaggagaggaggggggaggtgtgtcggaggtggggagggtagtgggatgtgtgaagggtcggctacgggggggacaaagagagggtgtgatagggggaaatggtggttgaagcgtgaggaagt

SEQ ID NO: 11970 - DNA, 866 bp, Homo sapiens
aataatagatagtacacacaatcatcacatcgagagctccgcaacgtacatcgcggcggaccgcaagtcacagaccggagtgacgtgacacgcacgtacacggagaaaaacgagaggagtgaatgggaaaagcaaagcgagaggagaaagaacgaggtgtcgtacaagtcgacatatgtgccgctagcgtgtatagagaaaggtagagcaagagagaacaatagagcgatgagaagatatatgggggcggaggggcggcgggctccacctcgctggcgcgcacgcacgagcgcgcacgaacgcctggtcgctggcgcggtcgcagagcaggtgcggggggaagagggtgggaagtgttcgtagagcgggcgcgttatgttttggggcgtcggggggggttgcatgagccgcgtggcgagtcacataccaggggccacgccccatgccgcgcggcggggggggggggggtgctggggggaagggtcgtgcggacagggcgagggcagaggcggagggagacggtgacgctggcgtgagcacaactcgcggggcgcgccgaccgcgcgcaacaagggaccgcaggcggcggagactaacatcacacgtcgaggaagctgaaaaatgcgatagtcacctggccgaggccgggcaaaggttggatgatactccaggaggtatatagtattaaaagacgataaaacaacgggtcatcagaaggtcatgcccccaccgactagggagttaataaaaacatgggatgaggacgtcaaccgaaagtgttggctcaaacataaacacatgacttctccatgtggcctgaacttccttgcgagcagcggtcaaactccaagagcagtgcatcccag

SEQ ID NO: 11971 - DNA, 284 bp, Homo sapiens
agagagatttgacacagaaggagaaggtagcataaccactgaagcaagacattacgctgctggctttgaggatgggggaggggaccacaagccaagaaatgcaaagaattcagctctaaaagctggaaaaggcaagaaactgcattttcccctagagcttccagaggagcccagccctgctgacaccttgatgttggcctagtaaaaatgatgatgttggacttctgggggggagactatgacagcataaatgtgtgttgtttgaagccgcaaaaaaaaaaaaa

SEQ ID NO: 11972 - DNA, 866 bp, Homo sapiens
  misc_feature (1)...(866): n = A,T,C or G
atctagggtcgggtggtgctaagaaacctaccataagctnactcacttaaaaatgcagtttcaggggctaataattacaccctctcttaccctaaccaaccaacaactccaggtttccagcccctcaccctccatgatctccagcccanaactcctgggggagacanatttgangggctcttcccatcttngcaacngggccctgtgatcatcaaaggggggtctctnttncaaaccttngtntctcaaaataatggggctctgactgcgcagcaggcgtacaaacctggtgggtctataacacttccttctttcctcccttttctccctccttccctctcttgcaccctgtcttgctgcctttcttccttccttcctttcttcctctctccctgtttcattggctctctccttctctccctctctgccttttttcttacttctttcctccctccctttttcccttgttacttacttgcttgctccctacttgcctccgtctgcccttgctctggcccttgctcactccttcttgccttacttctttctggtgttcttcatgaggatttgtcaaggagtggcttaaaccagcattgccccatcgccgtggagctcgggagaatccggatgcttaggcgccaccccaatcctactngatcacaacctgtgggaaggggagcgccacgaccatggttggtacaaggaagtgctatctgtgtcttgagagcaggtgtgggttcgggccccctggagcagacaagcgtttcaaagaaggccgtgtattctaaagggctaatggacatcgatccaacctgccccgggtgatggtgggagagcggggagattccagtgaaagaaagagcggg

SEQ ID NO: 11973 - DNA, 953 bp, Homo sapiens
  misc_feature (1)...(953): n = A,T,C or G
cttactgttggttgtctgtcctttgcgcatgcccgtatggtcaatcggagcgagggatgtatcgtagctgacggatgatatcaanagtgacctgttcgttgctgcctgatttagatactctttggagcgacggcgtaccggtgcgggacgtggttatctcgatactcagctaaagatagtcgctgcgagacgtgagtgtgtgatcggggcggcacgagacagacgcgtgataaaggtgagacctgggcaagagctagtgtagttctcggtgcgcgatgtggaggcgggcggctgcgattgtggtaggcgttatgaggcagtgccgggatcacgctcgcttggcgttgcggaggcagtatcagctgactggatgggtgggtgtcggtgttgaggtagactgcggcacatggtcgttactatactctaactctagtgactggcttccgtcctttctactcaccgactctttatctacgaccacaaggtgatacccaaattataaacatcgtgtggggagggcgatctgacggcggatgtggggtggtgagggagggcggaggggggtgacgatggagcaggcgcgggtacacncccagcgtaagggtgggccgtgctcggcgcggtctaggacaccagcgccaacgaaggcggcacgcatgcggaggaattctactcatcatacaaaactttttaaaaaatatcatgctgcgcctgtccttcacaccatgtgttaacagctccgctcaatatactgtcctcacccctagaaagttcatgggactggagcatcatgtaggagtgagggtgctggaaacactggacgttgttggttggtcagggtaagagagggtgaaatcatcaggaagtgaaactgcattacatcagtgagtcagcttctggtaggttccttcagaccgcctgacctcagaggcttcactggtgcgtaggaccag

SEQ ID NO: 11974 - DNA, 356 bp, Homo sapiens
ttagaaaacacatggttactgaagcagagacactgtgaatatccaaattgaatcaatctgcatgtgatgtaaaaccttggcgatagggggaggatgtaaaaattataaaggagcactgagacatgaatgaaattccccagagaatcattagatgatgtatcaacttgacgaaatatacccaagtatttgtctatttctgtccgtcatcactaacacttcccagatccaagacatcatcgggggggacctggactactgcattggctgaaattgaaaatctgaacttcctggtttgactcctcgtttgacttctcatttcattaaaaataaaatgtgaacttttaaaaaaaaaaaaa

SEQ ID NO: 11975 - DNA, 1002 bp, Homo sapiens
tgtctgtttggttgcgcgcagaagtgggagaaagtctgacactacccatcatccttcttctctgatccaagggtaatgaagaaggaagagttattattgcaaagaagataaacaaaggggcgtgggagaagacctttcttcacgggaataacttctgaattgatttgggtgttgtgcactagtttgtttcacacaacatcgcatgaataaaattagcagtggataagcggagaaaaggaaaaagaaaacttgattgtaattttatctcgtcctacgcgggggggggttatcttgttactgctatctatatacaaatatacgggagcgcatcatgaggtcgttttgagccgcgagtggcttgcacgttttatacttggtcgcgtgatgttggtggtcgtggtgtacggattcagacctatttttgtgcgtggtagataaggttgttatacgagattacatttgtgtccacgccttgttgtcgggactgattatcgatagctgatacggtttttatgcgcggtcgcggcccgctatgccgtgactcagttatttcttctttccacttctgttatcgtgttccttgggtggacacggtagccccgtcttctttgcgtgccatgtctctatctcgtgtcagaccctattgtgtcgtcgatgtcgagctctatgtattatggcgtccgattgtgtatgcgttcggccgcgcccgatagcattggtgatggagtctaacatcgtgtccggtcgtttctatatatgttgtgaagcttgtgacgggcacaaccctcgctgacttccctctctcctgttcactaatatacactttgtgagatcagttggtgtgactctcacgcgtctacgcgtgtgtgacgagcgacactccggccacataatctcgtgtatctccgcgctcgtatcttcgcattaccaggcagtctgatttctttgtttgttgactttgctctagtgcaagtttcattgcgatgtgctacgagggacgga

SEQ ID NO: 11976 - DNA, 1166 bp, Homo sapiens
  misc_feature (1)...(1166): n = A,T,C or G
tttctntctgttcttgctcgtcctcctgtgtttctgtcttcggccgctcctgcgcgtattgcggattgttgtgcgtcgcgctgcttcctccttgtcgcgtcngctgcttcttggttggtgtcgggcttcgcgcgttgctggttctttgctttgccctgcgtgcgtggtggtccttgtcgtgtgcgtgccttctccttcttgcgtgtggcgtggcgctcctcgagctcgtccctggtcgtgtcgtgccccgcgcggtgcgttccttccgtctcgctcttccggccgcttggcgcgcgtgtctggccgtgcgtgctcgtgggcggcntgttggcgcgtcttctctgattctctcgcttgtggcggcgggccgccgctccgtcgngccggtgctctcctcttccgtcccgcctgtgtgttgtccgctgctgtcgttctcgtgcgtggggtggggggtccggcgtgtctcttccgttcgcgccggcgctgtgcgtggtgtgtgtctgtgttgccctgcggtgtgtggtgtcctgccgtggctcgttgtttgttggtgtcgtcgctgtgggtgcgggcttggtgtggcttgtcggtgtgctctcgccgcgcgcgtgctgcgcccgccctcgtttttctttctgccctgcgtcgcttctcggttgttctcccttcttcttccccttttctctcctccctgcgggtcgcgccgtctcccctctctcggcctgtccccgccccctctgcgtgcttctctgggttccgngcctgtcgcgtcctttccttttctcttcctttctgctttgctttcttaagagaaaggtttctctgccccttcctttcttcttttttttgcctctgtcctcttggcccctgcctttgccgccccgtgcttccttctcttcttctgcttgcgcggcttcctgctgcccccggcggggtgctgctcgccgttccccggcgccgtccgcgcgggtctcccccttggnctcttggctgtggttttcggtcggcccctgggaaggctttgtttgctgttcctcnctcgtccttgttcggtggttcccccccccccgagggttttgttctgctgttcccccttcaggcttttttttttttttttttttttttttcctcttccncccctcccccctcctctcctcctttctctc

SEQ ID NO: 11977 - DNA, 524 bp, Homo sapiens
cttcaggaaaccaaagcaaaaatagatatcactgaaaggcttctgcacagcaatgagcacaatcaacagaatgaaaagacacctaggtatggggataagatactcgaaaaccatacacctcataatatcagctattttaatgtccaaaatatataagaaacttctacaactcaataacaaaaataacaacctgattaaaaatgggcaaaggacttgaatagatatttctccaaagaaggcatacggatgggcaacaaatatattaaaaggtgctcaacatcactaatcatcagggaaatacaaatcaaaacgacaatgagatatcacctcgcacctgttacaattgctattactttaaaaacaaaacaaaacaaaacaaaacataatgagtgttgaagaggacatggagaaaagagaacctttgtacactgttgacaagcatgtaaatgggtgaagccactatggaaaagagactggaagttcttccaaaaattataaatagaaggaccacaaaaaaaaaaaaa

SEQ ID NO: 11978 - DNA, 1374 bp, Homo sapiens
  misc_feature (1)...(1374): n = A,T,C or G
tggcgagacgacgagttagtagctagaagntgancangtctccgacaaacancanagtngngtggctgntactggagannntacnnngtcgtnanctttgtcgncancgcgatgttagcagaccgcnantaccnagccgccnagcagtcagccttgaattgcatgngtgngtnatancnagnnggangtaatangaccntccagngngaccnttcntngcnatcagcctctatgnntaccgttnntgggtacgatcattgttgagtcgagagagaagacagtgatcgccnaanacctccatcccnttnttncggatggagtgtcngtnngtgagngagagngnngncnatgagtnagtaatnaaaaacatantaatantntctncnctncnattncaacaccttcttgcatgtgcgagagatgtcgtgtgtaggacgncacttgtcacatcgncgcgagtacnccgtggcgnaagacgaattacgcgactccgtatacgccttcatagcgaaagtnataatgtntctgtgttaacactgaggtgctgtttgtttgccgtgtaccttacgtgttgacatgcacacgtaaatatcttctacatattatctccatctgacttctcatctggggggggggtctctttcctttcgcgtaacttcataaaacatatatgtagagtgaggtatgttggggtatgatgtaataagtagagagggacatactgcaaagtattggacaggagactggctcactgcagaggaaaatgcagctcaagtaagtgaattcatgcgtcatgtgagggagctatatctatcgcgatagcaggtcctttgcgtaggccgttgcgaggagctgtgcgatccatccgagtgacctaggcnaattatggggatgtaggactgggagacggccttttggattatccggattttagtttcccgaggctgacatttcgtaagagaggtgggggtaaagtaagccactagagacacattagtatgagtgtggcggatgggatgaagagtgggagtgattgtgggtgtcgttgcggtggagtattggtgagagcgactcatccacgggtacaacgcgagccaggagaagaggacaaagatgactagctgcgcaccgcgagtatggaatgagttcactctgttagtctcgatggagcatgtttatcccacggcagcgccacacgtgcctgtcgatcctcgaagactgacgatattcnaccactccaccgtacatcataggatacatgtctcctgctgtcccgtgggaacgtgtagctatgttagaaatgcgtacagaacaacgagcaggtcggagccacaggatatgttcagtataggcgactcgaggggtcgtgcggct

SEQ ID NO: 11979 - DNA, 922 bp, Homo sapiens
  misc_feature (1)...(922): n = A,T,C or G
actttacctttgtgaggccccattcacacacgcagcagcagccancaacgaccggcaagaggagggggcgacgagagctctggcagcacttgnaaacgcagtacagaatagattcctcgctttcacatgggggcgcgaggcgggcactcgggggtcggggaccctcgnnccctgttgcgctggctgtattctggggctgtaagaaggcagagactcaaactccttggngcgcggatccggcgcctttaccgccgcctatacccctcgcaccgctaactacgcacaaagaaaaattggacataattcggactttaccatgacccatgatgacttcgtncttatcacccaccatattaactaaataaaccttaccactcggttctccactctacnagttgctcggcgcagtaangtcttgtgcgggagcccttgaatcacgtgagcggccgccatgcgcagcgtttaggagaaaaagacggatattccagggagattcagaaaaccaactacgggaactgacacctgtggctcctgngcttctgntgctcgggcctgcctcctcgctgcttcccctcctcttccctttttttcttccnccctctaaaaaaaaattttttctccccctctgcctccgctccggctccttgctccgcccgcttgtnttttgtcgcgcgtccctgcgccttgtctngtgttttgcggctccccggctgtggctttggcctgtcccttcttcggtntgcctcttgtcncgcctctctttntgctttgttccgccccccgcctctcctgctggccttcctgggngtgtcgtgctgcccgtcgcgtttgcccttcaatttggggctaaagtccccccaaangcgccttttttcctcttctttcctctctcccttncctccccccnnncctttactcttcc

SEQ ID NO: 11980 - DNA, 952 bp, Homo sapiens
  misc_feature (1)...(952): n = A,T,C or G
ggtgggggggattgaccagcggnagagatacagccttcgacgcggaccgacctgggaacccttccttctactccctgcttctaggagtctattaacagatgaatggatatagaaaatacggggcgcggtatgcaatggaatattattcacgcgtaaaaaaagaacgagaccctcgcctttgcaccaagatggatgaacctgcaggacattgtgctaagtgaaatacgccacacactgaaccttctctagattgatgctcctcccactgtgtttccctgaggtgggttcgcaccttccatcctagatgaagcaccacttcacatacccgttgcctgatccgcctcttctgcctacaccacatctttgccttaggcttctctgcccactacgcccatctccacgcaccaaatcactcttaacattctgttcacaagataaaagaagagacgccccgacagccaccgcgaacgccaaacccagagacagaccccgacgggactccgtcgcctccgatcctcactcgtcacatgttcattgaacatatgatcgacccctgggcgcctgctagggaggacggcgggacggcatttcccgatactagtacagccttcgttgacctcccgcaggggacgctttgcatgtgtcctatactcgccgtgcacgagcgatctagatagcgtccatcgccctaagcgttctagtgtcctatctcgctcccacgtggcgtgtcgccccgcaccatcccgactccacacagagccacgactcactacgcccccaggccctagacggtgtggattaggacatgatatatacaagccaatgaaaaatcccacgtttacgataagacggcanaaagaaagaagaacacacagcaccgacaaccacgcccccgaaacgtccgaaagctacgctacgtctataggacacccacccccaaataccacccagt

SEQ ID NO: 11981 - DNA, 1146 bp, Homo sapiens
  misc_feature (1)...(1146): n = A,T,C or G
acccgtggaactgcgaagngtactctgcggtatggtgtgtgagttgtngaggttggtgtagtcctcttcgcggtgttgcggcgcccactcgccttctgggcgggcgtgactctgggaggcctcactccgcggtcctcgggccactccgtgtgagctccgtgnnngccccttgctccgggncctctcgtggggctcttggtgtccgcggagcgggctcgagtcgcttgcctctgggtcgttgccttggagggttctcccgcggtgcggngcctcctccgtgcgctttccatcgtggttcgtctattggaagcagctggaatcggcctgcgtgggctaatcatcgcgcgcccttcggttgggtcctccttgactcgtggcctttgaattcttttttaatttggccgcgcggggccgcggcccggccacgtcttcggncactaccnntccctcctgcctcgctctttttaatccttctctaggccactcgncctgtgtgggtgggggncaattcaggttgggccgctgggactcgcccgggctgngggccttcctggaggccactcggggaggctcgcgtgggtctcgagtctgctactggattcgcattataaagtctcttggggattctatgtcacctcgctatccctctaggncccttcgtnacggtgccggnccctgactcttgantatgatctttgcgcctttttcctctctctttctctctatctncttatntacatattnnttttcttttttttcctcttttcacctnttcgttgtccccttcctncctctccccccccctccnnncnnccagtacctccctcccttcttccctcctgctccctttttttctcgcttctttctctttcttnnncctccccccctcatcctctctcgctctcnnntccctctcctctgtcnacctnnnccctctntcctcttttntttttcctttnctttttctttnncttntcctttattctcttccctntcttctttnnnnctntcgctcttnnnggtttctnncccttcataaaatnccttttnccctnntgtatcccccctcaannnncctttctctttcttcatctttctttnnccttctncccttnccctcctccctnnnnncctcnccttttcccc

SEQ ID NO: 11982 - DNA, 903 bp, Homo sapiens
  misc_feature (1)...(903): n = A,T,C or G
tggcccttgcagcgccgtggggaggggggnagctttcagatcactactgaagcatttcagatgggatgctagatgtctagacttgccttacaacaatgcatcaagacccctggggcgagggggggtactggaaaataaaaactacagaagctggaggagggggaggggcaattcacagttctccaatgcttcatatataaatttcaaattttccatactaaaaagtcaaaagacctaaataacaaaccctgggcaaaagctagttaatccttgggggggggtgcccctcccgtgcgcctcatacgaagagggagctcacggtaccgctccgcttttacggcttggggtcgttcttcgccccacgcgggggcgccctcggggccggctcctttgtggggggggaatctctcgtacccgcccccataaccgctctactgctggcggccggggcgccgggcgggggcaccctcctcttggacgggcgctgccgtcttccgcgcgtcggcggcccgcccagacagacggcgtcggttcccccgcccccggcgcgctgcccccgcagggggccgcgccgcggctgttgctcctggggcgccccgcccgcgggtcatcgaaatcacgcgtgctcggtggggggcccctccccgcgggtctaaagacctcgccgtatacggtcgggtactctcaggggctcttgatcctgcccgctttgccctcctccctgcctgctctcctttccgttgcgtggttttatccctctttcgccgccgcctccccgcgcgtggctccccccctctggcctcgactcccctctcagcgtgggcgccgcgactcggagtccgctccggccatcacgagatacacgctccggccgcttctaggcggggtgatgcggggggaggg

SEQ ID NO: 11983 - DNA, 1556 bp, Homo sapiens
  misc_feature (1)...(1556): n = A,T,C or G
aatatacgactcgaaggtatagtanagctgccactaacacacanaacgcagagcgagtcagacgacnacacatgatgagacacactaacgtgtgttacgantagacaagcgacgcgccctcatacacgtacgcnattacgagcggtgcgtgactcgnatcgagctactatcatacgtgtctcggacgactatagatacgcacgcatagcgatactcggcatctcattaagatgaagatcgatcgcatatnctagaacggtacacgcgtatctttatatctcatctanttatcnttgcagcgntctatntatacgacacactatatngacactaagatcattgactgacagtgatcgatcgacggcanctctagcgtaggagtattangcaagggctgtagtcgacgtttacgaatacatacgtcaggtagagtctttngcatagtctcgtntttcagcagtgtgtgtcgcacacatcgctcttgttcgagcgtgcncacttcgtatgcgtacggcatggctgcggtggacgtgcagattgcgtcactgacttatcgttgtccatacgtagtcagtgggcgctgtgtgatacagtaattcaaagcgatagcattatgcgcgaaagggattactaggccgacgaccatcgtctgtatggatgctatgctcctcttatccgtagacgatgttgtatttacaatacggttatatcgctgctacgnccgcgctgtcacgcgatataatacgaggccattggagagagcagcgtgagtgcgcaanaggcgatcggntatgtatagttggtgtagtgtctgcgtcgtatccggcatgtcagctgtcggcgcggtcatcgatgttatgctacatgatgtacattctgatatcgcgcagaggacgcgcgngtgcgcgttccgtgtaactcagcgnactggcgctagtcgtcacgagataacgtngacggcgagatgttgtgtctaactctctgtctgcgttcttgctacctctggtaacncgaattctgtgtgattgatcaagacgagacgataacgcaantacttgcatatagccggaacgcatcccgaaatgacgtgatcttacgcaagacnacgctgtcgagcanaattacaagatctgctacgacgaatatctcgttggaggtcctcgctatatacaggcgcgagtgtgtggacgacttcctatctattagctcgctgactatcgagcgtcgcacgcgcgcgacatctatgtgtcatgtaccactctacattatagtacatgatcaaaactatgatgcgacgacgggcgtattgtacatcctccgtctatncctgatcaaacaacgttctcacattcgtaatatcattatcggcatatcatactcgatacgaggtgtggggtctacatgctncttnaccaaaaactccttgtccgtgtncgcntgtttctctcctccctgtcgtagcncagatcgttaagttggcgtggcggtagagcgtacngtgtctagcatactactagtccgtatgtagttcncgtaactagaggaagctagattga

SEQ ID NO: 11984 - DNA, 326 bp, Homo sapiens
cctagaactttttaaaactggtggacttaaatgttctgcaaagtcttacacaaaagcccaatacagtacatgaactacggaaaagcagaactgctctgaccaaggaagaggtgggagatctgagtcctggccccagcacccacttcaacttcagtcacctccttggaatctggggttctgcagcttgaaataatcagtttggattttaaacttatttgtaacataataataatcctaggaactttaaaataatattttgtactaaattttagaattattataataagtgatctaataaaacagtcttttcctgaaaaaaaaaaaaa

SEQ ID NO: 11985 - DNA, 199 bp, Homo sapiens
gagggggggggaagagaggaggggagggctcagggaacgtgccctgagtgaaaaccggcccagaaggttaggcagaagaaaagagagatgagacaccggactgtgggggggaggaaattatacctgcgtgtatggagaaaataggggggtttgtacaaaactgatgggaataaagtgctacatgcggaggggaggcgaa

SEQ ID NO: 11986 - DNA, 1123 bp, Homo sapiens
  misc_feature (1)...(1123): n = A,T,C or G
atagcatagaagggggagtatgataatactttttgaaaatttgaaaatgtgaggaactcgccgggggcattgcgtcgctacagccgctgggtcgcctctgtggctggagaaagttctgtagagcgagcattctgtgatcattgtagattctataaaacagaacgctccgacaacatagaacataaagggntaattggaaataaagaaacagaagtgtatagaacatagctcaaataggaatcagaacatacaaatgaatcagcgacctctccnnnccatcgcggacttcgttggtnaccatcagggagcgggatgaagatggagaaatagcaaaggaagagatagaacagtaggggaatatgaataaaaagaaagaaaagtgacacaaatggggtggtgggcgtgaaacgagattgaaatataaaaaaaagatgccggacataatgngacataaagatggaaggagagaaggagcgttggtgagaacgcaaggaggagatataatggnagccgactgggaggggtatggtgtgcggaaccaacaactgagaagaatctagaacaaaaacacatcacaaaaggaaaactggaaatagaactatcagaaatgnggctaggggaaagcacaggcaatcgagatccattagtgncaccactggcaattagctatttaatagatagaggaaatacatgagtaaatattttatatctatctttatataaaaaaaatataactaattacagtacataacacgcgttacggtatatctgngttttctctctgaattcgttgtannnagaacgggcagcatgagcgacatgttgtagtgatttgaaaatgttacatttatatgagtggngaaatgttaacgttaaaaatctatatgagnnggatgtgtcttggtcgtctgntcctgtnncccattctttttccttttgctttcttcttngtcttnnttttnncttatttccgncttctcctncctgtcttcttgtttggtttttntcctcaaaaattgttgtctcccttgttttccccctcacnnnncttttttatcatctctccacttctncccttctttcattttctattctttttctttttttcccntcttttcttctt

SEQ ID NO: 11987 - DNA, 906 bp, Homo sapiens
  misc_feature (1)...(906): n = A,T,C or G
cacactcttctccagctgcgtggtgtctgctatgagtgcgctgcacgaggaatatctgtagagacgggtccgatagagatactctgtacgcaatgactaaaataaaatcagttatagttctgctaattacttagatttcgctagtgtattcgcggacgagaattgggtatcaaatggggtattgttagtttacgacttgatttcgatgcggaactcgtcttataccatcnctatttactcctagtctggttcgataactaagtcgaatatacaagtgtgttatactaatatataattaataattacctctatgatcaacagcaacctttacgtgctctggtcgttgtggatgttgaactgcgctgacattttattgatgtgtggatagttctcgcttgctaatccacctccggttgttataatggagttataatgctatctatattaaacaatattttatataacttaataaattaatatagtgataataagaatttagttacacctagatatactcttatcgtctcgctggtgggtaagcggcctacgaccccaagcgtctttagccggtttagcgaaagaagtcgtgttgcgcgttggataggaggagagtcaaacgatataagtaacgactcatcagagagtttgtcattgcactatattagcttctgttacaatatatatttcaatacattattcttttacattatggttttcgatgcaggtgtcatccgtgccaattaatcttagtcctttatcgaacgtcgaggtggccacagtctttgagtacacactctggtcttgatgtaggtaaaatggaaaggttgaaatctaatcctccttgattatatggaatggaaaaatgttctaaatgagttcatttgctctcaaaaaaaaaaaaaaaaa

SEQ ID NO: 11988 - DNA, 469 bp, Homo sapiens
cttcaggaattccatggaacttgatgaagtaattctgaaatgtattaagaagaacaaaggaaaggaaaagattatactctctgtggtaaggggggtgacttgaaaggaagaaaggaagcgtcatgaaactgttaaaactttatgccctagcaattcctctctagagtttactaactaaagagaattgtacagaggagaacacggagacgttaaaaaatgtctgtactgctattgttgataagggtgagggacacacccatatgttctctctcaggagaatggttaataataactgatatacacatgatatgaaagaatcactgtaatgaaaagtaatggcttataactgtatgcattaatatgaatacatccttaaaatataatattgactttaaaaaagcaacttggagaatagtacattagaacaactggtaaataaagcagaaactactatccaaaaaaaaaaaaa

SEQ ID NO: 11989 - DNA, 816 bp, Homo sapiens
  misc_feature (1)...(816): n = A,T,C or G
gactctgagaagatctgacagagcagatgaactgatcgctagagagcgcnatcgctaaccgaacgcatcagcggtgacgtatcgctcgactgcggagtccacgacactgacccncagtcactctactgtgncgcctctagctcncnctctcntcgtacgtagtatgtactcgctcccanagncgcgcgcngtccgattctgnatgagtagtgtgctgcgcgtanctagcgatcaggcgacgctgtccncgcacccatcancatactacgctgacatacgactattagnancnataactcgaacacgctcgatgttgagatatatcgcgtcgcccacatacatcagcgcacaagtgttatcctccggtctacgacggctctcgccctctcaagcgcagtcaccacgagtattcaggtctcgtgcgacgcagacgacaagtacagtgagctgagcagcngtagacgagcgtacaattgaactagaagtatgagcgtccgagatagtggagnaggacganggactacgtcgctgtgctggatangtgcgatacgccncacacatggtccgcaaccatagctacaatctgagctactacacgtctcggtctactctcacgcacgtgctcancgtatcactcgtctcgtgtccnacgccgcgcgccctgtcatcggcgtctctgtctcatacanactagacacagtcacgagtgtcagctacatcgagcnctacctcncgagnatagtngcgcgatacagacgntgnactattagtaagctcgtaatncnncagtgaacgagcgtcgctagctgcgcactg

SEQ ID NO: 11990 - DNA, 609 bp, Homo sapiens
  misc_feature (1)...(609): n = A,T,C or G
atactagtgcgagatggttattgttgtcggtgatggtgtcgacggctggaggcgcgcgcgcgcgtggaggacaggtagcgtagtaggtctaactatgatcatataactagctgtgtcttcgcgtctatttcggtattgtatattaataccaaccatcctagttttccaacgcagtagaaagtactcagatagcgctagtaagttgcgactcccggtctggaggaacgaagacaagagagtcagtgaaaataatttcgcgcgtggatttagtacgtgtatcttgttatgtttcgtgtttaagcttattgctcgtgtccagcatccttgtcatttacgcgtgatctaatatttgtcacgagaacactacgacgtgctcgcttcatacttgcgtcgtcactacgtcaagaggagatatcagntagcgttcntagcatgtgtattgtatcattactcctctctgcctgcctattcgtaatgtcgcgttcctcgcgcacgttgaccacacactacgcatgatgatttctgctagatagctctgtgttatattcgaacgagactcgtcagcttagataatgacttgaacatgctacncgagtctgagtgatttat

SEQ ID NO: 11991 - DNA, 1293 bp, Homo sapiens
  misc_feature (1)...(1293): n = A,T,C or G
atctcgtagtcggcgacatttaataatattnnnntcctcacgcggaatcgtgagtactgtcataggcaccacatcacaaagtntgactctaaatacttatgctagagtggtatctcgagaaacgcctgtacttctggcgctcgactcgggagatgagtgngactggtgggagagtngnntacgcgagtattatttagtaatgtatatgagtgtnnacgccacatacgctgaggtntcatgcagatcttaagaatggtagaagatagacacataaatatatnnacttctgtatgaataagactagaatgccctcatgttcgcgaggtccagcacgtagggcatgtatgagctggagcagacgtggatatcatannngctagttcgtagatagncgcactacatgnggtggaannnacgcacaaagcgaataccccatgagcactcgattacatgtaagatagggcggtgagaagagatcacganancgtgaggggtcacagactaaaaataagagccaaggataaaagccggatgggataggtgatggnnaggagagtgcggagagcagactgagtagtagagagcgaatgggngacatgtaggtgagatcgaacgtgtgtataattaaaaaatataatctagagcgcagacgccataatagacgaggacgcaatgaggcgtgancgcttgactcaacacaagcgggacgtacagtagcacgcggtgagaagaatgaggtgtttnnaatatttagattatattagacattgggtttgcaactagcggccttattgcgataatgtcatgaataatgnaactacaganacactatagaataaccattacgaatagaaagtgataggagaatcagtannaggctctatatgtgagaacatataggagactgagaggagtctagggatgagagaagaccgcaacctaggagaagacacactaatacgctgagttgtnagcacggtngagtgtgtgcatagacggagaggtggacagacgccaggtggctcatgtagagatatgagccgtgaaatggcgacagaaaaacgacatgctagtggccacgggnnagagctactggtaatcataacgtgntgcacgctcgnnggcgtgtgagtnggtgtttacactatancctcgtcctacatacaaactatgtggattttactcctgggngtatgggtggcgtgcgagatcgtnatagagccagacagtataagcgacactanganaaattgtaagntgaaccagtgtctggtaacagacagctggtaacca

SEQ ID NO: 11992 - DNA, 293 bp, Homo sapiens
  misc_feature (1)...(293): n = A,T,C or G
tatgtataaccctacgtaacgtgaggaaacacccactcttacgaacctganatgagtaaaagagcaacataggcaacatacgtgaacctgcaaaattgtccatgggtaattactctttccctaaggagagattaacgcatactcagtcacgcctgctgaaagatgccatcaattctgtcataagaagctaaaattctcaaagccaatgtatattatttacagtttcttttacttggttgtgcttaaatgtgtattttattgcatatacatttcgggctgtaaaaaaaaaaaaa

SEQ ID NO: 11993 - DNA, 295 bp, Homo sapiens
tttgcccccgtcgttcagcgccaccaaacccaccctttagttaaacactgacatgcattataaagatgctgaataggcaacatacgtgaacctgccaaagaattaccacaatcagtaattgtatatttccctaaggagagattaacgcatactcagtcacgcctgctgaaagatgccatcaattctgccataagaagctaaaattctcaaagccaatgtatattatttacagttccttttacttggttgtgcttaaatgtgtaataaattgcatatacattgaaaaaaaaaaaaa

SEQ ID NO: 11994 - DNA, 847 bp, Homo sapiens
  misc_feature (1)...(847): n = A,T,C or G
tatcccgccaacgccgcacacaaaccacacgaccaaccaacaaaacncacgngcctcagttagganaaaactaatcgaccctcgcaccccttcgagctggnactaaaaacaaagactatagcgtcgcgtagatcactggcgatcatcgacgcatcatatccttctatatacagcatagtgtgggtatgatgttggaacagcctatcgaacatgctgcgggtacttcgtcctaaggaaatcacagcgcccactgatcttataggtaaaaaatacaagtcaaacgattagagcggacactccgaatgcaccaacacaaaatgcacaaagaaacaaagccgcccccccccccacccactcagtacaacgaagttgtttttagtttatcccccgagggcgtggcgaactcactcgccgcccgtctccagctctatgtacagcaccgccgcgcccctagccgccctgacaacaacatcagtcatagtctgctctacgtcagccagcggttctatgcctaccccccacaccctcgatagacaagagccgacccaccacctagtgcgcatacttaacaccgcagcgtcggcacagcaacgcgttcctctacaccgtcgctgtaaggtcttctcgcagcattgatcaaaacgccaaacgagacagactcctcatatactgcagcgccgcaactcctgcatagctaacagagtgcgattataatccagtagtaggctgagatatcccctccaccttctcctacacctcactcacacctaacaacacacaccaaatcaaatctaccactcgtaccacacctacccagtgcttaccccgccatcccaacacccaacct

SEQ ID NO: 11995 - DNA, 1019 bp, Homo sapiens
  misc_feature (1)...(1019): n = A,T,C or G
ttgtgtattgtttgtgtgttgtgtgtgtctagtgtgccgcgtcccgcccgcgccgtggtgcggggccaccctccctccggggcgccctggggtcgcccgcttcgtggtgggccctcggggtgcccgtggnctcgctctgttgtgggtcgttgtgggccttggttccgcccgtgggcctgggcccttctcgtgggttcgtggcgcgccggcactcggtcgatggctgngctctctctggtcccttcgctcctggatgcttgcgccgccggcggtncgccctagggctgggtcncctatcgccggttctctggggcctnctcgtcctgcttgcgctctacacgtctctcttccgccgcctggtnggggggtgcgttcccccgcccgcccangtanaccttctagccgttggttttaagccctatgtgacccgcggccgtctctcgcgcgttcgcagttcgcgagcctgcgcggccggtcgtgagtggagcgtcctcgggcgccctgtggggcggcctccgggggcgtggaccctccggtggaaccctcgggttgacgctttctgttgcactcgggcgcggggcgaccttgtgnacccttctttgttcatctgggccctgtttcgtgtctctgcatnagggcgtcncggccctcttcatctctccttctccaaaaaaaaaatnttntctcctctctctccttcctctcttcctcccctcccgctccctcnncctcgcctcttgcttncgcgccgtctcccttnttctcgtgtcgtgttgttctcctttccctccccccgcttnccctttccttctcccccctttcgcctggctcccccgttcgccctttctcttctctctttctcccctctccccttnncctnccccccccctctcttcttcctttctttctctctttgggttttcctcttttaaanncctccncctctgttcccccncaacnnntctttctttctttcctcccttttcctctccctccctcttttttctcctcctttctct

SEQ ID NO: 11996 - DNA, 112 bp, Homo sapiens
tggtactttgcatatgagatatattttattaagatgttgttatatttgaaagctatgtcatctcggtattgtctaagaaatacagttcacgatttatggaaaaaaaaaaaaa

SEQ ID NO: 11997 - DNA, 658 bp, Homo sapiens
  misc_feature (1)...(658): n = A,T,C or G
tcatcaccacacaatcggccacggccccgggccctcngcacaccagcacacacttctgacctttctgtcatgtgaggctgcaatgagaagatggccatctatgaggaagtgatgggtcaccgaacaccaaatctgctgacaccttgatcttggacttcccagtcaccagactatgagaaatagattgttgtaatttataagctgcccaatttatcggagcagccctcccgaaccggactaagactagtgcgatatctcatgcgcgcctctcttagaagggggcgtgaccagccttgcggcgacagccatccccacactataccaaacaacaccacgtctgagaatattgtatgcaaggcctcatctgccggagcctccgccgggcgagctagagcgcccgagcgccgctgtgctctgccctccctccacgtcttggccgtcccaccgcctcgacacgtggtggtacccccatgttgcgcctaccacgcccccatacatccctgcgtccacgtcctcgacagtacccagaggaggttccccggtagccgctcgctctccagcatccgcagtaccctcccctcggcccgttggcggcggtccatagccgcccttcaccatgcaacgctggtgttccccccctgcccgccacacactgcag

SEQ ID NO: 11998 - DNA, 151 bp, Homo sapiens
  misc_feature (1)...(151): n = A,T,C or G
acccccccccccctcccctcccaccaccccttcaggaaacaagtatatgcagtacttacaatcacantgctcctgtgatgattcataatcattttttaaatggcacattaaaatgtatttggcagttgggaaaaaaaaaaacaaaaacaaa

SEQ ID NO: 11999 - DNA, 436 bp, Homo sapiens
  misc_feature (1)...(436): n = A,T,C or G
ctagagaacggtcttgctatgttccccagttggagtactgctgggctcaagcaatcctcccacttcagcctcccaagtagcggagagggcggatggagtttctctcttgccatctacgctggaggccagtagcacgatcttggctcactacaagctccacctcccaagttcaagcaattctcctacctcagcctcctgagtagctgggattacaggtgcctgccaccatgcctcgctgatgtnggtattttttagtagagacaagggttcaccatgttggccaggctggtcttgaactcctgacctcaagtggtccaccctccttgggctcccaaagtgctgggattacaggcgtgagccaccatgcccaggcgttaaaagtataaactataaattaataaattaaaaacacaaaacactaagaaaaaaaaaaaaa

SEQ ID NO: 12000 - DNA, 659 bp, Homo sapiens
cggggcgccggtgcccggatgagccgtagcgccggctccagatacacgtcccatcaagctacagatggtcttacaaaaagaaccccaaatgagctcaactaacaacttctgccaaggaccggtggactgacctgctggccctttcactggcctaaagagttcccttttggaggacactactactgcagggccccttcttcgcccctatccagcaggaagtagctagaacagtcattgcccaattcccaacagcagttggggtgtcctgtttacagggggcggtgagaggtgaacctggctgggcttctgggtcagatggggacttggagaacttttctgtctagctagaggattgtaaatgcaccaatcagtgctctgtgtctagctaaagggttggaacgcaccagtaagcactctggtaaaatggcccaatcatctctctgtaacaggaccactcagctctctgtaaaagggaccaatcagctctctggtaaaacggatgaggcggccggaatgcggatggggccaaacaacaacatacaagctgggtgcccgagccaccagcgggcaacccggctgggggccccttcccaactgggggagcgtctgggctttcgctttacacagtaaattcttgctggtgcttaaaaaaaaaaaaa

SEQ ID NO: 12001 - DNA, 904 bp, Homo sapiens
cgcgccggaagcgatgggggggggggggggtttcaggatctaccactctcttagaagatctgctgaagtattccctgagacgaaaaccaaccagtttctccagaagtggggtggggggcagtatgtcacaggctgttccccttgtagtctatgagcctgtggaatcacattcaggaaaacacctacccatatattcccatttagaagaacatgtaagattcttgaattaactgctgcaatttgagcttgactatgactagaaaaagggggggggataatttcttcatctaccacataacctactactagcaatatatttctggcatggcttcttgaagtggcaacagtgattgagccaaacgaagactgtggggaacattttccatattgcgtatgcaatcgtcaatttgccgtggatatgccacatctgaatggagggatgatattgactggattggagaggcaaggaggggtgtgcctcggtatcgctggaaagtagagtggtggtggaggggcgacaatttgagagcgcaagagggagaggtgtgtggcggggtgggggtggggagagggggggccggggcggggagaggccgacactgcgggagggggacgggggaccagaagccggcctgccggactgaggaagcacgaggcctctgggtaatgggtagtatcgaggggggcggcgcgcgcagcggtgtagagacactcgacgagttttatgggggggctattttgtcgcggtcaccagaacgcgctggccgcgcgcgggccgggcgcgggcacgggagctgggcagggggaagggtgccgagtgggtgggcccacccggtttggtggcgaggagcctaggggcgtacaggatagcgccacttgacgatagaggcagcagcgcccgccg

SEQ ID NO: 12002 - DNA, 933 bp, Homo sapiens
  misc_feature (1)...(933): n = A,T,C or G
gctgccaagacacnagaattagggagaagccgcggtcaggactaccctactcagaatccttcgggccatcccagcactgctcccgctcaaacaacatggcatcagtgaagacaggatgggtagctctgtttattctggaagattccttcaaatatagtcacttgtgagtcaaccacacctgtttaggaaaacatgacgcagcctcatgctctatcgtgacactcctgagtgcatgactaaatgacctcggaaccgctccttcaaaaaaaagaaacaaagggggctcctcgcccccgccggtggacctatgcggacgattccttacagcgggggcgtactcatgatcctccctcactgcctcggtccgctgggtcgtttttatgtggtgagcggtttccctcacgtcaccggcggtctactgtgttctcccaacccggcgattccgcacgagagacttcggggggaagggccggggaacggccgggccccgggagagggccccttctctatntttttttcctcggctccacccccctttaataccccaccgcacggcgaccctaagactctgctcgctcaacgccccaggactgtgcgatcccgcgcgggttttcttacaaagtctccnnagcggtcactggtgggaccggggcggatacccgaaccttcaatgcctattccctcctgaactgtgggccctgcaacacctcaccttgcgtctttcatcatgtggtagtctttgccgaatttggacgacccctctaattcatgtctccccaccaccgccccgcacgtctactgcgtgccaccaccgcatgacccgacatatccaagaccccctcatgataatatgacttcgcaggctattgggaggtagggacatgtaaagagcacaatccagagcaggcacaagcttgggaagggaggtacgcg

SEQ ID NO: 12003 - DNA, 1401 bp, Homo sapiens
  misc_feature (1)...(1401): n = A,T,C or G
ttctgtgcgccgctccgcgtgtatctggtatgtcgtttgtctgtgtctctctgtctcgtctgccgtgcactgctgtggcgcgccgcgccgtgtgcgcccccggcgtcgtgtcgcagncgcgcgccgctggggcgagggcgcacgcggccgccgcctgtctctctcagcgggttctctcctcttcgtgcactctcccgtgcgcctcccgcgtgctggtcctcttcgtgtggttgccgctgcctgttgcggtgcgtgttggcttgggtggcgggtggtcgtctgcgcgcacgtcaccgttctgcgcgcgccttctggcgcgccgcgcgctggccgcgacgttgctgctggcgctcgcgctcgctgcgcctctgtctgccgtcctcgccccgccgcgccgtccgtcggcgccctcgtccgcgcgccccctttcgttccgcctcttgtcgcgcgncgctcgtgcgntactntgcgcgcgtgcgcgtgtcgccngccttggtgtcctctctgtctcgcngttgctgtcgtcacgtcggtgctctcttcctgctcggcgtgcgcctcgtcgccgctcttccgcgcgtccttccgcggttgtcgctgcgcctccgtgtggcgcgcgtcatgtctgtgtcgtgtcgtcctgtccgctgccttcgatggctgcgctcatagtgtctctccctcgcgctcgtccccttgcggcgccgttccgcgtgtgcgtctcgcgtctgctgtgcacgttncgcgtctctgcctgcgcgtctgcccgctccccgcgtgctgtgatgcggccggttgctggtcgcgtgtgcctctcgcccgcgggttttgtgttcgttgttctgtgcgcggctcgacgggcgcccgcggtcgcggctcgcccggcgcgtcgcctcactccgcgctcggcttcctttgcgcggtcgcctcgtcggcttctctccttgcggcgtgtcggtggtgggtcgcgcctctngctgcgctgttctaccaccatctgtcgtgtgtgctcgcgtgcgcgtttcntcgttccgcgtccctcgtcgcctgcgctcctgcccgcgtgggtcgtttggttctccgtttcttcggtccggtctgtgtgtgtcgcggcgccgccgtgccgtcttcgcgcgctggtttcgccgcgcgtccgtccgtcctctgtccccccgccccgcgtctgcgctccggctcgcgcgcgggcgcgcgcgcggggtgtcgtctgcggggctctgcgccgatatctgtgtcggttggtgctgccgcgcgggctggcgtcttgttgtgttttttccccccccctcaaccntctggggtcctcgtctcgcgcccccaccnggggtcgcccttccctttgccgcctctgtcggctgtcccccttcccgcggtcgccggcgg

SEQ ID NO: 12004 - DNA, 909 bp, Homo sapiens
ccccccccccccacgaaatgaataaacgcttaggtgtacacatgcctccatgtctggcttacctgcagcctgtctaacccccaagagatgcatctgagacagcgtcataacgcgtgtgcttccaaaccaccatcgctaaaggcacagtcctgagggaaatgaatcatcgccttggaaatttgcaacctatgggctgaattcagctcacagaagtgttttttccacagggtgttttgctttgatttttaaacttgaattagatgcctatataaaggagcgggatattgaatctaaaaatccaaatttctaaatctaaaaatccaaatttctaacttctcctgaaaagtagattgctccagcagttctggcctgtgtttctattggatgctcctacactgttcaacaaaagttctcacaataaaatttggtatttacattcagcggccccacccctccggtcgggcgggcgcggtggcgcgcaggcagagcgggggtccctagcaaaacattctcatgggcctctcgtggccctaggggggagctcttgggggcgttttctttgggggggggcaatcctggcgccttttcacatgaccgatgcctcaggtttttgtctggtgcaggggttacctcccacaagcggcctatcccctcttcccaaattgggggattccccaaaaaaaacctttcacctaggcccccaaaggcgccgacaaccccaagggcggttggtcggcttctttttaaggcacccctccctggacttatcaaagaacctcccctcatccagcggcatacacccatagaactttaatctcccgttttcctttttatcccctcccgccctctttcccccctcgtatacaaaacggcgcccttcgctctggacgggggtgtcatagctcccgt

SEQ ID NO: 12005 - DNA, 946 bp, Homo sapiens
  misc_feature (1)...(946): n = A,T,C or G
cggccagcgccggcccggggccgagagagcccgcttgagtattaacacagaaaacccttgatcagaaaggaagactaagagaaaaagggagaaaagatctacaaaacaactangaagggggtagcggaatggcagtagtaatcccttacctatcaataattaccatgaatgtaaatggattaaattctccagttaaaagacagactggctgaacggattaaaaaacatgacctaactaaagatggccattgaacaatatgagtttgagctgcaggaggggggtgtcatgcagattttcttccacctgtggcaatcctaggtagcaagaccaggcctttctcgtcctctacctcagactgctagatgtgaagaccacgaggatgaaggcctttgtgcgatgatcacttccactcgataaacactaacactgtccaactgccttatgatggccgtggatacattctctgtctagggtgctttattggaaaaagtgtgggttatacatccagcctacccaaactaaaggacactggacctccttggctccaccggggaggttatgaggacgtttgcttctagggagggtgaaggcaggatcctcgtaagttgactccttgggatggctcctcttttaatcgaaacgggagcagctcactcacagggcgcataacggtccccaccgaaccgcggggttacgccctgaaaaaacctttcgcgaaaagggcgcagaacgcccgccaccgctataagcgccggcgccccggtgtttcatggggggacccgcggtgggatgatgcatagcggctcgcgcggcgagggggggaacaccgcgaagcgattatcagccccgcgtatactccccaccgccccgcgccattttccgcccccctctcataaagagagacgggccagcgcaccttagaggcagcggcttgcgtgccaccct

SEQ ID NO: 12006 - DNA, 328 bp, Homo sapiens
  misc_feature (1)...(328): n = A,T,C or G
tttcagggacactggnnatggagttgtaagccatcatcctcagcaaactaacacgtgaacagaaaaccaaataccacatgttctcacttataagtgagggctgaaggatgagaacacatcgacatatgcagggggaaacacatactgggcacctctggaggggggtgattggaggagggagatcaataggaacgatagctaatggaagctgggatgatctgtgcagtaaatgcatagcacacaggggggcgtgtaacaaacctgcccatcctgcgcatgtacccctgaacttaaaataaaagttgaaaaaaagctaaaaaaaaaaaaa

SEQ ID NO: 12007 - DNA, 1405 bp, Homo sapiens
  misc_feature (1)...(1405): n = A,T,C or G
cgatccgctacaataccaagagaaccacgcaacacacaaccttacagggtaacctccatgctccagcgctatcacctgcgaaacccccgcgcatcccctaatatgccttcgcgtatgtcgcagactcacnacacattcgcatacagtcgcatgaggtgcggtcgcggcgtcgtgatctactgctgtagtgaatataggaatctcgcacccngatacgcatcacctgcagatatatagtagctcgtcgcatctcacgtcatatcactataagantgatcgggcacgaagacacatcgtacgattacacggcgtgtgactgcaacgcgcaatgcttcgcatcccactacgcacacngcacncacgtacatacgatatgtgcaaaactcgcttctcatcacgctttatagttctatgcactgaggaggtgnagagatcagcgtacctcctcacgatgatgtgttggacaaatgtggaagtaagtctacacttgagcaaccgtctaccggcgacgccgagtganctctcacgcagttacctgattctaacacgccncgcacgcgccgctccctcgccgcgttcagccgattcataattccgcgacatgcacccggcagtggcgcggcgtgatccggtacgaggccgtgggcagagtgaggattctcncacaacatctcaccacccctgttcccgcgggtcacgcagcaatccaccacgtaacaggagaagaggcnacaaccgtagtgccngtagagtgagaagagcgtgctntgcccacccaggtgtcccccactctccccatattcccgtccatcnacaccactagatatcacagctcacaacgccgttcacagactggatgggagtatcctgcctcacccagcctcacagcgcacggcgcccccacaccatcacgaggagctcgccttnacncgtatagactactctcacctagccccgaggtgagtggcgagcgngtgacgagggagcgggtgaggcccgatctcagactccagacttctaacgacgagcgtcggcgctcacagctacatctcacctccctcttactaccacccgctttctatcactgacataacatcntcgtactaccgtagagtaacgacgcacccgcgcttatctaaggggccgtcttgaatagtcgctcactaatctagccgatcagtcgcggngaacacgcttgtgactacacaaacgaatcgccacgacacacacaccacacttcacacctcctgcatctctgcacgcgatattatatcacanacnccnccccacccgcgcnntgtnatgtaatatancaatactacccctntaccgagcntgctctaagcgntcgcaggcgctctaccggtatcggaactcgcgacggcacacaagcgccncgagcgag

SEQ ID NO: 12008 - DNA, 1310 bp, Homo sapiens
  misc_feature (1)...(1310): n = A,T,C or G
ccgctcgngtctctctccgcgcggcgcgcgcgatgcgtgcgccctgtgcgcgtcgtctggtgcgcgcgtgtgctgcgtgctgcgcgcgctcggacgctctcactcgtcggatcggtccgcgtgtcgcgcgctgtccgcgcgtcgtcgtctgtcgctcgcngnctcctatnctancacgctctcgctctcattctctctgcactgttctnngtcgcgcgccggtcaggtcgngcgccacngntgntgngcgctgcgtgcgtgtgtngcnggagacgcgtgctgtcctgtcgcctcgactgcttgctgcgtcgtcgtgtcggtcgtctgcgcgtgcgtctctctctntcggcctngcgctgcgctgcgacacggctgctagtgtgtgagtgctcgctagtgccctcaacnactcgtcctgccgacgagcctacggctccttcctcggtnnctccttcactcgtctcgctgtttgtcgtgctctccgtctgtgcggcaggatgcggactggatcgnatggtgctgtagctgcgcgtcgtcntgctccggtcgctgcggtcgcgtgcggtggtcgcctctgtcgcgncnttggcgccggcgcgtgctgcgcgcggctcggagccgccgccgcgccgtgctacnccgnaacggcncccctctgtcctcctggcgtgccggtgctgtgtgcctgtgcgtcgcgggtgtcgtcgtgtgtgtgagtgatcgcctctatgttttgctcattctccggtctcctccgggttctgcgcggtgtcgctgcgctccctcgggggtggccgccccggggcccgcgacgccctctttgctgggttttgtgttgccgtctcgctgctgtggccctcgttgtcgtgcgtcgggctcccgtcgtccgcgcccgcgcgtgcgcccatcccgctgtgccccggccggtggccttgtgcgcgcccgcgggggccggtcggtcttcaaaaaaaaaatttttctctttttcgttgctctctgtggtgggggtgggggtggggcgggcggccnncctncccccctccccnnccccttctccctttttctttnctctttccttctttcttcttntcttctttctccccccttcctcccccccctcccctccccccttnccctcctcccctccccccttcccccccccncaccccccctctcttccctccctccccctcccctctccnntggtcgcgcccctcccagnngggtgnncngggttccccncncaggnagnncccncttnttttttttcttctgttttttctttctccccntcttttntttcctcctcc

SEQ ID NO: 12009 - DNA, 881 bp, Homo sapiens
  misc_feature (1)...(881): n = A,T,C or G
gggaggtgctcaggcttgaaacgttcctcggtaagcagaaggagaatggtccttagccgaggcctcacagcataggggggggggcgcagactctaacatctatcagacctgatttgaattccagctccactgctcccaagctatccacagagagcatgtttcttcacattcctaagttccatttttcctgctgtagaattgggtaacaatagtgccctcctgtgaagatttagaagggggaagtgaattttggatgtaaagtgtttcactcagtgccttgagcatagtcataagaaactgccaccctgagctcaatcttaaaatcctcaacaaagcaacacggtttgtactgctgtgttgtaaggggcagaggggagtgcaagtgaatcacaacaaccttgcaaanaatctgcttctgctcctgcgagataggacacaccaggagcatatcttacggggacaaggtgctccacgtatcttgggcctaaattgctattactcttcctctcaccccctgtgatgaaccgtgggtgcttaggggctcagctgggagtttcagcggtggccaaactaaccttctaggtactggaattactataactcggattgtttttaaatacatataattttgccgaggccactaattgtcttttagtaaaataagggctaaaccaaagagaaaaaaaaaacaggggcccgtgggccccggggggagctttgggcgcgcttccttaagggagggtactggtgaggctgcgactggctgcgggcgctggaggtggctgggggggggttcacgctccgcggggggaatagcggttcgcggaccggggagagccaggaaagcgcggggcagggcacaaaggccgaaccggtaaagg

SEQ ID NO: 12010 - DNA, 213 bp, Homo sapiens
gtttaaggaatttcaatggacttatcttcaagttcaccaattcttttctcagctgagtctactctgctaatataaccattgaggtcattcttcattgctgatatggtatagatattttcaacttagcatggactgagatcactcaatcacctgtatttacatggctgctgtactgaaaagtctaataaagctttactgataaaaaaaaaaaaa

SEQ ID NO: 12011 - DNA, 481 bp, Homo sapiens
  misc_feature (1)...(481): n = A,T,C or G
atantccnggggttgtccncnccctttagantagnggngantttttgtgaacatccgngaggngggggngnacctctataaanaaaaatnccagaacaaagggggccttttttttagagntttcngnggcccttntntngnggngcccatttttgggctncccaaantgtttntntttcccgaggngtantancccccacnanaatttttatatggngaaaataanccggatanttcnccccgccccttttttagaggnnaggctataaanatancaggctnttacccngcgaaanctaganaaggaacccaganggcnacaagccaagttcanntaaagccagagggaaagngggnaanangncggnccnaaatntcgnnaaagnnccngcctttcttnnnncnggaggagnttnggnccagatttcnantataattgccagcttgngngaaaaggggnattgtnattgnatagngcnnt

SEQ ID NO: 12012 - DNA, 1153 bp, Homo sapiens
cgataaaaccccgccacccccacgtggccctcagactaattattatcctgtctctttgcgcagatctattcgccaatatactatattcatagcccctctcatgcctcgtcccacgttgcgatgttccatggggcaagccatctattcaagtcataccggtcatgtgagtaacgatcgccggcgtaactaagtaatgcgatccggtgttattaggtcgttaatgcagcgaagagaagtgtatacgcgtggccgcggtcatgagtacagaaagtgcggatcagtatgtgtgaggtgtatttagcgtacgggcgccaatgacgcagggtggtacgcgatgcgaacgcagccgccggaccccgttcgttctatctattatatgctgcgacactcctcccgccgcggttttgaccctcaacatttacattgtcgttgacactctacggcaatcaggcggcgacgatgtagtgacgcgcacctagcctacgttgtggcggtgtgtgtttgtgatgacaccacgggctgcactagagagggtttactattgtgtccgcccgctagaagcggcccgtgccggctacgtatatggcggcgaagcgcgccacgtgcacgatgctacccacctcttccccggtgcccaagagtgttagatgtttgattttcgctgctccggtaatatgtatgacgccgggactctgagagcctaaaattcactcacctacctagtgttattgcctatcccggccccgcacgtacctcctactgcttcgtcccatcacaactgttcgtcccccatttgagggcactctatcccctcagccgtcacgttatatagtcgcgctgtttgccttagctttgtgttccgctatctcccgctttctcgatgttgtcctgccgcgttggctcgaataatcgtataggatgcattatattcggagctaactgcttgtgttgagttgttccccgtcagaaatgctccgtgtgtttggcgtcttcccgtacgtgtttactgtcatcctcacaaagccgttatgttacgtaggaatccactatatgcttaggtgtgtctacgtgtctccggcgaggatgttatagtgacccgtcctggcacgcctgctggctgtactgaactatgactcccgttatagcgctcctg

SEQ ID NO: 12013 - DNA, 594 bp, Homo sapiens
agacgaggggcctcgctatcttggccaggcgcgttatagtctccaggcctaaagccatcatgctattcgaattcccaagggtgataggatgaccatagtttgacaagcgtagagaatgtactgattcactgcagtaggttggttcctttaacacgtccttgacggcggtttgtgaaggaatgctttgggtattaagggtgactaccacatatcacttgtgggtttagtggtcgtggaggggtgtaaggaaagttggattatcgtcacgtccaattgcggtctattataaagggggggtatggacatcggtatatggtatgaacgttgtgcgctcgccggttcgagaagaatctgtgtgtgtcaggtgcggtgaggagggagaggtctgagctatatgtgagggttaaggttatgaagtagaccggggtttggatgagttaagatggtagacccgttgctaggtggttgtacgacgtgatgaacgcaggtgaacgtcactagggcactaatcgacatcatgttcacgtggttgatggttccgtgcgggtggttaaggacttattcacttatctttatttaaatctcatacacatt

SEQ ID NO: 12014 - DNA, 896 bp, Homo sapiens
  misc_feature (1)...(896): n = A,T,C or G
ggatacacnatagagtgntanncagagatagtgagagngacattataatagtatananancaaattnnttatagtttagaantagtattaanattatattnannattaatatatgtcattanacnacattaanatgtngatttatacgaggaaganagnagtgatganatagngnatanangaatttatanaaggnatntnacgaagagacatgntcaanngagntgtnataaagacangaanataatanacnttaatagtganganacntanttagatanagtnaaanagaaatganaagaatgaaganatatnncaangtanangaagatcgtaagacanannggaattangtnnacnnagntanggnatgataaangtanagagaaaagatatganananaatgnanaangncananaannagaaaaaggaataaanaagagaaanaaaaagatannnnaggagtnnntaattaaatnaaaaagnataggnataanaaagagnnanaanganatgannataannannaanaagaacnaantcanaaatgatncgcnagtaatattaattgatgccggntagctagaagangaggggcctcagcntatcttgtccaggcagngtntcaaactcctggcctcaagccancctgctcatccagcctcccntagtagctggaattacagataattgaagaatcagttccanagagatctcctggagggccnaggatcacagnncaaagctagaaaccgcagctgtctcggaggacgaaactccaagctcttcacccanagatagtcgtgggctggtggcttcagggcccactagggcctttgntatgagttttctcttcccagcggtccttttattgcataancaanaaacncggat

SEQ ID NO: 12015 - DNA, 725 bp, Homo sapiens
  misc_feature (1)...(725): n = A,T,C or G
aaanatttngtgggancnntttttttcccatccgtgnntnaaaacccgnncantttntnanaccccccnanaaggnatattgggggcccgcccccccccgggggggggggggtataaaantttaanggcnaaaagggccccttacccaanttaattttncaaanggnaannngttttttntaaanaaaaaattaanaanannaangngnangtnntntttnttanttcacccccccacaaaaagattgnntgancgtggggncccaagaanaanggggnaaaaaaaggnnncctttttttttaaaanaaggtgntcccccnntaanaaagggccctcagnnaagtaaaanacnnccagggnctnggggaancncanccngaagccccgcatnaagaagacncctnnctttnttggganntttcctgaaannacntngnttnaanagcanatcgggtnatnctttttntcaacaaaacgganatnttggaggagaaaatccccccctcccacctggcnacctatttccccngtttccagggtaagcagttnnaganctttnaatacccttcaactntcaaaagcagctccgaagagagatgntaatccagcntcnacttcagcctggagtcaccggaactttcacataggatcagacccgcgttctagactcagctccatccactgcccgacctcattgaatctgttttcccttctgtggaatgga

SEQ ID NO: 12016 - DNA, 1408 bp, Homo sapiens
  misc_feature (1)...(1408): n = A,T,C or G
ggcggtgggggtcactacgggagccggcagggagatagcacgagaatgagagacataagcaaggcttacagttggcggcgactagcaatcatgataatacatttaaagaggacacgcgagagctagactaccgactctgacataaacgatccggcgagaaggcagacatggcatagataagaacagacgacaatgctaacgacaacgtcgcgccagacttgtaatatatagggagcgctcgaaccgcgacccatcgattgtcgacactctcacaccccagtccgcgactctagagagggacggatggagcagctaagaacatagcacgatcagtataccacgccgcgtgtagatatgagaccgcgcgccgggtggttaacgcaccgagggacgatagatcgaagagtggtgtcgagtataattctttcctcccactagccatgctcccgccgattaccgcgccatcgatataattacaaatatgcgatcgcacgatactgcacgctacgcgctagtccgacttgtcgtctcccgtagtccagaaacacgtcgactnataggcaggaccggacgcggagtcttgtgtaacgaagaaggtgagcgtagctncgacaatataatatctatatcagataaagagtagtccgcatccgcgtatgagntacaagaaacactgacgcgaatactatttgaagtagcacctggtcgtacgcacgcgtagcctacgcgatagacattccaccgccatatcgccgccagtagggccgggaaggctaaggaagaaacgatatatgtgagctcccgcatgtaataggagatgcttgngcgacaaatgaatgatcgtactggaagtgatgatgacgaccgtcgtgcggtacagtagaagagagcatgtagcaccgaaacggnctcagagtctatgagtagaacatacgctatcgcaactactgacacacgaaccgacgcatattatctcagataccgagacggcgcaccgcatctcgaaaagaatcatctcgccagtntgaggaagcagcgtgctttccacggngatacccgccgatcgtcagctgatagttgcgggtgcggccaccccngctcagttagtataactgcgacactattcgtatatggcagacgtgcgcggtgaaccgcttaaacgacaattatctaatagataatctgaacacngcagcaaggagggatttcccgacgnctaacgtacgcattgcagcccgcatacagtgcccgcagataggagtgatagctaaagcgatgactacaatgacacacggacaaacggccaccactccgcagcgaggcgaaggagtattagatactgcgggctgcgccaggtagacaagtcgatgttacgcgagagctgctcggtagtcgtgtgcatagcgcg

SEQ ID NO: 12017 - DNA, 654 bp, Homo sapiens
  misc_feature (1)...(654): n = A,T,C or G
agaggcagagcattctggagaccaacacttcctgggcggcgctcagagtgggtgactctgcagagagcacctgccaggtgtgatctcggactcagagttcaatctgcatttagctgacaatgaactgcaaactctgaaaatgttcacagccatggagaataatctagaaatcctcagttcattgggaaacagtgtgggtcagggagtgtaaccaacagctggaggtgaagctggggccagtcagtgaggttaaccacaccagggaagangaagaagaaacccagcatgggccaaaaccgganncttttcattcgatgtctggaagggggnccttgncccntcctngtttgggggnatttggnntggngngntggccctggggttattaaatttttttaaggggccccttggtnaacctgncnaaacttggggtnggccgttnaaaatggacaagaaacctttcacctttttttcaccaagnnttnttgggaanaaacaagaangttcccaaaaaaccttaaanctttgtgggggccttgggggncccgtggncttncctttnggaaanggcttttgnggggganggggtttcttttcctgggccctttttcccaaantttttgggggngggggttcccgnccccctcctttgtg

SEQ ID NO: 12018 - DNA, 707 bp, Homo sapiens
  misc_feature (1)...(707): n = A,T,C or G
tttggaancaactttntggggncnnaaangggtttttnnaaaanacccntcncnnggntgttttcggnacnaaannncaanttggnttaactggaaataantccaaacntttaaatttttcnaacccatgnagannantctaaaatcnncagttnatggnaaaaagttgggtcnagaagtgaacccacaagntgaagttaanctgggcccantcagtaggttacccncaccaggaagagaaagagaaaccagtcaggggccaaaacggagctttcatcgatgtctgagggggccttgtccatcctgtttgtggatttggttgtgtgtgcctgggtattaatttcttagggccactgtaactgcaaactgggtggcgtaaaatgacagaaactcactatctcacagctctggagaacagaagtccaaaactaagctgtgggctgggccgtgctcccttggaaggcttggggaggctccttcctgcctctcccagctttgggtggctccgcccctccttggctggtggctgcagcactccaatctctgccttctgctctgtcttcacacggccttccctctgtgtctctgtgtcctcttctcctcttataaggacaacagtgatgagatttgaggcctaccccgcatgcagataatctgatctcaagattatcaccttaattacatctgtaaagaccttattcctaaat

SEQ ID NO: 12019 - DNA, 1050 bp, Homo sapiens
  misc_feature (1)...(1050): n = A,T,C or G
cgcggcgcccgcgcagcccgcgacgactacacacaaaaattaaacancccatcttcctcccattatgaagctaattataacgcttagcctcccgcgaccggacgacccatagcgagattagcgtcgagtcacgaatgtgacgcaccgagtacaatcagtatcatccccaacaagagaatatcaacggantataagngctcgtcgtcgtcaggaatatcccagacgcaccaacgtccgcggtgcgcacgcatataaggacagagtgactctacgcgacgcgagataggtgggccggggccgcaacgtacacgccgaaggccgccgtgcgcagatacattaattcttcccccatcccacgcgcagcaatacgaccatcattaagtgagtatcggtttgtgcacgcagcggcgagcgcaacgttcccagcagcatcgaaatatcgttcattagtagtgagaatgaaagcaganccacacatctgaacgaaggaggatgatcggcgaactcaatgcacattcatccatacaaatttttcaggtgtgtgcgcaatgcgtccggtgactactcccggtccgcgtatcccctaatgttattcataaacatcgcgaataaaataagagcgattacaatccaaccaagcatccgccattgtcgtatgttacacatatagcgccacaggagtctattactactcccctatcaaatacgttcgcattcattaagcgtctaccgcatgtacaaaccgtgaatttacgcatgatgcgtaacgatactatcaggcgatccttattcactattcgaacgaaatcgtgtcgctgcatagataatacgtcagtagttatagagcgaccaagactgcagatactgtcttaatattcttactcgaacgatataatgctaccccacgtgagcactaatccgccacgagcccccagcacaaggtgagagactagatatagcacctatcatgatcctgatcgaacagcgtaattgtgacatggcgtggtacacctatgagtagattntaataagaaaggaaatacaagtact

SEQ ID NO: 12020 - DNA, 1487 bp, Homo sapiens
  misc_feature (1)...(1487): n = A,T,C or G
gcagggagaaggtggcgagaacgcacagagagtgaatcaaaacaagtaaaatataaccgggaatatgtcagcaanagctacgacactcagctattgttttaaatacgcgccgctcaagaaatcagtacttacgacgtatattaggggttattagagatgcgttttactcttatccaatatatatccaagtgggaatataaaatatgatcatcagcttgttctcgtacgcaatgcttactatgtgactacttcagattcatcgcactgcgttgacgaccgaacgacactagagtagtggcgcgcacgagctaatgtgcgatggtcgacgggagttatctaaacagcagcggagtgggcgagaagtaagcgcatacgatcgatacgtctgcacgcncataatacaagagtattgatgatgattatatcgattctcatacgccanccaccacgagcacgctccagttaattccgtcgcgatcagtgtctcgtacgtatatctcnttatgacatgcgtactacgtcgcgctngccgactagcggaccttatacagtgacgcggatgccgtgcgtatacgtgagagatgcgtaggtgtacgattgaaagtatagtcaatagtatgcaaggggaccgtccctatgatagtgcgagcatgtatgtgattataatctagataagtgtcacatgctcgactagtggtcatcgacataccgcgcacgcaacgctctatctatttcgaccgtaagatcgccagcattacggtaccactgtatgttgatcgcngcgcctctttacccgcgtgatcagcccgcgtatctantaatattatagcgtagcaatgcacgcgcgcgcagtatatatactaatatcgagtggcgagcgcatttagagatcgttctagatcaactatgacacgatcaactattagcatcgagaaatgatcgccatatgtaggcccgacgacatcctattcaancgatatactgtggcgatgcgtngacaacaaatgcactaccgccatataattgagcattaccatcatatcatacctaacacaatactaatagaacgctatgtagccgcattacncgatgataacggatgatttgaccacaatgatctctacatagcactcaccacacatctctcgcattcataatatgacattcaatctaaattacttagctcatcctcgccgatctcaaattaaccgcacatagaccnatccgacattacacacgatatatgatagagtattgatcaccacgagatggttcgattagtgtgcggcatgacgtatgcgcgagcgtgaatatgcgagtacactgatagtcgagatagtgaaccacgcgctacgtagagagacgcatgacttcgcgagctgatacatatatctnantcatagtntatctncgctcatcaactctacnttgatctgatatctaccagctcattatctgcatctctgacattatacgatgagatagtg

SEQ ID NO: 12021 - DNA, 741 bp, Homo sapiens
  misc_feature (1)...(741): n = A,T,C or G
ctatatagacaataggtacgtgtgacgctcatgtgttataccttccctagaataacagagatacacctacctcttattggaagagtaggcctctcccggaaaactgatattttggatggctgtctagatagtgagcccatgatggacgtaactcttttggatgaacatggcaaacccttccggtgtctcagagccccggcgttgcctactgattaactggcacatcctatgacagctatagcttcttgggacagacattcgacgttggactacgggagatgcgattacgaagagctgctctactgatgctgtcgtggatcacagagacctattaatactctattgtcaaccttattctttgtcttaaaagacctaaactctgccattgcatgatgactgtatatgagcaatgagtggctagagtatagaacatatttaatatttaacgaanagttgtctttgcttatgatgttactggtagaatgattagccgatgctgaccggaacacagacaggtctgcccctccctgttgccattaggacgggtctattagccttgtgtggtccgcctgggagctaaggcagccgcgcgtaggtacacgaccacactgtttaggccctagaagcacaacacgtgctctaattagtcctaaccggggaggaggctataagtataggacagagagattggtcttcgaccctgcgctggagtagagcaggattcatataagccgagcagag

SEQ ID NO: 12022 - DNA, 1077 bp, Homo sapiens
  misc_feature (1)...(1077): n = A,T,C or G
ttttttntnaataaaanagatnntntntnttggngggnnnccccccccncnngtntttttttnnccncacacnccncgnaantttntnttanacnccccnnngngccccncaaanatntttnttataaacccnntcttccntatnaggggcnnccanttngggggnncnctcgcccccccccccccnnagagtannncnanaccnggtanaccanaaaagctctatatntgnccataaaaagnccccnttntcccnnagtttaaaaatgccncaaaaccanggaaggncctttanttgnnacaaccaanccaccgaangttnaaaccnaccaattttacttcttnttaaattngnacccncgcggatacagggaaatattttaaaatggacattgagaaagnttnngttgtttantccattnaaaaaaaaaanctgaagaacacctnaccctctttatttgananaagntgncctnctccgtgcaaaaacataatattttatgaatgcctgtataaaaagttgttccatgatnnangtanctcttttncatnnaacatggnaancccttttggngtttnnagtncnccggngggcctgagatcgcngncctcaccctatgacagcncatagcttcttggnacanacaaacgcactgtggaatgcgttgatgcggaagaaagagtgcacngtgcgagctggtgtggatcanagagaccgaagaatgcctaattgtcaacctggtccttcatcttagtatcncaaaacatcnaccattggtttgggagtgaattataancagtaggaggcnaacnattgnngntattnagttgnattactttngacnggcttngttctgggngttgnanannnnaataaaacccgatgcggcccgccnaccgcagggnagtnnnagctttttgtttccccttnagtnagggntnatttnnanctggnnaanannananncnnannnnnnnnannnaannnnnnnnaannannnannnnnannnnnnnnnnnnnnnnnnnnannnnannnnnnnnnnnnnnnnnnnnnnnnnnnnnannnannnnnnnna

SEQ ID NO: 12023 - DNA, 745 bp, Homo sapiens
  misc_feature (1)...(745): n = A,T,C or G
aaacaggaggnttttngaaaaaagttnggaaantaagggcggggtntttttaattaaccccccnncccgggaaaagggaaggnncccccccnncngggnntttcccgggggggaatnaaggncttggtgccccgttttccnaggggaacnaggctttcaggccccatgggaaagaacccgggaaaattgggtccnccaaagcaagtaaaatgattcnaggagtgtctggcccaaggccacctaactanaagaagtttttattttcatgtgaaataaccagttttctgtttgaccttcaaggccaggatcccgttttccttttgcagttcttctgaggaagttaatgttaatgagcacaagatgaaacttagcttcaacatgatctgtactttacacatcaaaataaagaagattaccaacacagtcacagacacagaatggaagatgcatggattctcagattgacgaagcccaccaaactctgagctcctagacaaaaatgctgtagaacaacaaagaaaaagacaaagtcatacaagcagccataagggaaggactgattatcacaaaataaacacaaattagactgtaagaagacctctctgcagcacagtagagaggagaaggtaataaaacgatcacttcacatgtcgaatgaaataattgtccacctagactttttcatctagctcaagtatcatttaaaggcaaaattcaaactttttttttcccaataaacggagat

SEQ ID NO: 12024 - DNA, 1307 bp, Homo sapiens
  misc_feature (1)...(1307): n = A,T,C or G
ggcccacgctcgcttccgggacgtgattataacaggtccaaattttatnttgctcactatagtcgccatctctacatcatccgctgctgctgatggtcgcccgccgatccgatcactcatgtcctattcgtcttaatgactttgttacgttgtcggtaagttattaacacgcacccccaacatattgtgtctgtgaacacgttaccccgcgtgcgactgcacacattcccnagtcgcgtcagatacgcggcggtagagagaaatctatgtgtgagtatgctccacgtcgcatagtgattctaccgaccacagtcgagcgtgctggtaagcgaactatactcaatattgtagtctattatccccgcgtaccctccccgcccgttttgcgcgcacatgtgtgtactttcgttagtcgcgtcgtcgtgtcgacccccatatctccgcatctctatgtacgaagcagcagtgatgccgccgtgtggacgaatgcgagacagatacttcataacgntaatgcggcatcagagcctacatatcagcaatagatggatgaggtcaaganatgcagactgagtcgcctgcgcagcgtattgttacattacttgctgatagcggcgctagatgtagttatctccgcagaattatctaacgctanctcgtcattacatcatctcgaatgtcgcctcccgattcgcgcgcgatacccgacactagattaattgatttgtacgtatccgtgcgctgtaagtgactattgtcaacgtcagcagctgacacatcattctcactgttattacggacgtatgtaccgtagtgttaggtaaccgtgataggcaatatccgcacacgtcacgcattcgaggtcccagcacggtacgagcagtctggtaggctcggttatgtgtatgcgatgtcgctcacaggtctgagtacaacgagttgtcgtatgtccgtggcgcagngttcgcgattagttgcngcgnatatctcattatactgctgaagtcgcggcggccacggtaagcacgattatgtgtactattcatacgatgttagtctccaangcatccccgcgagctcacatgcatcaccaatatcatcctatatatgcaagatgtgtatgtgctntcgcgcctgacgcaatcggctcgcacccttcgccagccctgcaccactactggattgttgccgatgtattgctgatcctctgtacatgtttagcttgacgattaagtacgtatatgatgatagcgccgcgcagcgcgcatcttagaggacgctagaagcggacttatagatgatccgtt

SEQ ID NO: 12025 - DNA, 1173 bp, Homo sapiens
  misc_feature (1)...(1173): n = A,T,C or G
gagcgcgccaccgccgtcaccgcagacacagtatccacacatcatcaattaccggtgtttatgcggcgacacaacgataattaacgaatataatagcgcacgctaccgactanctgcaagccatattcgacacgatagacctcattcaattatttgaacagatactattatgtctattccaacgaataaagaaaagagcaatgatttatcacgcctccgattatcctccaccttccgccaagcggcacggagggcgtgatcacgatgtgagagatgagattagaccgtgtatatcccggtcgagtattgacgaggtagcaccaacccgcgcgtcgaccccccggccgccgagccgcatagacgcatactactntgataactattatcacgtatgcctcggcacacctattccccgcgacgatatactaactagaaccgttacacgtatccaccgacgatcgcccgcacaatgcatacaagagacgtactgaagtatgtagaagatcacgaattgtaatgtagataagtataactacccagacancaacataacacgagattaaataattataaatgcaactcgagtcaatgacatgttgcctgaccgaagatctaatatngcaccatgatgaacacatatgcggtcgcactaccatntcgctgcgtagcacacggaaaccacgtagattagcattaaaacattatagccgccaataattgagtcacacccctgacctgctcatcaagcntaatagcacggaggacgtcgattgtgtacgtacgcaccaccacatatctgcgtagaacagaagcctattccgataacagcctattagaaaatgctatagtccggactgccatcccaagtacgatacccatctccgaaacccagcaatagccgaattaccacataacgatcagcgcttcgcgagcttaagccagttagcaaaataaataatgttcgttacgtncaacaaccgaaggcattcaatctattgcatcatgtcaccagatgagaagacgcctggcttagcacgggtaagagccggcccatgcgctgttaatgatagaagaggggaagataatcgctcagagtagcgctgaggaatgctgaaaaatcacgtcggcaaggccgcgaataatatgttaagataagacatgaataacttcggt

SEQ ID NO: 12026 - DNA, 789 bp, Homo sapiens
tcaagaggtacgagaactatgaagcgatagaccagatatgctatttatgtccagcctcccgaagtaggggcagacaaccgtgtcatgccctactcacgggccagaaacgcgatatccttccccgcccggccgccatatccccatcttttgcgtttggaagtcgaacgacgacctcacaccatacaacgcagcacggaagctcttgcggagctttgtgatggcaatgccacgctctacagaattgattgccgatgtgtgtaagagacccgcttgaccttagccgaccccctgaaatagccgcaattccacgcattatacagatatgttgcgccgattccgctgagccgctaattgtatttcggttgcgtcgcccatagtataatctagacagtgaacagattctatctatagccctttgacctgaatgtaccgtttcgcatcgccgtataacaatagacggcgcctcaacagtaggtcgcatctaattcatatatcgcatatcatcacttaatctacgtatttcgcctccgtttgttccgatagtaagatatcgtcaaggcgggaggatacggatcgttttcgttacacggtatatttaccaatgagtacacagatccgaagttctgtgaattgacattgagtatggtaggccccgtacgcacgtattcaccgtaatgccgtgtctatatatgaaccgagatacggcggactgattacattaactctcgacgaattggagcataccgcaggcacgtatcacattgcgtcaatagacaattacgcatcctg

SEQ ID NO: 12027 - DNA, 208 bp, Homo sapiens
ttcaggcacactcactgggatcctaaccgaaaagacaagctgacgaagtgcaaccatgctcataggattttccagcccctgagggtaaagttctcaagctagggaaccaagtgtacctctcagacttgcattttggatctatgagtccaaagaagaaagagtgagagaaggaaaaagaggttcatcccatcaaagaaaaaaaaaaaaa

SEQ ID NO: 12028 - DNA, 908 bp, Homo sapiens
ttaggagacagcctttagaaattacaagaaacattggtatccaggaaagaaacaaagtggatgaagattatatgaagccggtagctactctaaatgaagtacatccctgactcttgagaactacacactgggttcttagagaatgtggaaaccatcttgttcatttggccatctctgattcaatggagaatggaagaggatcctcaaagactggagactggcaaaaagtggttcccattgtattattatttctttttagagatgggggtcttgctatgttgcccaaactggccttgaactgggctgacacaatcctcctgcctcaacctccctgggactaaaggtgcacaccaccatgttcggcctggttcccattttcaaagagaaggagaaggtaaattttgcaaagtatataaagctttcaaccaagactttaaagtgaactacaaactttaaataggaaagcctggtcagcgaactatacctgttggcccaatttcacacagtgcctgttttatacatcaagttctaatgatgattcagcctcacccccttgttatggattgtctaccgttgctttaccactgccctggcagagataagtattcctccagtgtaaaatgattactggctacccctttaaaggaaaagggcagatccctttttatattatatcccttgctgaccatcaaagcagccctgcgcgaatcgccgaaccaaaacaccaccccggatccaagagccttttgtggctacttaaaacgcttcttataaaccacccttctgctttcagagggtattcgactgggccacgagaaaccgatcgcttctggctccccaaggctcaaccaccaatacctcgggatgcatcgaaccacggatctgtacaaccatagaaaggagcccgg

SEQ ID NO: 12029 - DNA, 616 bp, Homo sapiens
aaactccaagaacaccggaacttcctgggaatttcaggcctcactgagaacttcgtagcacaaataggaggacttcctatcacaaatagtgagacacaggcttggttgggtgtgccttaaaaggctccttgtggcgggggcttggtggctcatgcctgtaatcctagcacttgggaggtaaatgtgggaggattgctatacccctggagctagaaacccgccttaacaacataatgagacctctgtctctacaaaatgtggaaaaatcaggctgcgtgagggggcaccttccctgtagttcacagttactcggtaggctcaagtgggaaggatccatctaagcctggggatggttaaggctggagtgaaccaaaaatccggccaaagtattcccggggggggtgccgcgggaaacccccacatacaaagaaataaaggcaccttccgggctccccgatacccgaacctgaaagattcgtggggaaaaatggttttttcttaaatcgcacgtgtgagagggtatttttaagggaaaattaaagtcctccaccccaatgagatggccaggggcccttgcggcaggttaccttagcactatcaaactctagctgtgagc

SEQ ID NO: 12030 - DNA, 612 bp, Homo sapiens
agttgaaccagctcagaagacagaggggaacttgtgaagaaatatttcctgaccttcaactcagccacttgcatcccaggactttccctgttgcttgccatcttgagaaccttcttgctttgaatgaaataatttgatcatggatatgagcccttactcccaaatttgtaaatattgggaatccctaattatagggaaacaagtataagttaatttataggatttttatagcaaagtcttaattgcccacgaaatatgcatttttccctttttgctttgaatgaaaaatttgatcatggatataagcccttactctcagattgggcaatactgtgaatccctaaatttagcaaaaaaaagtttaagtaaattataggatttttgggacaaagttttaattggccaccaatatccattttccctttttctaactaaaagaatcctatttggagatggggagtggagtgggtcttaaccaaaacatatggcttttccacccctctttggaaaataaggcgaggggcaatgggccccttttgacactaggaaatggaggataatcttttggtgaggctggggaagccttacagaggggggactacttgcttgtcc

SEQ ID NO: 12031 - DNA, 857 bp, Homo sapiens
  misc_feature (1)...(857): n = A,T,C or G
acatctcgaccagcaatgcctcgaactgcaaaaataaaataattttcaaaagaggaagaatgctaaagtcattatttcaggaagttcttaaatatttgttgaatggatgtctgaatgatagaataaaacgtaaccctccgggagaacatgcattcaggatatgctatgctagaatgcagaactctcaacgtaagaaccctgtgataaatctactgtctttcctgcaaactactggagtgcttttgggccataaaacttttgggagactctacttttttttgagttgagataaccatggaaataattttggctaccctgcttaatagaccaatggaaagcgtgacattctaaagggtgaaagtccccagggagtggaagatctcacacaaagaaatactccgataagtgattggctttagaatatcctctttcttccatagctggaactaaaacaatgataagaagcctttttctggttcgctaccgttgtattactggatgcaccccatccacacgcccttctgtgcctttantatgtgacatcgaagtagtctagtcccagctgacttccccgttattcttccagccaaaatctattaaatcacataatatggtgngaacgatgactatatgccgcgatattacggctcagctgagtctcatcttctatatattctacactttattaatatttctcaataaaagacactgcttttatttgttgttattacatattacacagtattgttaaaaatacataaaaccgcataagagtgagacattcacgaacacgattagcgtattatgatacctgctttcgtctatatattatatgacgagttaatgtctactctccc

SEQ ID NO: 12032 - DNA, 957 bp, Homo sapiens
  misc_feature (1)...(957): n = A,T,C or G
cttcttattttctttcgttctccaagcagtaggcggaggggggggctagtgggggacgactctctgatctaccagggctaacgtaggatccagcatattagaggccagacaggtgatttgcatactcaagagaaccagccacaatagaagaaggcagaggaggattctgtgttgaaagcaagcaaatatggacacaatttcgaccgagcttcacgtagaacttatcatagggaacactctgtctcatttcttcgtgctgtggagaatggtaggtttcttgtattttgtttcttgaatcgggccatctcggggtattctggacaaggttctgactttgtggcccctattactttttgtagactgtgatattctttatcaccctttactatattgcagagttattcaactgtttattcattaccttagtttgtatacgaagaatgtatttttatttctcattatccttgccttaggcgtattaattcaaaaattctgtaaattaatatttttactataacccctcggccagtgtacctataattctaataagtttgagagatgtacgttgttatttcgattttgttaagtaacaaaaataaaatgagaataggcttgtaattcttatataaaatatatgcaattactcgatgttgaaaatttgattttttcccgcgttcggtattgagagttaatcttaagcattacttgtccgcgttactaataattctgcatatcatttttattctactctaaattataatcttgtatctactcttacgcataatcatatattataaagcgctatgtgtattgaatagcaattgtttcttgtattctcattatctttggtttaatttactctttgcctattatgattattactggcctgcgtaatacagactacgtttgatactttgaatttgttatgttcggcgtnctctttgtgctactgtcgcc

SEQ ID NO: 12033 - DNA, 811 bp, Homo sapiens
gagtcttgctctgtcgcccaagcatggagtgcactgggcggcgatctccagctcagtgcaagctctgcctcgagggttcaaacacattctcctgcctgatcctgaggagtaactgggactacaggcgcccggcacgacgcccggctattttggatttgtagtagagaccggggtcataccgtgtatgccaggacggccttaatctactgaactgatgatccgcccatctcggactccgaaagtgctgtgattacatgcggcacccaccctgccaggactgaggtgggcttatattaaccgaaaagagccctcgtttctatttcctgttctaccctagaagaaaaaatacttctttccaacttgggggtacaagcaggtgcccttaccaaaaaccctggggtgcgcggggagggcttcagtaagcccagaactcttaactttctctctctgccagatccgtggacgtattcttcccccgtcaaacccattattcgtaaaaccggattataatataaacggttgtcggccgttgcctttattgagtggtaataaaagaagctagttctctggcccaacaaatccttttagtataggtgaaatccatactcatccctatcttgcaagcgggtccgcggtgttccgccaggacaagcgattccgtcatgaaaaaaccgggtcgacaagggctgccaagagtcagaaatcgcgacagagggagctagttggccatttgcctatgatcgcccccatggcaaaatgacctatgatgacctagtgcaaggcgctagacccagaagaaatactaacgcac

SEQ ID NO: 12034 - DNA, 1245 bp, Homo sapiens
  misc_feature (1)...(1245): n = A,T,C or G
cgttactcgaccctgccctgtagaacgacaggcgcggtcagggggcttaggcggcngacgcactctccttaatttaccacgcgctacaccgnatggctctttagagtaagtagactagcaatagtctttctttattatgcgatctgaagagacacacccacgctggtcatacacaatgattctattgtaaaagtaggcatagtgtagcaaccagagcaggaaattatagccgaatccactcccaggcctgtgctttgttacacgagttatccttagattcaatggagacaccatgattcttactttaaactaatcagacaacttgaatagaattcgggcgccttggtctgattatatgtccaagtcgagtatgcattctcgtcttgatgtggtccacctactgggtctattaagtcgctagtcacgcattgtcctacacaaccatatctactccaacttggagctacgctcacggtatagaagtgttacaaacttgctttcgatgttctctatcaccgacgacaccgtattctgcagcagtaacatgcgtctaatattcttatatccccagtagcttggcaataatccccctaagtacctctctcggcagtcttacgagctacgagtgtagagtcggacaccactcatgactcatatgatcagtgttgcctcctaattccttgtagaatcaattatccttttgccgctattcagacacgtgacctcgagtaaccctactacaattctgtgtgacctctcctcagcatccctctcattatacgacatatgcacctatcgtctggtagacttgatactagcaattcatcacgccggcgtctgacaccgagtgtatatctctccgtaatggntcgttgctaatctacctgtgttaactcgtctgttggatgatatataccagccatgtccttctctatccaacgtctgtcatacatataagatgcgccctagacaggctacactatcgtcgctgacgtagtattatcgcanctccactcctgaactcctctatcantatctccgcatgctcctcgtcaccccttttagtgatctcgtatgagtgtatactactatgtaatgcgcatctctgagcatattgtactaagcatacaccnctggtagtttatattaatatatgcttgtcaccccgcatcacgccctgcatagccatcgtctcgtcctattattaccatatctatactcccacttctaccccttcgacttcac

SEQ ID NO: 12035 - DNA, 1043 bp, Homo sapiens
atgttttctgtattctataaccacaggtggggggggggctagctgttacgactctcttaattttccaccgctacacgttgatcccaggagaaaacattctactcctcaacatgggtcttgcctgattcatccaccaactatgacatgctcgtggcacagaggaaaatggacttaggtagcggtaacaggctggcgactgtaggcttttacacatgtgctttaacactaacccttgtccagtgagtctttacactactcacttatacaatctagagtgacactcattcattttgacttggtacccctcgtccggataaattacggtaaggattcgtgttgagcttttttcttcgaatcaacaattggttcctgatgtctctgagtgactttatttgacttagacttcccttggtttgtggtgtcttctcttcttatttttatacatatgttagtttcaatcattcatctttatctttctcatcttcttttgccagcggacccgatttaataatgaacgtatcgcataaacaaaacacaatattattatgtaatgccgtcttctttctattgtgagagagagttattatttcattatgcctactcttcccttaacttacttttccgtattcgctcatgttctgcgaagaacgatgtgctgtactccttaatccactagtactgtcgcgatcttgccgattactttactatgagtatatagtttacatcttctccacgttagccattggatatgcatattctttgattattacgttcattaaccttatagaaatatgccacaggatatctgtaatttacttacgcttagcttttcctcctcgctcgtttagcactctaagatcatagccgtcatacttagggatataaacgtttattctcgctgtgtgcttttcgttgtattcggcatctatctatatatacactcacgagtacataattgtatatcgggccgctaccacctcactatacacgcaatctagtttgtatggatgtatacggcatagattatgactgttatagtattg

SEQ ID NO: 12036 - DNA, 881 bp, Homo sapiens
ctggtgtgtgctatccccccgcacggagggggggggggggagtttagctgcaacgactctcttatctaccaccgctacagtctttatttcagacttgaacttagaagtcaacatctttttttctggggctcaaaggagtgcagagaccctagaggtgtttccttgcagaggacttgagaggtacctcagataattcttgtgacggatcaatatgggaaaatggcactttagatctatgccgcccagagtgaggtccatgaatcagaagcttcggcttcacctgtgcttagcaaccaaacggctcaaagaggacagcctgactgatttgtttgtaggagatagggactgatttcgtgcaagacatcccagaattggggcttaaggtccacgtgtgttggcaaaactgaacataacctctcacccctaaggactccgcgatggaggggcagtatgcatacaggtggagttaataactggatttgaggggtcacattcattctttgtgctgtaatagacctgataagatgtcttcaggaatttttaaaattgtcttgataactgctatattataagtgctttgctgtgagctgaaacccctgccgggtttttacccctcacatattatatcccatattataccattctttacagttattggggtttaataagcacaaaagctgaagctttaaaatttgacccttttctctcaactttaggccgcaagaccgaaacttatggtgttgatggacaattatcctactgacatatattcaaaaccacgtgttttttaattacgcctggggcatctatattttttatcccataaaccatactaaacatgtgagattcgtttatattcaataaatattcagctactagag

SEQ ID NO: 12037 - DNA, 787 bp, Homo sapiens
cgataaagacgcatctttgtttaacaagaactggaagtaaaactttgtcccaaaaagcagaatgaagtaaactggattgctggcaaggtggccgaataggaccaactccggcctgcagctcccagtgaaattgttgcagaagcgtaaacaaggctgccaggaagctcaaactgggtggagcccactgcaactcagcaatgccactgtgatcagactgccagatttctactctctgggcaaggtatctctgaaaaaaaggcagcagccccagtcagggacttagagataaaacccccatctccctgggacagagtacctcgtggaaggggcagctgtgggtgtagcttcagcagacttaaacgtcccttcctgacggctctgaagagagtagcagacctcccagcacagctttcgagctctgctaatggtcagattgcctcctcaagtgggtccctgacccccgtgtatcctgactgcaagacgcctcccactaggtgcagacagacacctcatacaggagagctctggctggcatctggctggtgcccctctgagatgcagcttcaaagggaagatcaggcatcattctttgctgtccgggagcttttgctggtgatacgcagggcaacagggtctggagtggacctcagaaactccacaaactgcagaaaaggggcctagtgttaaaggaaactacaaccggattgctgcccctcagaacccatttggtggcacaacataaaaccatgggtataatccaaatatgggaaaaccacccaaaatgtta

SEQ ID NO: 12038 - DNA, 630 bp, Homo sapiens
ttcttatatctgaatagaatgctacagcatttagaaggagccggacgtagctctgagatgactaccatgactatgtatcacggcatcagatagctagtgaagaggtctctgtccagctccagatgtacagcctttcattgccagtgagggtgagatggaaccagaatcacggtttaaacactactatacttacctctgaatatccaacaattaagaagatagcctcatgtacctgccaagtagggttcatatcctgacgtcatgatatatatagatgtatgatgttcacaatatattttcatcttgtgtaagcattagaatacactcgcactttcccgctcactctttttgcttcagacctatatcagcttgtaacgcccttagaaatatatgctgcctgttatacctttgaaattaaataataatttagatctgcagcaacacgtgagtgtaatgatgaggatttatcctctttcttagactgacgggcacataaaacctacatactcttttacctaacatggcctgttatttgtcactttacaaaacatattattaattataaggttgtatgaagggcttataaccatgcatccattcttcggagggtggcggttaatttattattaa

SEQ ID NO: 12039 - DNA, 743 bp, Homo sapiens
  misc_feature (1)...(743): n = A,T,C or G
ttgtgatgaagaaataaacaatgcccagttcctgccctggagaagctcattgcatagaaaaaggaaaaaggcagatatacatgccacggtacagtgctgagacaacataaatcacaagcaaccaagtacaaagtggctgttaaccaagtattggtgaatatcctatatgaagattctgctaaaagtaaagctaccctgactgcgatgcatggatgatacaatttactgcgtctaggaaagagaaagaaagtgtgtgggccgggcgcggtggctcccgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttggaaggctgaggcaggagaatggcgtgaacccgggaggcggagcttgcagtgagccgagatcccgccactgcactccagcctgggcgacagagcgagactccgtctcaaaaaaaaaagaaagtgtgtgttttgtaatttccataaatgataagtgttgatacactagtagctgaaagacanactatttctgcccactgaaaggaaaaaatgaagaattatagggaaaaccatttactacagttaaactagactgatttttaaattaccttcttgcgatatctatacaaaaggaaattattatattaaaagcga

SEQ ID NO: 12040 - DNA, 417 bp, Homo sapiens
  misc_feature (1)...(417): n = A,T,C or G
cctaagcgtgactgactctcttaactaccaccgctacagttattcctgctgtgggatgaaaacaacccaagacatgatataactcctgtggagtccaggacctgcaacatatttctttccaaccaagaaatcccagctttctgctgtctgtccctctgctcacttgtcacaatccacctcaaccaacaaatctaacctcctccccaccaagaagattcaaaaaccatcatcacagtggngaaacttgaacaatggctacattctccacacaatattttcatcttgtaattacatatgatgcaatctggagggaaagtttaatggaataaacattcaggctaagatttaaaaaaaaaaaacaaaagcgacaacagttaaactaaaaaaaaaaaataaaaaaaaaaaangccagggggg

SEQ ID NO: 12041 - DNA, 603 bp, Homo sapiens
atggggtctcacactgttgcccacgttgaagtgcagtgccacagtcatggctcactgcagcctcaacctcctggatgcaagcgatcctcctgcctcagcctcccaagtagctgggactacagagttctacttctctttgtacagctctagcacagtcagtgtccttcctcacctcttcactaggaacaagaaatgcatttgcaaatatgcacatctttcttcaagctggccttctgaacaccaagagtgcctgagagctgcggccccaccctcctttggtctcctcaatcagctccttcctgtttctccctggtttctcagccactctccaccaccatgtaaatcaagaagttcacgatggtctggttctgcctgtggagacttaaactgatgcgagtggtaaacacaacagcccccaagaaactacaaggggggctccaatcggaagcaaaattctttctatgaaatgcaaagccgaacctataaaaaaacccaccgaaggaagatgaagaattgttcatttgattaaaccaaataggagggtgagccttccacccatgggcaaaagagtctctatacaaaacataaagttgccaagggtaa

SEQ ID NO: 12042 - DNA, 885 bp, Homo sapiens
  misc_feature (1)...(885): n = A,T,C or G
agacaaaactaagggcaccttaagatacagaagggaaaaaancctagtcgncgacgactctctnnacttaccagggctaaacggctacagagggaagaatggaaagagaaggcatatttaccaacaggcaaacaatttttggtaaccaaaaatgtgccgcgctataagcggcgcaaacagatggaatattcagatgaattggaagctatcattgaagaacatgatggtgatggcggatgggtatatacatatcacaacacaggtataacaggaatttctgtttccggtatagagancacacgggaaaaaaaggacaacataaggcgccaagaaagcccagcactatgtgaacaggaagaagatgaagatgaaggagaaactgcatatatggaagaatatgaagagagtggattgttggaaacagatgatgctccctggatacaaggaaaatcgtactagtcttgacggctcaaactgatgctaggccgccacaaagctatcttacaaacccgacacaatgaccttcacaattctaatgaaaaatatcacgagactccacattatgggtagtgaagttttgacgaggtagggttgacagcaacacaagcaccgacgaatgaagacatgcactggatattcgcagataaatagtcgcttgtgaaaatatcctgatgtagccgcacctgagatgagataatacacacacgctacctcacaagtctatacataaaaaacttcacaatgtgtcaaactgaaaggagaacattaactacgtacatgccgtagctaattctagtgaatttgcaatatgagaattgcaaatgagacggaccccccccaccaaatcacaccgagcgacagacatcacataatcggattattact

SEQ ID NO: 12043 - DNA, 556 bp, Homo sapiens
aacccatgaacccagtctaatcatgacagaaacattagacaaagccaaaatgaagacattctacaaagtacctaactagtattcttcaaaagtgtcaaagtcatgaaaaacaaagcagtcctgacaaactggaggaaactaaggagacatcactactacccagtgaaacatgatatcttggattcagttctggacattagtaaaaaaataaaaaataggccaagcgcagtggctcatgcctgtaatcccaggactttgggaggccgaggacggcggatcacgaggtcaggagatcgagaccatcctggctaccactgtgaaacaccgtctttactaagaatgcaaaaaaaaaaacataaaaacttacccgggtcgtggtggcaggcacctgtagtgccagctacttgggagggtggagctggattatggcgtgaacctgagagggcagcttgcattgagcaaaaatacgccccaccgacttcaggctgggcgacaaagcgagatcgcatctgaaaataattattaaattaaaaattgtattcaaccccgatgccgg

SEQ ID NO: 12044 - DNA, 909 bp, Homo sapiens
  misc_feature (1)...(909): n = A,T,C or G
ttagctcagctattttattgtatggagtaggaaggagaggggcctagtctggcaatggactctcttatctacacccgctacaggtaaagaaactgcagtctatcctaaaaccaatgattctttggcggttgaaagatgatgtggaaaagaaccttgctcccaaacaagagacgatcattgaggtggaactgtccaatatccagaaaaagttctaccgtgccatccttgaaaagaactttgccttgctgaccaagggggcaaataagcacaacatgcttttttttatcaacaccatgatggagctgaggaactgcatgtaccatccctacctgatcaatggagcttaggataaaattctataagatggtcgagaaaccctcagacctgatgcacgtgactttaagctgtaggctctgatttaggctattagaaagcttgtgttagtggatatattgttatctactctgattggatgagggtgcttagtacttattttcaatcagatggagagctgacttgacatgctagagtattagttaatcagataatatcctttataatctatctgttggcctgatagaggagaaaacttccttaaatagtgcctatgcagacagttctatgcccgaaagtatccgtcnctactttatatacaatactttatttgtactttttggtgatcacatgaccatgatccttctttggcgtatcatggttctgagccgcccctacaaaagactcgcaactgtgacatacgaaaatccaataataattagacgcactgacaaatatatctctcttgtttaacttcgtatatttactcgaattatataagtgtgcttattagtgtagtcgcttgnnctagtgatttagcctcttttctacggttattcgatgatttatnacatt

SEQ ID NO: 12045 - DNA, 367 bp, Homo sapiens
  misc_feature (1)...(367): n = A,T,C or G
cgtcaccggcatatccggaccacactggcccgccacgcccccatcctgtgcttataaaaacccgagaccctagcgggcagacacacaagctgctggacgtcttgacgtacacatccatggaagaagaacaagtggctggacagcgagaggacgtcgagggagcacgctcgcggaagggcacactggcatgcaggcgggtagncgacctgggtcactaggctgagttnggcctgggcagtcagaggagagctggggccgcctagcgacccaactccagagaaagaccatctcccttctcgctcccccatctactgagggctacttccactcaataaaacttcatactcattctccaaaaaaaaaaaaa

SEQ ID NO: 12046 - DNA, 858 bp, Homo sapiens
  misc_feature (1)...(858): n = A,T,C or G
tagtcggaacgactctcttaatcttccaccgctacacagctttgcacttacatctctggatggggatggaattggaagtgagtgacaagagcacagcatgtcagttccagtcatgttcttcacttctgatggatagagtgaactgagacatttaagatactaacagtcctggaactcaattcacttcgttaaatatcgactgcctgctatgaaccaagcattgaccacatttnttgaattcagagaagtgataaaccttatggttgccctctggaagagacaggcacaatacaaataatacaatgtgataagtgcttataaaacaagaatatattaaatgatatgtaaacacaagtgacataatagccaactcttcctgggcttcggggcaggtcagacgacagcaaccaagtgatattgagtttatccttgaaactctgggcaaagaaaatcaagatgaagagactagaaccatgaaaaactttgtgttatttagaagagaacacataatatttcagatgctcttggaactactcagattagaggcaatataggtccaaatcaggccaagggaaatagatgtaaaaagacagatcttggaattatttgggagttaggaccctccaaatctggggactaaataagagaagccaggatgacttctaatttcctgggttgggggattggtcaaattgatagcattagttaactcctgcaaatttaactctactgtggattggagacaaatttcccacaaactggttttaaggccaatttatttcatcttgagaaatggcacgcttaaactccaaaaaattgaatttattgccccattaaatttgataaaagcgggcgccc

SEQ ID NO: 12047 - DNA, 672 bp, Homo sapiens
  misc_feature (1)...(672): n = A,T,C or G
gttgtttttaagctagaataaatgaagagcacctttctctgaagcaatctatcactcacaacaatgtaggggattatatcttaataaaccaaaagggacatttacaaataatgtatntttcttgctgactgattcctccaaaatttggaaactctgattgagtatctaaatttctggcgatgaagtatctggataagtctgattaaaaacaaagaaatgggggtattagaactaatgagtaactattttagggttactgggaagtctaaaaagaaaaaatttttgtgcattgaaaaccatctctgggtgtagaaagtgcgcacaaaanccaatctaaaccttattttaattggaacggataattntaacaggctcttggtgagcagttttcccaacatgtgcaaatggggggctcaaagacacccacctagggttgagaccctgaggagggtcctnaccgcagcttggcacaagcttttggctcccccatttgccctatacctttgcaaaatagggttaagtaaattgttcttttggagggcgctggacaactgtgaccaaaggctgaagatactgcgagaactcccggccatctgctcgggtaacttatttcgacgtgggtagaaaggagntctgaactgttacattgcatggcggatatttcgcgagagt

SEQ ID NO: 12048 - DNA, 792 bp, Homo sapiens
  misc_feature (1)...(792): n = A,T,C or G
cagaggaaacccaatccacattaggaacaaggcttcttaagacatggatgtaatttggtggatcccaccgtactgggattacaggtgtgagcgcctgcgcccggccaaacatggatcatttattgcatgaacaaacntctcaattatactttatttatttacatgtggacaataaattacatagatactgcctgttgatgacagaatgaactttacttctaactgaaacatcagacacactggttagcaattagaagagtntcttattttaccattaataacagttataaggagaaaattattcccaattccattactaagagaaaccaactttttagcaatcattttatatccggtattgaagctataacatcaacctgctatcatttataaagtaatggacttccaaatcaaccaanatagaaaatacctaaactataattgtctttttctnaaaaactttaacgaaacaaagatatcccatcaatatatttaaaccaacagaaaccnnnccaaaacatagttcctgaacaaggaaaaaaacngcaactcttgatttccaaataatcccttaggccggacataatctcgcatctttaaaaaacaattttaagataagtagtagtgcgaaatcgttattcctaactatatttccgcgtaaggctggatacaacacattttgaaaataatcatcaatttacattgggaataacgtgtcggaaataaatgatacgtataaaagggtgatgtctctcaatacatgcttgatagactcaaatggccccacaaccg

SEQ ID NO: 12049 - DNA, 826 bp, Homo sapiens
accccccctacaatgacactaatggaattcccagcatactcggctccatgaaagcaggacccttgggagtcctgttcacagtagcatccccagcgcctagagggagcctgctgcactgtagaagcccagcatatcttggatgagtagatgatgtcgtctcagcaaccctgggtctgaattgccaactcccactgggtagactctacatgcagttacaacattaacatattaactagtttctgctgttcatagaagatgaggaaacttacgcataagacatgaggtgacctgccttatgcccccagcttatggattattaacccaggtctgtctgaactttaaccccaggccttttttttctccacacaccccacgtggaatgattctatattcattatcactgtatatgccgcgcgctttctctttagtgagggagtatttcctgatccccatctcactgactctagcgctcactgtctatctgattttgttatcgtaatttttttcctctaaagcggtgacacatcaattccacacaaactggcggttaccctataataacatgtgatccaatagccactcaggggtactatctagctattactggcttgtaagattttacatagctcacagcctagttatttttttattaattttaactttttatataatattccctactccagcgcatctatagaaatactcggttgttctcctttgatcttcttttctcacgtctgttttcaagactaggcaatatactatgccatgattctctttctcctccaaaagctagaacctattttcatcaccgacctatcgagtg

SEQ ID NO: 12050 - DNA, 842 bp, Homo sapiens
  misc_feature (1)...(842): n = A,T,C or G
aaggtctgcagcttcactcctgaggccagcaagaccacgaactgagcgggagggatgaacaactctggacgtgcccccttaacagttgtaacattcactgtgaaggtctgcagcttcactcctgaagccagtgagaccacgaatccatccaaaggaagaaactccaaacacgtttgaacatgagaagtgggaacaaactctggatgcaccacctttaaaaactggaacactcacccgaagggtctgcagcttcatttcttggaatcagtgagacccaaaacccaccatttctgggcacaaaatggaccaaagattggtgggatactatttcacttatggagttataaaccataggatggggggcgctgtgatatagattctaaagaggaaatttacgggggtttaactttgggcactaaattggggcctggagcccacacaccccaatagtttccccttgttttatggaagctaattagcaatgtttcattggtgaatagattagtagttccctaatgggccaacttgcnaaaagggggaaatatagtagaatcttcccttttttgattggcctgggcggtgaggaccggaccaaacattaatataagaaccccgaaaaggtgactttcgaaacacgtgaacagagggggcttcaaagtaaaccttgggtgttgagaaaggtattatcttaaaaacaaaatcacacattctgccaaattggctcttatttcttaaaaagagttgccattcgccagcttttgacccggctctggttacgtgccccggtgaattcctggggggaaaccaattttataattaataaaaaataaagtggcagcgcg

SEQ ID NO: 12051 - DNA, 197 bp, Homo sapiens
aaaaaaatgaagtgatactgaaaccccaggggcatacaaagactactcacagtaacaaatacttgaacatgcatggttgtgatcaccacaatatcctcactcaattttctcatctggcttcttcaaggaaaaaagaaaaagaaaaaaaagacattagaaaaattaataaataatgtctaaacttaaaaaaaaaaaaa

SEQ ID NO: 12052 - DNA, 824 bp, Homo sapiens
  misc_feature (1)...(824): n = A,T,C or G
atcatgacaaacgggaggcaggactagattgcatttccgactcggacagacagagcagtgtgtggaggctctcatcatgaatttttgctccagaatgactgcaggaataaatcaggaaacctaggggacccacagaccccctgaaggaaacagattgctcctgcaggacccaggaaacaccccaaatacagtgctggtatccatggccgagagacccacaggtggttcacctcacaggactctgtgcagacaacccccagtaccagcccggagcctggtcgacttgcctagtggcttaatccaggagtgagataacaatcattacagctgggctctcaagaaccacatccataggaagagggggctttttacctttggcccggaggagccctgagccctagtcttgagtcacaacaaatcacaactttaaacacaaggaaatcctctggtttgggaggaacgtaagagtcgaatttggaacctaaaaaacaattccccccttgagccggcagttattttccccttcttagctccatcaaatttttacgggtaaaaaaaaggaaacggggtaaaacctcccggtgaaccctaacaaattgagtaaaaaaaattttttttcccttaccccttttatacttactaaaaaacaataaagccgaggcggcgtttcttttaggaggggtaattaggaactccctccttgcctctgggcccggggactggggggggaacgtgtttgctcattcaaggggcaatcggttttccacaatttngggtaaaccggaaagaattgtttctagggccgcaaagcccaaacctaaagg

SEQ ID NO: 12053 - DNA, 607 bp, Homo sapiens
tgcagagagggagacacccttacaaatggagatttgctggatagaaatgtggccaaagagttcaataaaagggcacagctgcttaaagactgttaccggaaaggaatcctgatccagacgccaagagagggttcttggactcatgcaagaaagacttcaggacgcagccaaaagtccctggggaaaccccgccttcaagcctaaaacagcctgaaggatgaaaaaccagacttctggtgcctgatgaagccctgccctttcctgactgattctaattaatgcctacctgccaactgggaaggcagggtggaccctccgaatttatgaccttcgaggggagagggcttggcctttctattctggggggggacctgggattcaaatgggaggggaaaacctgctacaggaatctcgctttgttgggagtttttttcttttccttttatccaaaaatcccgaggggccgttccctttagggggggaattatgatcttcgtcactgctcgctgccccgggggtcggggggggaagcgaatagtccataaagggggaatccggtttcccagattctgggataccgcggaggaactggtggcaagggccccaa

SEQ ID NO: 12054 - DNA, 935 bp, Homo sapiens
  misc_feature (1)...(935): n = A,T,C or G
agctcacacaacacgcnnnccacnnnnnnaaagnttttctggacacaaaccnnnaaaattaanntgggcgtggttgtcgtgtatcattgagcagtgggcatattcagtgtttaatgaggccgtagaggcctactcgaaattaaaagggaacccggcacaactcagggttattaacccaaatagagcgttgtattgtatgactcgtgaaccctctatcttattgacacccaccgttggcacgggcccccttgttgttttgcctaggagggaccacctctccttctccttttattcgaacggtgggggaggacagagggttgagtgtgcttttctcaggggaacacacccctgggatgtattgacaaatccccaaattaccctcccaaggagagcaacggggattatttttccttatggtggagagggatacaaatttccacgggggtccaaggtgtaaaaaggggccaaaaattccaatgttattggccaaactctaacgcgtggggccactgagaaaagggtataaacccctccaacgataagggaacacaaatacctcctccgtttatcttggggggggagattttggccttctcagctagccaaaaagattgtccctcaagaaagagtgaccccctcctaccactcaaataaaattcggaaaaagagggggaggggaccatggcgaggaaacaggtgggtccgccccgggggggaaaaaaaaagggccccgctacattaaaacctgaccgtcaaaccccgcgggggggggtttttaggggaggggcattagctcgaaatacttctttccccggcgttgtttgtggggggggtaactaattaaggggggaagcggttcacaaaaacaaaacaaaaaaaaaaaggcgggtgttccggtcttgggacccaaaaccggaaaaaacacggtgttccgt

SEQ ID NO: 12055 - DNA, 807 bp, Homo sapiens
ccctgcgcctgagcctgagccaggtcgcggagttttagactgacgcaaaggaggcacccccgcagcagagatgctcgtctttctgccacacaccctggaggacccgacagactggcagcagaaactaaagactgttcctgccgtcctctttccaacctctgcatgccccaagaggggtctgaccccggaatccttttttccagggtgccccgccggggcgcaggaaggaaactcagcatacgagtaaaactagaaaaaaatgatagaatgcgatttatgttgattcctggtcaagggaacacaagccggcccactgaaccagaagaaaagagtaatagaactcttgaaagagaagataaaacccaccgtatccagatattgctgggaagaaaaataaaaacaactattaaaaatttaaaatcacttttagaaagcttccttgcattagtgctatgaaatagaaagagtcttggagaacaggatttggtcacgttaagttgggcaagtcttttcttcctgggctcagtttcctcatctgcagtgcatgaggccattgacctccataagccctaaggtcccttctggtttcaaaatcccatacgtttgaataaacacttccttggcaaacttttaagtcatttcactttaattttgattatctgtgggggacattaaagggaatctaatcaggaataaaggctggtttcttcgtagaagaaatggcattaaaaatgggatacaaagagaacaaggctaatacccaagccgttttaggtccaatgggcctggccaaaaaaatcttttaaa

SEQ ID NO: 12056 - DNA, 458 bp, Homo sapiens
tcattctggcactgactctcttaactaccacggctaccgactgttgatttccaactaaggatggggggaaagttaaaacaatggaaataaaaggtcaaagaatccctcagctttgtggaagtgtggagattcacattcaaaatgaagaattgtttcgtgaaataatttgcagaggctcaatcaagagaaatgaaattacttaaagagcaatttcaacatagtgaaagcctgcttttttgtatgaactcaccaataacatcacattcaactgacagtttagaacacaagaaactgccttccttcagggtgaagatagaatatggatgtggcaaggtgttgaagatcagggtcttcttatcaaagcctcccatagctatatgctcttgggcattttctgtaaaatattaatgataataaccttcttcctaaggtcattgttacaattaaataaaacaaga

SEQ ID NO: 12057 - DNA, 613 bp, Homo sapiens
tgcctgcacctttgtaactggttactttattaaagtctcttcacttaaatcaactgggaagaattctgtcctactcaggacactaacttcaaactgcagtatataccatcacagcttctttggtttgacagaacatttggacacatttctgcaaacggacccttggcatctcttcttggaacaaaattttgtatttggactctggcaccatgcaccacagatgcaagcaagaagcacttctaccttctgaggcggcccctcaaactcaagccagctaggctaggcctgtccagctttccttcacagagaaggattggagagttgccgcttattggctttctcaaatgtcattacttaaccagttttctgaagattgagattcatgaacattggactcttgcctgtaattacaattctaaagtatattaaccttattttcagctgtatttttagttgctttctgaattcatcttgaaaatacctatactctttctggatttatctaacctacctcggagcttgatttaaaaaaattttatcatggaacacctccaaaactatttttgaacttagaagtttcttaaatttttagaaaaaggattagatccacttg

SEQ ID NO: 12058 - DNA, 1419 bp, Homo sapiens
  misc_feature (1)...(1419): n = A,T,C or G
cctcgctgcgtctactcttcgtctcgagcgtgctgcgtccggcttgtattcgcgtctctttgtgttggcgtaggctcgttagttctctcgcctctgcgttgccatacttttcgtctcttcgctggcntttgtgtggtgtgatcctcgtgcttccgcgctttgctgcaccggtgttgtttgctgtcctcgctcgcgcgtacgtcggcgctcgcggcgtattctgtcgttcctcgccggtgtttctgcgtgcgggtcggaggttgtggatttctgtgtgcttgttgtggcctcctctctttcggcgtccgtatttgcgtctatgcgttggcgtgtggcctcgtgctgttcttcgtcttgtccgccgagattacgtggccgtggcgcttgcgtcgtgttctgtcttgtcggcgcttcgcgcttcgtgtcgtgtctgttccgtgttcgtcgtctcgtgtgtgcgtggttccttcttcggcgtgtcctcgtcgccgctgctttctgcggtcgcgcgggctggtctaatccctcccgcgggtggcgtgtccctcgtaggtcgttcctctgtttcggcgttgcgtcttctcgtggcatcctgtgctgttatgcgccgggtgtgntgggactcgatccgcgtgcgcttctctgttattgtcctgcgctgttgtcctgtcgatctctttcgcgctcgcgttcctctatgctgtgtgcgagtgtggtctctctcgcttctaatctatcttgggtcgcgtatctantgtgctcgtccgtcaccgccggcgtcgcgcctctattcgtgcgtgtcgcgtggctgcttcgcgcgtctactgcttggtctgctgttggcgcacgcatcctcattgtctgatngttccgtcgcgtcgctcttatgcgtctgctctctcttcgttctgtcagattgtgggactgctcgctcggtggtgcgcgtcgtgctggtggtcgtcgctctcttcttctctcttgcctccgccgtgccgtgcgtcgtctgctggccggtgcggaatgcgccgcggctccgtcgcgggggtgcgcggtgacttcggcgtgtcgatggtggtgcgcgctgtcgcccccgtgccgggctcgcggcgggcgtctcttgttttcttgcgcgggttctgtgtgcattcgtcgttctttttctcgtctcgttgcgctgtgggcgttggtatccttgtggtgttccttgtcttttgcgcgtttctcgctctcgtttcctattgtggtgtggtcggcgtggtgtgtgaagtgtgccgttgtcgcgtccgcggtcgcgtccgcgtccttgcccttggtttctctcccctttgctaggggtttnggcctccgtgttttcccgatggcacggtcgtttgtttcgttccctcttttcgcgctcgtgtgcatgtccgttcgtgtctt

SEQ ID NO: 12059 - DNA, 1813 bp, Homo sapiens
  misc_feature (1)...(1813): n = A,T,C or G
agcgtngttgatcttatcgtntcgagtgatatcacagtttcngtatatgagtntntactgtgactgctgaataagcatgggcgcgcggtcgatagcantctagtgcgcanatacgtngactacgtatgatgcgncatgcagccgactgatacgatcagtcatcanccgggantgcgagcatcganagcgtacgacacgcgaagcgtcatcagcgatacgacacgcgtgcgctagtcgtctanctcgcatanggtatgcgacanantatatccatgcgtcgcgactntgctgtcatctgtgatanactagcgtaccgaacgagcgcggnacacatacacacatgctgtgtngctntnctacgtcgtgcggcnagacgcgacgcgcagtctctacgctagagcgagngctagcagtggacggtatcgagagtctgtgatgtatatactgtgctagcgtgacacgcagacgtgagtacgatgtgcagcaactatcagtcacnagagcggcagcatntttagagcgcgcacagttcactctgagnagatcgaggatacgctgtatatgtggantgctgtatagaatacatctantatcanacngtaatactntagcgtgatgatgtcgacgacagagcacagtcgaanctacgcagacacgntggatgcgacgagctgcactgcnactcatacnactatagangtgtgtagtgtcagtcatgataccacgcacacacagatctatacagtagaagcgatgtacagtgaatacgnctgagcatcatattctccagncagcgatgcagctcgctacatgatnttatgcgaattagcataatctgtcatgatcntgtgtcgtattgtctatcatcactcgtacanagtgaaggtacgcgctcgacatcgagtgtatacgctttgcatgtngntntccgngtgtctcgcgtgtctacatagcgcacgcgancagcgtactgtatgacactgtacgtcacgcgtcgncatacatgatacttgnctagtatatgcttttatcnccgcagcatctcgnacttctgagacactactgacgtaactgacagatagtacgctangtattgtgaaagcagacagcatcgcactgcgtcgatcgantgctngtccgtctgntacgcgacgcgatgagagncagcatnacaacatgatcacactagtggactctcgtgtgtatgcacggtagccgatcatggcctcacgaatgctatcgaacatcgacgatgncgacgcatcgctctcacaataatatcataatcgagatgtctgactaacaancaactcaacacacgcacggacgtgtatcggcgggcgccgagctcacgatgntagtacgtcgcacggctactcaacgacattcgccgangtcacgctcatcntacacgcaataggcgcgtgattgatcgatctacttcgttacgcagcagacagagcaatcgacntcaactatatagcagcgagagagagcattaagcgacagaatacctcctagaccctcagcgtgtctagcgacgctcatctgataagagagcgcaagacactgagctcacgcactactaacttctttcactatcgtaaactatgtgatacgaggcgtacgacacgacactgactacgcacggcactaactgcctccaccatgccgcgacgggcatacccacacccatataaaatattcgtaattgacttagttttcccgccgttgaaagcccactcgttcgtgtgaatagttcctcctgatcgaactatctactacaacacaatctagaaggtgatcgtgtgtg

SEQ ID NO: 12060 - DNA, 201 bp, Homo sapiens
gacggatttggaataaaccattcaaggatccaaatgggactcaggaaaaccacccaacccgcatgtagcggctcataacggagcagaaaaagtataacagagacaaacaaatctcattatacgatccgtgaaagtacagaagtaaaatggcagatacataagtggtggagaggagaagctaccgtcacgaccatagaatga

SEQ ID NO: 12061 - DNA, 917 bp, Homo sapiens
  misc_feature (1)...(917): n = A,T,C or G
tttttttcccttttctcttcctccccctagcttcctttagctgcagtgatctgttattttccaccgctacagctcacagttatgaagtttctggatgaatcggaatctgggaaaagacctaataatccaggcctgagttttcaggagcaagtattaacactactgagataatcctctttatcgagagatagagacagagttagtacgagaacgtttaaagatacttgaatgatcaatatatatttggcctctctctccaaagaccaaactgaagttgatcgatgtattccgatatggaaggatttatcattcttctggttcaaggactccttcaacgtttatcgtcatcttttgttttttacctctttacaacatctctgaccgatccccattatctcccaccatatctcattttggtttcttcataagtcaatagacattctagcctcctcgaccgtatttcttttaattattgctcgctcacgtttctgtgtcatcagcccaatctttctttttcctgtcttggatttcggttatcgtccccttcnatacatattcttctctatttcctatttccgcgcgttgactttctcctggggcttcttgctgtttcttttgctccttgcctctgtctattctcttttttctactgtccttgccgtcttgatcttagtctctttagtgctatttctcttctttcggtgttcctcactcctcaaataattgctccttccttggtccgattttattttttgttcccttgttccgtttttcttcttttttttcttgctacttgccctctttttttcttccctcgtctctccccccattatttctcctctctctatttcttcttaatctccccccttttttttcctctcctctctttttctcaccctcttcttctcctctacttt

SEQ ID NO: 12062 - DNA, 666 bp, Homo sapiens
ttaaaacttccggatacccttgctccttctccctctgagtttctctcttcacaatatacctgcctactctgctactctggattccagaaaacatagttggcgtgaggaactcaaaggaagggctccccatgcctctgaaagttactgaaaggcaggtcctactgaagccccaaaagctggaaatctgataaggtatgtaaagcgaccagagctctccctgactacattaataccgcttcccaagtcagcacaccataaaactatatattccaaggggcataacaggaagtccttttttggaatacatatcatcgccgcccctatgacctctgtttgaccttccaggggaaaaagccaaagtagtcagcacctccagccagtggaagcaacatctgggacaaattacacagaacttccgggcttgtgaaggagcaagaatggccctcttttattcaaaacaggggaaaaataactttattcacagctacttattgcgctcccctctgcaccacttgcaattgacctattggcacgacgaagaaaagtttgttaagccgtcatcgtgagcgagctttagataaacatatcgtaaaatatgaactttctcgatgtgatataaacttacggcctgctatgagaagttacattattagaatacagaatatc

SEQ ID NO: 12063 - DNA, 1887 bp, Homo sapiens
  misc_feature (1)...(1887): n = A,T,C or G
ggacgaaaatgcagacgacagcacgatgtnnatgagagcagcacggacgcagacaaagcgcgagcgcgcaggngnggacaangagnagagngngagggnagnnnccctttagnagttcaggtatnnngngactnngngnnacngcgncgncgcgngnagnaaganngcccttannngncaganagggnnagangnnnncaaccnnnnagnngngcggnnngngangannngannnannagggnaganagaaagggaggaaganannagagagnancagaagangaagaattctttcntgagagaagaggaggngncagnagaganagacaantaacccgcgacgncacagcncgagaggagagacgncagacagnaaggagganacaccgcncaganacgcaagaacacacggagcgcgaccgacncaggcggcgcacacaagcgcagaggaaaagacagangagagaggcgagacaagcaggagggancanccagncggaggcaaggagagagcacgagnacggaagccgaccagacaagcaggcgcgagccacagggcgacacagcggacaggagagacancacncncagacaggcagcaacaggcacaacggccanagaagagagagangnagnactgcttcgtttttctttatgagacaaganagngagggncgacgnagacgagagacncgacggcagcgaacaganagcagagcgcagacgcaaggannaagagcgagcagncngnnagcgcgagnangacggaacgcgcgcgagcggcgcgagagagcaggagagggaaancgcacagagccgacgaacggagagngacaagaagagaggcagacagagagangagaggaagngaggcgcgagcgagagagacgcgcagagtgcgacggagacgaagtagggagagagacgccggcgcgcgagacacacgagatacagagaagacgagagnacgagaccagaaggngcgcgcgcgaagagcaacgatcagtacgacaggtgagcacagacagagagacgagatgcgcacancacagtagtacgagtgtaggacngatgagaagacagcacgnagataagagagagcgcagcgagcgagccgacagaacgagaacgatacgcacagagagagacaggcagacagacaggagagacgcgacgcgcagagaggacgggcgaggagcatgtgagtggagtgcgcacacggagagagagggaagaggngntggcgagcggatagtgagcagaagtgacgagaagggacgggagaggacagtagacagataacagcnaggatgcgcgacagaacgatacanaggtaaggggngacaggagagtaaaacaagaacgntaagcgacagactantacgacgactagacacagatcaaggtagatacacatnatatatcagagcactgtggcgnatgcatgtcganagtagaagcgagatgagaaacatgagangagagaccgagcngagcgtagaagcgacgagatacgatgcaggagacgagancactgagcgnacgcgagagagagcgacagggagagagcgaagatcgagccgcgcancgagntcgcgcnccgctcgagcgaacgacacggcangngcgacactagagacacaacagcggcangtcacagcacgatagtagaagncacattgtagcggcgcgccgacgactatggaggacacgagacggagacaaggatancagtaaagagagaagagagggagangaagatatgaggccgagagaagngtangaccgctacacggaaaagaggcgaggcgcgagcgagaggagaagggtgangcgaatgcgatagagagngagagagagcagagacacaaggagagacggaanag

SEQ ID NO: 12064 - DNA, 891 bp, Homo sapiens
  misc_feature (1)...(891): n = A,T,C or G
acgtatttatctcttgttcctcttgcgcaacggggaagcggcgacttatactgcagagcctctcttaattattaccgctacaggtctgccatcatggatgttctcgcagaagcaaatggcacctttgccttatacctttatgaaacgctgggtaaagacaacccgaagaatgtgtttttctaacccatgagcatagtctgtgccctgggcaaggtctatatgggggcaaagggaaacacctgtgaacagatggtccatattctctcctataaaaaagtggctgcggtggagattacttctgtgttttttatactttctcaccgtcttgcaccttattgatatcgataacttcttcttgtatgtcacaactattcttgggcacacatatgccatcccttttcagtttttgtatattcttattctcattcattatcccccgaagtctcaaattttgtttactactttttttcccgcacttgcacttaattttttccttttattgcttatctattgccatatattttatgatttccgtcttgtcgtgcttctgccctcgtttatctcttctacgtatgtttaattttttactttctctaattaaaatataaatagatgaagcacgagatcatgcncttttggcgctctggaggatgatgtccctcccatatctacttaagtattgtgtacttcctatatgtttatttttagtttctttgctgctaaataaaatatcttcacttgttcgtctctattatatatctatttcgctcacgtgtgctattgtgcatgtttttatttttttatccgtcttatctctaattttctagtaactacatttcctcctctcctccctttttttagttatttttttgttactaaaacgactgctag

SEQ ID NO: 12065 - DNA, 478 bp, Homo sapiens
cttcaggcacatccctccaagacagtcttctctgtggaagcagcatattggaggtctgctaggacagttcacaggaatggctggggagggcgtgcaggcatgtctctaatcagaacctgcttgtctttttgattgacagctgcactttctccaccaagaagtgggtactgtgcaagttatggtcatagtgaaggtgggggacatggagatgatcccgaatgagctgcataggcctcatcgaatggggggaaggccttgagaacagagccaaagtttctctgaggaaggggaaattctacctgtagacagtagcttcagttcctgctgcagtttccagcctgcccttcctgatgtccttccctgtggattccagatttgccagccagtctcatagccacataagccaattgcttgtaataaatctcctagtgttaatgatcctttaatactatacctataaataataaaaaaaaaaaaa

SEQ ID NO: 12066 - DNA, 882 bp, Homo sapiens
  misc_feature (1)...(882): n = A,T,C or G
cttcagtgctaccaagggcccttcagtacaagattgaagtgaagtgatgatatttgacatccttgacttcaaaggaaagctttgaaaatctcaccattagataagatgcttgcagtggatttttttttaaacttgtaattagcctttatcagattgaggaagctccattctagttctagttttccatgagtttttatttttaacttttatcaggaatggattttaaaactcatcaaatgctttttatgtatcaatgagttgaaacctatttttttattttattcttaatatgaccaattacattgcctttctaatgttaagctaacctgaatttctagtataaaccaacttgcttatgatgaagtctttttaccaactgctgggtttacatttttaagaattttggggtctatgttcataatgagattggactgtatgtttcccttgtcatactctcttgattggtttttggtatcaagaaaatccagtctgataccatgtattagagtttatcttattttgtcgttctctggaaatatgtaggattgatattaatttttcattgtgcctgttagtaaagatgtttgaacctaaacattattttggaggaagttttatattgctgtttcagtttctttatggttatctcagntttttattatatctttttgcaatttataagtgggcgttttctagaattttctggacagttcttctgatttctcatttattgaataaagtattactacagttaaaaaaaaaanaaaanaannaaanaggaaaaannncnnnnncacaacaancnnntcannncnnnccacnaacaaaaaaaagtgccctgggcccccggggggcctcggcgccctcctttgaggggggaaa

SEQ ID NO: 12067 - DNA, 960 bp, Homo sapiens
  misc_feature (1)...(960): n = A,T,C or G
ggcgcaaccaaacttgggaatccaaaaacaanagttctcggtcatcgcccccnggntttaanngncccnacagcccggcanaancaacagaaaaaggaggggcattccagaggcaggggagggcgggagaagccccgcgcccccaacccgaccgcgggagcgcgcaccgcaccaagcagcaacagcccggcagcagccncagggcatcgccccggagacggacagcccaaaccagcaacaaacgaagaagcgggaaaaaacatttttattcaagaggggggcacacacccaccaccaggaaaaggggcagaaggccccccaagaggaggcgccagaaagccccgacgaaaggaaacgaggcccacgccaaagagagagaacggggcgaggcccgcgaaaaacgganacacacgagcaccagaggaaacaggcagacccaccgccgggaaaagaccacaccgaaaggaaaccagcgaggccacgagagagcccaacagccaagggagagagaaaaaaagagccccccaggcccaccccgaaacccccaaancacacaggcaacgcggaaccgacaaggaaaacggggcaccaccaacccccggcgccacagccacccagcaaaccacgggacgcncgagcgcggaaagaggacggcggacnccgggccgcccaaggaaacccaacaacccacacagcgaaagaagccccaccacgccggcgcacaccccnccngacccaccaaacacaacaacgccgccccggcgcacaggaacgccgagaccggcaggcacagaaagaacccacgcacagaccaccccccccgacgacggggggggaaacgaagccaaagcggccgcagcgcaaaccgnccgggcggaacgagancaagcccncaaacacacggcacccaaggcnnnaaaaggagccccagggcgaaaggggaaagaagacaaaaagaga

SEQ ID NO: 12068 - DNA, 762 bp, Homo sapiens
  misc_feature (1)...(762): n = A,T,C or G
ctatcctctggtaaccatccctccattctctatctccatgggtccagttgttttgatttttacattcagtaaatgagtaagaatacacaatgtttgtctttctgttcctggcttatntcacttaacatgatgaccacagttccatccaaattgttgcaaataacaggatcccattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagatctaagtctcaggagagatgcaccgaggctgctgcagagctgtagagaggagatgaggagcgagcaaaggaggtagggttggaggcgcagggcatctcccaccctgacttgcctcagacatgcccctcctttatctgttgattataccaggcgtacagggaggatattattcgaacaaagtacctgcagg

SEQ ID NO: 12069 - DNA, 175 bp, Homo sapiens
tccacttatgcttcaatcagacaaaacacacccgcttcgagggctacctagacttcaatattgcaaagcggaaaatgtctcaaaaatattcttactcttcccactcaaacaatataagaggtgcatattcaatgagcagcagcaaagcccttctaaagtgacaaaaaaaaaaaaa

SEQ ID NO: 12070 - DNA, 947 bp, Homo sapiens
  misc_feature (1)...(947): n = A,T,C or G
tgtcgggggttgtgcctgagtcgtccggccttcctccggcgcccatgcctcctcgagagtgtgtgcgcgcatggctgcggaccatgcggtggtagtgtcaggggctgtgtcttgtggtggcagggggggacgctggtgggcgtttaatttgggccacgggtggtgtggtcgtgtgtggtgctggggttcgggtgagtccattaagcgcgtgcggatnggcttcgatgtatatttggngacactgagtcgtcgagcgtggtcgtcggaggtagccgatgggtcttcgcggcagcccgctctgtacggatgaccggggtacttccggatcattgttggcgcatcttgcatgcgtgtttatagtgttggtccccgggttgctagccacgctgctagggcgacaccacggcgtggacctaccgccctcctccgttggtgttggggcgcgggtgagcatcaccgtgggctgcggcggggagctcgtcggcgcggtgcggtccctcgcggagtgatgtggggttaggtggaatgttgcgcttcgcgtaagggtggtggggggggagggggggcggcgcccccgggagagtggggcaacggaaggagattgagttatatggcaacagttggggcgcgcatatctctggctgtcgtgacttcgttgggtggttgcgtgactgttttggaacgtcgtggtgcattgaccttcaacgattcattcgtatgataggagcaaggaacatgaataggcgtaggatgtgtgtagacgagaattgatagataatgggtttggcaattttgcgttccgtctgctctctgggaagtaattatagacttggtgatggtactaatacctaatattatctacatcaaaaaaaaaacacaaacatttaaacaataacaaaaaaaaaatcggtcctcgtcggcaacagcggggagtgttcgcccaactc

SEQ ID NO: 12071 - DNA, 1039 bp, Homo sapiens
  misc_feature (1)...(1039): n = A,T,C or G
tacggatatttttcagtatataccccccccccccttcagaatcaggnaacatgtgctggcttattacaaaggtatattgtgtgatgctgaagtttggattatgaatgagtccatcactgaggtagtgagtatagtccccagtctttgatggattggatgaagcccttccacattgagaggacagcctgctttactcagcctactgattcaaatgttaacctcacccagaaacactctgacagacacatgcagaatagtgtttggccggatgatggagtaccttgtggctcagccgagctaacacgtaaaattaaccatcataaccccccaaattcccatatatgctttatcagtcaggcttcccacttccactttggtatcttctcaatacttccacaccaggaaacgcctgattttgtttctactactggggataagattttttgcccctgccgcttctatgccgtagattacccgctggagtggcttggtnttggaccncatcttttgcaccgaccccccgtcttttaacccattccagtagcnccccgtagcatccgctgcacccccttgtacaggatcatactccccacnccccccgcgctgcgattggcctgtacacccccttgggttcgccatccgccttgcgcgatcccaccctgcctatatcccaaccaaantaatttatcctctcttataatatattcatctattcccctcaccatcccctccctcttgntccgtgcgtgctttctatctacacgagcgactacctgacgcgctataagactgttgtaagagatgaactagttaatccatctattaccctcgcctttagtgcaccccccactactacatctgaattcgttaggcctgccctcgtactcgcgagtatcccgctcctcgcgncctcnccgcgcgccttgcttgtctgtctccctcgctcnccaagtggcaaacaagctacctgtcgatntctaattacgtcgnctcaccacgccgccgccagcggtcgcaagtgagattctcacatgatctg

SEQ ID NO: 12072 - DNA, 285 bp, Homo sapiens
  misc_feature (1)...(285): n = A,T,C or G
cttcaggaggaccatctgacatttttctgtagaggcacccgataggctgaaacgctacaccactggtcggccgttggctccttgggagctggagagagaagttggaatgcacatcatgctgacttaggtagatgactaattcacccaccatgaccttgatttggagaccatacttgacttaactgaatgccctacctggcctnacgctttactgtgtagcttctctttaggagggtatgaatgatcgtgatactagtctcgctcgctcagaacctcgtctgacgt

SEQ ID NO: 12073 - DNA, 438 bp, Homo sapiens
  misc_feature (1)...(438): n = A,T,C or G
tgaggccaacgaggccattttttttttttttttatgagcaataaggctgtttatttcacctgggcgcaggcgggctgagtccgaaaagagagtcagtgaagggaggtaggggtggggccgttttataggaattgggtaggtaaaggaaaactacagtcaaagggggttctctggcgggcaggagtgggagtcacaaggtgacngaggaggatctttttgagccaggatgagccaggagaaggaatttcacaaggtaatgtcatcagttaaggcaaggaccagccattttcacttcttttgtggtggaatgtcatcagttaaggcaggaacaggccattttcacctcttttgtgattcttcagatacttcgggccatcggggtgtataggtgcaggtcacgtaggaccctataagttgggttggtnagttaccgccagg

SEQ ID NO: 12074 - DNA, 153 bp, Homo sapiens
cgtagggtaaccaagtgaagcagtggaaggggagaagaaatgaagaaatctgtaactggtcatgatcaatttgttggaaacatcacttcacttggatcagacaatttattaaattattaatatgcttaagctataaacataaaaaaaaaaaaa

SEQ ID NO: 12075 - DNA, 483 bp, Homo sapiens
  misc_feature (1)...(483): n = A,T,C or G
ttgtgagaagctcttgctcagnngtctaggctaaacacaatgatgtgatcatagcccactgcagctttgcctcctggcctgaggggatcctcccaccttagcctcctgagtatctgcgataacagggatcgaggattcaacatgaactctagtcttaatagtctcaaaggatcaggctgagtcctctggagggactagaaacagatacaatggtttctgcgatcattcctgnaccagactggctaggagccagcaagaagagaggaaagagagagagggagatattgaaaccacattttgtgccttgtcatttcacaaggaaagaaagctttagtttctctctttatttttgattgtatctgtcttccctttctaattcttggccctattccttattcatttcttatttattattatagtctttttcgctattaaaacatccatttataagaaaaaaaaaaagaacggcctcttttggcccca

SEQ ID NO: 12076 - DNA, 351 bp, Homo sapiens
ctcagcgtcacccccaggcttattggaaatttggccttctcctacactctgcaatcagacacccatcctctgccttgtcaggaaggtcctgaattccagcaaaacagctgaacagctgatggcaagcagtttgaagacctccacagaggaaccaaatcagcatgagaatacagtttcttcatctccctcccccatgacttcaccctgcactcttccatcaatcaacaatctccacactcttaaaaatcctagcccagaactccttggggagacagatttgaggttccctcttatctcctcattaggcagccctataattaaacttctttctctgctgcaaaaaaaaaaaaa

SEQ ID NO: 12077 - DNA, 932 bp, Homo sapiens
  misc_feature (1)...(932): n = A,T,C or G
ttaaacatgagatgcccagccccggcccattcccttcaggcaacaatgaatcaggcattgagcatcaacagctgcaactacagaaagaaatgaccagacattatgtgcctcttgtgcacagaacacaccacggcctacggccttaggagaaaggattaagcatgaatctgatcaagactttggatccaactaccaatttgcgggaaatacataggatggaggaagatgttgactcaagctatgattatgtaatttaaaaatccacactgtagatagctattcaggccaaatgcaacatataaattttaacaggaagagatggagggaaaactagagattaagacacttaacagctggtaattttttaaatggaacagattatactcgccttcgctgcccattcanatcctcccaccttctaattttacacatgattcgacggccagggtagcccatctgacccattaaaccagagtggcgcactactggggaagcacggattaaaactagggccgaccttatggaggggcctctggataacttgtagaactcttctccttgacctgactgtgtggttatacggcggtacgcgaccgttccttggagcctagcttcgcgccggggattttttaaattccacgctcttcacctccatcccaatacaccatcccctatgaatacattacaccctctcccgcccctctcttgtttggcggtccacctctccccgccgtctgtacctcgcggtgatctgtgcgcccccgcctacagccgcggccctcccaccctatcaccgccttatgtattcgacatccctccctcaccaccacacctatataccatctcccccagcccccttctgcggacacatcccactcatccctcctctccctttctccccatgacttaggtgcggtgcggggagtgggggg

SEQ ID NO: 12078 - DNA, 910 bp, Homo sapiens
  misc_feature (1)...(910): n = A,T,C or G
cctatcccccgctccacaaaacacacacaaccttagcatacccggactctgctctttagcatatgcaatgctctgacttcaaacaactacaaggtacactatataacagagaaggaaatatggatgagaaatactcaagaagaaccttcaatcaaaggctgctccagctttgactctagaactgtgctgcccagcatattaaacagtagctatttaaatttaaatttcttaaaattaaataaaattaaaattccagttctgcagtggcatcaactacatttcaagagctcattaacacacatggatagtggctaccatgcagtacagatactgaacattctcatcaccctagaacattctattgcacagtgctccttcacgaagtactctgaactatttatttaccagcttatcttancatcatgtgaactgtgtactttgaaaaaaccacttctggctagggagggaacaatcaacaacatccaccccactctgcagtgcgtccctgccctactcacaccggcaccaggatcaccaattagatccacgcctcccccccgaagcaacggattcaggctacgaagaccaactctggacaaaagggcacacacccggatcgtatttataaaacctcatggaccaaaattggaaagaccccacggaggtcgctggaagacaaaagcgatcgcacttttcgcagaagaatcttcccactctcagacaccagcccctgaagtgcttctgaccccctggaattcgcttcctccccttccctcccccccctcttctatgccccgccccaccacgcctcatcctctccttccccgctctccccaaacttttccgccccacagccgggactgctacattcgacacttctacacnccccacaacacaaaacacgtcgctg

SEQ ID NO: 12079 - DNA, 1973 bp, Homo sapiens
  misc_feature (1)...(1973): n = A,T,C or G
atctatctactcatacagctaccagacttcatctctgacaacactacnacaccacaacacnaccaaccnnnncnntttcagcantagagttacnttactgnagagacangtanagnncncataggnncngttagagngacgtgcgacangncacacaccacntcnacagcncgtcgtctgcgcagcgcgangacgcaaccncnacacatcgtagtcgcataagagtnactactcaganatttgacataggactcatagtatctagtatcaaatcancagtnctaccgcctnctangnangcgaaacagcagantactatcngancgcngccacactccagtacgacagtgtcatgacncaacgtatgaccgtacggcatcatctctcatacgatctgcactacgtagcccactgccagccctgctacgtcgttactcgtctgtacgangatanactatagatgacacacaaaccgatagatatattaatnaacantctcacacatagcgacacaatggatcagctggatgtgtcgcgcgcgnangnnnatccagaggacatgacagactacacancgancacgcagtnacgatctgctacgtcactctactattgttcttctatgttatgtgtgaatctacgcgagctcacatacgcacncgcacccgcgctgncgcgtncgcaccgcccnacactccacgtgtgtgttactcactcatatatgaacgcgcgcacgtagangtcgcnnacacacactaagacgcgcatgatacnatcgactncntcatcantagcgatactacnacnagacgtacaatcgctctccgtcttctgcctnctgctgtctnctntacgtcatccagcntgtatccactnagagtcantgtgagatagtgacaaccgacatgtgatatatntnaaaccnacacncatanctnacgcaatnacantccntntccttcctccnctcctccgntcctccagatctagatgtagcccgcgcgtctgcgcgncgccngcagcgtagcgcgcagagcnccacacccgcaccgcgcgacgcgcgtcagatatagcgcgtcgtcgtagatgagcggcncncgccgcccgtctgctcnctcacnttactcanntaccacctcgagtcgactatcctacttctcgtcattatanatcaccccccncactctacgtccagccgccgngagaccgtagacgcacacacacacaccatctcttctccgcagctctactaaccgaacaccgcacgacatacgtaactccgtatcactcaacacgatcaacgaccacgtcaaacgctatagcgagttaacactacatgcatagaagtagtgtcagaacagacttatatcaccacatatatatatatcattntngctntntacatgcgtgaggcgtagtctcacatcaaaacacncctacgcacgcgacgacgaagcgcgcacgcgctgagcgatgtgtcgagtcatagatatcatctcgcagatgactgnagtgggncntcgcactgcgtagatctntcacgngtgacatactataggcactaactcggcgcgcagcactcgtgtgtacgatgtctcacacgtgacgtcgtcaaccgccttatgtaactatcgcatacacattcacacaccanagtcggacntctcagcgacgccgcagcagagccagatctatcccantcacacgcatacgaccgtgacnacacattanatgcgcagcgctgtccgacncagctacacacgtcacacattcctgtctgctgtgntgactacgctacagtntccatgtctaccngaaacagcacgaactgcactccgattatgaacgtagacntgacagcgctcncgccncacgcgcgcatcaaccacantactnactctcgtctanatcgntctcgccgcactgctcctctatagcatacgaggagagangaggagatagcctgtagacgg

SEQ ID NO: 12080 - DNA, 160 bp, Homo sapiens
  misc_feature (1)...(160): n = A,T,C or G
aaanannncncnnnnnnnncnnnnnnnnnnnnnnnnnnnnnnnnnnnngtnnncnncccnnccagcnnntttntgntnnnngggnccccaaaaagcnnccgccccccctttttttttttgaaacgcccccccccccccnnnnnccncccccccccctttt

SEQ ID NO: 12081 - DNA, 1266 bp, Homo sapiens
  misc_feature (1)...(1266): n = A,T,C or G
ttaaantcctgnnggnnttnctcctnntgtncttaccaagttctggtagtgtagtcggttgaagatcatacgtgataacatgtagaaatatgtgtacatcctggaggttgttgatacaagactagttacgtaacttgtatatacgatgctcggataacgacttgtgacatatacgttctgtagatataccaatacacatcggtaagaatagtatgagttgagantattgatcgtgttgtgaggagagaatatatggagtgacagcgcgggcgccgcgcttggggtggccgagagcgtgtgtgagtagtaagacgggaccgagngtattgtatgtggtggatcctgattagcgcttcatgaggcagagaaagtcaatattctcatttcaacactacatgatacggagctacgctgatctcgacacgataaccggtcctacgccacacagcggcacagagagcgctcgacgacgcacgagtatcgcctagcccctgaaccgccctctgtcgtgacacatcgcgtgcgccacacagcgagcacgcgtantatcggcggacactggacagcaaacggctcaataggagcgcgccatccacgcacgcgctacgtcgagccccgctctctcatcctctcgcctagacgcttcgtgtcgcatcgatactcagctagagagggagcgatccgccgctcacgcagtgtacattagtggactgcgggtatcacctcgntagtatcatgtcacatgtaatctatagtcagtgagacgacgcngaacacagcaatcacgaatgagtcgcgacgtcatgtacgcgacncaccgcggtattctattctngtatgtgacgcgcatctcncgagtgcccacgccacacacgcgactcgcgcagatcaacacacantatggctcangatacctatcacctctctacaccagtcacgagccgntgcgactgagccacaactcgccgacantcgctctgacacacagctcaacccagcaacatcacantactcgacacgccgacacacgacagcgtatatagttgggcacttaccttacgtgctgtcgtgtaacaccagaagcgacgcaagatatctgcacatcttntgcgggacgcacgtgcgccagacctcctgcgaggcagcgcacgtctcgcattatcgcactcagcacacacgcgtgcggacgcgtacatgagtccgtgcgatacacaccgaccacacacgctcgagacgcaactggcgaacacgtacaacgagatgcgt

SEQ ID NO: 12082 - DNA, 934 bp, Homo sapiens
cttaggttttgcaggaagcatggtgctggcagctgctcggcttcgatggaaccctcaggaagcttacagttggtggaaggtgaatggggagcaggtgtatcacaggatgaaagcaggagcaagggagagagagtggctggggaagggtcacacttttaaatgaccagatcttgtaagaactcactatcatgaagacagcaccaagccatgagggatctgcacccataattcaaacacctcctaccaggccccacctacattggggattacaattcaacatgatatttgggcagggacacatatctaaactatatcagcactggagttataaactgcatctgctagaaaatattgagcaatatcaagttttcatccgctgctccaaatgcagcaagagaactgagctttacctcaatactcaagaagctgcaagacaccattgagcagagaacaaaaattgaaactggggacatgttctgaatcagaggctatgtctacatgtgcagagaagagtgacaaatttatgccactgcttattataaaagtggacgatccagtgtggaacattcaaattgcaagggtgtttgagctgcccattaatctacaggaaaggttaaaccaagcctttccattgcccagtcttaaagaaagaagaagcacctaacaatccaggtgtcctggccttcactagtctcatgggtttgctgagtgaaaaagccaaagaattccccataagaacaaagggcgaactttgagccacaagagttggaatgggtgacgctttgttgtccttgctaaccagcctgtacctgcagggcctggcttaaccaaggagattttacaaaggatttcctttcaaggcatttataccattattaagatggtcttcaaccgctggcggaacaaggactcgctctcacaaagaaggtggttt

SEQ ID NO: 12083 - DNA, 301 bp, Homo sapiens
acccaagccctctcgtcccaccagggaaaagggtcgctagctactgtccacacgccttgaccggggacctcacagtgcaagactttccatctggtaacactgggaccacagtcacgagctaccgaccctgctctggtaactttagagatcataccactgaactaagtaaaaacttccagaaccctaataaagaactgacgcattcatgaagattgcgaacaccacatcgagcagaacaagaattaattacgacgggcttctcttataggggactaaaaggacagccacgactctccgcagc

SEQ ID NO: 12084 - DNA, 911 bp, Homo sapiens
aacaccccccctagccccaaaaaaaaaaacccttatggagaccctgccgtgaaagtgatggaagtcatcgttctcgctttgaccgcacatagttttctaaggagaaaaccatatataagcttgaatactcttttctagtattagatactacagagatagatagacagctgaacaatagatctgctgtgttaagatttgtctcgagaagatatcaagagactagggtgaaaaggatctatatgttgttttttttaaaccagggtgcgagctactaaaagagcctggaactgatgtatcgctactcagactgtgcttccaacaaggcagactctactccgctatcatgtgacatggcagcgccagaggtctagcgccgccgcgctactcccgcgtcgctcccctccccccctcaggtatgacgcacagtccaggcggtccctacatcttcggctaataatctatagagtccaccgtcccccctctctacccacccggccgcggtctgcccacgccccccgccctgtaccctgcgcccactgcgccccacgggggagagacacggccaccccgacacaggctcctcgcgctcggggagctgacccgcccccacgtttttcattctacgcgggcacactagttaccagccgccgccgagacattctgttatagctggtaggtaacgcacgtaccgcgcttaccgtcatgtgtcaggccggcagcggtggctggggcgtcacgcgtgttcaatcccgtctcgtcgcccgccgccccggtacccacctaccacttccttacctgagacccacccccgtgcgccccccctaccaacctctgtgcccactcatactcacctctatacttctacttcagtataacaatttccccccgccgccgcccacggcgggcgccag

SEQ ID NO: 12085 - DNA, 983 bp, Homo sapiens
  misc_feature (1)...(983): n = A,T,C or G
cgtctctctcttcttgtttgcctgtctgcgttgctgncgctgtggtgtcgtgtcggcgcgctctgcggggttctccgcccctgccgtctcctgtcgccgtctcgtcttcgtcgctctctggtcggcgtggccttggtgggcgtgccccctatcctctcctcctcctgcttatctcttcgggctctgcgcgccttctgctngcgccgtttcccactggccgctcgctccggccgcggccgccgccgttcgcctgtgtgtttggccgtgcttcgcgcccggctcctgctgggcggcccgccccgcgcccggccgccccggtggggctgtgcctctcttctcctgctcttcgggactcgccctcgcccccgtgtcgctttgtgctctcgcctcctcggggtggccggggcggcggtgtggctctcgcgcgtttaccgcctttcccgccgctcgcctcacccgctcttcgcgccttcgcctctcccctcgcgcccggctggggcggggcccgcggtgtggcgtggttgtgggcgccctccctcgcgccccccctccccccgcccgcccccgccctccccgcggcgtggtgccgcccccgtgcccgggcctctcctgcatgcgccttccgggcccttctgtggctctgggtctggactgctcggcggccgccccctcttcgccgtcctcccncctcccgtcttccccncccttcaaaaagaattttttttttttttgtgttgtcttggcgcttggtggctgcggcggcccccgcgccttcctctcgccgctccggggggtggcgcggcgggcggcgccggctccgcccgcccccccnccccnctcccgcccgcgctttcctcnctcccccngggcccncccccctcccttaaattctttntcnnccccctcnnncccttccccccggtttcccccccgagggcccgcccncggttccccccaggccttttttttttttttctttctcg

SEQ ID NO: 12086 - DNA, 918 bp, Homo sapiens
gctcagcgtctacccacctacaagagatagaaattgcctaaagtcaagtggaaaggataagggggtctcacagattcaagaaacagcaggcactgccagacatcatggaaactgggagtgtagccctgaaagccctcctgcccctcacagggctagtggtccctcatctctgattccctctaaagtgtccccatatctgcttaacttagtcgtactctagtcaagtacatagtacaattgggtcaccagctccaacactccattgtgatttcttcaaccccaaccatctgcttctctatgtctgtgtctcttattataaattttggcaaaatgaaatctgagcagataataagctatgtgtgggcacagttctttgctctaggaacacaaatgagtcagatggtcaattccggttcaatcacgggccacatctgaataacatcttccccctgtttgagtacccactgactacgcctgaccacctccaaaagggagaaactctcttggctcctgggtgaagtggggctggactcagtccactgaagcttacctcacttccctaactaagattgactctgccttcccccaacacgtgcttatactcttgagcggcccctcccttactccgtctggaccacaccccctcacttcctaactcttcactgcgaccactggaccgctgactcccgtgcatctaatgtcttcacccactctaggccgcacttaccctccctaccaccacgctcgtcgacccgccaccgccccctctcactcctcccccgccaccctctcttaccctcttccatcccctacttacacccatgcaccacgtccctaccactcaaataccttctagtcgcgatgaccctacgcaccacccccccgccccaccaagacacccccgcatacctcaccagt

SEQ ID NO: 12087 - DNA, 923 bp, Homo sapiens
cttcaggtgacgagacaaccagattctgcagtctacaacccagaagagaagaccttcatccgaacccaaccatactggcaatctgatcttagacttccagcatccaaaactgtgagaaataaatttatattgtttatagccacccagtttagggtactttgttaccaaagtccaaactgactaagacaacatctctttcacaaagggcctctgttatagcaggctacttttttagccaagagatacaataatgcaattgaagaatgacatgcatcgtacacatttatgcttgaactccataacagtccacattgcctgggtgcactatgaaagactaatttcacaaatcccataattatcttgtaacacaattatattgtagtatgcgttatatattagtggtaattacctcaatgtaaacatttagagtcgcacaattttaaaaggtctgtcttgcgggccacgcgcacttgctcaccccctgtatcccggcacttctgaacgccgacgtggtcacatcacaatcgacacgatatcatgaccatcctggttaacacatctgaaacccctctctgcccaccaacacccacagccctctcggcctggaggagggtccctgtattcctcctaactccgaacgccagggaagacaacgtatacaaccttagggccacctccaatcactgcgaatctgcccccgctcgccgattccctcccgacgcccagaacgagcaggccacattggctacccaccggactccctgcccccgcttcagtcgcgtattaatgcacaagcagcgtcctcgcatccatgactgtcgtatctaaaccgtctttaatcaaacgagaaaagcgaactccaaatcgacttaccctctctcaacacctcgctcacacattatatgaataagaggtaatagcgt

SEQ ID NO: 12088 - DNA, 944 bp, Homo sapiens
  misc_feature (1)...(944): n = A,T,C or G
gaaaaggaaggaggaagaggaaagaagaagagagaagagaggggagggaagaaaaaaaaaaacttaaaaaaaacaaaaaaaaaaacttaaaaaggggggcgcggcgngagaaaaaagaaggaacaagnnaaggattaanggggaaacggggggggggannaaaaagnnaaggctgtggagcgggcggtaacggtgatagagtattgtccagctctcggcgtgcccgggtaaaaaaccccctaaggcagatcggggagcgggacgtaaaggaaagtcttgtacgcaccgcgcaaagaagacaattataaacacaagagtacaggagggatgtcgtggggtgggggggtgggaggtgagttgttgaacaagaatctaaaatagagaagagaaaaagatagaaattcagaaacaacactcgcactatatttgatataaaaaaaaaaatcagaccactgaaacaaaataccagagagggaaaaggacgagagacacttaccaatattatttattgttaatatcgtattatgggaggttagagcgacgagaggacggggtgcagttgcgtgtgccatacacgcccctatatattctactagcccatgccgacggggcacggggtggtagggagaaaacgcgcgtcaggggggagagggcctgtgcgggttgtctaagccgcgagatccaatcgcgaactatagaaggagccaggctgtgccggtgaagagcgtatattacagtctcgcctccctgccaccagtatctacattctagttaaagaagatgatagaaaattcgaggtgttaatgtagtggcgtcgccttatatatatacaatggcgcgactgtagagcgcggtgcggatggataggcgtccagtggtgcgtcggaggaacgaggctgccgagatcggaaaccgagaaattcgtagtatagatatcatccgat

SEQ ID NO: 12089 - DNA, 886 bp, Homo sapiens
  misc_feature (1)...(886): n = A,T,C or G
cttcaggttctgcccagttggtttttctgngagtagtaattactgtattaaagtacgtatgtgtttcaagtacctgaaactacggaagagtgtgcgaaagacgattctgatgagttattctccatgccccagacctccttctccagatttggctgaactgtggttgaaagaagttgctcttccacttgaggaccatcaacttgtgataaattctcaatctctgtgaataacagtattagagggggggtcatagtgccatacaagtttttgtaaagcatacataactgttattgttattttgaaaacaaactacagggtcctaatagagattgcctgaatatatttaaatactctgaaggtctgaatagaacggaattggattgcgatgcacaattctatacaccatacagcgctgcactggcatttcgagagcacacgggaagccccaccggagagcgcttcgcctcttgtgtctcggcgcgctcggaggggttggaggggcgttgcggatggcacggggctttaatctgactcgggcgcaagggagggcgctctggcaacccgcgccgccggctagcccccaggcagaggttatgccggtctcctaggcgccccgcgcccggcgccgcccggcttcggcgcggcgcgcgtgcgtcgcgcctcgcgcagcgctgctcggggaatagagcaggcgacggggcgggcccagtcctcgtcggctggcgccccagcggcgtgcggccgcgcgcaacgctccgcctgctgacccgcccgcggtaccgccgggcgggcgaggccgacactgagaattagcccagcgggcccgggagggtgtgggacggcgggcgctgcgtgacggcgagcgagcaagcaccgcggtgtgccg

SEQ ID NO: 12090 - DNA, 598 bp, Homo sapiens
ctcagaagacaactggattttgctatttactcctcaattaactctgttttggttgagtagtgaagaaaatccagcctcacccacctatggagttggaaaaaggagatatatttgaatagccttttcagtaatattcattggtctatccactttcaacggatcatttacccactcatgatttttaacatcatctgttggtcatttggaaaatatcggctcactgaattaagcagatcttctcaggggcaacacagcggaaaaggccataacaacttagtattactatgacaacagttttgacttcattgaatcctgaaaggatcctggggcttcaaaaggatctgcagaccacacttagacaagcgccgttcagaatcactttggggactcagagaacctaaatgactctcccggtgcaggagaacatgcacacttcattccagaggattctgacgcttaccctgcttggtgcagaacttagcgagtgccccctgtttaagagaacagtacactaaaatctctaacaaaaggaaaaaagtaggttgccctaagtacttagccagatacataaaagtatctgttaaatctccgaaaagaa

SEQ ID NO: 12091 - DNA, 734 bp, Homo sapiens
  misc_feature (1)...(734): n = A,T,C or G
cctaggggacgtttccctgcactttctttttttgcctgctgccacttaagatgtgacttgctcctccctgccttctgccatgattgtgaggcctccccagccatgtggaaatgttccaaagcctctctgtttctaattgaatcaaacttcagaaggaaaccagttttgctgtcacttgaatgccatattgctttcacatctttaccttttgctcttaccatttccccattttaagtattcctctgctgtcttaactggacccattcttcaaacaaactccgtttcttgcttcttcatgaagtgccttctctctaccacaatatgtagagctttctcctcttctatgtcctcaggaactttatacagatcttggaatatgcaatatcattttattaattatttaaaaaatgttccctgcttacctcaacctaattgaaaaagcattgagatcagaaaatgtgttttatatctcttcccatctgcattgttaagcacatattagaacctcacaactgttaagtaattttgggggactaattaatgagctaataaaactgtattttgatgaatttacttgataatacacagtattccatgtgatgttgaattccatatcattaattatatctccatctanagaatgcaatcggctgaagagacaaggattttaccgagtaaaagatatttctaaaattgaaccctaaaaaaaaaaagggcctccttggcctagccgg

SEQ ID NO: 12092 - DNA, 1015 bp, Homo sapiens
  misc_feature (1)...(1015): n = A,T,C or G
gggggggagggtgggggtgttgcaccttcagtaacacatcaactnctggaagaagaatccaaatgatcaacatgctttggaacacataaaagccatatggttactaggaatgccgaaagtataatggtatgaaagagcaggctcgaaccttacaggcccatttgttcttcatggaaaatcacacttacagaccatttatctttaaccactccgtgccgcaccgtttggatgcttatctgtcggtagaattattcgttatatcccagtggggggaacgctcctgcaaatctgtgcggtgtgagctctcgatggcgctcgctcctctacaacgctccactcccccggcgcccaccacgcgcgacggcgggccgagggaagggggacgggggggcggaaggtcacacacacctccccccgactcttcacacggtactctcccgccttaaaggggcgaggccgcctgtacgcgagcagggagccccggcgtgacgctcaaagagtacacagggaggtgcggctgggcaggcgacaggagtaagccctaatggcgcgcgtgggtaggagaggcccatgtggggtgccggggcgggccccccattgtgatagcgtaacggaacgcgtacgccacggtgtcgtcaaggcgccgtaggagcatttgatagagcggnnnccccggcgcgggtcccggctggtggtcgtcgggtcaccgccgctcgcctgagggtatagggcgcctgtgcgggccgagcaggcgccgggcgctctggtagggcgagggtgcggacgtagagtcgttgtgtcgcgggtcgccaccccgcgcgcggtcgcggccgtcgtcgcgcgggccagtgaatcggggagacgncccgccgggagcgagcccgcgaggtgggcgtacgctcgaggcggcgcggttggctgcttcacgggagggccccctagtctgatcgggtctcgaccgctcatacgtcatcgcccgtggataggcaacgtgcgaagccggctcgcagtctgc

SEQ ID NO: 12093 - DNA, 940 bp, Homo sapiens
ataagagcagcccacggcgaagacaaggaggctctccattggacaactttatatgttagtgaagaatcatttgctttctggattgttgtatgctactaaaaccgaacaaagaggaggaggggggggatgaatccaccgaccatatcaccctggcacctatatcagctcaaaaactgaacgaaataccgctttcctgccctctctttaactaatgctatagactctgagccagcacggcctgggtgggaactgagaccccacttttctcgaagaggggggggggtcgccatgctggttccccctctcaccacgacttagaacaccagcgcctgagacgcacgcggacacctcagcccggtgacgacaatgctggggagccgtgcagaaggtacgccgcgccacatcacggagacagaagctggccgtgggtgcggagcggcccgtcgcgggcgcgcacggaggtggggatcagggatagggcggatacgggatccttgaaggagcacgtctggcgcgcaggcgccgagcgcgggcggctctcgcgccgcgacgccgcccggtgcgccagtttaattggcgcgcgacggcgcgcggccgagcgcgttcggggggtgcgggggtttggcggggtgacgcgggtaacagcgtgccggcgcgagtagtagaccgtcggcggaagaaggtgtgccggggcgcaagggacggggcccgcggcggatgggggggaggggagcggcggaagggcggggagcgaagtacgaggatgggcggagcgcaatccacgcgccaccaactaccctgccgcacgcaccggacctagtgcgcggcgcagtcgacaccggccgcacggcggaggatagcaaccgggcgggcgcggcaatcacacgcctcgcgccacggccggcgctcgtgacgggagccagctggggcgtgtaggagg

SEQ ID NO: 12094 - DNA, 920 bp, Homo sapiens
  misc_feature (1)...(920): n = A,T,C or G
cttcaggcatacttggaaactttgattcaagaaatagagcggttggtaataatctctgatgatcagtccgagcttggcattttcatttacagagtcttgctccgttgcccaggctggagtgcagtggtacgatcttggctcagtgcaacctctcaagtttaagtgattctcaagcctcagcctcctgctagctgggactacaggcatgcaccagcatgcctggctaatttttgtatttttagtagagatggggttttgccatgttggccaggctgctcttgaactcctgacctcaactgatcctccagcctcagcctcccaaagtgctgacattacaagcataagacactgtgctcggcccagtgcaactcttttgatacaaggaactattcaaaaattatgtcatgaaagttggtttaatggcatgttgtcaagtaggaaaagattttaaaaataatttatacataattcactgtgatttttaaactgtaaaagtaaaactatagattttttttctctatatgtcagagaagactagagggatatatacaccaaaatgtttataataattntttcctttatgcttgtcaacatttcccagtggtaaacataaataacttaaaatgacaaaacanctctaatatgtacttttaagttaagacaaaaaacattntggatggtgtttctgtgtttctataattcatctgactctcagaagagagaggtattnttgaaacaatcccttatagggctggcactgatgtggggtaacaagcctatagtgtcttgcttgccagaatttcctttttgtctacaaagagcaatgtttatataagacatattttattagtttctaagaaattttagaaaaggacatgttcctttcggctttttaaggaactgacaaatggcttccagca

SEQ ID NO: 12095 - DNA, 321 bp, Homo sapiens
aataactgggagatgaaacaggaagctctatgacacacttgattgaatatgacagacaccgaaaatcacgactcagccccctccagcacccctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaaaaaaaaaaaaaaa

SEQ ID NO: 12096 - DNA, 918 bp, Homo sapiens
ctcaggttactgccccaaattcctcactgcctcctatcaccaaagccacccgccaccgctggcctcctgcatgctgtgggaggagaggagggcagacaacgttgcctcccctgactcccatcgtgcgggcttgtgagtccatggagcgcagttgtccagggaactatccgatgcagcatgaggggaaggtgatgcagcggcatcccaccttgagatgagagaaagctgttctgggcttccagtgattggtagctgaggtcactcctttgtccatacccccgccccgagactgtttccagtgccccaaattcacctcaaggatcattgcacagcagaaatgtaaggaggccaccagccaagaaatgctgtcagtgcctggaagctggaaaggcaatgaaatggattttccccagaacctccagggagaatatggcacagcttctaccttgattttcacccagtgagacacattttggatttctgacctaaagaattgtaaggctgcctggatccccagagtttgtcctggaaagcctcttgagatggggttatgtgctccgaggatcccaggaggaaggatggggcaagagcagacaaacctatgcctcttgagcagctgtaccgttgtcctggaagggaccccagccgtggcttaaggcacacctgccttcagaggactatttgggatgcttaagggacagagaggcacaggactatcaaggtgaactgttttttcacttgttggccccagccagggcctggattattctgacacaagaacatgcaggccctttctttgggaaagctaacagggaccaagcaacttggagggccgtccctcctggcaggaggagggagctcttcaggcctttttcctaaaaagacttgggcccacttccattacctgaaggtaaggcc

SEQ ID NO: 12097 - DNA, 755 bp, Homo sapiens
  misc_feature (1)...(755): n = A,T,C or G
gtgttccaagatcccagaagaaggttgggcaagaccagacnaactatgcctttgcagcagttgacggttgttctggagtgacccccaccgtggctcaaggcacacgtgcctccagaggacattttggatgctcaggggacaaagaggcagagggactatcagggtgaagctgttttttcccctgtttggcactcagcccagggcttggatttatcctgcacaaaatgaacagtgcagggcccttcatctggggaaagcctaacagtggcacccaagcagagctaggaggtccaggtcctccagtggcagggagggagggagctcctttccaggtactttctttcctagatagaggatcttggtgactcatctcccagttcaactgtaaaggctaagggcctccttgaagtttccttccttatgaaaatgtccatagcaagtttgtcacttaggaatgtttttcaatgataggaaacagaaaagccaactagtaggagatgaaataagttgagattttttttttaatagcaagaagtctggatattgtcagtagccggcattggtttaggacacaataatattggggatgatgtcctgtatttttcttggcctttttcttagagtcacaatgtggatgccatggctcaaggtatcacatccctattcaaggcaggatataggaggaagggatggtgccagatacatctgtcccatttattaaaaagcaagcttctccaaaaaaaaaaaaaaaaaaa

SEQ ID NO: 12098 - DNA, 593 bp, Homo sapiens
tcctatacccctacaatgagctttgcctctactctcccatctgagctccagccttcgcgtgtgactccgaacggtggagttttctcctaaatccattcatcttgccaaaacactgttcacaatagcaaagacatggaatctactaaatgcccatcaatggtagactggataaagaaaatgtggtacatacacaccacggacaaccatgttttcataaaaaagaatgagatcatgtcttttgcagagacatggatggagctggaggccatcatccttagcaaactagcacaggaagagaaaattaaatactgcatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgtgtgatgaaatcatctgtacagcaagccccatgacacaggtttacctatgtaacaaacctgcacatgtacccctgaactgaaagtaaaagttaaataaaataaaaaatggcctcgctggcctcagcggcgaa

SEQ ID NO: 12099 - DNA, 375 bp, Homo sapiens
ccataaaagccctgggctcggccacagcagggcaaagaccaggggacagagagaggaaggggataactacctgcagagaggagctatcctctttgctgagagcttcagaggcctgcagagacatctgaacaacctgcctacaaagaggagccaccctcttcagagcctcctctctgctgagaacagcagacagcaggatgaccagtgggcagagaagagctaccccctccagggcctcctctttgctgacagctgaacactccatgggatgacctgcctacagagaggagctacccacttccggtctcttttgagccattctaacactaaataaaattcttcttcatcttcatcaccaaaaaaaaaaaaaaaaaa

SEQ ID NO: 12100 - DNA, 427 bp, Homo sapiens
  misc_feature (1)...(427): n = A,T,C or G
cctcaggctacgaacactgttcttatgctctttactggtgaagttgggcctatagtcagcttattctctccatggcaacccactggggacaggctgggtcagaggtaggcacccagacgtcatgtccatctgagtcatccaagggagctgagaggcaaagaagacagagctatggctctggtgctttaccttgagtgaaggggacacccagtggaatagcaaagatgngtcnccagtgaaaattcaatccaaactttgactttggggacatcatgaccacactaccaaaagtcaatctgtgttgcctcaggttcttcgtgtttgaccactttttggagttgcgtagattaatttgaatgtcagtaggataatagaatagttacagatattaaaataaaaatctgttataatagcaaaaaaaaaaaaa

SEQ ID NO: 12101 - DNA, 747 bp, Homo sapiens
  misc_feature (1)...(747): n = A,T,C or G
ctgtttacttgtgcaattttntgttttgtttttaaggtaacccttcgtcctggttttgtggactcttttgacatttttagtttatgcataatttaatgatgctacagattttaacctcatcactctcagcactgggatttctagaaagaagcattagtgtgttttacatgacagggaaacaaaacaaaacaaaaaaaacctctgtttggagccagacaggtctaaattcaaacacctctttttaagcagagagtagagtgacctctagtatatattttatgttctttgagcctcagtttccacacttataaatgcagtagttataggctttggtaatgagatcatgaatataaccctgaggaatgatcctagcaaagtgcctgatacattgtatactctaagccttgctgcttaaagagtatttcaaggtcagcaacagcaacaagcagggccatgtaagcttgtagaatatcaggaccagtcgcagacttattgagtctgtatctgcatttttagaaagatttacagatgatttgcatgttcattccaggttgagagtcagcttctatattactattagtactgctacttgtacttcttagtttttactcacagtgctctattagagcaacttctttttgatgttctctagtctaattatattaatgttgaagtttaacagggagaagtacacatattatctgagtgaggtccactagagtggatttgaaaaaaaaaaaaaaaaaa

SEQ ID NO: 12102 - DNA, 422 bp, Homo sapiens
ctcaggagcttaattccccctgtagtgaaaggagaaccaaggcaactattccagcagatccaccctatgaactggaagagctcctgatggctgaatacatttgcacaccccatgttcaccagctccaatctttcccactgctcaatgccaatcaatgcctacttagaaaaagctactttcccactcctcatggtctgccaaggaaagaaactgttactggatcaaggagcttcagagaattggaaaaggtgaggacacagcgttcctcccctctggaggatgaagaaataaggtgccatcttggaagcagagaacagcccttgccagacaacagaagctgccagtgccttgttttttgacctcccaggatccagaactgtgagaaataaagatctattctttataaattaaaaaaaaaaaaa

SEQ ID NO: 12103 - DNA, 452 bp, Homo sapiens
  misc_feature (1)...(452): n = A,T,C or G
cctatggggtacagagaccagaagccttatggatggaacatgaccagaccatacatgaagatagaactctgactctacaatctcttcagcaaccagcctgcaaatccaaattacaatcttggcagcaatcaccccaggacagcgaggatttgatcaatgactaccagcttctctatttttgtgccccaatccctgcatgatttcaactcaaggccaaccacagaaagccacncctcctcctgaattaattccctaagatgctctgcttttagatagctggccttcaacttccccatgccaacaacctccaattagatcataccttaacgtatttttttcactataaaacttgcctactcgtttttgagtctgcccaacgaaagcgatgttggctgacttccttgttatagcaagatttcaataaatgaattctgttggttctcaaaaaaaga

SEQ ID NO: 12104 - DNA, 1667 bp, Homo sapiens
  misc_feature (1)...(1667): n = A,T,C or G
agatggtggtgatgcgcgaaagttagagaacatacaatgtataatacttataaatgncaaatgctaganagatatctcgcacgagagatggagcccagcgactagaaaagtgagaaaaagaaaatacaagaaagaataaagcgtgaaactagaagagcgacacgcagacactacgagatcgggagcgtagtagggtgagtatgtgctggatgagaagctgacacgcgctacactagacgagcaatattgcaccacatcaataggacacaaacattaaatatgtgtagttgtttgagtaggagatcagtattatcatttttatggaattttcatctctcacgaagacgcctctaaccaagaaagagatataataagacgaaaacataagcgaggatacagatagaggtngtgcctcgccgccactccgctctccgtcagtttcggcgcatatccggtctgtaatctcgtttcacgtgtttgcccgttcgggtcgttcgggtagggtagcatctaattgcgatatgcgacacacacgcaggcatccggcattaaanagagaaggatgattgtagtcgcgcgaggtctgagtcgcgattagttgtgaatgtcgcccgggttccatattttgtgcaccatacnccacgaaagttattctaagtaatatctgattgagccgagcgacgttatctagcggcagtgatgttctaccgcgttgttcatccagaagcatcacagtcaccgaccacgaccagacgacgggcagagtgtgatttgcgaagacgtatagaaatattactccagtgagttcaagacgcaatcgcagtcgttattgtccgcgcgctgtgacgtgtgtatcgttatgttatcgaccgccactcgtccgcacctggttatgtttattacccatacacgtggtatggaagataatcagacagtatagtgaagagaatactataggggtcatgcgtacgtcagtgatctgggtgtatctgttgtgctacgcgcgattttgtgcccgcgatgttggttgtggatgattggcccgttttggagtaggcttacgctggtcgcgctacttattcggagttacgaccgcacagagcgcatgttgtcgcaccatgggcgtgtaggcgcaggagaatgagtagatgcaaggttagtgatgagattgttttgcgtgaatctctgctctcgtgttgtacgttcgcgtcgcgtatgttattgcgactgtggcctagtctcgcaactcttggtttacggagagctgantnaagacagatctcagcgtgtaatcggncagaagatgccggtctggtacgagattcgagaaattgacacaagtcggagagccggttgtgtatgtgtagtgtaggactatatgnatgttatacaccgcagagagacagataatatatatacgacgntgaattctactcactgtcnanacggcagtcgtcacgcactcacatactcagactgacgtgtctcagtgagggagcaaggcgtccgtntcgtctcgacgtcacagcgcggaatgttggtgatagctatgctagtagacactcctctaaggaacgcgtacagatgtgaggtgctgcgttctagtaggcaccagcacatatgagactgatggtgtcataagatgtcgcgatattcttactttcaac

SEQ ID NO: 12105 - DNA, 2291 bp, Homo sapiens
  misc_feature (1)...(2291): n = A,T,C or G
ccgccccgaanccgcagcggccggcgcgagacgcngcagccgagcacagccgccagcaagagacgcgnagccgcgagcagacgagaangcacgaagagatgnttttgtnggngcngcgcgagcacaccacacacaaaaacacccgcgancagcgcntnatgtcgaacacgcacgtaccgatcggacgaaancgcnagagaaccagccgcggacgacggccgcntgtagatanatgacngttnaccgngacacgcacacngaccgntangcncgaccgcgcgctacaagcagcagatntattgatntnatgtngtgcatggtgcacntgnantagangacgagccacaccacgacgcgatgacgaacagcgcgctgatcacgacngntgtgcgcacatnctgcngcggatgtcgtaggcagagacgagagacagcacagatgacgtcgcagancagctattagtatttcgagnatgatatgatatagatctatgccacagctagtagtcgacagaaatatatccgtatacaacgncgtgatgcagccgccgtactacacacgcnatacagatcgacgganatatctcatagtcatgatagtatgtgacgagtacaaatatacattganatatagatgcgatatcacacgtacgtgatcgccgctgcgncaatggtacaggaggatatagacgctcgcanaatacgcagtatataccatatcaggatcttacggttaaagagggcacaattaggatatggtatgcggtgagtccaggtgtagatatctgtgagtcngaagatatacggcgcgatcagcagcagcgagcaagagagagaactagacaactagagagacgagacggatgtgacgagatcgcacgacgagatgtgtgtgtctgtcgcgatcgagtgtctagaactagctcgcccgcacgatgtagtaaatagtattgantatcgacgaaagtctcagaccgagtatatacgagtacgctgctgagagtagtataataatcagactaaacacgacaagtgangatgatgcgnaacntagaatagtaacgancgcaggtgcnggcgatcagcgacgtgcagcgtggtgttgcggtccgcaacactntcatcncgcaccagttgacagtgtatnaatagtcgatgagtgatctactgatgaacacagtaagataacacagccgcgctctgatnaatagttattttcgacagtcgactatagacggtgagntagtatatgttggccacgcagccactatcgtctctgcaacgacctgtcaatagatgtgatacacgacagcgcgcatagcgtgtgcagagcgattctgtgccgaacgtaactcaattgatagagatcataagtacatagctgacatactatancagcaaagcgtattgagcgtgtataatatacatgcaccgcgcacgcgtagttgcacacacagaggacantagagtatgttagatcacaactcacaaacgtatntagnccagcgctgngtagcacgtggagtgtgtacagncgattnacgtcagcaacgatgcgacgacacgcgccggccgcncntancgtatnccgcgacgagcgcgcctgcgtcgntacccgcatctgtctatgattnagtacgagcgtgcacaggtgcgaagatcgcgacagcncgtcacatgngntcacactcagagnacgcgngcnacacgagnccggctcgacgcgcgcngtgtangcggcgagcgacgatcgcgtgagagtagagcagtgaccactatngtcacngagnaccgaagtgacatgaagttatgatgtaggacagatcagntcgaagtggatgacccngatacgagacgcgagcgactgtggacggatcgtcaacgagtataggacacaggtagacgcaccacagccattngtgnatatacacatagtggagtgagactgggcagtgtgagntcacgcagcgancagtacgtgacctggtcgagcgcgtcatcacantatgacgcacatagagtagcctgcaacgctcacgcgcaccacgacgatatatatattgacagtgatactagtgacttgcacagtcatgtatctcatacgcgcgcacgacatccgcgcgatagagtgataagttgacgagcgtcgcgctcgatagcgcanatacgcacgacggngacgcagactntagtgtgagtacgactatacgcagtcaancacgacncgtcatcgcgcgacacagatagccngacgatagctacacgcgatggacganagtcgtgatantagat

SEQ ID NO: 12106 - DNA, 1527 bp, Homo sapiens
  misc_feature (1)...(1527): n = A,T,C or G
tgggcggggcggcgaaggnaacaaaaaacacaggacgcgcgggcccgaggggccagaggtgtggcgaaggaccctaaccacggcgatggaaaccgaagactcgcgcagatggtctaatgcgcggacgggacgcgatggcggctcgcactcgggaggggggctggggggagcgctggggatggacggngctgcgagtgggagggatgggctggggcgacgctgggacgggctgggctggggggggagggtgggcggcaatgagggagggaggggcgatggtggagttgtgtgtgtggcggggagagagaggtatgccgtgtcccggcgcgggatgatgcggagccatagcacggcggtgcggagggcgggatgatcgggtcgaccggggcagacgcctgagccggtcggcgcaggcggcgagtgcagcgcgtcgcggtgtccgaaccggtcccgatatgtggcggacggagcggagggtggcggggcgaacggcagcgggaggcgccgcgggccgcgcgcgccgacggtangatcgcggatgcgggtngcgcgcgcgagtataaccgggggaaggaggggcccgccagcgcgggggtggtagggcgagcggccgcagacgactcgacgatatcttggggaacgagcgcagaatgtgaggccggggtagggggggatccgtcccgggccgcggacggcggcgcgggccgcgcccgagcaggagtacgacgacattccgtgggcgcgggcgcgcggtcgcgggggcgaaggccgccgggcgcagggagtcaacgcgccgccgccacgccgggcgagtggggaggtagcgccgcgtgagcggggggaaccggcgcaggcggcgcggagaggcgggggtgcgagtacgcccggacgtctgcgtgcgcgggtctgcgcggggggtgtccgcctggtgtggtaggagctgggcaacatcgcggggggcaccggttgggcgcgcagaagtgtcgggtcggagccggacgcgatggggtgcatgaatggcgcgggggcgccgcgctgtggacgtggcgaggtgacgcgagcggaaggccgataggaagcggcgcggaggagatgccggagaggcggggttgctcgcgcgcgtggagatgaggcgcccacgggcgggccgcggcccgtgattctgacggctgccggatgtcgcgcgcgggcgaccgccgcgctagcgccggccgacatgattcggcgcgccgcgcgcccgcgngtttacacatngggggagcgagacggcgatgacaacacggcaacactccccggagccgagggcgcatgtaacgacgagatcggggtctcggaggccacctcgctcagtaaaggaggagtgccgcgggcgccggcgcgcgcaggttggagcggcacagcagcgcggtggatgtgtggagagtcggagaggaggccggagcggagcgatgcgcggaacggggagcgtgacggtaggccgaccggaggcgcggtcggggngcggcgacgcggtgatgcgccggccgc

SEQ ID NO: 12107 - DNA, 1505 bp, Homo sapiens
  misc_feature (1)...(1505): n = A,T,C or G
ttttttgtgggtgtcccccctctnttnttcnttcccctcccttctnntttcccctggtgtgttttcttttggtncttttgtacgccccttgtcctctccctgacgagttcgccctgtaccgcccctctcagtcggcctccggtcgatcctttcgattcggtttccgcattccctgatattagcccccccacatagatagtgatccccaactcgcgcgtagtaaatataataggtgaggaaatcagtaggggtgggtaggagcctcaataacgccccccaaccccccattagttattttatatttcatactcaattgtgttatatcattaaccccataatatctataataaccaagtagttgaacccggttatgcgcaaaaccaccacttcgtaatgtcgcgcgtttatatgtcaacgtcgacgcattatccgatatacgagttgtataagacgtggggtggataatgcggcccggggtggtataatagtacttgccctcgatctacgctttcttcgatggtgtcgactaaatacacacgcaacacagacaaaaacagaagagcgagatatcagagtctggatgaagagatagaatcacacgcaatgagatatacagacaaaataaaacaatacgtgaacaatcgctggcgtagcgaattactatcagggtacgggagcgtgcgctatacatctctagtgcgtgtgtgtcacactcgtgacgtcgctatacagaatctcatgagggatttagttgtgcggtgaacgtctgcaagctaccgtccgaanttactggcgccgccgctcccgattccgttgcaatatatctatctccggccggcgaatacgagacatagcgatacttatantnacagatcatgagcaacagtagaaacacatactaataaactaaatcattctaaatcgaaaacaatgctgatagaacgatacgtatcacaatatgtgtgcgagtggcgtatatagattattgatattcacgaatatcgcgacatggatgatgtatgtacgatatgataaagtaggacgacacaggctatatatgacggatattaggtgaatgcaatcgcaagatatggtgtgggacacgcggcgttgggatatccacggggaattttacaacgattatcataacatccgccgttttaattcgcggggagtatgtgatcgtaattaccccccgtcgaccatatgatgcctctatagattaccgtcgccggcatgtggaaaacggcgggttatgcgtggatatctgctatatatatatgtgctatagggcggaataagcggtaaaatataaactgcaacggcggcggattttattcgacgattcgaccatgatttactgcttccgccgtgagctgtattatgcccgctccgtttttatatgatggaagatttacacattcaaagcgtcgttttgatatgacctcctccgaccaagcctttggatatgtgccgaacatgttcaaggtattagttgatttcta

SEQ ID NO: 12108 - DNA, 1845 bp, Homo sapiens
  misc_feature (1)...(1845): n = A,T,C or G
ccccngggggggggnnnnnnnnnnnnncccnnnnnnnntccctcacacccccatcntngtacgaaccgacanacctatcgcancngaagagggaagaaagataacgccgccgaaatataaagaaccccacacctaacacgtcattcttatattttatttttctaaaaccttcccaaacaatccactccttactttttacgttccttttttgctaaagattgatttgtgaattattgttttgatgtgtttttatgggtttatgagtattcggtggggaggcgaggcagggacagggagaggaggagggaagagagtgnagatgtaggtgtaaaagatgaaagatgtgtggctcgttcgggttcggtaggctggaccgtagtgagcgagttagaacgtgtacccgcatttaacctacccgatatctggttctggcgcgattcgatgcgatagcgatcggcgtctctaaacgatatccgtcgatgccgatgttgccacccggacgcgcgcactgagaagaggagatagtatgtaattgttggtcggcgacggcgngctctctctcgcatctgttcgtcttatgagctgcccgacgcgtatgtctgtacgtgtcntggccncggcacgactggtcgtcgtagtatanctancaatacatatataatatcatcatacccgcagcagacgcgattgcgtagcatacanttatgttatatgcgcggtgaaggttaagcgcacgctgaggncgtgtgtagtgaacgacacgagagcnctcgcaccacgcgttcgantgtntgtattctagcatatgtatatgtatatggctccgcgatctatctcgaacgccgcactgggtatatagtgtaccgcacgcgtcgcagntcaagtgtttattgtgtgtgtgtcgcgctcgtctgcaaccgcagagagggtgttatgcgtgatggccaccacgcgagagatgcgacgcacggtgantgcgcacggatcacagacacgaggaagatcagtgtcgtggtagagtatgcgcagctgtatagattgacactatgttaagatgcagcgcagttgttcgcacccggtatgaatgttatgtttgttatcgcacgcaggtaaatgatagagatatgagtagatgatatagtaagtatggtacagaggtcaccgcgccgcgagcggcgataattagtagcacgctgctattgtcccggtgtctggccggctacattcacgtggatacagngggagtatactgtcgtgatcgtagacgcagagcactancagagacggagtcgtgtgatccatagggtggagtgtngaggggtgcgacgtcgtgcgttcttagtgtggacnggcgtatgtagagagtagtgacgncgagtagtcgtcanggtgntatgtgagtgcanatacgcgcgctcacagctgcggcgtacgtgagcgctgataccgcatnttgttcagcgtagcgccgcgcaccgccanttgtattattctcanangagangtgtaaagagntgtgtggtcacacaccgtgcactgtancgggcatccgtgagcgctgtgtatacatgtcacttgncggagatgacnaagacagtatgcacgcgcnacagatctctatgtatacatgagtgacgtggtacacgcagccgcgnaagtcgcggcggcgtccctcgcatcgcgngctgctgtaggtcgtcatgtgngtattcctcagtgagcncgcacgngaaagagcgctgacgcatcgctcgatgtgtctctatctcgtcagcggcgcccgctaagntcgcacattcggttggtgtgacgatcgcgcagcgatgaatcacgcactcgccaact

SEQ ID NO: 12109 - DNA, 940 bp, Homo sapiens
  misc_feature (1)...(940): n = A,T,C or G
aaagggaggccacatggcagaagcgaaaagacagtccatgtgacaagccagagcctcgagggtgaactctgcagcagttattaatgaagttggcaagcactcaccgctgaatttgggtccctttgtggtacgcgctttccttcgtacttgaacaagtgaaggtgtactactcaatattgatccattgttgcctaaagaagtagtatatgaagaaagtgaaaaagaagatgcctatatgtggtgactagggacatacttttttttgtctaggacacaagggaaacaatgatcatacagcataaaagaggcatttgacgtcttgttattgatcccacgcgaaagtgaacttcgtaataaatatcccagcgactccttccaagaagaagaaaataggacatgctttttagatgaataaaataaaaatagtgccctcaattgactgagggggggagcgtcttcgggccgtccacgttgagggggggaagggtcatgaccctcgtgtttggagacgcgaagtggttggggttggatcgggggggcgggatccccctacctcacagggggcactgtgggtcccttgagagcgggtgacaaagcaagagagaaacatctcaactagaggggaggaatggcccggaaacgaaaatagcgcccgtgaacagcgtggaccactactttccgtactggacgagaagtggcacgtccctaataagttagagggcgcggtgacccccgaaggcccgttatcaaagtaggacgtagaggaaaccaaacgctatgtataggatgtggggatgacgcgacgaagcgcttgtgctccccttgaacggggggcttgccgaggttcagatgcgatgtgtagtgggncagagtgatgagctnagagagtgagagtagcaccgtaagaggagcatgccgtacccagcagacaatctactca

SEQ ID NO: 12110 - DNA, 923 bp, Homo sapiens
  misc_feature (1)...(923): n = A,T,C or G
ctctgcgtggtggtgtgtcggtccggagccggcgggcgggggcgcgcgggttgccgtggtgcgcgtgcgcggggcgcccgggcgtggcggggcttgctgtggtcgcggcgcttggctgtgcggtgctctctccgccccgtggtgtttttcgggggcgttccgtggggtcggtggtgccggtgtgggccggtggggcgtgggggcggggtgcgccgggcgcggggccgcggcgtgcggtgccggtgggggtggggggtcgggtgtnctctcttcggctgcgcggacctcgtgggggggcgtctctccattcctcgtgccctctcttctcgtcccnctcttctcttccgcctgtcttctcctttggtgcgtgttggtcttccgccgatctacttcccgcctcgctgtccctctctcgccgtctccgcggtgtgccgccgcggtaatgggggctgggcttctcgcgcgcgtggctggccgggtgtgtggggtggcgtgcgggctgccgggcgttggtggcgtgggcgccgcgccctgtcctggggcccgcgggcggccccctctggtcccccccgccgcgcggcggcgcccgtccgcgctttccgtccctctcttctgtgttcctcccctccctcaaaaaaccttctcttccctcctcctgttgcccccccgttcttgttcgtttttctgtgctggccggcgccggcgtgcgtgtgtctctctggcggggtcttccctgttttccggctcgtttcgtctcctgccttcgctctcccccccgcttcctttccttcctttctctcctctgccncctccctcggtctgttctcctggtttttcctcaagtctttttttttgttccctttagttttttttctctttctcccccttncccttttcttccccccccccccccctttccctct

SEQ ID NO: 12111 - DNA, 714 bp, Homo sapiens
atcttgcccttttcacttccgtactgtgtttttgggtggttgtgtggggggtttacatggtgggatgacgtgcgtgcgtagcggtggcgtcgcgggttggtgggtcgcacctgtctcgtgggcgattcctcccctgttgtataactgcttaatcgtgtggggacacccgtgtggtgtttgcgaccgtgcgcgccatggccgcctacttcgggcgccgggggggtctgagcgtccaattgcagtatgtcttgcaaggccccgaggttctcgccctgagcccgtgcggatagtcccacgcgggttttccagggtcttttttgggcaatgaggccctttcccaacatttttttatgtgaacgatccttttcgcgcctttttgcggggggggtgttgttggtaccaggtcttgcgcttcggttcgggggacagcaagaccctgggtttggttattttctccccttttggggggcgggtttaagggggggcccttccggttttcttggttttcccccttttttttaaattttggggtttaaaaaaaaaattagccccaaaaaaaaagttttttcccaaaaaaattgggcccttttttttccccccttgggtttaataaattaaacctgttttgtaaattaaaaaaaaaaaaaaaaaaaaaaaaaaaaaaaaaaaaaaaaaaaaaaaaaaaaaaaaaaaaaccaaaaaaaaaaaaaaaaa

SEQ ID NO: 12112 - DNA, 1767 bp, Homo sapiens
  misc_feature (1)...(1767): n = A,T,C or G
gttgtgtgcgtatgacagcatgatgtaatagatcagtatacagtacgccanaacaggtgatngctctngagtagtcagacgaggagatgtgatcagctcgatagacaactacaacagtcgcatacgccgcaagacgaaganagagccaccatgcgactctagacactagtanacatacataagtgattagaatctcgcattntanatccttcacaatattcgcttctgcctnagtcataatctcaatgtctagatttgatcacgattcttatcaagngtgaacgataggttcggcgtatagatatncgactcagtccctatgattcgagtgcatgatgtgtaccgattgtagntngtctgagtcgtgtgcgcgcgctgcacgatgatgacgagacggacgagcgagtgtggtgngagcatcatcgtcgagtgttgaagtacagtatatgtagagatgatgagtcatgangttgtcggcaagcgaagtatncgagatcagagcgtgcctcgtccacgtcgctgaacgatgcttgatantcgacatctagcgcgcgcgtatcattgcagctcgtccagtaagcgcagcactgaccgcgctaaattcatatagcgtatacgcgatgtaagagtcactactggtcagcttgntgtagtgtatctatcgacggactgtgacgtagtattagagtcgctaacgtgacgatatgatantaaatctgatacgtacantgcgcataggtgtgtcgcgtcaggagggcggcgactcgtcaacatatcggcgtggtacgtancgagtgggctagttnctcgcatcaaccgccgctggtctgatagacgtgcgacatgatgtgtgtcattgtgacgtgagtaatcggaagactgcagtatgatcagtcgacgcgccantcgtgcgtagtctagtcgcacttgaagcgcagctgtacctgtcgtcgtgatgagtgacgtagtcatcgcggttacattggttcgtatggtctactcaatatgagtagtacaggaagtagatcgagagtgtcgcagaagtatagacagaatntgacgancaacgtacgattgtgtagtatagtgngatacantantagcatgatagcagatgttgtatctgagctatatatttatantcntatncagtcacgcgcgcactccactagatctcgagatgtcatcgttantgngttgtctcaggacgtnatcactgtgcgatcgagcagtgtanctcgcgtgagatgncgcggcatcgtgctgccgagtcgtagatcagcgtactctacagctcacaggcgcaaagagtatacggagacacggaagagtgataatcatatatcgancgttccatagtctgagcggttgatcatgtcgatggctctcgctacntggacngtgacgtgtccnctcgatcatagtcgcacgtcactatagtctcacacgtgatagccgcgtgtctgtgcgcgagcgacatgagagagcagtccgccgcgcgagctcgctcggtgaactgagtatcacgtatgcattatagtgcgctctcgcgtcataccgcangtgcagnctgagcntcaatagcgttatatcagagctactagtagcgtcgttgtgcggntcaggtacttgtgtgttaggagcgnttcttatgcgcgatgttgcgtgcagcgctcggaatcgcgcaatgtgtgcatagaatgtattcacgangnantggtagtggtatgtatcagctcagccatgcattgcaagactcngtcattg

SEQ ID NO: 12113 - DNA, 1765 bp, Homo sapiens
  misc_feature (1)...(1765): n = A,T,C or G
atagactcataccaaatctataatagtcaagagagaggaccnagccgaccgaaaacttagcttgcaaggaagcgataccacaatgcncgnacacatatactgttttcctcntaagcatctactacaccactctcgtaacttggtcaacncgatcaaagtaattcacctcacaagtccatcacatcactccacttntangcnantgtgccagttctatctaatgtcctcgctctcatcgtcgcgtcacacctccacctcagctcgnccatccanaatgtccagagatgacacctatcggcacctctcgcgcatccttcactgcctgcacnatatgtcacaacattacttatgcctcatcntcgatctatcatactaataggtctgaacttactngagacgtgtgagatancagtctgttccttctcgattgcattcatgttacttatgcgacacaagtcatctaccttacgcgttataattacgaatgccagcagnacgatggcacgatacgtgtactgactgctagtgtcatatgaggtgcgagtntngtagatctctatntacggctactctcgcatataagttaacgacagcacgantaagctagctactcccgctgacntgactacgtgacgctcgtatcctccgttatatatgactatctcatatcagacgtgtatctattcatagtgctcacatancttagcactagcaantgcgaagaagcacacgatcgcgtgacgattatgcgacacatggtcagtgcagtctttngcatgatgttaccttcgttggcgantactcagatccgctatgctcccagttacattgattatcatattcatctactctactatacacangacgcacatacactcatcacgtcagnagatatacacacaagtcgattatatcgatctagcgacaccagagtgaccatgtcgctgtgaatcgtagtgtatgatgagtcagtcacgtatagacacaanctacancttcgagtccatcctactgacatactacacagctactactactctatatgatcactttcaacngccagccancntatcatacatatacactagtatgtatncacnatatanttcagtacaatagtaacttactcgcacagcgagtctacggaattgaatatgagactgtgctgctagancgtaacatatagatataaccaacgacacatnacgtaantatatacatactataantagaggacaagtacttcgataagcgagaggacngaacattttacctgagtgcaatcttgaacagctgcgtatcaaacaacgactatcacagatatctaatcacgtgtgctataactaggacgtttcatgaggtngtctacagtcnaaaacgagcagcttcgcacgagactganctagcatgcatcnacgcgcgaacacgtatcgcaatgcgtgntgncgtcgcgtgacactcctgctttncnttcactatatctatatcctatcacttcgctgctttgtgtgcttcantacattatttactatacactcatttaaattactatagtctaggccaccgtatactagctcagaccactctatatacaccagctctacgaggctggatctgatgtctagctaacacagctgagttatcagaganctntgagttcgccatccacgtagcgctagatcacgacatcnctccatcatatcatcttatanatttattatacgtcactgtgacacgccgatcaagcttagccactactactcgt

SEQ ID NO: 12114 - DNA, 745 bp, Homo sapiens
catgattgttgaatagaataaataatattatatccaatatatcctagaaagcatcttcttcagatattaaatgaatgtaaagtatcttttgttctttttcaatgtaagtcattccatagtccttaatcttgtcactaagacttttaacgccaggtaattgtttctaggagtttgctgtctaatgagaacaacgacatacaaatataattaaaacacaaatgtactgtgagatcgaaagaactacggaagtgctatgagaactttgctcagtggtaccataaagccttacagaagagattcttcaaggatgaataggagtttggtggagagacgggaaagattgtatagaaaaatgtgaaggcttaagcatgttccaaggcgggatggagatgagacttttaagaaaagtaatgtccaggctgggcatggcggatcatgcctgtggtcccagcactttgggaggccaaggtggatggatcacctgaggtcaggagttcaagaccagccagtccaacatcgtgaaaccctgtctatactaaaggtgcaaagattagctgagtgaggtggtgcacaccagtagtcccagctgcttgggtggctgaggcaggagaattgcttgaaccccggaggcggaggttgcagtgaaccaaaatcatgccattgcacttcagccagggtgacggagcaagactccatcaaaaacaaaaaaacaaaaacccagaaagaaagaaaaaaaaaaaaaaaa

SEQ ID NO: 12115 - DNA, 1614 bp, Homo sapiens
  misc_feature (1)...(1614): n = A,T,C or G
atgtagtcgatgatgnactgttgtatgtcatgagattatacngnatccatgggtacatagctggatatgcagatgtgagatagatagtgtatgantgaatttatatacgtagaacagctatagacatatacaacacgacacgcaatggtangtgccattcactgcaatatcgtcatagttgaagatactagactcatgtacgtngtcgttatatatataacacacagtggatctcgcgtagtanaccgatatgcgcgtcgntctatctgagcactgtagcatcgcgtctccantctactccatatgatcttcatcgacatgacactattcgccgcnctctatcgctccctcncccgtctatagatgtagtagtatgtngagactgctgtgtgtggctgttgatancgtatatctcactactaaccacgagcacgtcaacttgatactctgccgttgatacatcgacgatgtcgaggcgtacgcgatccagcgaacgaccgncagctcgtctacgcaggtcactcgcgcatgacgagtacgcatatttgtgtacgcntcattcttgantcagcganttacgtcgaaccactctgacgagacaccataacgtatacgttgcgattagcgcgtctagtcaanganagaaggtagacaatgaggagagagcagcagttacaggcgtctactacacagatctctcgtgccgcgcgcacagatcgagtctctgcgacctgtgacgagtagtgtngtgcgtatagcacatatgacgccactgacgctgattcgtncngattatatctagtactctcatactctgctgtatagcgatcttagatggactgaatgagnaatggagaganaaccgtatagctaacatcggagttatatcgttcnactgcccgcaacgctgcagctgtgcgcagatctctgatgctggtgacgctcgtgtncagacgagtgacgtctatatattcatcgacgnagtgtgtgactagggtcattagattcacgagcttttctacccctncgacagcagcagctagtggctcatcaacacacgctgatacaacgtctcactatgtttctgaaagaggatatgctatacgcaaatgtcacgtactcgaatatacgcgaatacgaatacgagttacggtgtatgcagacagcatatggtggcangctcgctccatggtagcgacaatcagctgttctattgtatctcgtcttcgacggtagcaggagatagtacgatcataagcagactaactacgcgcngacgcatacgaactgcatcnctcacagcagcgcacgagatactatatactaacagactctcgaacgctcaacacgatgaccgcactacgtgcatagcaatcagatacgttgctgcacgccaagcgtgacanactcacgcttggaccgaagcagcgtcactgtcgacgcgcntgctattctcacacacgttgactgccatacgtctcattatgtatactgtgcgatcaggtcgtctagcgatcgtagatctctactgagtagtcattatatgtcgcgcatacatattgccatcatgctgctcataatcgctgtagagcctcaccacgtagtgctctgtcc

SEQ ID NO: 12116 - DNA, 1811 bp, Homo sapiens
  misc_feature (1)...(1811): n = A,T,C or G
aaagcgagacgtctagcntnctctatgatagtagtagaacgcatggcaggttcgacgcgagagcacacggctatgangaagtgacgatnatctgtgactacagaacacatacgacacnanacgtcgacgccgactangtgcgngacaccctaagctcactatcaacacagacgactcacactgcgcanacgcagcactatanagcatcacacataactctactacatctgtatgtcatcagaaatcatntcancttatgctacattcnctctgtcttatctcgccgatgtctactcgtacatcngatcntgctacactactgctntgtnanatgttgctatacagtactcngtagttacgatagtcggtctagtgtgatgagtacgttaaggtactatgagctcgcagacgtgtactgtancanctatcagagtncgcgtcagcggntntggtctactgatgttctcgatgagcgtgcgtagtnaatagagtatncacacgtatgatagtacgacagacatatccatgcgtgtnctgttgcgcgancgcgaacgcgttatacattgtgtacagtataatgtgctgctatgtacacgtctgagaaagagaggnatgcacagtgatgcgacgaccacgcgattgtaggcgacgctatcaggctcaagtgcgnagaagtcgcgcatcacgtgcacgcttcatagatgtcatgaaggctagatagaacgtagtggtggggtactgtcagcgatgtcgagtggagtaccgtcggaantctgacgacttcactgtcagtggtcatactcgaagaattcgcacgtcatatcccataggtgcatatacangcgagagcgcgcgaacagaactttactactcttctccctcgacatttctcgccatagatnttatacggaaggtgactcggattagtagtcagtagggctgcagtagtctgtgagtctctattcatantagtaatgcacctgactaacattgatggaagagtgttatacatgtttcatattcctcgacgtagatgtacgtggatggtgcacacgcgagctcgacgcatcatatgataacatagcgtaccccnacatccgtcgcgtagtaacatactgtagtgtgatagagctcgagcangtgtgtatcttggacgatagcacacgcgagctctggtagtcgcgagtggcatctacgatagtgtgcatcgcatagtgactaatcgactatattagttatgtactcgtcaagcgctgaatcgctgctnacntatgacgtgttactactcgtacgatgcgtcgttggcacatcacatgtgtgancgtgactcgtacgacacatcgcatcgcgcgcgcgtgtccgcgatcgcgagagatancatatacacacttatatggaggacagtagactgtgtctgctgctgtatctctgtgctggctngnagtcgtgagcctgcgtgcgtcgtagtcggtnactacagcagctatcgttgntgtgcacgatcagcaacttatacaactctgcttatctatntgccgtggctgcgcgcgtgtatgcgcgtggacatgcgttgactatcaatacggactcgataggtaatgacttgtgtgtgcataaggtaaacgtatgtatctacgcgtnttctatacacgccaccataccatctctgacgnangatctgcgcgtagcganccacagagcgncgagtacatgcagtccaagagaacgcgactgcacacgtagatagtacgatgagtatganagcacgaacggcacaggtgaggtgatacacgtaacgcantgtatgatat

SEQ ID NO: 12117 - DNA, 903 bp, Homo sapiens
  misc_feature (1)...(903): n = A,T,C or G
ctccgtttcctcttactttctctccacccatccttataacaacanatataaccacaaaaacgctaggtgagctgactgctcacccagtttanaccaggnaagacagaaaacagagaaaggctgcccctggggggccgttgcataggtgaggagtcaacaacgaacccctaagaatactgtggattgcaagcaataatgaagtaattatgactgtaaacaacagtgctagtctcgtgttttgctttaataaatgtggaacgcttatcccattaaaatattctaaaatatcccccccaattttttcacccactacccacccgccactcccgccattccgcatattatatctccctattatttttttctctaatcacactaactcacttcgccaaaccataatatttatttccgctttccttttgccaaccacgtcaaccccctacgtccaccctcccattcttctatatttctccgtccccgcgccgcctatttcccccgcaacgtaccaactactcccccattttctcactaccccccccaacgccccacagcaccaatactctaattttttttcctctctttctccccttccacacccctaatgatttcaatgcagtaacaaacaacccccacgtctacctatatctcacgcccccccccctagccttccctatcactaattcgctcttcaatctccatacttaacaacatacatatcactcaaacttcaacactaacctactgcttatattattttataaccacccaattactcctccatccatcaactcgccccaccctataacatccctcttttccatcccaatttcccatcatacattattttttccctatatttacatactccagacagactattttaccccagcatcccaaaaataa

SEQ ID NO: 12118 - DNA, 266 bp, Homo sapiens
  misc_feature (1)...(266): n = A,T,C or G
tttcagtcgtccctttacaggagccagtagnagcaaaggacacacacagaggagaaggcgacttgaagatggaggcggaaaacgaaatgatgcatctacaagccaaggaacatcaacgattgccagcagccactggaaggaagcctgaagagaggcacagaacagcttgcagatggaaccaatcctattgacatcttaactggatttctggcctccaaactgttgagagagtaaatttctcttctttgaagccaaaaaaaaaaaaa

SEQ ID NO: 12119 - DNA, 1207 bp, Homo sapiens
  misc_feature (1)...(1207): n = A,T,C or G
cgcgcgcgctcgcagaagaacaagtagagcgccccaccagcaaagagacgacagcgaaaacgacacagaagcctcgaagngagnaacacagagnancgaagattttagccggaggcacacccaccaaggcacgaagnaagaggcgaagaagacagcgcgcccggacggccgcccacataccggcgacaccaacaacacagcatacacacgatgccagacgcacgagagcccatcgaagcaccgcgcgcgacaggaagataacgcgcagggccgacacagccatccaagcagacacggaagcgagacgacgacacgccacgcgacgcgacaaggccgcgccacagnacacggtccgacgaaggagagagtggagacccgacggcagcgcacagcccgtgtcgaggcacaaaggagaaaaaataccgcccccgacacccgatactaantcccgcacgcaacaaggacgcccacccgacgcgacgcgnccgcgcacaagcgagacggcgcgcaaacgagacacgacgccccgcgccctaaatatcagagaacgaggccgagggcgccgcaagagaggcaagcaaggccgcccacacgagaggagaaccacaacagcccagacgagccacacacgagaagaacccgaacgcagcgtaacccgacgccccacacacacgcaccgccgcgcgcagtaccagaccaccaagtacgagacgctcgagcgagcgacgaccgcaaacgcaacagaacggacaggaacgcgccacgcgcggccagccgcgcagcgcgacgagaatacagantgcggcgcggcgcgncccgcgccgagaaaaacgtacatgacgataatactagatacggtaccagccgtctaccacgccgacgaccagcgccaacggcccaccaaacaagcacaacgagaacgggagacataaaacaaaagaaccgagaaacagtcggagacggcaggacgaaaacgcgagggaaaacgcggcggcggcgcgggcagccacacaccaagaccgcagcgcggacgaagccaagggacgaggagcacggagagaaagccgcgcccgcggagaacgcccagctagcaaccccccccccaaaaacccgcgccgataccgacacccaaacccagaccccaaagtaccgacccagaagacgcgacccgcacgggcccaaggagcccacacaacacacaagaaat

SEQ ID NO: 12120 - DNA, 1482 bp, Homo sapiens
  misc_feature (1)...(1482): n = A,T,C or G
gcctggattacgagtacattcatccgaccaggagcgccgcgggggaaaacttttggtgggaggaaccaaagaaagaagaacacttctagggtgtacgaacacaggcgagagatcaacgtataagtaagggaggaatcaactaggaacgaatacgataaaattatgagtcgacgcggaatccgactagtccgtcanaccctaggcgtatgcagcagttctatgaactgatntgttcactgtcatatccttacaatatatgctgtgctgaggcgaggttacaaggtaacacgagcaggcctaagaacaggcgcgatggccgaactattcaagaacacaatgcgctgcggggcacgcggacgttcaacggacgagaccangcacacgttattggtatatagaggtagggcgggcgacgtgtattacactatactggtggggactgtcgcccaccggtgttgcatagtctaaccaacccaataattaccatncagagcatgagcagacgattcagaactgtcgctcacggtcgaaagatcacaccgcacgattctaaagaccgacacgatagacaatgaccagtaacagtgatattatccaacccgtgcgaacgctanatagcatggcggacgcgcagcgtcataatcgacgtggcactactcgcgcgccgatcgcggctgcgtgcaccgcaccgagtcgacgagtgacggagtagaatatcactcgaggcagtcctccgagcacaggagcatctagcacgccgagccatcgatgatcggacagaccagaccggtatactggctaacacatgaccncaatcgantgagtctatcgtatcacgagtgcactgaatatgcattaacatgctaggaccatatgatgccgatcgagcacaatcaatcctagaaacacgcacgctatagcgtgatcgatgagttgatatgtactatgaatgagacgcggaagatagtacgagctgtcgtttgtgactctcgacgagcgactacagatctagacgcactgtggagcgcggtgagcgaggcgtagatagaacgatatccggtccgacaagctacgatagagaggagagcagcgacagatgcagcgagccgagngagctcagatagagccaatacgcgaagtaacaantggtgactcaacgacgcgcttggcggcgttccgtgcggtgtcagcgtaactgtcactatctgagacgcgcactgcgcatatcgactacgtnacgcgtatcgatgtgcngagcacatacacgaatactccgtccgagtgtgattacgngagcncagngcttancntctctgacatatgatgatagtaagcgagctatgctgagtacacagagtcgatcgcagacgcaatcnctgcggtgctcacaccacacgcggtcactacgcagtatagtataagtgagnatatcgcngnagagcgatcngcagcaacncacgactggcagaagacacgaangnt

SEQ ID NO: 12121 - DNA, 869 bp, Homo sapiens
  misc_feature (1)...(869): n = A,T,C or G
ccccatccttaaaaaactttccccgcaaattccacaaaccgccaancctcgtgtgngaacnagcaaaagactttanagctaacacctgcactactatcgacgggaattcctgccgaagtgagaaaacgaacaatggatacctataccaaaatgggcgaagtctccacagatctctgtgtctactttttcactttcatcttttgtcatgaactgcttgatcatcgcggctctgaagtaccatgaatcctcgccaactgacaacgacaaccctactttttttaaaacaaatgctctccaatatccgcagtgtccctaaaggaagcaaactgcattacacctccccagaaccctttcacatcaagggctgcaaagctccttcattacaaatagcaccgcacaccccctgacttacccgggcccacccatgtattattcactgacccgacacaccccagtactaaccgccactaagctgacccaccctgccaatacaaaataactcacccgcaccacccaatctaactgacacacaattaatccactccccattctggcacgctgacctagagcgcatcagcacaacacacacatgcgagccaaactccactccctacacaccgcgctcacgcaccttcacgatacttgaccacgagtaaactaactcttctgacctcttcttctacaccatccccgcactccctgcttgcaaccccttcaaaacaacaaccaacctagatactcccccaaaataaaacacaccccctccttttccccccccatttctacccgcgtatccccacccccccaatataactctactaatgaagaacgagtgataccggtgagcagacagtaaacactcacaatat

SEQ ID NO: 12122 - DNA, 1074 bp, Homo sapiens
  misc_feature (1)...(1074): n = A,T,C or G
catcggcgagatgcacgtgcgtgcggcgatgatcgcggcgactcggacattaggcctcacagttccgtgtctagtgcgcgaggcgccacgagaagatagtgtgggcgagatcgacggacacgtacataccactgtcctgccatccaacatcatgcgaccctantcggaacatccacgtgctgtacgacttcgtcccagcctcgtaccgacactcaacnccctatgccactcgcccatgcgccggcgtgtgagcggagaggcccgacgatacgaaatgggacacgcagacgagcacgcgctgtnagtagcacagtcacccctacgtaggatggccggggcgaggggaatatataataccataccacacgacacatctcaccctattgagcacggaacacgctcttaaccggtcgacacgcgaccgcggacgccaactcacgaactacctaaaaaatgatctagggctcctctggcaacagaggtggcaccgggagtcgcgaccgaccacgggggtactcggaggacacgcgtgggcgggaggctgcacgtgggacgcgcgcggcgggggggcggaggccgcgcggggtaccgtgcatgttgtccgccgtgctcccctcgctcgagcctccctttgagctcgtgctgatacattaatacactattgattgtttcgcgcaaggacacttcaaacactcgtcatacatcattaaatacagtatcacccctcgcccgacaccgtagcgcgccgtgccgcgttcgcacgggcgcgctcaccgctgcactccctctcactaactggtgagtgtgttgtcatctcagtccggcgggagtctgtgattgttattggctgctctcggctctcgctcgcccgcaactcgattcccattccgntggcatcgcncttttcgttcttatcggtgtctttttgtttcttctccctcctctctgncctctgtttctttttttaaagtgttttntctnttaagttncccacnttaggttctttcttccttctccttctctntncttctttcnctcttttccttttctcttcntttctctcctttccttctt

SEQ ID NO: 12123 - DNA, 1249 bp, Homo sapiens
  misc_feature (1)...(1249): n = A,T,C or G
tcgtgtcttactagagagtaccggctaagtgtctntcagacgaccgttatttatattgtgtgatacgtgacagaagagagttattttgcgagtgtgtcgtctgtttaggtcgtttatccgaatgcgaatccatcgtaatcactcgtctgcttttgtaccccttctagcgcgcgtcaactccctctgtcccttgtcatgtcagtcggactcgttctagcgtatctatctccccgatccgctatcctgtcgctcacatattgatgtagttattttgtgtcgcttcgtctctctctcgtgcactcagtctcactctgtctgtcggttctagcaataaatctcgacatcgagcaagcagttgccacctctagcagcggtatacgatatttacagggcgacgtcgcatgtgatgagacgagtcaactatgtcctgtctacgttgcagcgcgcaacgttggagatgttgtctgcactagttgtgttcgtaaggctgtcactattacacagacgaagcgatctccagagtcacccacgtagcactctcagagcgccgcagcgtcacgcgcgtcggacgagcgaccacataccattactaccccccagacgtaagtgcgatggtatgaatgcgatgntaatatacatgagntgctagagctataagcttattcttagcccttcgctagtatgtcgcgctatggatctgcggcataatgtactctacatcgcatcgcgccatgacagacgtgatacgatcacatatgaagggcgatttctgcgcatgcgaggttgctcgaggcgtcaattctccactcttcttacagtgtgtaggcaggatgaccgcgcggcgcagtgctactctcgcggtatgctacgagtagtctgctctccgggtctccgcgcttccgatctcgctcctctcctcgtgtatgtacgtagcccgcgcaggatctcagcccacctgcactgttgcgccgttgctgctcccaggctgcccgcagctcgtgtagtcctgtgtcttacgctactcgacactcgccgagtgtgtgccgcgagcgttgagtgcttcgacgatgtactcgtcacactacgctatccggggccggaaccgggacgccccgcctttctcgcaggtcgcctctcattcgccatagtctcacgctccagtctcgcatgtcgttcatgcgtcctctcagatcatgtcccttgtacgctgatattcgattgacgttagtagcgangagatcagttaacg

SEQ ID NO: 12124 - DNA, 159 bp, Homo sapiens
cctagattcagcagaaatgaataaagtaaaatgaagcaccactgtatctgacagaaactcctgagagtatctaaggttctcacttaagtaaatctcctaaaactttcagtctacaaagtatggcaataaaagttaatattcataacaaaaaaaaaaaaa

SEQ ID NO: 12125 - DNA, 1305 bp, Homo sapiens
  misc_feature (1)...(1305): n = A,T,C or G
actttgattctgaatcggtcagtgacttcgtatcgccggtgagtattgttattaactaaatagtaccgtcccagagaaacttcatttctttgggctatcatatctactctgatcatattttgctcctcgtgaccgcaattgcagtgcagatagcttagagacgctgtgggtacgtctgatgtagttcttacgtatgtctatacggattctctcgagaagacaccacgcacaccaactactgtagcccatcgagtacgtccgtagaaatgatagggcatacttagaatanaaagagtgataatgatcacataccattgcgatatagctcgtataaagcgatggcgtgaagcggacgcgcgcccgcactacgacatccacttccactgttctcccacgagcctcagcacccngcgcttcgtctcacagtgattaagatccgtacactacgctcgcgagcgtacctattatcaccgtataccatcatattgcgtgtgatgatctcatatcacactcccacacggccacgatacaccctacatctttcatcactcacatcgttttcgtctatgttgcacgtactgtaccgatctcgatcccaccaccgcactaccctacctatcccacagaccccattctagcgcttcatatcaccagtgcggtaccgtgcccgtacgcaccgagcgtcattaagaacaaggccgccacttcaagaccaacctacgtgactcacgtgtacatgtacacgctactagtgcacggtcggtgatcgagcagatctggctcgctggtgcaagctctcgaatgttatagaaagggatcgtattacaatatagtcgatgtaccgaacattcggtacttatataagacggtgtcgtgcgtcgtgtgctatgtcggttctatcactgcgcgagctaatcgcncagatcgccaccacanagcaaggaggactatgctgcttctcgagtacctcacatgctgtatagggagctacagcgatatttattgcatcatctgaaatatcacactaagcgtatagagactagaagaaatatatactctatactatgaataantacattcaaaggtgtgcatatcggtcgtcgagctcatcgcactgtggacagtatactcagatctgtaacgctncgacgtgtaacatcagcttctataagcattatcaatgacgtagacctcgacagtacgctcgacgancgagcgagccaccagtcaccgctcacgcggcaatagtgtatagtatagtagtgtaagtgacgtgctggacctaagtcatctcctctccacaat

SEQ ID NO: 12126 - DNA, 150 bp, Homo sapiens
cctaggttggacacagacaatggtacagaagggagactagaaatagacccatgcaagtcagtggagaaaggatggattattttcataaatgctgctggaaataaatttgaatggaaaaaatgaaactggatcaccacaaaaaaaaaaaaa

SEQ ID NO: 12127 - DNA, 725 bp, Homo sapiens
  misc_feature (1)...(725): n = A,T,C or G
ctntnttaatnaccccgctacaggtattacactgggcactgaggacacagagaagaataagagggctttaccctcaagaatcctgcaagtctaccagccacaaattgcatcctgctcacatcaagccacttggtgtgtcctgacagattggatgggagcgctcccagataaaaagtggtaggagttagtacaaaaccatcaaaactttggaggacataaggtcattgagctcatttccccactgaatttcactcttgnggcccaggctggagtgcaatggcgtgatctcagctcactgcaacttctacctcttggattcaagtgattctcctgcctcagcctcccaggtagctgggattacagctaccaagaaatttaaaattacgtatgtggctcttcacatatttctaatgaacaacattggagactcttaagggcaactttggatggatccatgctgggcctttgaggattgagctcagaagaggagatttgaaaagcantcttttttcatcaccaaatgaaaatgcaaagagatatgtttgtgggaacagaatgtaattaacccaaagtnggaattggggccaactaagcagcatttaacaggctaaatggtntccccagttcttggagccctttncgaanaatggggcttaattctttgncngcatgaagaaaaagctnaaagcatctacaagaagttttaaaatggggaaantggaang

SEQ ID NO: 12128 - DNA, 1423 bp, Homo sapiens
  misc_feature (1)...(1423): n = A,T,C or G
tctcgtactttattccggactgcccgaagaggacggagaaagaagccgtgcttggataaatcaaagagagagcccctttcatcgggaacaaacacagcaagggcgagacaggacgacactagcgtgaatcgccacaataatttgtggcggctagtggccgtgcgacgttatggtacgcctccgcgcgtttgctgccacttccgttaaggggtccacctatatggggcacggagccgcggcgccaatgtgatgtcggacgcgctaacaatcatntcagggggcgtgggcggcagagaatggtagcgatgaccgcgggtgtgggaggtgtggtaagctntagtatgtcgtatcgcgtgaggggatgcaggaaaaagattttcttgtagaggagaggtgataagccgtgtatgatgtcgtgtacataactgatggttgttctgatatggtgctagtcgccatgcgggtcaatatacgcgcgttgtattaccatcaggaaaggaacgatggataagaattacaaactcaatttggcccagtgtgtggacgcggttacacgcgcgcgcgtgccgttatcccgtatttgtatagagcaccgtgtcgcgaagcagtgagtgtagtacagtggtgaatattcagtctggtccgcggccaacacaaatctaggtactgatacgcgtcgacatatagcactatcaccgcatacagcacgcgacccaatcgatcgtaagatcctcgactccactaantcgtccgtactgtattctcgtatctgcttgtggtgcacacgccgccacagctctacacctacgtatgctcacccgccgcaccgccttcgtagacgcaacgccatcagtgcatgcacagaacngttaggtacggccgcgccgccgtagcgcgcagcagaccatagagaaggagacgaattggagtgctatatcacgctncagattatagcgcgcgctactctcccacgctcagatacacatattagttatcatcgataacacgctgtaagatctgtagatcaccgcgtgacgcttatactgactcgngangagagcggacgcagataacgccacacacgaaacgcgcacgcagtcgacgcncgaggagtgccgtgctcgtantatacagtgtncagtcgcagcagtcgactcatcaccactctgcgtcgttgggagagcgcggcatatggtgcgctcgcgcgcaacgctccagactgccatatactatcgcgctngctctcngtggactctgcacacggagatatgctgtagcggtncgagcgagatgattatgcgaacgtccgctgtgtgcggagnagtacagagagatcgatgagcgtgtggctggcgcgcacgcgacgtcgcgcggacacgntcagtgcgcgataggcgagacgcgtgagagggcgcgtgatatt

SEQ ID NO: 12129 - DNA, 1463 bp, Homo sapiens
  misc_feature (1)...(1463): n = A,T,C or G
atcttgtggatcgactgaataagngtatatacaggatcagagatgagatcgatatgaacaatatcagtaactnaacgantcactacctaaggtgcgtnctctctatgtggactacatttnagaagagtgtatacantatgtgatcgtgatcgancagtgatctatcaatgaccagtacgctacagtggaagcagacgacaccattgtcgcatcatacagcaattccctcgtatactgcatcgcctctcctgtgtgtatgacacgtcagccgtcacagccccgtgcctatcagagaggtatgttattgtgacagtnagaaatatactctganatatcacgantaaactgtaggctgaaggtatagttaactcaaggagttagtcactagcatacagcccacgacgtgaagaaatacgactacacgagtagtacatagaccgaggatgagagatagagcgcgcgctccacgcgctatatacacattaaacgcacgcgctaccccacagtctacaatccacactactatacacaacacactatagcagacgacgctcagcatacacgcggcgtagaatcgaccggcgctctgcaccgccgacagaggacagagctttgaacantattccgagatcatacaatacgatgagacagcgtgcagactgtatataatctttagttgtataataccgccgactcttcgcatgtacnggatcagcgtattgatgcttactatagctggataatgcaggaaccgcatctcaattacaatcgctagcgagtcacacagtatacactccaatacgtctgccttcctcaaacgcgcagaaagctgagtgtagactgacctactcagaactactagcacgccacgacgaggtcacatgaacaggcagacacgacctcatatgactgtattgcttactctactaactatcgcgcctcatcagacagataccctgcgatagagtactgcttctaggagtaacgtagatgataagtgcattggtagagacaaccccacaagcttactactcacgtcgtcggtccaacttcaaccagtcctctgaacacatccgcacagacagccggcacaccagcatcgagggagataatgaaacgcgagtataaaccgccacaccatcgccgcacacgtctgcgctctcgctncatctatcatatctcaacacctaagacagatctcgtccatcacgtacaccctgtcacgttctcagcgtccatctcctagcctatagtctacgcccagtctcactaantacaatgttaagactgattatacatgncagtcgtctacactcgatcgctcgttaccacgtactacgatgcctcatatagctcaatcagcaacaccaatagctccactctacctagccaacatctatatcgtctgtgaactatacacatccaacagacatccacccaccgtgcgacaatgactccgcaac

SEQ ID NO: 12130 - DNA, 1659 bp, Homo sapiens
  misc_feature (1)...(1659): n = A,T,C or G
atatcgtcgcctagaacagtcaancattcaatgtattcactgtctctactagtcancagatcatagttacgagctgtattatagtatacgtgtacgnctctnctgtactgcgtctnctcgtctactcttgtctgcgacgcgtcagccttgtcttcctctctacgcgcttctgttgctctctctgcttctcgtctatcatgcgttttctctatcacgtgtgtcgctatgctcttattctgatctggtctcctcattacccctcttgtccgtcngtactgcgtctttatattatgtacgctcctcttgtctcggcgtacncgtgcgttatcctgtctcacgtgttctgcataagactgcttcatcatagtgtgcgcgccncncactncgctcactcntctcncgtctccgtactacactcatgctcgtctctgtactgctgtgatctctcctacgnaccacngcagccnactctccagtacgtntatcctcttctatgcnatctcactgcaccancacgctgcgaactgatcaggntcttccgtatctcgtcgttgtcttctactatctacgcttntccagctcctccgtngtcctcaactgctctcatgatcnctacacagatatctctacatctttctcctcgatatatgtcacaacaatacgtgtancntcgcgtctccactcgttctccgctcccgcgtgtacctgcctcgcgcatcctcgtantgttcactcgctttnagactccnctacgcttactgctcgtctctatctacctctactctttacacgcgctcctcaccatcgcgtctgtgtcctgtatcgctgcnacttcttcnctcattcatcatgcgctctctgttcctacgtgcctacttctccgctgttatctcgtccacgtctcggctgtctacggcctcgatcgactcgtatggctacaagtattcactgatacactgccagactatacttcagcatanctctctcngcccngccatcgaatgtgtgctgcacncgatcgtacagctcgacgtgcactcactgccgctcgnactcgcggtncngacgcacgtgcggcgcgcgccgatcgctcatctgaatctacgcatatgtgccgtcttctcnatctcattctagcgcgtgtacaccgcttatcacggtttnnctcgtactgttcctcgtgcctgcncactacctgtctcatcttagtgtcccgtccactatccgtcttctctacgcactctctactactcatataccgccgtcacgtacgcngcctctcgctctcacgactctcctctgctccgcncgcncactctacgcgctgtacagcggnctatcggacgtagcgtcagcgcgtctaccacgtcacacgctccacttatgtctgtcttctgatgtgctctgcttctctctctancgtcatctagcgactctgtctctcgtcagtattcntcncatctacgactataacactgctccacacactctgcgncctaccgtctcgacgattcatatctataggagctacagcatcacatcatagttgtctgtacatcacctgatcntctactntacttgtgtccatacgtgatgttgcacgtacatcgaatactaccacagcgccncatcacacacactcnacactntacacatctg

SEQ ID NO: 12131 - DNA, 1671 bp, Homo sapiens
  misc_feature (1)...(1671): n = A,T,C or G
tagggctaggtaaattgtggaaggggagggtgaggggaaaataggcgggtgaatggagcgagtgtgatgggcagcgggggaaaggtggcgtaagattgacttggaagaacaaggactaaaaactgccgcgaacagtaaatatggaatctgatatccaccgataaccacacgctgtaggtcaagctagaagcagatagacagagcgggcaactatagccgcctcagtcccgtgttatgttgtgtgatancttgacgctaggcacgacgacacctctgcgcgctcatcagcagggtgctcgacgcacgcgtcctgattcgtgagtgtatatgacgagtcagangagtgctatgtcgagcggtcgttgcgctgtngtgtatatagtacgtgcatgtaatactgtatgctctgagatgagtaggcagcgactactatgcagacagtttgttatttttataattatcatcnccgccacactcttatgcctgtcgtactacgnttcttnctccgctcacgacacgcgcgcagcagagagcggttctcatccagcacgcagaccaatcccagcgtcatgcacctancgtgtgctngtctgctgtctgtgtagattgtangtgtcntgaatgttgtgagtgtnagcgatctcgcagacacgaggcaatagacagtcgtcgcacagtgcacagtgtagtntngtatagcggtacagatgctcantgcgtgtacncgcacgtcacgaagctgtatnangangtgcttgngtcgctctcatagttggatatancnanacgcgcactcatagtttagatctcgagtagaagncactccgtactgactgtgatcntnctgcacgccntcgtgntactctctatggagcngtctgtgacgctcgggtgctagtcgctgtcgtcggctcactacgcacgacngtaggtcgcataggcgtacgacgtgtcgtatcgtggcacgtaaaggtgtacactcgtgccncttgagtttcgattgctcgacgaggtcgacggaggatctagttcgtgttgtaccaggacgctgcgtgaatgtcgcatcagatttntgtcgcgatgtgtggtgttatcgtgtgagtaccgtntagagtgtgtagtggtagaagtggtgcggtagtctacgtgtagatgtgcgnacatgacgagtaattctacctcttctcctcgtgcggctagtaatgtcgagagtgctgtttcacacgccatcccacagatacgcactgtcggtcgtgagatgtgctgtgcgcatcgtgcaacatgtgacgagagacgaancagaacgtagcgagcatgacaggcacgatgacataagacgtgatgtaganagatgatgttgtatangcacactcgtcgcgacgtcacagtgagtactcttcgtctagcgctcagcacgcgcagttagtctacgtgtctgagctctccctctacgcttgtcgatactacaaacatccgacgcttgcgtacggcagtgcgccacaacgactanagcagcgcaacgctcacgtgtcgacttgcatcactcgcgtgctggtcgcgacgtcaccagatgtgcccngacagagcgtgacanncgctgagacgcaccnagtactacantgcgacagcatgagtttatgtcgcatcgtgcatacgtgtgtattgggttcg

SEQ ID NO: 12132 - DNA, 408 bp, Homo sapiens
ccctggcggggactaaaaggaagtcttgccatatggatcaaaggtcaagctcccaaggacataaaatctccatctcaaatgccacaaactatggctccatattcattgaaccagcaggcatgccccagaacttctcccagacttactctcacacgtgaattatgggaaattgacttattggttgcagtgttgttggaaagggcaaaagacagaaaaccaccaaaacgtccatcggtaggagactagttaaatagattatcatcagccagcctgatggtcagcaattttaaaataagttctccaagatgtgcattaagtgacccatgtacataatgtgtgaaatttggagcaaaattgaaaataaattagactccatacccttaaaaaaagaaaacaaaaaaaaaaaaa

SEQ ID NO: 12133 - DNA, 1784 bp, Homo sapiens
  misc_feature (1)...(1784): n = A,T,C or G
gtgatgattgatcatctgtctgacgtagntntcgatactctcgacacacatcggtgtcagncgatatgactatatatgatngaacgcacgtctgtcaacatacgaccaatatatgcagcactcatcacatcacagctcctgtttcatctactcatcgtgcgtcctacgagcatagnagtaacggagttgacacatcgcnatatcgcgcgcacngcacatnntcntcatcagatatatattctatactactgcccgtaggctatcactcngatgancctgagcnagaggagcatncgatcgctagatgcgcgnctgtcggnactgatgcagtgcgactgtagccacgctgctaatgantatataattgtagtgtgtgtgcgactcagctagtngagcntganacacgccctctcgcgtccatactctgtactgcacacgtcgtacangtgcgcacatattntagagaccacgcacctgtcagtatttgnangtgtattgcgtcactncagcatatagaacgagcttcataacagagctagatatcngngagtcgatcacagtctgtcacgccgntnactantnagtatatgcaacgcacactcacacacatcgtcagtagtatcaagtacgtagtaagtgacagttcgctgacggcgatgagtgcgaatggacatcgaacgctacctgccgaggtcatctcatcagtngcgtccgccgtcagctcntgatcagntngtatctcgctctacatcgccctgcntattactancacagtagtatgctcatcactcgtacgcggntgtcgcgtgtcgatcgtctacacntgtcagcgnactcacacgactgatgncgtacgtgtgtgacagagatacgatctgtgnagttacacgtcgtcgcatctgtcgtgcaactgtacgcngcctacgccatgtcacactgtcgacaagatatcatctacacgcgtcagcancaanactgtatgtaatcagagtagtgtgcatacgagccggcgtcgacgtacacactgttgtgaatncgatcgagagtcttngtatgtgctgtagactatatggtctctattgtantcgtgtcgtttctcgccatacttctcanacatcgatcatcatcctatcacccngtcancatagantagactgctgtagagagggnatacgtagcaggnaggagcgatagtntagatctatatcgcctgagctacgcataacgaagatagtgtgagtatgtgagcgctcacgtgagcggangantatgacgtagtagtcgtntgccgacgntactgtgcgcgtcgtcgcgtgctcgatgtcgcagagagcgtacacgacacgacgagctacgagacagtgacgaagagtagntngactcgcgacacgattgggtactantcctctctctacatagacgtaacagcganacgcgtgcgacagtacgangtgacacaagcagtccagcgcgacgatgnacaggatacatatgctcgtgacgcagcatgtgcataactatctcgcgtgtagagcgttatacgcagagaggtgtgatatatagagcccactcacnatatgacgtacgcgtctgcgcgagtcatgatgatcacgtctgccgacggntcatctgagatcgagtcatgcgtgatatactcactcgcnatcatctatccttacctcgtctaggtcgncgtactctgcgcgtgtacgcgctcggtgtactcgtatctgacctgtctcgctcgcgtnctnacacatcacgacncggagtgacgtcgtgag

SEQ ID NO: 12134 - DNA, 192 bp, Homo sapiens
tacaatcacaatctaatatcctatacctgcagctgccttttcttgctccaatcagactcacaacatttttttgggggtaattgagaggagaggatgtcgtctaatgggaacccaggcttcaagaagaaatcttaactacttttctgattttgagactccaataaattgctgaatctttcaaaaaaaaaaaaa

SEQ ID NO: 12135 - DNA, 2028 bp, Homo sapiens
  misc_feature (1)...(2028): n = A,T,C or G
atcgcttgtcgagcngnagcgagtcgngnangatgcgatagtagtagtatagctgtcacgcgtgacgncatcntgtgcatagctacttcatactagtctcgcatnatctgtgtgatcagtctgagncgtgtagtcgtatgctgtacgtcgcgcgacgcagnacnacgagatacngactgcntngtnagntccagagcaggaaaccgcngagcgnaccgnntcncgtgcacgctgcactggatattgatatcgagaccnatctgatgtgtagtatctgctgagtagctgtactcatgtggtnactagagtcggtagaatctacgtaacgcatcgngtcngtgactgancgctgtatagccagacgtgactccgatatcagtcgctgctcagcccgatctgncagcgcagnaatcggcacngcntgcatacgcagtgtcatatngatntttnacngctgancgangcgcactacatgtcgnagtctacntngntgtcacagtaatagcgtacatgtcntcagctctgtcacntcatcatgaccgaatcntctcattctagtatnaagtatacancgtcgttcactgtgtgacgactctgcgcagaatntacaccgtcatgtcagctntacactactccatgtcgacactcgtggntctactcagcgatcgtgtcgtcncancacgctcgatcgcatacgtccactagtatcgatctgtatctatcgcgtagcgcgcatcgcgtggtcggtcgcagatcgatacgtcacatacgtcaagtatctgcacgacttcacagaatatcgtatacatcgatcgactggagtatcntgcgtgttacacgcgtgatactgtcgtgtgctgtntatcatgtatcgtgtccgtctagcagtnagatatcgatacagtgcgtcctgcagtgatctacgctacatacgttactgtagtgcgatcagttctcctcctggagttgatgcgagagcgtcgncgncagagtgtgcgcgcgcagagtagtacagactagtgagcttcgctctacgcgtcctngtggtctacgagcacgacgcgccacctctgangttagaagtatatgtntgacgtagatatgtcagcagtgtgagcgtgcagtgttngtctcatgtacgcggncgtactgtactctgtctctacagtcagtcgcgcgcgccnancctcgcgtctactgtacgcacgtaagcattgcgcgtcgatancgacagcnacgctagtatgnacanatcgactctcanctccgntatncaacacntatgacgcagtcgtcaganactgcttgatacgtcgacgctcgtcagtgtagtctgtcacgcagtctactgcagtgagctcattagagtgtacgacgntgtcagagactgtctgtgtacgatcggggnctatgcgcgtctggtcgtcgtactantcacgttaacatagatcggtcgagctgtatanantgtactagttatatgagtacatgagaagctnatctgagtatgactgcgnacacacagtncgtcgctgactcgcgctgacgtgatgtctgtccgctcgccgtgtcgctcagcncctgcatacattcatccctgtcacgaggatgcgtgtaggactagctnttgactcggagtactgcgctgtatgtgatgatagngtgtatgtacatctgctctactataacgacgtgataattacgcgcactnagcacgtggacaccatattaagtctacgatctgcggcgtcatcgagcgctcgcgcgcgcgcgccgtgtgggggcgctcgcatgcgatcnacacggngccgcggtnctacgctctcaaggcacgatactgcaaagacgcacgaggcgctgancgctctncancngcgtcgcgcgatgatgtataganatcgtggtgacgctcatgacacccnttcaanactgagtcaccgccacgaaccgcctctctcactactgnancaanagatnctatacaggcaacacagacactatactgatctcgattatcgtagtatgact

SEQ ID NO: 12136 - DNA, 1627 bp, Homo sapiens
  misc_feature (1)...(1627): n = A,T,C or G
tatagtcaagcaacaaatataaagacaaagcatcagagaaagaaggaggcaaatgatggaggttgtatgatgagcacgtcggatatgtcantcacgttactacaaatacgaatctgtcttaatcaccaccagcgtacactacacgaagacgtctgggtagataacgctagagagtaacgagtctacgacgttaacggtagagtacacacgcacagcgctcgagtgtacaagcggcgcacgtgcaagtatatcgtctgttcacagtaggcgagtgataattacatagacaccggcatatcatacctcgcggcggacgagcgaggtatgtgcggtcgagtgagtatagaatgcagagggtaagcggtggtccccgagaaacacgactaaggactcggatgcccacacgancggcacacgatcgactcgattatatagtatgaaaacatcggaacgagacgatatacagactaaactaatgaaacgcactagacgtacaccaacaccatcaattgagcggcacagaggcgcatgagcgggccaagcgggatataaggagcgacagcgtctatatcgaccagataccacgatcaaccagcagcggtccatcttagtagtgactactatcgtcgaagctggtactcatcctcgcacgcgtgagctgagggtgtggacacttgttatacgacagacgaagtcagaatgaaaataaaagtcgctcctcgccttacttcgccgcgatagtggctgacagcatatatacgacatcanagccgatacgagagaagtatcacggacgtacaccagctactagaatcgctacactcgtagatgacgcggagcactacactaagagctgatcgagtgaaggctgcgtgagcgagangtgagctgatncaatgctgtactaccacttcgaggtgagacatcatacgagacgccaccatgccacagaagatagngagatcnancaccacataatagagatagagtgtgctgtatgagtagcacatactctcgntgtgacatcctaatatatgctgtctagtgagttcaacatatcgctagatctcgttgagatgatgctctctncatgcgctangantatgtagtcacgagctgaagtactcgtctacgcgtctcgacgtcatcacgcacacagaacagcactcacgctcgacgtcccactcctacacatcactacgtacntaagtgctcnacatgtataacgtntaccacagtctcactctccatcgctatctncnacatcatagttaagtgagtctgacgaatgatagaccgntgagtcgtagtgatagtgattgtcanagtgatcttgtctatcgacaggtcgtctcngtgacgcagcacagcgagtcgagatgancatgagctagtagagcgngcaagacgcaanattgacacgctgnctactatancatgaatggcnctnactatacnactcatagaaggatcacgacgcgtagagcatcagatacgagtgagtctcatcgantgngtagtgggacggtagactactagtacaagtcggagctagataagntcacacatccatactgacacganagtnacggaaggaagctgccaacgtacgtgtgaagatcttntg

SEQ ID NO: 12137 - DNA, 1254 bp, Homo sapiens
  misc_feature (1)...(1254): n = A,T,C or G
tatgagcgatacgttgtgagctgcacagacattatgcacagatacgagattagactgtgtctatactctacatcattatcatcaattgctcattacggctgcgcgagcgggtgaacactgtcgacgcgagagactgccgggtgaagtgaaatctgtcaagatctcgcccgaccgctccatcgccgcttctcactctatcagcggcgcgcgccaactcgcgtcgnatattggtacgcgcgtctaagatgcgtacaatcctgctctcacgccgaggacggccgatngcgagacgtagtataccgtgagttctgtggtcgataggcgttcgtatacacgagatgatgccaacgcaagtcacgagcgattaccaacctcatcactactagtttagatttctactctgcggcacccgctgaactaatgtgtcgtcatagcggaggntgtgcgtgtagtgacaattatggctgcgtgctacaacgatgctcactactatgacgtggacacgaagtgcaggcaaagatgtggcgctagggctcggcgcatgacggttatgaatagagatgattatataagacaatcatagagaactgcgcggtcagttgatgattacacgcaagctcgtccgtcgagttgctagcaagctcacgtcctgctggctcattaccgcctgtactcgagacgcntgttacacatacgtgttttcaccgcatggcagagcatctcgctaggatatgcgtgtacgataccagctaacgcgtgtagtgagtatcttactcctgttgtgctagagacggntgctcggttacgacgctgagggttttgcgatggtgcgaacagagtgagagacgagcggatcaaggtcgtactatcgtcacacatcacatcactctcgctccagaccgtaacaccagactgcaacgaaacagcactcgcgaaaacacaggcgcgactacactagcgttagtctagttgtatacgatacatactatctcgagtcgcaatcacgtatttgataagcgtcgaaggtaacatcacctcaacgtcgacggccgctaagcagccgccgccgcccgctctatccactctgtcttcgcggcctgttgcaccagtgtggtatgcggtgtcacccgatattcggattacgcgcttggatactcgcgtatactaacagactaccgatatacgcaacctctatgcaactagatacgatattactccaccgacaaacgacatgctcgcgtctgttcttcaata

SEQ ID NO: 12138 - DNA, 1738 bp, Homo sapiens
  misc_feature (1)...(1738): n = A,T,C or G
aaatgtttgagtatatntatatctgttatactacntntgaaactngatagtcagattcnatataaggagtatatatnatactagattantataatactgtgnaaatagtatctgacagtgtatatcactntctcctatggactatctatcatatatggcaggagntngcttacgatagtgtcgctgcnctctgagtcgactagtacgagacgagacgtcngatatgtacacagaangttctctcggtagtcnntnncatcacttaccnatnctcgtcatctgagatgcgncatcgtagatnancagantacnagnagnacgatgtcgctcgacgcnatagtgcagagcagtcactcatcttgatatatattgtgctgcgtcgcgtaacntagactcatacactcacatgtgatntacggctgaaagcagcaacacgacagacgagcagccctgatagcacagcacaccgtctcgtaaagcgtggctcgnacgagcgcngcgtgaatggacctgctaagcgtctttanatacantcaatcatccgcacagtgcacagaactatagtatatgaacatcagtgactctcgagccgctcacatganaacggntacgatgtgtatgtantgtgagatgntcattgctgacctcggtgggccgtgatattantcgaaagcacgccctagacgtcggactgagatacactcacctgtgatcatgctcaagtccaacatgcgaccggtatcgttacaacatcagcagtctcatcgcatgtcggtacctgagctactgtcctcacgatagagacaccgacaagcgcgatcgcgacatgatcaataggcgaagaaactatagtagacantatancgtnactanataataantacgtggacgtagagaggtagtgagtgcaggtattcgactgcacaccacgcagactacgccacacgcacgaccctgtcnaccggtgaggtgactctacacgcttgacgagtcagtgcgtcacacatagtgttngtaagagtgatgtatagnacatgagattcgtagtatttatcactgtatgctgcgatcgcgcgctnctaactgtatcttatcagtctatcacagtttcccnatctctaccaatanagtcacagtatctagcgncgtcgcacgtgtatagcgcacaccacacatagcgagctgancgangtgcgcntcgncttacgctgcacgatcgatgtacgagaagcgctatgcgcgaantgctggtagtggntagngcactgagagtggagatcttgtcagtagacggcgcgtgtgatataggactcacagtnatggtcnncatctatttagatcgcgtanacacgatgccacacgcgcgttgcgaagagagagcgtcgcacccgcacgactaccgcacntcgacacgcatctcactcgctgcgcatgactntcactctcatctgcagtacgtgaaggtattcgctctcgngcacagagctatcgttgtatacacgctcatccacctgtcgcttcagttatntctctcgtactagtgtgactaccacatcacgaaagcngacgagccgtcacctatcgcgacgccgtggagacactcaggagagcgtgaggtgcgatnccacgcnctatgcgatccccncgtcagatcntacacactacgtattagtatccaatatagtattgatttctatcatagccncatgtgtctagtcttcgtatacgtattgagant

SEQ ID NO: 12139 - DNA, 1235 bp, Homo sapiens
  misc_feature (1)...(1235): n = A,T,C or G
gctgttaggccggcgtatttgaccctttgtaccttgaagtaatagttgctgatggtgaggggtggtgttctcacttgttgccgtgtctggtcggacctgtgcatcgtcgtaccctccccgccgctcagaaacggccagcgctatccttttctcgccgagaccgccccgattgtggggcgcgccgccgcgtatccctggtgtgtattatctctccagagttagagcgtagatcatttgcccgtagacgtatataaccaagcacatggagcgggaataggatcatattcaacccacgcgagtacccagtttcttagtgagtgccgcggctatctacaggagccgtgcgggtagtacactaaggccaacagagagccacggcgccctcggacgcaccgcatgatgagttagtataggatacgtacccggcaatccctacttctgtccacaactaaccgtttcccctccacttttctaatatgggtcgctgatagtcgtgatttagctggttggaagttaccttcgcctcctgtcggtctggctgacagtttcctacttaccatactcacgcacctacacctctatccacacttcgaccattattaccattgaactctttcttatatcttgtctcgtgtgtcgggatgcgagtaggagatgcaagctagtgaacgagcagaagggaatagggcaatatagcaacagtagatagcagtaagtacgatcgccaatctcgccgctcaccttcaatgtctagcgtctctcacactgtacattcctctagtactgcacactatatactccgaatgacctatacctgttgcacgcctccgcacaccgcgtcggcacgtctgcctctcaggccgggcgaagaagcgagagaaaagaacgtgaaggagtaatgtcaatcgactatatgacaggctagcggagacgtgaggggcgcggaagtgctggcgttggtacgcacccgcgcatgctgagagtcctcctcacgnaggtgagagtcctgtatagattcgctatatgagatatcacatcaagaacatatgagcatgcgaacaacacaagagatcttgcccntctatgcccacgtcgtacatactcctcgcctatgttgccgagacgacgcgtccgcagcatgttcgaccctcttccgatgtatcgtcggcggacgatcacgagcgcccgtgaccacagatacaccacccgctccccatcacacacactcacacccg

SEQ ID NO: 12140 - DNA, 785 bp, Homo sapiens
  misc_feature (1)...(785): n = A,T,C or G
cctggtgctactgcttactttctacgtggctgaaccgtttcacattcccaccagcagtatgaggtttccaatttctctgcatcctcatcaaaacttgttattatctgtcttttttattttagacgttctagaaggtgtggagtggtatctcactgtggtattgatttgcatttccttaaggactaatgcttttgaacattttttcatgtgcttattgccatttgtttcttctctggagaaatgtttattcaaatcctttgtccattttttaattggattgtctttttattgttgcatggtataagttctctatatattctggacacaagtctcttattagttataccatttgcaaatattttctcccattctgtgcattgtcttttaacctttctaatgtgtccattgaaacacaaaagtttttaattttcacaaagttcaatttatctacttttttctttcgtcacttatttgtatcatatctgagaaaccattacctaatccaaggtcaggaaggattactcctatgttctcttttaagagttttattgtttttactcttatatttaagttgaatatccattntgagttagttaatttttgtatatagtatgacataggatcgagaggatcttgttaatcactttttcctgatatacatcagcttcaaatgtgaagctataaatctgtaggtttcctgaaagccctcattatataaagcaacttctgtgacaaatttgacttgattaattaattaattagagacacagtcttgctctgtcccc

SEQ ID NO: 12141 - DNA, 1613 bp, Homo sapiens
  misc_feature (1)...(1613): n = A,T,C or G
acatatacactacagtagtagcgtcgtgatatatgatggagatanggacgtcagtgttagatgagtgtagcgcgtgaggtngtgcgaccgaagtanagagatgtgtacactatgtgaagntatggagntcgagtgtgtgntcgtgtgtgcgcganatgtatgaangtgaganagttgcatantntaccgncgtancagtgangtcagagcatgntgagctacaggcagcacgagagcgatctgtgttgcgtagntgagancntaagagcgcggactgctgcgcgntgtgcgagtcactgatactggtantcaggggtgtanctgatatcgctgagtggcagcancgagtgtatgaggcgagagactcgagtccggtgagcgtgtcgccgtcgcgcgtgncgacgagtgtgngtacggcgacgagtaagtcgctgacagtgggtggcgagactacacgtaagcgcgactngatcagagagcagtacgacgcnagtagatcacngcacgttgcgccatgtgagtatgtcngggtgcgacatgctggctgtcgtgtgacagcgagcgacaagcacgtctgttcgatcgctatggggcagtgcgtgagttgtntagattgacgttacgtttacgaactgangattaatagatctcacggtgtcgagggtgctctagctgagtggactagagtcatgtgcagngtgccgagatgaagnacgaccagacagccacaacacctccaacactcacactaaccctactaatacctagtatnagcgtgagntcggagttgatgcagtatganggttgtgtcttggtggtntgatnatatatagtatggactgagtgctgcgtgtgcgacatcgcanggagatgaacgaagtgacgtgtgagggagtcgagtgtgtgtgagtggtcgatgagtattcatgatcatagtcacacacctatcggtggcgacagcagcagntgacgtcgaagatacgaaggcccgactcaccatcatctaacaacatcccttctggttggctgcgtctccgcttcttcacttcgggcgtgcggatcgtagattatgttatctatccatttctacaccatctcttcatacntatctttacattcttantctacttctccgccctattctctattccctcagcctcttttgtattgactttttaaataaagagtggtatctataatgtcacatatgcgtatacactgagctacattcgtaataatacgaacttgtagtatgttgaataaggtgtaaganagtccggantgaaacgacgcaaagacaatacagaatagcaccagctgacatgacctaaagcgacatagagtgtgtgctgtcagtgtgtggtaagagcgaatatttggtgtcgtgcattgcgttggtaggctctgttacgtgagggatgggtggtggagaggcggtggggagtttgtgctggcggtggtgtggtggcgatactgttaccaacgaangagaatcaaacccagacaatacacacacacgctnntanatttanacccatataacaatnccacatctaatcnaccccccannntnnnntnnnnncnnnnnnancacnnaaaaacaaaacaacaca

SEQ ID NO: 12142 - DNA, 1461 bp, Homo sapiens
  misc_feature (1)...(1461): n = A,T,C or G
tgtacgcgatagacaagagtgagcgagacggccatcgcacgtagtgagacgcaagcgtagacatggagatgatgatatgatcacgcgtctactattcatactacgtatcatcacacgacgctctgaagtgtactctgtactcccgccaactatcatccatacttagacataataccacgtagtcacatctgaacggccaacgcagtggggatgtctggcggcgcgacactccacataatgtatagtatgtacatagtgacaagaggttcgagacgcacatagatgttcgacgattgaacgttggtgcttgccattgttacacgatctacagatgtcaagattactacgatacgagcggaggagaataagatcgntacgataccgccagacttccgccacagtatttgtatgttcgagccggccacgcccgccccagccttcacccgaccttctcggtcgccaggggtgctgctcgtgattgacgctgggtagtattgtagctaacgtacttgttcgaatactcgctcatacattaactcataggtcaattcggccatgaatatgaccgctagcgatccatacagggtcaagggatgagtcacctatgttagagtgctcgctagcgctacgtcgcatgtggcgttgtccactgtatacgatgaagagtacatctcactctattctcatatgcggtgtcactcccgtatctctcgtcaccactcatacatgacaccgacgccagctggtatgcgtcctcgtgtggcgagaatgagggagcgtacgagactcagcacgccgagtgctaagatagcgatcacttacacgacaacgcggtgtacactgtcgacaggacgtggccggcgggtaccagctcggacacgacctcgcgaggctgcgacgatagacatagcgactaantatgaggtgaacaaactacgtggtgacgatctagcgcgcatactggagtatatgaaanatcgtgatgatatacgtcgacgtgcgcgacgtgtacacacgcggaggtaagacgacgactcacttacatccacgtcacgtctganactcgcgactagcgtntagtctcgagcgagactcgtgcaatagagtagcaggtgcanatgttcgtcttcgcagataatatactgagtgtctncacgatgtgtctggtatagtgcacctattatacacgcacacctgactatctctgattcgcgactctgactgctgatcgtanttcactgaggctctcgcacatggactcatcggccgagagaccatgngtgtgctagactctatacgctctgtgtccgcancgcatctcacggtgtgacgtgacagtgtactacgcgcgacagctccgcagtacgtagtcactgacagctctcgcacgactccgcgtgtacgacganagtacagacagagacatgcgcgagccagacgccgcaatggcgcgcactctag

SEQ ID NO: 12143 - DNA, 235 bp, Homo sapiens
  misc_feature (1)...(235): n = A,T,C or G
ctacnacgctctgcccacttaaccattggaagacaaatatttagaactccctgaagtaagaaataagaagcaatatttcttccaactcaaaatgtatccaggaagtctatgtatgagatcagcttacagtattcacttcagaccccaaatgacgatatgttgcctgacaagtatacagaaaaattgtgctgaatacttaaaatatagctcacctaaaacttgaaaaaaaaaaaaa

SEQ ID NO: 12144 - DNA, 1158 bp, Homo sapiens
  misc_feature (1)...(1158): n = A,T,C or G
atcatgatgcgaacaatgagtaaagttcatggaaggtatgatttcagtggtatggttgtggtatgagtgacgtccaatgtttatgtatgagttcgtaatgattgaggtcgggctgtgactacccaaagagacgaagatcgttgtcgtcgtaattctcagtatgtggatctggagcgacgagccgccgacggatgcacttccccaaattgtataatagacccactagcgagacgatcacgatctacattccatggctccgtctgaacgtggttatgcacgtgatgtctagaaagtacaccttgcgatagtagcggaaacggcattgtcgtaccaccgagccaaccattctaaatagattgagagaatcgtatcatctcttgatattaactactacaattatgggctagcaactatagcaaactagagacccagtgatcatatggcactatcgaacgcactgtcttatgtactccaatgacgcgaccgatttaaggatttcataagtccccaggaaccaatttgtatagataatataatgaattacttatatatagaaatttattatgcaatttagggcgatgtccaatatttacaatcgacactactaattttggtctctcaacctcatcttctccaacgcctcatggggacgcgcgtgggagtgtacagcacgcacaccgtacagtgttaatgagtatcacaaacgataatttcttccgagaggtttgatcatccactaacaaaccgactacctgtgggaatgaacaaaattcaaacactattatatgtaactatatagtaaagctagtaagtcaaactgttgatgacgtgtagttgaagaatgagtccgacaagacacaggtggtcaggttgtcacactactaagacctaaatgaaagatagtgcgaggaggtttggtggcacatgatattgtggtatagattgatgataagatatgcgcacggtagcgatantgtgagtgttaatactcaagcttgtgctcaagttgagtgacgacctcgcttcaagagatactggagtgagcttctcctcgctgcgccgtacgatgtatcatctctcgtcgacgagggtataacacattgtaaccatgataaagtatngagtggtgaactcgggctatgacgtatgagacatatg

SEQ ID NO: 12145 - DNA, 1602 bp, Homo sapiens
  misc_feature (1)...(1602): n = A,T,C or G
atgcgtaagtcgaagtaggtacgcgacgtggatagtggtttagtgaagatatatatgatgtgtttgttatgtgttaatagacgatccgctgatatactatgtgtgtatggtgacgttaaagtgtgtgtgcagacgcgtgcgctgttgcgtcctcatgtcggccgacaacctatcgtnaatagacttttagtgctggatgtcctcggcctgacgtagtgttggggacggatgtccctgccgcgctccgccgcgttaggtggtggatgacgggtgtataggtctatgtttaggggaggcatgcacactactctaaatcaactcctattacccacccgactcacgtactcgctgcccgcgctggacatgcggacgttactatggattgatgcgcagcgcgncatcccacgccgtgacgttatttatattttgtagcaagagcatattacgacactgtcgtagtgtggagaggagcgttaantcatcaatgatgctgtcaccgcgttggtggcgcgcgtgcgtcgcaactgcagtctattgctcgatgtacgccgcacgtgtattactgacctctacgctgtattagtgcgagcacacgcgcagagtccaacgctacagatctgatgcgcggagctatcacgtgtcaactgcccatctcgtcgtatctgtaggtgagaagcacgcgcaataatactgatgtggtgcctacagtaccgcgagtgccgctctccattatgttctcgtgcttatcgtcgaatactatgattagtgnactaagtgtgtagccgtgcggtgtagggccagaggcgctaagcgtgtagagttgtaattggcatatgtaggtagatgtcgcagatgcggatactgtattatatgttgtatntcagtgtgcgagtacggtcagattcggntgtacgtgcgtggcagccgcgtatgtgttgacgtggtgaaactaatgatgacgagtatctagcgtcgagcgatcattacgcatatacatccggacatcagcatccgtgtagcggtcagcactacagcttatataggttaatcgatatctgtgcatgcgcgatcttgctgagtgatgttnttcgtgatcagttatctgacttcnctatgagtcttgcgatcagatagaggcattatacacatattcaatatgaagttagtcatatcattgattataatatntagtcagtcgagtcntcgagcactcacatgtaccacantcgttccnatctacgaaacatcactcattgcctttctagtgtcagagctatcgctagtcagtactacatagtgtgtcgtcgtcgcgcagcaagaatacaagatatntacgcntcgtcatgacatcacgcactatatctaaacactatacaccactcacnaacttgtacgatcgatctagtctgnaaggtgtaanangtaccgttgcagtcagtacatgtactcagcactactcttactagatgncatcaancgacgcgtcgggcgntgctcagcagagtgactcgcgtgcggcagtgagtgagcagctcaggatgtacgatgcatgctgtactactgagagcgagagcgtacgcacgcatacgatacgcgacgagg

SEQ ID NO: 12146 - DNA, 1397 bp, Homo sapiens
  misc_feature (1)...(1397): n = A,T,C or G
ttatttaacatacatattatatataaactgattataaatgagatataggcaatttgttcatactctaagatcttctactggatcgatacatctcccagcgcgctgcattgtattcagagaatatccacatagttgacactaggattagcgtactttactgtacctctagtgcgcactgtgagcagtatagttacccatactggttctctcctggcacatcttaccatgcgttcacagctcacactaggattgatatcggcatgagatctatcctccaatcgtcgcgtaaccataatatattacgtattatgtacatcaattacttctccttacgcatagaatacccatattcgatcacccatagtaagcaggataatatctcanagctggtgtactgctcgatataaataatctatactattattctatattagcccttcgacagcagtttacaacagtgcagtgtacgcgataggctctcttttagtgacatttagcaaccatatgctgatcaagtacagcatgatcgagagcaagtgagataggtgtcgcatcctgacagtactacacataatagcatatgaacgcactagtgagatccgcctgacttctgtcatgttcgtcaaattatgatttatgttgcatgtagaattataatgcgctggagaactgaaggaggcatcttcatttaatatcatcgtcgactgaggagtcactaaatactatcaatatacactttatatatctctatgctggaaatgatccgtcgtaagtatgtatcagagttttatatatgttctactacgtacatcgtagtcgatacatagatatcattaatggttactcgtctcgcatcgatctacgcgatcatgactagccgtcatatctgtagtacttatattctctgtttaattactatatatattatgtgatcgtcatagcagtacagaatattatatatcttctttctntcgctctgcctattgtatcttatactatacatgtcttatacatcatcagtcgattatcgccgattaggacgaagcctgatacgatatacttacatgatttgttataatattctattgagcagcggacataccacgtgtcgcgctcacagtanaccacagcgatactcacaatacgcaacagtatctgtgactgtagactatccactgagagaatacggttgtattatcgctactcgacatgacatacgcgctaagacatccgaattgtgtatatatatagtgcataactaacagatgttaggacatgaccgcgcactattaactcatcatatnattntgtaactacnctcgactatcatccatcatgcatccactctacgcatagattatatacgagncatcgatctaactccgatgacgcatgcg

SEQ ID NO: 12147 - DNA, 1279 bp, Homo sapiens
  misc_feature (1)...(1279): n = A,T,C or G
tttctgtattcgtggacgctatattttcgtgtgagaggaaaagtagagatgaggtggaagtctcacgagtactatttcgaattaatatcaaagatattaaaaggatacctcagagctatagtaccctcacatatcgcgccgtgagtgtccgaacaactcccacccaggcacaacagcgttgcggcaagagccgttctcgacgcctccagccatgattgagtccacgccagtcgagcgccggacacacactgcacgcgatgccagatttactgctgtagcgccgacacgctgacggaggcgcgacgcgcgtggtactagaggagaacacagcgagcccagcgagccgattatgtaatgcggcacgccactcgctcgccgctgatctattctacgcttatcctggcccaccggtagcggacgacgggaactgtagcgctaaacactaaggagcggaggcgtaatcaggaccgccgcaacaatagtacacgacagacgtataagatagctgcccggggccgccccgccgtcgacgagtctagtaatctcggagcaccaggcgcggacgggagtggatgtccgtcatctgaggcaggcgaccgtccccctggcgagcgcccgacgcagaacgcaggtaccgacgcgagacacctaacagtcacgagtgttgttatacgcaatcgacgtatgacagtgcataatcgtcagcactacgactacagatagcataatggcgcgtgtgacacgcgagcgtagagagtagggagaacgatggacgagcgacgcgaagatgtgcagtccaaccgctcactagccgggtgtagcgtctggcagctgtatagtgccgacgaggtgatgtcactcgagcacatacagcgcacgcatgcaggagcgccgnacactgcgtcccggaggagtcgtccggcgtgtatcgcgcgtgcggtgcacggcggcgcacgccgccgtgtctcgcagtcntctcctcatgtcatatcacgccctctcgaacgaggtgtcgtgattantacgataactgcatgcatgagtgagcgtacttgtgcacggacngagaggagatactagtgatctctnttcagtatattccaagacgataccgcactcgattagcgacataacacaacttgatagcgtgagtcgaggggtctcgaggcacacgcgaccgngccgccgcaggtgacggtcgatgctacgttgaacgcgagactcgctagctggcgnccgctcacgtgtctacacccactcgatatatctgcgtggacta

SEQ ID NO: 12148 - DNA, 904 bp, Homo sapiens
  misc_feature (1)...(904): n = A,T,C or G
ggaagatgagagtaatagggaaggggaggggagggaggaaaaggactactctggacagaanaccttttcccacgcccagaagagcaatctaggaaacccaacattcttcttacaattgcaactttggagagcaggtcacaacgcttcctgctagaaaaagagaacaccctgacaaaagaatgatacaatacttacgaatccccttcctgtcagcctggcggtattttgcagagaatttaataaattctaatttaaatgcggaagaaacaagtatttacaaaaaggggggggaggagataaacaacgcgattaggagaaaaagaaaagaaaatgcaaccaagacgggggcgtcggggggggtggagggcgaggatatcggaaagaaaagaagaggctcacgttcgccgcggtactaaattcacggttgccccgatgcggattgtgggtgctgtgcgggggagaattcgtgtagggacgagtaagaggaaccgcatataccggcccgcatatgtcatagaggggacaaggtaagcaggacttattgatacaacgaggatgaggattcgcggaaccctaggtacagctaggcggcggggccggttcatcaacgaataagtgacgctgatcgtccggcagagagcgcgctagggcagaccaggctagaacctcggggtacacgaacatatacggctggacggaatcgttatttatggggtgaccacccgaccagaggatgaagtaccagggcgagctattgtgggataatcccgcgaggccagaacaagcagagatgatctgccacacgccgtaacgcggcgtgagttcgatttgtttcgcgccacagtcaagtattgcccgaacccagtcgtatgttatttatgcgtgaagggaacagcgaaacatc

SEQ ID NO: 12149 - DNA, 1496 bp, Homo sapiens
  misc_feature (1)...(1496): n = A,T,C or G
atgtgtagtctgtatgacttgtagacgtataatgctgtatgcgaagggacgtaaggtgcgagataggtagtagtggataaatntgcgatcatgaatgtcttntaatatatttataatgtatataatagacacttcactataaattatccgtcataatgagagtgatctggcttatttactaattatggtgtatccagtgattgccgcagagttccgctggaggatgtgatggtagacgtcgcntgaccagtgtctacttaatttangactactcgtgatttgaggaccggttcctttcttcaggatcgcggacgagaaacttccgtgtatgcgacgacagctgcaggctgcgaaacggccgcgcgaatgcatgaggctggcggcggcgtgctggcgaactcaccatcgcctcatattatatgatatcgtcgatgaataagccaacgccatatatccgttgacatagaactatcactagaggtgaattcaggaagttccgacaatggagagctcacacgcaccggagtggaggccggtcgagcgcgcgggtgaatcaattatcttcctgcgccgctggtgtatctgtcggaggtgttccgagtcgttgcggtggctgggcncacacgtcgcggatcagtaatcactcaatagtcagaccacccagcgtgatgttacatgcgcgagaatccagcgtaatcctccgactgtcccctctgtgtgcaaggtgcgtagtgacgttgtgagtgtaacgctgccagctaatatatctagatgtctctgtgactctgattactacgactccatcgatantccatcnttatgacgtcttagtgcgtacgtgtcgaacggcatggcgcgggacgcacgcgcgcaccgatgctagctgtcgtggtgtacagcgcgcgcgcagtctcttcgacttcctctcatgtcgtctagactgagggactggcgatgctgtcgcttcgctcatgantatatataacaattcactgtcaattgatacgacgacctagttaatagacgatgaatangtattgtgtgtctgttgcgatgcagcatgtagttcattagatgttagatcgccccatgtgtgtcatcttntgacactcttgttgtgctgtngtagtgtatgagcagcggagtgcatgtgctcacgtctcgacacatatgtggatctcctcgtctctcntcgcgcgacattcagcattatgtagtcttcagagtggagcgcgggagatgtatctaccagcgagagtgatagacacnacgttcacgaggacgtcaccgcnctacactatatgctacatcatgtatgactcangtcttagtagcccgttactaccgagtttncttcatgcgcgtcgcgatgagcgtccgccgtgcaccagcgtccgcttaccacggtcgtaccactcgtaatgtaatcaggcgatcaatgtgctcttcgacgtctggtcacctgccgcacgcagtacgtgtcacgaagtatactt

SEQ ID NO: 12150 - DNA, 375 bp, Homo sapiens
  misc_feature (1)...(375): n = A,T,C or G
aaattttgtttacctcgcacctgggcttgacgnngtacnccaatatatgnggatnntcttctgcctctgtccancagacaagagcaactactcctctcttcctcctcctcttcggccaactcagtgtgaagacaatgaggatgaacacctttatgatgacccacttccttttaatgaacagaaatgcagggaagaaacataccctgggcctgctgtctcggaccgtggacagagctgaatttgcatacacaaacatcttcatcctctgaagaggacaaaaataccaacattcttgtattttccaacatttttcaaaataaggtcactatgcttttagtaataaaatataaatcagttattggaaaaaaaaaaaaa

SEQ ID NO: 12151 - DNA, 312 bp, Homo sapiens
  misc_feature (1)...(312): n = A,T,C or G
cctagnagggtactncagtntaccaacnttcaagcggtggaaaccacacttggaaaatgatttcatgtcatatgctgcaacatggataaaccttgaagacattaggctaagtgaaataagccagtcatggaagaacaaatactgtatgattccacttatatgagtgatgcctgctccccttcgccttccaccatgagtggaagctccctgaagccctcaccagaagctgagcagatgtctttgtcatacttcttgtacagcctacagaaccacgagccaaataaagctcttttctttataaaaaaaaaaaaa

SEQ ID NO: 12152 - DNA, 206 bp, Homo sapiens
cttagggacactaagacgtgtggtggcccaagactacaatcaagaagcagatgcaagaatctagctgactttcaggaaattagaccttaaagcgacttgcaaaaatgaaaaacgaagcctcttccaaattttttgttttggaaaataagttatttttcataaaaaacttacattaaagtatttatgtcaaggtaaaaaaaaaaaaa

SEQ ID NO: 12153 - DNA, 763 bp, Homo sapiens
gccctgctgtctaagctttgctggaggttggacattgtcatctgtgccgactgctctggaagcagggaagcagagcagccacaggtcccagcatcagaagggcttctacagaggaacctatggactcttcttgaacttggtatatatccttagccagcacaagggcatagaataacaatttcaatctgattaattctagatgttggtggtactcctaaaccttagggtatgataatataaagaagattgaatgagaggttttcatttgtacaacatgaaatctgataattcaggaatgatgttgtaaataatgtagacatttttcaaactggcagttggtgaaaagaaagttaatagcaaaccacaaaataataaagaatgaaatgaaagactgaataaatatgaaaataatttgctctctggtaggttctttaaaagatccccaaatttgcaagaatcttactgtattaaattttatcacattttgttcttttgagtaaattataagagttctcatagggccctttgagactggaagtaaacggtatgattcagcttgttaatgtcactaattttttttaaaattgcacctatcggaatactccataacactactccaaaagactttgccttcgttttcattctgagacaccctcttattttcactttttctcttgccccgccaagcccgttgtagtattactattcgacgatcaccctgtaaaaccatgtgtgctttttctatgatagattgctatgtaat

SEQ ID NO: 12154 - DNA, 824 bp, Homo sapiens
  misc_feature (1)...(824): n = A,T,C or G
tcgcggggctggatcccgggtacctcttcttcttcgcgttggggttagttcgcgcttccaatgattagacatcccatcggaattccgtttcgaggcgactgtcaaccgttggtgacattatggggcctttacgtactcgtggggtgcttacactctccggcacatccttgcgacctggtccccccgatcctagcgagtcaccactgttggactttgtcaccatgaccccaccggggacttgcgtancacgagcgcgtctcgttctacagtcttgagtcgccctcgcccacataggtgtgtgtacctgggccttccccatattacgtagtactgtatatcgccgggtcgggtggggcggtgcgctgcgcataacatggttgattgtctgaacgcggcagcgtgctggagatactggccgccgactgttctacggtgtcgtacgcgatgaaagaatagtgagcgtaccgcgttgcgatcttatggtgtatttatactgaacttgatgttctatcgacgcccgcttcccaaacttctgacggggagtttgtggctaatccgtcctatatatcccaccgcttcatcgagcgtgctagaggggtcctctgggtgtctgcctctacaccccacctcgccaaaatgtgtcggtgtgagtggagagctgggtgccccccactgcctaaaaacattttttggtcctctcaaccgacggttctggtcctccgtaactggatcacgtacaccctgtgagcgtatctttctgccgtattcctggtcggcaatctaccccaacgaaactccccgatcaacttgaaaaccgaatagat

SEQ ID NO: 12155 - DNA, 728 bp, Homo sapiens
gttttgttccatgtataaaaagctttgctagtatatgacaaaatatgtattaccatgtcttgtgaattagtacttttatcattttgaaatgtttgttatcatttctgctgaccgtcctaacctgggtatctattttgactggtttttaatgtaactactaacatctttttatgttcagcactttttcacaattttactttcaatgtctttatttttaaaatgtatcttctgtagacagtgtacaggtggtcttgttttattgtaaatcaagtgacaatctctatttcataattgacatatttaatccatatatatttaatttaattgttgttattttgagacttaatatccagttttactattttggcccatttatttttggtttattttagatgtcttgccttatcttagattgattgatatttttagtatttaattacatttcttgtataaatgtaatttcttgaatatttgtttttattttagcaattgctctgggaatataaaaatcatctttaaaatctatttagagttaatggtactactttatgcagtaggtaaagacatttcactagcacaatttcatttgcaggcacctaaccttctgtgatagtattgtcttatattgttatatttatgagatacaatcactacagtaaaatactattttctattcattgtgccatcttacaagtaaacagatgaataaacaaaaaaaaaaaaaaaaa

SEQ ID NO: 12156 - DNA, 209 bp, Homo sapiens
cctagaacatccagaccaatgccctaccaagctaactgcctgtggccagtagacaactctacagtgcttccgcacaattctgctcacaccatgtggtatgcttaccaagaaccagaggtttattctcaaacttgcttatgttagttgcacttgtaattgtaattacaaaactgaattaaatattacaaaagctgctaaaaaaaaaaaaa

SEQ ID NO: 12157 - DNA, 338 bp, Homo sapiens
  misc_feature (1)...(338): n = A,T,C or G
ttcttagtgacgnctggagaagactgctgtgtggaacgagtctgctctgtgatgtttccatttactacgactggtgcgtgttaatttgccaagttgatgcaggtagaaatggcaatgggacttccagaagctaccagaggggtcagcaaactatggtctgtgggtaaaatatgttccacgcctgtttgggaaggctcacaaatggaaaataatttgaccattatcaaattatttaaaaattcaaaagaagaataacattccatgatatgtgaaaattatatgaaatcaaaatgtggtatctataaataaagatttattggaacacaaaaaaaaaaaaa

SEQ ID NO: 12158 - DNA, 836 bp, Homo sapiens
tggatggagtgaacatgcggcctgatgacattaacccgaggactgggctggtggtggccctggtcagtgtcttcctcgtctttggtttcatgttcaccgtctctgggatgaaaggggagactttgggaaacatccccctcctggccatcgggccagccatctgcctaccaggcatcgcagccattgccctggccaggaaaacgagggatgcaccaagtggccagagaacgagctgctgtgggtccgcaaattgccctgcttccggaaacccaaagacaaggaggtggcagagctgctgaggaccccttcagacctagaatgcggcaaggggagctcagatgagctggctaagaacgagggcctcagggggaagcctaccccacaaagtcagggtgaggagaccgtggtcagctcattaacagtcccacaccctctggggagggagaccgccacaacctcgcccgaatgggcatacgaggagactcgcacaacctgggagggactggccctcggcgactacctagcctacgtgcattggacgcgatgcgcgtacaccgggcatatcctagtgcccgtcgcttgggatactacctagattctcgcccaaaacgaaacaccgagtcgctctaccccttacaatttcgcgacaaacacagcgatgctcccactacagaatattacgacgacccaggaccggctaaagaactaataatatgagtgtgtatgatacacctgataaccacgcccgcccccagcacgatccaatcacaactaaacgctgccgaacgcgctagccggtacggggtgtagcgatgtacccacccgcgctccccccg

SEQ ID NO: 12159 - DNA, 749 bp, Homo sapiens
  misc_feature (1)...(749): n = A,T,C or G
ggaggaaggagaagccagagcctcgtccagaatgggcatcaggagaagacgtccagatacctggcgggctactgcccctcgggcagttccctcacctacagtgccttggacgtcaagcgctcagcaagggacagatctgagtgccctgagcctgnggatagcaccttctttgtgccccaggacagtatcatcgtttgctcctacaagcagaacagcccgtatgacagatactgttgttatatcaatcagatacaaggcaggtgggaccacgagaccatcgtctaatctctgcctacaaaggtggctggattgatagaatatgactaagcccagctccccgtggaagcaaattgctctgcttggagagccttcacactgttagaaattgacctggtatgtgatgggtgtgataacttctggtacccgagagtcatgtaaataggcatgttggggacacattttagggaagggcgatgagggttaaggacactggaagaggcagtgggtaggaaaggaagctactccagttgcttcttaacaatttacacaatgttaaatgttttgtaaaataacccaaaaagtgctatccagaaccagctgagagcaagataaatctagagtgggctgcagatgtgaggcatcaaatgatgcatgagctgaccacagggaaactgagctgctttatgtttgaataagttgaaaataaaattaatgatccgttatataaagtaaaaaaaaaaaaaaaaaaa

SEQ ID NO: 12160 - DNA, 727 bp, Homo sapiens
agacagcatttcgcttgggaatgggtgtctcacaagaaaaaacccaagccctcacccaggagatgagtcaaatcattcagatgactccagaagccaagagaccaagccagcctggcatcccaaactgctggcctgttgctaaacacgcacaccttctccagcttctattaataatcggccaggaagcctcccatggttactcacctaatgattaaaccatgatcactgtttcagagagagtcctggcccaccaccaccgagggggcagggaggaggtgagatcagcagcaatgccctttctccctttgagtagaggcagtgtgggctggattgtggtaagactggatctgcagtcataagacctgggacctagagccaggaacactctctctgggtgtcaggttcctcagactacacaggaagaatgttgacttcaagcatttccccaccaacctttgcattcagaagacacttggttgcttaggaaaaagaaaccatggaggtttggggtcatccagataatggtggttagggacacacttgactgactgcctgggttccaatcccagctctactggacgtcttcggcaaattattttttttctgccttggtatttccatttatacagtggggatgttaaaaacagtaccttaccttttggagatgtgttgaagactatggttattacatacaagtggtttataaccaaaaaaaaaaaaaaaaaaa

SEQ ID NO: 12161 - DNA, 780 bp, Homo sapiens
aggcctgagggcagtggtggtgtctcagctcacgcaacctccacctcccgggttcgagcaattctcctgcctcagcttcttgagtagctgggactacagacggagtcttgctctattgccaggttggagtgcagtggcacaatctcagctcactgcaacctccgcctcctggattcaagcaattctcctgcttcagcctcccgagtagctgagagacagctcacacatcctctccattctctgaattcccacaaagactgttattgctggggctcataaaattatactccaaagtatgacgctttggcatccagagtggtttgaactaaaggagactgaaggccccagaagccaaatttgcctctgaccttttcctgcttcctggcttccacccctacttttccccgaaaggagtcctggaaacccaaatcttcttgcccaagcagccgggacaccttgaaatatacctctaacctccctggcctttccgggggcaactggccatgaagaatgtctctgacccaccttgctggaaagcgaaaacaagaccctggtcccaggccgccctggtgtcaccccgggggaaggaattgccttccacaaggggccagaacgaggctgaaaggtgggccaatcccccttgggccggggggggcccttgtttcttgaaccgtaacctgtaaaataacagtacgccccgggtctttagggcctttttggcggagaaagtcaggggcggggaaacttgaataggggagagggcgaggctgatgtggggct

SEQ ID NO: 12162 - DNA, 1143 bp, Homo sapiens
  misc_feature (1)...(1143): n = A,T,C or G
atgggcgtgtgagggacactggtgtgtagtgcacattgatcgggagtcgagtggtgggcgtggtatctacgctggagaagcgatcgacgcgtttcgaatgtctggccactgatcgggtagagagcactgtgtcgtcgcatttaacgtgccctgtgtaggatagtgcagagtgcacgtctattatggtgtatccattacttgttccatgtagcccatggtgttcttgggtgggtgacttgcgtgtgtattgttgattcgttggtagagagaacgtggtgtagatgttatgatcgggtccagctccatgttgaagtcctgtttgttacaccgccgactatcgctatagtggtgcatcgttggcagctcacctagcatctacgctatgccgaagagaatgttcggtgcggcgcgccggcgacaacagacagatatctgggactggtgatcgcgtacgacggctcgttgtgctcggctatcggagcgcgtctcgctgtgaacgcgtggatgtctgtacgtgagtgtcggagtccggctgttgacctgttcatgtcgcacggccgggtgggctctgcactgcgtaaactgctctttcgctgatgccgttcgtgactgtacttaccattattccgcgtctatttgcgcgccctactctcggattctattcgtcgntgcgaagtgatgctcctaagtgggactactggctncgctgttgtgcgtattgtacgcaacctgcaaacgcctattctgacgttgatcattgcgaggtcagacgcgctgaacttggttggtgcccagccgcgtcaccatcgatgcatgcgcgcgtgcttctcttcgcgtgcgcggagcgctattgttgtgggtgtgtgccacactgtagttgttgtgttgtactcctcgtgacttcttatcgttatctcgctgcgcgacgcgctgcaggcgtcgtatgtgcttcctccggtagtgcgtctcctccgacttgatccgacaaatcgtatgctttggcagggtgagcataacttagcgttctgtgcttgtacttagctttatgtttggttcgttacttggaaacgctctgtgttcgtttccctgtgagtataccttgtactacaccacttgacggtcgtcgacactccatatacttct

SEQ ID NO: 12163 - DNA, 469 bp, Homo sapiens
  misc_feature (1)...(469): n = A,T,C or G
gtactaaatttaattagtttcncnattaccttaacaaaaaaaaaagctagtnagcggcacctgcttacagtctaacatctccccacctatccatgctatgcttccataaatattggtgaataaatgaatccaaaatgaacaaagcgcctcattcaaacactcctgtaaatcagcatcacttttaaaagggcttttacaatttttctgttgtggagctgtgttttatatttaattctgtggaggagaaggacagggtggcctccagggcaagaccccaatggacatcttctgaagcatcacaggagcgggcatgaggacagcaactgcctactatctcaacatctagtggaaatggattggattcgagggtacaaaaattatcactcttgcaaggttcactccagaatctaactacacatggaactggttaaaatgaataaagaaggaatgtacagcaaaaaaaaaaaaa

SEQ ID NO: 12164 - DNA, 251 bp, Homo sapiens
  misc_feature (1)...(251): n = A,T,C or G
atgacaccagctatgaatgtgaagaagccgttctgngacattccagacccagcagatgccacatggaacagtactggggtccaaaacacatggttttccaccatatcctgacaattgaactaccctggctgaagcccagacatcatggcacaaagacaagctgtcatcactgaaccctgacaaagttcttgacccacagaattgtaagcctaataaaagtggatttttaaaaaaatgtaaaaaaaaaaaaa

SEQ ID NO: 12165 - DNA, 772 bp, Homo sapiens
cctgactcagaaaacttgtaagaatacaagataaagaaagaagtaaagaaaaagaataaaggagagagaagggaaagaagatgagaggtaactacacaaacatgcagacctaaagcctgctgatgaccagtggacgtattctcatgcacaaccgaaaactcagatttgcttcttcaatgacaccaactttcaaccaggccaccaggacagcacaaagctgacagctctgtctctgttaataaagactcagaaatagcttagcagtgtgttttgacaccaaaaattcactgcggagttagagatcagtttgttaggaacattgcaaactataaaaatctaaaaggtttttaaatattaatagcacttgagtggttttctcccagatggccacaaagctgactatagttctctcctagaaccctctgctgtttatcctctaaatgtccccaatataaaacagttttaatctttgttgctgctgtaaaacttgatctactgtggaacaacataattaagtgtcagtgtctggatgtatggagtgagatacagacagagtaatccaggatgtatgtcactaataatttagtttatggctaagtgataatgggatccctgattattagcaggatgcctggcactggaggcttctagcttgaagcccaagtgtgtggacatatgaggtggcagagggggtgctggtaggagcacgtttgcctcactttttgcctatgtttttagttcattgcctgtaaaggtctaataactctcacgg

SEQ ID NO: 12166 - DNA, 250 bp, Homo sapiens
ctgaaagatgtgaatatggtccttcggaatggagatgggggtgaagagagccctcacaatgctgctgcgtacggggggagggggggccccaaagctctaagggagaataaaatgaaagactgaaaacattcgagtatttataccaaactggcagagacttgcaagggaatgcagttatttttggacatgcatttaaactattattttttctaaaataaaagtgattcttgcggggttaaaaaaaaaaaaa

SEQ ID NO: 12167 - DNA, 297 bp, Homo sapiens
agaggtttccgttccaactccagctggaaagaccttggaaaatgatttcatgtcatatgctgcaacatggataaaccttgaagacattaggctaagtgaaataagccagtcatggaagaacaaatactgtatgattccacttatatgagtgatgcctgctccccttcgccttccaccatgagtggaagctccctgaagccctcaccagaagctgagcagatgccagtgtcatacttcttgcacagcctacagaaccacgagccaaataaagctcttttctttataaaaaaaaaaaaa

SEQ ID NO: 12168 - DNA, 230 bp, Homo sapiens
tagaatactcagaaccgggaggctgggcgctattacgggccccagtttgcagtcgaagaaactggctcagaacgtgaaggtgcatggggactgagagtgggcggcggcgccaggagtcagccctggatctgcccgaccccttccactgcgccagtttgcccttgcgcggccgcggtggggaatagatggagacgtggacagctcaaataaatcacagatggaatgtgaaa

SEQ ID NO: 12169 - DNA, 404 bp, Homo sapiens
ctgtactgattcttccgttttctcctgggattcctgcctcctcccctctaggaagacattcagaagatctcacttgcctgagccggagggggtcagagctgctactacctgctgtgtccgtgaggaatcagcccaataggaaatggaagcaacacagaagagagacagatgtgagatgcaaatggagaaactgcaggctggggacatcttctgagcctctgagttcagccagcctgacagctggtctctcttcactccacaacctttttcaatcgtgaggtctgaaatacctttagactttcagtggagcctgcttcctatgggttacaaaattctttatcatgcatggtttaaattgtgaaaacctctagaaaaaacgtctttacttggtaaaaaaaaaaaaa

SEQ ID NO: 12170 - DNA, 259 bp, Homo sapiens
  misc_feature (1)...(259): n = A,T,C or G
gattatattttttatatggcggtgggtttttcacccccaccgtccacgcnagctactacttcaagntcgcctatggtagttcggtcggattattctgcatcagcttggattaaagcctgctctctgtgtccagtatggtctcttattctccccnacaccctgnantannnnnnncttcttttttttcccattcaccncccaagagcggggggcggtgggtattagtagtgtgctactttttcttgatacctgagganat

SEQ ID NO: 12171 - DNA, 787 bp, Homo sapiens
  misc_feature (1)...(787): n = A,T,C or G
aaacaaaacaaggtcgagataaacgcgcccctataggtcacagtcataatttactcaaatcccaaggagtttgtggnatatctgcaataactggaatttaaaaaatttatcagggaccaaaaaggattatgatactctcgaaaaggcaagcaaaaagctgatgtttaccatttctagccgactcagtttccccgaagattgttttataagggtatgaagcgtatactagcccaagctgaattgtgtgacatattctaaaccaagtgggctacataaaaaaaaaaccgaagtcacattattacccaaaacaacaatgctaacggttgaccttaaatgttgaaaaataaatcagaagatgcataaaatgacgacggaaagtgttgcttcaatttcctngttgtcctcttgccactgttcctgcaacgcccagcatactttcctcctcagagattttagcttttaacaattttgtgtgtcttataaacataccctttggcttctatatatgcatatagattcataccttagtatttccttctatttattgtataaaatatcaagttggtgatgccctatataagatttcacaatgtgtttctatttccataaatgtatatcctagataattttttcttgtcagtacatttaaatctaaaccttttcagatggtaattcaaacaaaatattctgtatttttgacacttactctttcaataaatttagctgttcacaaatttttgcttttataataaatgtattagacatccttaaaaaaaaaaaaaaaaaa

SEQ ID NO: 12172 - DNA, 766 bp, Homo sapiens
atgacaaaatctagtaagatctatatgtatctttctaagtatcgaatgagtgtcctttgtttctttagatattggctgcgtgtcagtactcctctgcagaagtactatcacttcacttataacagtgaatttatatccgccagagaataatagatgtcaggaaccgacgataagcgtactaaaaaacgattgcgcccatcatatgattgaatctgttcgagcatttttggttgtgtttaagcgagagaatgatataaatacagtgatccacagcaagacctggatatgaatcacgtgatcttctgctaacgaccggttttttaaccctccagcgcgattttcactctgcctacgagtccagagatgtacgggtagcgtggtcgtacggtgtcatgctttataaaactttattaggataagcaagaccaccagacccaatgttcccctctgaatagagggtgggaaggtaaaaagggtacttgccacatagtttccttttaaaggtgcacatactgtatataatcgtatgcattttgtcacctgctaccctgagtaccttcaggcaagactgacttaaatattccgggtcagtaagtacttgggtgtaagatctaaacttttcatctgcagaggcaagaaaaatatttgccattgtgccttgactgtggaagatgatggttgcatgtttctagtttgtatatgtttccatctttgtgataagatgatttaataaatctcattgaatacttaaaaaaaaaaaaaaaaa

SEQ ID NO: 12173 - DNA, 326 bp, Homo sapiens
  misc_feature (1)...(326): n = A,T,C or G
caatcgggggagggagcggggggtggggggcggtggagagcctangggggagaacgnaaactncatacctctttataggagaacaggcaaaaagcgaatgcatcgatgtcgaaactaaaagtgatgccaagatgtactgcatttgtacggtagacagtgagacgcgagcngagtagtagcacggagagagcggttatatgaatatctcaaantcgaagaacaatagagaaaatgattgacaataataagtggtacaccacacctacaacagagagcggacggacagggagcagagggagaggacgcgaggagcgtgagggcggaga

SEQ ID NO: 12174 - DNA, 151 bp, Homo sapiens
ctcagggaagaacagaaactctcctcctacatgaaaacggcaaaagcaattatgagtcaactaaaattatccaaacgttcattttacgtaaagcacgttgctgaatgtacacgaaatgtttagaaattaaattaaaaaaaaaaaagatcaa

SEQ ID NO: 12175 - DNA, 761 bp, Homo sapiens
  misc_feature (1)...(761): n = A,T,C or G
ggcccgtacatatcgaaaacagtatatantnaattattntgaacgtcaggtaaatttgtgctatgtattgagattacatgtacctgtgtccaaccaggctaccgccggccaactctttgatctgaatgctctatcacgagaaggaaacagagacactttcatgggtataaacaaatacactgcttactgaaatgtggatcatttaatacatagctgtaatccgtaaatagagaccacacactgatggacttgtcttcctctgcatgattagagtgtagaggctgaacttgcgcaaaaaccaaagccaaagaggtctagatttactatatggagacctattgcacacaatccatttcaatatgggggctattttttacataggttaatgactgtatgtcacaatttaaatttggaaaactaagcagagctcaaacacctagtagaaggtacactgctcggaccatgcaggtcggacagctgtagaagatacatggtaaaaatatgctaagaaaaagacaactaccaaaggtacgtcgagcagttggatctttaccatggtttctcgaataccgttgaaacttaaccgaattaacaataatttctcatggggcaaaacccgacaggactttaatgggcctcgttggcctccacggaggagctctgcggccgctttcttgttacggacgtgtatttatgagaatcgtttactgactttttgcttttgagaagcttggctgtgtgcaatggattaagctaacgtg

SEQ ID NO: 12176 - DNA, 287 bp, Homo sapiens
  misc_feature (1)...(287): n = A,T,C or G
ctttttaatatatggatttacctcttctatcacataaacataccccttcaacggtgcacaccatcaacaaaatatctttatcctgagtccttcacctatagcacgcacgaccctcccacctctctcaccaccggcctccccttctccccgcccccccctcncntnnnccncnccacctttttcgcttttctgtggcttatagtatgattaaatacannnaaaaaatnccccccccntcacaacaaacacccactcttccttttctgttaatgtttatataagtaatg

SEQ ID NO: 12177 - DNA, 778 bp, Homo sapiens
aagccctttcttgaagtccagacttcctgaccatatgagaagcatatttggcttctggggttaaaaaacaatagctgccgaataaaaaactaaagcccttgccgcgatagagtatagaagagagccaactcgattccgttctacgttggcaaaaatgttcttttttctagaattaggactgggggcctaaggcagctacatttgtgaaactaattaaattgtcaacaagtttgtgtttcaattcggataatatagtaattgcatctactgagatttttggatgctaaaccccctcccgtcgttactgggataagccgtgcactcgtcagtgatgtgtttttgtgtataaggctgggtttgaattggtaagataagagacagatctttctttacgatcataagtatgagagcagagcgtccgtcccagacataaaattggaatcccactctggaactggaggctaggtggcttcataagcaaactgggaaggctctcctcaattatctttcgtaaacaaagtttgtatacggttatattcctcctttcatttttgatagtcttgatcagtttagccatgtggtccagcaatcttcattatgggaagattgttcactattagtttcacttcctagaaagacgaggggtgctattttgattcagttgtgataatttgtgtcttgcaaacaataggttcaattaagttatgcaagttatggaataatattccttccgtcaaagtaagaataacctgccacttcttaaaaaaaaaaaaaaaaa

SEQ ID NO: 12178 - DNA, 123 bp, Homo sapiens
ctaggtgacattcctgaggaactgaaatatgaaatctgtcaagtcacatacagagatcctgtagatcatcaactgcccatcccaaatcatccaataaaatatgatgcttcaaaaaaaaaaaaa

SEQ ID NO: 12179 - DNA, 417 bp, Homo sapiens
gtagatctctctctctttacatgtcaggctgcagtgggacaatgcacctaagattcttagaagccctgagatcgtcttcgaagtaccacattaaatctttcttggagtctttaaaaagaagtttttgccgggcgtggtggctcacacctgtaatcccagcacttcggaaggccaaggcgggtggatcacaaggtcaagagattcagaccatcctggccaacatggtgaaaccctgtctctactaaaaatacaaaaattagctgggcttggtagcgcgtgcctgtaatctcagctactcagaaggctgagggaggagaatcgcttgaacctgggaggcggaggttgcagtgagccaggattatgccactgcattccagcctggcaacagagtgagactccgtctcaaaaaaaaaaaaa

SEQ ID NO: 12180 - DNA, 1127 bp, Homo sapiens
  misc_feature (1)...(1127): n = A,T,C or G
gcgtgccacgaaactcgccccggcatgaatcataaagccaaagcggaggggcttcctgggggggacgaccgccggagaaagttcacncgcgccagaaccccggggaggatacacgcgggaggaggcgctacccggccgattattttccgagtctgccaaggcgccactcacatccttaaagagagagctatgacccaaaggagttagcaccgcgtccacaccggcgcagcccttgggaagccagcctttgattccccaatgcaagacatacacgcaatagacgcaacaatatgactcgacgccgcacaagaggtagtatccaagcaaaagataagaaagcagaccaagatagcgttggagagtgaagagaaggtcgcccccaccaccgcgtacaatgcacgggtacacgcgagcaacgaaggatgaccctgagtgagcggtgaagggacagaagtgggcgacacgaagtaggtagctgtacaggatattagagcccacaccacatcgctggccaacggacgtgtgtgtgctgagggccaacccataatatgccagaacagtgttatacagtgaccataaattcacacgcgagtgttaatacncactacggaccaatcttataagaatacagaggagagacggcacngtttgcgcacccagatccccgagaccccgcgagagccacgctcgtgtgactacgaagataggttgtaggggcgaggaaagaaggtagaaaccaaggaatagggagagaggttgtggatacatagaaagacattcgaccaccgagaagagttttgtgcgaatgagtaactcaaactaaacagatagcgcaaaaggacgttgacgcgtaattgacattagaaaagatcacccagggataggtgggtatacaccagcagatctactatcgccgtgagatcgcaatcgctcgcgggagacgatggttgagagatcgacgctgcagtgattattatggggacacgtgacacccaaagagagcgtggcataatcaatgtgtgacagatgcgtaccattaggaacaccgtatatgcgcagcacccacgcagtgtatcctctgtcgagagatacgaacgaaaagcacagctttaagagagacgccaatg

SEQ ID NO: 12181 - DNA, 1503 bp, Homo sapiens
  misc_feature (1)...(1503): n = A,T,C or G
gggcacgggccagtcggcacngctcggagcnntctcttntnttannnnaaggnaaagggggttttgtctttcgatggtacccagcagtgaacaaggttcttgtctgagtgtaagatcatcacgtgtgagatctcnatagacacattgcgtagctatacgttctacagtgtgatatattcaaacaggncgcggggggcgtgagggtgcgcantncagaagactatacatagagctatttcacantcgatntcctcggacggtccctctgatcgtcagcgccgccgtcgtgttcatgcatagctacaatatcttcagcacagacagcatgtcttttgcatattacatgctgaggagcagtaacccactcacccgcaccgcngctgatatacgctacctgtagttaatatgagataagtgcatgtccgccataatcgctctcgctgtgtcatacatanagtagcgatgcgggggggtagagttcatcgtcgcttacatgacgcgacgaaactatgacagagacagataacactcacacagtacctacggtttagatacgagcgtgtacattggcggaggtcacgcgtccgtttacccntcataagcatcacactgcgagatatatactaacacatgagagaggcgtatatagaaagtggatgtgtgcacacaagcgcagatatacgtgtagcactgtgatcgagtaataagtaattcaatccactcgttcacctaactacacatcacagtatgagagagaacgatggatggatggcagctgcacatatcactccaccagcatatatagacatnagccacacccacgntacgatttataacatactgtcagcttactgcaatcacctctccacgagcagcatgatcactgaacggatgacacggcgcgagggagtgacatgcgcagtactacgaatgctgctggacccgaatcaatatattcactcttcgcatatgcgctcgcgcgcatcgcggtggtattatggttatggtgaagtgaagagacagcaagaacacaagacgacagatattatgtataatcgttcgcncatttgagtgacagctgacagatgaattacacaggcaactcatagactagcacgacacacgacgtaccagatcggagagtagttcttgttagagatatatagagacgctgtgatgtgcgcgtcaactgacgagccacgtncgctgattngtgnagtgcgcgaatgcgcacacgctcactcgncgtcgtgggcggcgcgagaagtattgtcatatctatagtgctgagtcatgatatcngatccacgtatcttagcgagcacatgcacgtatgcacgaatgcgtcgtgatcagatatactanatcatcatgaatacagctatcactcgcatcatagcangatgtatcgagaagtctcagtgctcgacccaactganaaccgcgcgctgcacggatatcgacgagcggacagagagggttgcgctgcgcgcggcagcgcgc

SEQ ID NO: 12182 - DNA, 848 bp, Homo sapiens
  misc_feature (1)...(848): n = A,T,C or G
gactctcttaatctccaccgctacacgccttcacatgcccagttggtcttctggaatttgatcctggttaatggtctggttgtcaagagagaaggtaggggcttatcctgagaggatgcaagaatgtctcataaggaatctgcctcaactgaggcctctgcatgatcatcaaactactgggacagtcaccttctgaccaggggaagtgggccacttctttttggccagggggtccacgagaatctgggaatttgaagagctgaatgaaaacatgagctggggacaggggcattctctaacatgaccgcggggggggaccagaatggtgcgcctgagtgctcgtggggctggttgacgtgagaggggcgtggcagtaggcggacgagcgagggtgctggcggcgccgaaggaggtgggcgggaggaacgggagagactgggagtgaccctaggtcagacgcgtaagagcgaaggcctgaagggagggcccccggatgcccgctggcgtatgtagtgcgcgtacggcagcgaatacagagccagccccaaggggaacggcgatgcggagatcggtgcgttgtggacaaagggccgtcgctagcgaagaagtatggggcgtggtagatcggtgtggtcccgatgccgccggattagactcggctcggctaccgcgaagtagcgccatattatccgcgtaaagcgagcgacggaagagcgggttcgagagtggtggagacggaggcgctgacggcctcgtgcgacctgctaaggttgaggaggcttcggataagaggcgatgggcggatgggagcgtgnatatagggcgacgctggagcgagagagagagga

SEQ ID NO: 12183 - DNA, 130 bp, Homo sapiens
tcagattatcgaaactgcgtaaattccagtctccgaaagacattttaaatatgggaagaattgtttgtcatggttgagggaaaatgtaaagcaataataaatctttctaaaacatttaaaaaaaaaaaaa

SEQ ID NO: 12184 - DNA, 1507 bp, Homo sapiens
  misc_feature (1)...(1507): n = A,T,C or G
aagcaccggtgcttccgctgtggaggcccagcgggcgctccgggaaactccacacagtgatttgtgctaaacacgggcaaacataatttaagagcacgcgggaggagcctaatccagtcactggagtttgagcacatgagatcaagagtactgcccttcttaaaaagtcagcacgtcatatcaataagcacattagatagcttggtgtcattgtacgttatttacgtctcagggtgtcttactagtacgtggccttcccacaaggtacagcatgcgcacatcatgtatattagaatgtatttagcgcatactggtagagcattacgagtggttgcaactgtgacacatcatatctatgatattgagtacttagaaaacacagacgtatgttgcgtacgacgactacttgtactcgtagcaggacaatcgatggtgtattctccggcatactagcgacgcggattgctagccgcgtttactatcgcgccacagcggaacagttctctggtgtcaagcgcgcgcggagctacgcgagcgtatcgtagcagacgcgcgactaggatataactanacttgactctcttgattctgatcagtagctagtatgtgacactgccgctgggctcgaggacgtgatctgcgtgatctccggtgcttctgttgagcctgtactgactgtaccgccgccagtgctgcgtntcatatgtatctctactantgcggatgcgtagcgcgcgagcgtggagcgatgctcacattaanccgcggnctgttgacgttgttgtctgtgcgatcttcgatagcgtnctgcgnctgtattcagctttgangctagctgtngnctgatggntcgtcacgctcacttgtgtgagcngnagcagacggncggattgtgtgctcatagagtgatctattctcgctgcgtcagttatgtgtatcgctctctagagatcgcgtgcnacgtagagangcgcgctagacacatgnactgacgtcacgcgcgccggatagtactctactagagtctatgacacatcgtcgactcgtcggcgattgactgatcgtctgagtagctctatcgctcgatantgtcatcgactgcncgcntgcttntggtnctcgtgcgtgagcgtaatctacgagtatacagaggataggatcggccgtctcgtgcgncncagtngtgcanatgtcgtgacacattgcgagacgtacgtcgnttacagatcgtcgacntgctgctagagttgatacgnatgnacaggctgtncgtgtcgcgtcgactcgtgctgatntggctgggtcatgtatagatatactgtcgcgtgtagtatgacacgtgtntcgncgtaacgtcnacgatgtgcgagagtagtgactgcgacagagtngatagtcgcngacagtcgcggattcgaacgtatcgtgagctgttacntncntggtncgngnatatgtacgnacgcgtntcgtcatgcactgcnctgatagcagtcgatgtatgctg

SEQ ID NO: 12185 - DNA, 851 bp, Homo sapiens
tgcgggtgggccgttgggtccgcgtagatgatgctttgtggcgtctccgtctcctgctccgtcgctcgttactgcctcgcgcggccggtcggcggcgggttagatagcggctgtcggtgtcgctggtcttgtgttctgtcctttttgttcatttcgcttcatgtcgcgcttactcctccttcctcgcgcctctccggcttactggtggttcttgtcgttctgtcggagtcttatggtcaccagtgtggggtcgcgctgccgcggcgccgctcggccctggcgttcgctgggccgccttctgctcgtgagtcccgcttgcgcctggtggtgtgtgtgttgctgggcgctgttgcccggtcggcggcggcgtggctgtggcgtgtcccggtctattatgtgttctgctcgctcgggcgttctccgcggcgcgtgcgtgggggctgtccctggcgtgcgcgcgggggggcgcggccgtgccttgtgtctatgcggctggctcacgccgcgcttggggtgcgcccgttggcgtcggcccctcgtctgtccctcgctgttgctgctccttgccgtggtgggtcgcggcggggcgcctcgggcgggggggtgtgcgggtggtttcgtttgtggtggtgtctcctcgtcccgtcgctccgcgctccgctttacgtggcttttcctgcttttgcggttgtggggggcgcgggggtgtgggggtgggccccgccggtccccttcccgctccgccttcccgttcgccctcggggtgtggtcggtgtgtcccgcggtttgtgttgccttgttgtttttatgtgggtcttttgcgcgaacgctctcctttgttaaagaacgag

SEQ ID NO: 12186 - DNA, 707 bp, Homo sapiens
tggtgggcatcaagtcgatacagggttactctggcaggagccagatcgtttgcggtgctggggtgtgacgggcgtagatgggtacatataagaagtcctagtgaaggccctgatcgagaggactcgcgataatattcttctgggtgttctatatcgtgcccacgtggcggtgccaggcggttgggtacccgtattgtgatctggccgtgggcgcgtgggggtgcagggcgcgggggcggctctattatttgcgcgaagtccaagacgtttatgaggtgtattggggagagcaggaccaggggtgtggggagggggcgcataatatgggttgggtgagtctccccccggtaggggggcggggggggacggtagacatcgttggtcgggtgggttgtgtacacggtccttcgatactcgtgttggtggcgttcaggggtggcgcgaggtggggcatgttctgttcgtcaggctcgtctttctgggggtgagggggcgagggagcttggattctacaacaggattcggtggattgtggcacccggtccccgtgtggggctgggcggcgcccccccccctgggccatggtgccagtgtgtcatggaggcgtgggtcgtcatgtgggggtccctcgcgggtgcgtcatgaggttctcttttttgttttaatttgtaaatttcctattgcattcaattagttgtgataattgg

SEQ ID NO: 12187 - DNA, 1109 bp, Homo sapiens
  misc_feature (1)...(1109): n = A,T,C or G
catctcttggttggtgtgtgcgcggctcgtgccacgtctggtgctgccgcgtgtctggtggttggtgtgtgtgctttcgcgtgtggtgtgcgatgtcggtgtgtggacttgcgccgtgtcgtgttgtgtgtctcgtgcgtcgtttgcctggtgtgcgtccttggggtgtgtgcttgatgtcgctgttggtgttgttgtgtcctgcggtggctaagtgcgctccgcgtgtccgtagcgtgccgctaatcaccgctgtgtgttctgtggtcgttttctccgtacgcgccgctcttccgcgtgcgttcctgcgttgcggggctctcttcccgtttgtcggtgtactttctgccctctctcctctccctctcttgccgctacttgctcttctcgctgttggacgcctctcaacctactgttactatcgcggcggcgtgcgtgtctgtgtcgctcgtcctctatactattctctctgcgttgtctatcattacgctcctcgagcccgcctgaggcggctgcgggttgcctgtctctgtgcgctcgccgtgtgcgcgcggttgtgtctgttgcntgttttttgcgtgggtggagtgtgcggggtgccgtgcttacagcgtgcgagcgatgtgtgtaagacctttgtgcgtctctgttgtttccgctgctgtgtgtctgtcctcgtggttctgtgcgtgggcgcctgcgtacgcggatgatggtgctgtggatctgcgccgcttccctgtgtatagtttcttctgattctttcatattatgataatgtagtttccttgcccgccgtaggccgagggcgggggggcggcgcgcttgcgggtcgttgtgcttccgaccgtgcgccgctgcggtctctctaggtcgttcgcgtggtcgggcgtgcttgtgtcgcttctggtcggttcttcctttctgtggctgttccgccgtcgccctcctcgcctcggtgtcctctgctgccagtcccggcccgcgtccccccggggggttgggttcctcggtgcagttgggcccccaagttcgcgcccagggtttcccctttcccctgcccntcttcctcccntcttccccttctttttttctttnttttctttctt

SEQ ID NO: 12188 - DNA, 902 bp, Homo sapiens
  misc_feature (1)...(902): n = A,T,C or G
cctangggcaacaaatgggctagttatggagcaagcggcagaacgactcttgaagatgctgagcaacttctggcctatttggctcctcatgctcacacctcccacttggactcaagccaggcctggaccctgaaaacccaatcatggagcattttatgagccccatctgcaaagagaacattaactgaatacgtcagagactctgatcatgtcagagaccgaagcagagtttcagagaacactcatcttccttctcaacctggctctggatgccaactggcaacgctgtgaaccagtttgggcttggagggctcagaggaagccacttttggaaggcattggaagctggtttttcagagcctactctttgctacccctttctatgttgaaaataaaaatgtaaagcctaattcatagtcacaacaacaatgacaccaggaataaatcacagaccagagtccaaacatctggtcacgttgctcatctaccatctggtgggtctcctctcagctctgtgttctgactgccagtcatctcccttcttctctgtcttcactgacactattctaggtttatagttttgaaataggttcctaactggttgctctgcctccagactcttatactgtatacaggtccagtgacaaaacgatgggttgttttacagtccacagatacattttacttatttttttaatgtccataacactctttggaataagatttaaaattgaaaatcagatggttctacgtaaaattcatatttccggttatgctaaaaattgaatgatctgaccttactgggccacaccgagcaacactgggtaaacttgccattttggttttttttttttttttttagctcaggctcggatttggcccgttatcaacatctttcttta

SEQ ID NO: 12189 - DNA, 161 bp, Homo sapiens
ttctgtgacaccgggaaggtcattttgagggatacacagaagtggccatctacagccctgaaaagggacctcaccaatctaccagcacctcgatcttagacttcccatcctcccaaactatgagaaataaatgtcagttgtttaagccaaaaaaaaaaaaa

SEQ ID NO: 12190 - DNA, 693 bp, Homo sapiens
  misc_feature (1)...(693): n = A,T,C or G
cctagagtccctctgtcagttcttaaaccctgaagctaggagtggagtgaaaccagcaccccggaggacaccaccactatgactgtgctcagccagacttgaagccagcacaacactgggtcttccctgctgtaaccactccctggccactgcctatgtttgctcaaggccttggggctctacaataaacaggtggaaaagccatccaggacaacactgagtttaatgcgtcaccattgatgtgttctccctcacccagtgcacgaaaatgcccttgcaccacaccacagctgccagggtgtgatggaggggtggcttcagtgcttcaaaactccttctgcaaccttttcagtgcctttttcagcaacacaaagttaaaagcaggtactgcaagtgctcacttgagttttggttcttgtgaaggagctttgcttgcacagatagttgttaaattggtgtccttgttggggaaacaatcagtggagccttctattccaccatcttgctccacctcccatagtactatacatctcttcttttggctagttctgtttggatatttttgctataataaaactgtagttgtaagtaaaaaanaaaaaananaaaaannaatatnaaagannnatgganttnnnnnttttggaaaaaanantananatttggcctctttggcctcaccggggagactct

SEQ ID NO: 12191 - DNA, 246 bp, Homo sapiens
  misc_feature (1)...(246): n = A,T,C or G
cctangggtgagcttcctaggcatctatgtgtgtctgcatacatagcttattggctagccactgatagaatggaatttatactaagactgtgacccaagacactgagtgacaaccatgtgaagacacatacaagccaaggagagaggcctcagaagaaaccactcctgctgacgccttcatctcagacttctagcctccagagctgtaagaaaataaatgtctatttttaaagaaaaaaaaaaaaa

SEQ ID NO: 12192 - DNA, 1009 bp, Homo sapiens
  misc_feature (1)...(1009): n = A,T,C or G
gaaggggcggcgaacccgagaaggcacaggaaaaccctggacgttaacacccgcaacccttggagggggcaacacggccagcnagnacgaggaagaaagaacgaaaagttgaggagaggcaagaagagcgngagcccagaagaaggagagcccgagcaaccccaccggcgaaggaggcgacacaagccgccagcaaccagcacacagcggccgacgcgagaagcccggacgcacaggcgggccaagaccgacccagaagagagccccagcacaaaacagagcttttttgaagagagacaaagggacgccgaagacagagcgcagggacgcggagacacgacgaaaaaccgacggggagcacaacccgaaggagaaccaaacacggccgggcggaggggacgaacgaagacggaagggccagcgacccagaacggccaccagggccagaacgcggaccgcaacaacagcaggcgggagaggcccgggaaanacgcgcccgcgccagaacgaaccgcagaacaaggcgggcccggccacgagccaagaaagaacaccccccccacccggaaagagcccaaccccacacagggaagacacgcaccgcgcccaaggcccgcccccagaaaaaaggcagagaagaacaaacagaagccgccagagcgcggcgcaaaacaccacccgccaccaggcacaaccaccgacaagaaaaccgcgcgaacggcgagagcacacgagaagaaacgagcagcccgccagccgccacgaagaggaaaacgcagaaaagcgaagcccgccgccgcacggagaaacaccgcccagagcaacgcagacagcacggcacgacgaacacccgcggaccagagcacccgagaagcgcgccggcggcgagcagaagggcacggcagcagaggcgcggcaagagaacgacaaacagcaaagcgacagacacgcccgccgcgcagcacagacacccccacccgaagccaacgcacaacagagagaccacaca

SEQ ID NO: 12193 - DNA, 786 bp, Homo sapiens
tagagataaaggggaacgaggaagcgtatctatttgggggagtggggaccaggagaccgggtgggggtgtgagatcataagtgttacatttataggatggttgtaaaagggggaaatgacaataagtttgtcctcagaaagagagatgatgggtaaaagcaatatttggggttgacctagacccctgactaggggtaggtgtgggggtagtttcggggggtttatgtgacaaagggggaattgtgctggtttgtcaatgttggaacaaaagaaaagggaaggtacagcaaatataggaatttatggtttctccacaggattggttgggaagtgccaggttgtgggcacagggaaggaagcacaggtcccctcagtctaggcgggtatggaaagtggcatctagtccagccgaggcttgtcaaaggacgcgtgtatggatagtcctggcctcaggtaaggataaggcacagctcggggagaacaagtagctcttttatttaggggcgagcaaaatgtaagagtagattactttcagatgaggaagatgtcatagtggaggctgtgaaccttaaaggcgatcttctgtctatgagaaagtaggtatccgcatcctctaatagcccacaagatccataaaacctctgttattttgtttcaggaagaggaaaatgatgaatagtagaagccccgcctgtgaggatgattttaccggcagctgaaattccgtgacccagatattgaacactcagaataattgaactttttgtctagaaaaaaaaaaaaaaa

SEQ ID NO: 12194 - DNA, 414 bp, Homo sapiens
cttcagttctatttgacagagagactaccagcaaaagatggagctcagcagtcctcaccatgctggaaaagcatgaagagttggaaggatggagacatcgaatttgagtatgataacccctactacactaactgataacatttccccacatatatgcatgtaaatatattgtatacatagtaatatattaatataaatacatataattatcatgtgaattagcataatttacatactatattgttacagatacaatgtttcagacctaaatatattatacatttccttagaataagggcattttcctatataaccataatataattctcaaaatctaagttaaagaattgtgtaattaagatgaaacatatccctaataaagtgcacctgtgacataatgtaaaaaaaaaaaaa

SEQ ID NO: 12195 - DNA, 273 bp, Homo sapiens
  misc_feature (1)...(273): n = A,T,C or G
ctcgnaggaactcagaagccagaataaatgaccaagacacagtctccatcttcaaaaggtcacagtccttcagagaagacagacaactaaataaattccagctgactataatgtaaatatgtatagaatcatatggaagcatacaagaaaaagcaatgatttacttgacagacaatggaaatttcaaagcaaaaaagtatatttcatatggttattaggggatgagcacaactttgtcaagcagacaaaggaataaaaaattgcaaataaaag

SEQ ID NO: 12196 - DNA, 347 bp, Homo sapiens
cttcaggtggagagctggatttggtttgctgactcctgggacagaagacagactgaaggatgtctgaggaaatgaatgagtaaaagccaccatttttgttttgtggagagctggatttggtttgctgactcctgggacagaagacagactgaaggatgtctgaagaaatgaatgagtaaaagtcaccatttttgttttgtaagtctttgctatagcagaagcattttttgttttgttttgttttgtttttaaagaaagctttgtaggatcctgatagacttctggtttcctatgtatctattatacccaacaaaagaaataaagttgaataaataaaaaaaaaaaaa

SEQ ID NO: 12197 - DNA, 930 bp, Homo sapiens
cttagacggactctagctctgtcttcccagctggagggcggtgtcatgatctcggctcactgcaacctccgcctcccaggttcaaacaattctcctgcttcagcctcccgagtaactgggactacaggcaagtgccaacatgcccggctaatttttcatatttttagtagagacggggtttcaccgtgttagccaggatggtctccatctcctgaactcgtgatttgcccgcatcggcctctcaaagtgctgggattacaggcgtgagccactgcacccggccatgtcatttttttgtgcattttttactgtaataattttaagtatactttttcaatataatatggtcatgaacatattgtatatgttgtttttgtgttaatatagtaatacaagcattttccccactgctatgaattcttttaagcaaaaaatgtaatggccacaataattccattgtattatagactaaatactttcagagttgagatattaccaatattttgctataacaataaatgcaaatgttaccaacatagtacttagagatacctgctgtgactagttgcttgtgtatctctccagaaatatccgattgcttcatacacatatatgttatggatgtatttaatacaaatgggcttatgataatcatatttctgcgctgctataaaaaagcatacatggaccatataattttcataggcagctcattctgtgattaggacagattctagagataagctgccataattggattctgaatccactcatcataacctttgcaacgtctgacctatcatctaacctcaggttcgctatccttaagatggaattacactactacctacttctaacaatgttcgaagacttactgccctggacacatacacaggcttatgtattgttttaaactcgctcttctaagcg

SEQ ID NO: 12198 - DNA, 600 bp, Homo sapiens
  misc_feature (1)...(600): n = A,T,C or G
gttagaccaanaacancagacaccaatgaagtcgagangngagtatgtcgatatatatatactgacttagtgnaaatagctatatctcgatactcanacacacttcttanagaatcacgcntgttagncactcctcacgngcggnnctctctgtgggagtgacgacaactgtatgtgatctgttgngcatagttcgagactctgtactgacgcgtggntattctatactacacttatctcctgttgangngatatactatctgactcactttctactctcatttataaccctcgaacgtngagacactantgatagcctctgtatatagnctatctgaggacgaggnacagttgaaggactaccactaagacacataagtgagngagtctatgtgtgcggtgccgctganaggagatacgtagtagcatttctctatgtgagntcgtggntcatatggagacacatactcatctggtnntactctctgctatgangnatataatagagaggtagcatgtaagtgtgaaagaggnagcatganacaggtgacgcggagaagcagnggatggcgctgggggaacacagtgaacctctggacg

SEQ ID NO: 12199 - DNA, 866 bp, Homo sapiens
  misc_feature (1)...(866): n = A,T,C or G
ctcagtgtcactctaagaatccttgnggcaaatccaagttgatccacaaattcataaggaactgcaagggactctaaatacactgagcaatactgaaaaagaaaaataaagtntggagtactcacacttccctaaattcaaaatttaccacaaagctacagtaatcaaaacagtgtggtactggcataaaagtagatatatagcccaatggactagaaatgagattccagaaataaacccaaacatctatggccaattgaattacaacaagaatactaagataattaaatgtagagacaagaatcaaatagacgcaataaaaaatgataaaggggatatcaccaccgatcccacagaaatacaaactaccatcagagaatactataaacacctttatgcaaataaactagaaaatctggaagaaatggataaattcctcaacacacacaccctcccaaggctaaaccaggaagaagtacaatatttgaatagaccaataacaggctctaaaattgagacaataatagcttaacaaccaaaaaaagttcgggaccagacggattcacagctgaattctaccagacgtacaaggaggagctggtaccatttcttctaaaactatgtcaatcaacagaataaggggaacccctgctaacttattttatgaaggcagtatatccgcctcccaaccctggggtatcaccacataaatagaataaacttgtctccctcgcccaaccgtggagctcttcggaccctctcttatgggggtgaattataatcctctcactaattactcaacgggcgtcagaagagaacgtgatagctgactatagggtataacgcttcccaacagtgtggtctcg

SEQ ID NO: 12200 - DNA, 1348 bp, Homo sapiens
  misc_feature (1)...(1348): n = A,T,C or G
ctaatatcatgattcacgctctgctctacactctcttgtgtnacatcttctttcatctacgtactactcccacgtnntgcctctcttctctcacngatcagacagcctactgctccgcgcgtgccgcctcgagcgcgagtagtcttctgngagcgcgtctcgatagctagttctatgtctatataatgcgtacgtnaccactctgctatgnctctagttacactacattatttntattactcattcgctgctctctctctacgtgtgngagnatgacactangcgcctcgctatgtaccgcggagcnatcgtntcagacgcatcttcgctgtgtgatctgtagtgagangaagacgctgagaacgttagactcgctctngcntgcatctgagtaacgcgtatcggatnggcctctctcacgtaggtgtcgctcgggatgngactacgcattacatcatcttcatctgtatctctcgcgatccatatacggacatcgtatagcgctgcggtgnattctgttagtgtggncgctcttgtgcgacatcggacgcgtataggatagagtgacgtgtgtagcgagtgcctagatacgacagtgtcgtgtgtgggcgggtaacgcggatacactattanaccgcttgacagtgcgcgangcncttctctcgcgacagtgtcgccaggtctctataatatattctttggcgcgacatcggcgtcacgataacagctctctttcggtgcctctnctttcgggnngggtgtggcgtgtgcatggacatttgtgctagtgcgacgaaganggtctatatctttctctattagggtgaactcacaagttcttccgtaaaacactcaacacncctcacatttcactcccttctcccccaatacggctcatgcttggggcagtggcacacatttctggccactgttagatgaacccccaccctaaaaataatgttcatttttattttnnactacgacgcnnccacgccccgcggcgtattcgacctncacctctcgtgnctcctctcttccctctctccctttctagctcttgacanagccattgcctctgcctcataatatatacataaagtctgaacttctggtccctcacccacccgtttctttnnttttttcactttnnntcctttcgttgtacttttactttttnntnntattctttnnnngtcatnttacttncctttnttattcattnnnnntnaaaaantnnnnnnnnnnnntgttttnccctcaaaaaaantnnnnnnnnnnnnnnnnctnnttctntttttnnnntnnnnncttnnnnnntnncctctttttnnnnnnnttcccctttttt

SEQ ID NO: 12201 - DNA, 878 bp, Homo sapiens
  misc_feature (1)...(878): n = A,T,C or G
cgactcctattctaagtcaaggaaacgagacgnggaccttcaggtatcacttttcccttgggttgagatcctgcctggaaaaatgtctgcaacagcactgatcggattatcctgaccagaggagagcctctcctttaccgcctgtgagaagtggaatcatggatatagagatgctaagaagtgcctaaatcttctggcagatagatcgtgaacatctcagcttttccttggagatacgcgttctactttggttacctatgcgtttggtttccttgcacctctgcgtgaagggcactttcctaaagttcagttacaagaacattcggaacatctctccaacctgtgttccttttgtgatgctctcctaaatagttattttaggcttagccgttgagatggctgacaatctttaccaaaaccctcacctttctccttggaaacctgccaacatctcaacccgctatcggcggaacaagaaagtcatcccttctgctaaacaccccatgccgactcctccccatttagctcctttgcgactaacattagtgtcaccgagacaccgccccgactttataaacagcccttcccctgaatcccgcatgcatccacttagtgcttccgtcaattagctacgctatatattgccctcaatggcttactctctcactgctctcccccagcatcccaaatacccatatatatttcactccacccctcaccctactgccccatcaccacactccgtaccccactcccctgcctcaccacccaaaccgaaatttactgaagaccccacagtagcgcccccacacacccccctcatcctccatccttctcagtcgaccacccgcaatcactttacgtcccggcccacccca

SEQ ID NO: 12202 - DNA, 669 bp, Homo sapiens
atctggtttttttttaagctagatagcttcaagctcacacgaaaggcgacattagatcagtacaaaattagctacgtaatagacccgcacttctgccatagggaatgatatgtgtttaataacctcgatggtttttcagttaacaagactgccaacaccttcggacaagacaatccgcccaccacacctttagacttacttgtttttagaatacgctatataatataagataaattttttgtgacatgacttcatgtactgcgacgcattcatatattctccattagaaacttcctttatttcacatgactcatttaaagagttcgctatatattaagcttcagcaagaccccacatatatcaagaatatgatccgatctggtaatactcatctcttacatttaaaaactttgagacgaacatacccgctaactatatagatcgagatgcacgcatcccacatagtaacatttatacccgttcgcacacctactctgatcacatctctattgttaaccatcaatatataagatcagatatctataattcaaactcttatcaatccacttatactcctcatgaccatccctcacttataatatttcttattcgtccctaatttgatataatctaccaacagcccctatatatattcgagaaaaataagag

SEQ ID NO: 12203 - DNA, 397 bp, Homo sapiens
  misc_feature (1)...(397): n = A,T,C or G
tcagttcctcaggatgaagtgcctgccttgtccttgacctagtcccacaatcccaagaattcagctgccatgttccagaacactcttggccagcatgatgcctggatcattgtgtcttctatcccagatgtgctgctgtatgtgggccacttgtcacgcttgcaggagctcctccatgttgacctacccaccgagacctttatcctgtcacttcctctgctgacctgagactgctccacaggttctgttggatttcaagtatcttcttctataacatctactcccatgtgcttgtctcaccctgtaccatgtattttgttgctggatcattgtcttgatgcactcaggcagcaataaaagaataccatagcctgngtggcttataaaaaaaaaaaaa

SEQ ID NO: 12204 - DNA, 445 bp, Homo sapiens
attatggatggtggggaaagccacctgaagtataggggtgagataaacaccctgcatatgggaatcagcaggataatatcctggaagcgtcggtggtaggataggcttatcatgtcttagctgggtaccgtgctgctttatagtcagaagtagcaagactccatttcgggcatcgtcggggtggggcggacgcgaggagtgacatgggttaaaggagaattaatagcaaggtatgcgtgtggagctgggatttcttgagggaagatggtgacgtatagagatcgattgtcgacttagtaggtctgtcagtggtggatgcggtgctgatttgtgactcgcgaaggtgaggtctgtgtgtagcagagcgaatgaaagatgagtaagagaggagttgacgtaagatggtggggacaggaatagctagggtaggagatcagtgtctaag

SEQ ID NO: 12205 - DNA, 524 bp, Homo sapiens
  misc_feature (1)...(524): n = A,T,C or G
gtctattaattcatcgtttttatgctggggtttatggatgtcagtantcngctccctaaagcactgcagtcctcgaaccacctctgtacatgctccctactacccataaaacagatggtnnatcaactaatgtctagaacatgcttacaccaacgttgttgacttgtttattaaataaacagctgctgcccaactcctatcttgccccctctgagacgtttcattnnccggaccgcattatatacagccacgtcgtttaatctttctactttcatcaacttcttccccaatacctcttttctccatacatgtgtttccataaagggcatgatgactctatcttatctaccccgtcctcctactcctgttctctcccccgcattccatcatccactcctttatctaccatccctcacatatcactaactctctcccaacaaaccctcctcactcgtctatatagtcatctactatattatttatccttctttaatcatccgtgttaccagttgtgttttgaatat

SEQ ID NO: 12206 - DNA, 736 bp, Homo sapiens
  misc_feature (1)...(736): n = A,T,C or G
aaccgccaaagaggacgctgcaaagaaaaccggcccccatgcaaagtgacaaatcggagcccggaaacctgggtagtatgggacggtccggtgaaggcagccagaagaaaagggggggagaaaagaaccgcctgggggaggggggagggctacgaatgaatatgacgcctggaggacgcggcagatggagaggatgtgacattaattgaaccagaaagccgcgtagaccaccggccctgggttgtgggtggggtagaggagaagtgggaaggcgaggccgatacagaggtggaggcataccgcgacgaagcggacatgtaataaaggattaacgaaacattggtcaggcataggttagaccaataagatcttacacgcgaggggaagggtggcaggtgctttccaaatagcagagtatgtcgcaaccagcgagtttatatagagagatactcttgcagaaacacaatataaggtgttcagcaagccatgacgagataaggagagtactatcagggggagatatgagaaggcatgataatggtcgagacgaagttaagggaagggaggcgaatggcatagccggcagtacacgtgcatacggccntgatatgtttagaggatgaggcgggcagtaggagctagtatagcatatgattcaagaagccgggacacgagaaaccagcacagagatagagtggaaaaaccatcaagaacgagaagataagacaggagcagc

SEQ ID NO: 12207 - DNA, 1358 bp, Homo sapiens
  misc_feature (1)...(1358): n = A,T,C or G
ataaatgtactgatcattttatcttgtcgggagcgtcncctaacccctcactgtgtncaacgccaggcggggaagacatgttgctcattaagtcccgcgcctncccaaggtatgagccgcgacccagcgatatctgagttcgtaatgacgtgncacgagatggcaccgtcggcacctgccggccccaatggctctcactgcatcagcatttntctccccgagctaggcggcccatatgcnnctgtctacatgcatgtctctcctactcgtcgtaactcgcagcgcaccactcacgcccaacatcccgtattnnatcgcgcgtgacggactagactacttgcactattgtttcaacatgcctcctctcattgatcatcactatttctccgatgtcactatgatctactncgcggatccagctagtaagtcngcctcncccgttttgtgtcctatatgtgtacacatctcacgccatctcccgctcaccttcttattctatcatgtntcgtactgctcgatctctcgctctcctaggacatctatatcatgtcaatcactcgctgcatgactctactgtgtagtatccatatcgacgctccaaccagcgagcacatactatcacacgcgaacgtatcgtcntacgtcgcacgactgnattgcggactgcatacagcatcncatacatcacatgactagtntattaatcggccactactgcaatactaaatatgtcacaacaaacttccacacattctagttctatcttcacttacatgcacattcgtctacattagcatgtcgtcctctcgncaacactcatagtgttntactgtatntgtattatatctactatacagtatgacaatgactgtagcgatgatgcagtagngnntcacgtcgacatgcncagcgcacatgcacagtcncncnagtcgtgagtctgntaccgatggtcttccatagatagctatccatatactgttctaagtctnctaagcatatctctaccactagtatntatagcacaatagttgctagaatcacactatagcaactgtatgtatatggcgcaggtcgtcgtctgtatgttgagaatacatataacgtgaggtgtgcgcatcgcacgtcgncncaacgttagatgaacgcacccacaactactaacataataacacancagtgctccaagctaacacaatagagaatcctagatagtgatgttaatgatggacccccattgtcnaacatgtagtagcactattataatatgttaataggnctcatgagaggncctaggtaggctagagaagttgtagtgtgaaggtgtantatctggttataagtatatgtcctatgtg

SEQ ID NO: 12208 - DNA, 232 bp, Homo sapiens
  misc_feature (1)...(232): n = A,T,C or G
ctcaggagcacggcctgaagacttcttggngaataaagactccaaagagaagctgagtgttgctttgggactgcctggctggaacttccctgttttactttgatgtgaacaaacaatttcacatgcgtttataaactgtgggaagtctctctctaacctgtgtaggaagatttctggttccaacaaggatgatgccctcttctctcaaattaatcctggaaaaaaaaaaaaa

SEQ ID NO: 12209 - DNA, 176 bp, Homo sapiens
  misc_feature (1)...(176): n = A,T,C or G
cttagntgcaacacatccaatttgcttgtgccgggagagaaaattcttcatggatctctggtgctcctacacatctcactggttgggggaactatggagaacactcagagactaagcatcttaccaagccagatactaataaaaatggactgaactggtgctgaaaaaaaaaaaaa

SEQ ID NO: 12210 - DNA, 268 bp, Homo sapiens
tctgtgcactacaggtttgactatcggtttacacatggccaagaaagaatgcaaagatttggaaagtctctggaagagaacgtaataaaatcccacctccctgcagaagctgagaaagtctgcagcttgtgaagggccgagatcccaactgagcccgaagaggtcccatcactctgtatccctgccccagggactgcctttgactcaacccattcctgaaataagccttctgtaataaaaggtctgttcctacccaaaaaaaaaaaaa

SEQ ID NO: 12211 - DNA, 392 bp, Homo sapiens
tagaatgtggcagaaatgatggagcgtgactgccgagaactggacatcaaaggccctgtggtgccctccttacttgctggcttccaggtcacttgctgggggtgggggcacctgctgtgtcatgaggacatccaagtacgggcaggtccacatggtcaggaaagaaccttccaccaatgccagtaaggagactaggtcttctatgagtaaagctatcctcaagacgaattctccagcccaggcaagccttcaggtgacttcagctccagccagcacttcaatctcagcttcctgagagaccccgagccagaaccacccaacttagctgctcccaagtgcctgctcccatgctttgaaaaaataaatgtttattgttctgaaaaaaaaaaaaa

SEQ ID NO: 12212 - DNA, 929 bp, Homo sapiens
  misc_feature (1)...(929): n = A,T,C or G
ggggnaggannnnnnnaannnnnnnnnnnnnnnnnnnnnnnnnnnnannaaannnnnnataagagaaatannaaagaggnannancagatgagaggtgtacgagggngggcgttgtgncncggcgcgagcgaacaccaccaccggncccgccctcccctaccgcaccctccctgnccgtcggggtggtgcggggctcttgctatatacctaccggacgggctcccccgtcattctctattcntcttcttccatgcccggcctacggcatcccgtcctcctatcggtcccctttcctttctcgcgccctccctcctcctccgcccgccgccctccgggccccccccggattgtttcgcacggtgccccccccatcccggggcctgccctgtccgtgcgtcccttggtctttctttttgggcgggccggcgggccccctttggtcatgtacgtgtcgctcccatttctcttcgtccccacgcagggtggggcgtccggtcctctttgccccacctgttttgggccttgtttcgttgccccgtgtgtgggggcgccccggttttgtgttctcggcctcaggacacgcgttcgcggtgtctgcgtctgccgggctttctagtatgcggtgctggcgcgcccctcccgctgtgctgggctctttcctgtgcgtagtctgttgccgtgggtctgtgccttgtcgtgcgtggcggctccacgatcctttgtttattggtgagtagtgcctggtncccggggggggccgggaccggtcttggggagtaggggttcgtccactggcggtggggggtactgcgggggcggtgtcatccctcccgccgtgttggtctggggctctagggttgtgcggtgggncgcgtctatgcacgtcgtgttttctggacggttgcccctgtctcgggtaggggtgcgt

SEQ ID NO: 12213 - DNA, 287 bp, Homo sapiens
ttaggcagaggggttctctccctttggctaccatagctgggaatattctgggtcacacatgaagccagcatggctctgaatcttacccaagggacacaacagagtctcgctctgttgccaggccggagtgcaatggtgagatctcagctcacttcaccctccgtctcccaggttcaagcaattctcctgcctcagcctcccgagtagctgggactacagtttaattttgcaggtctctgataaaataaattactttcagaaaactaaaacaaggaaaaaaaaaaaaa

SEQ ID NO: 12214 - DNA, 290 bp, Homo sapiens
cctcagagtcactcactatttttactcatttagtaaacatttaccatcacccgctatatgtcaaagctcagacgtggacacaaagaatttaaaggtataaactgtgttctttggagcatgcagcctatccaaaaagacaagacccaaataccaaattctactggaatttcaattatacatatacttgcacaatttcactaagacatatgaagaaggatattcactgcaacaacaataacaacaacaacaacaacaaaaactaagaaacaaaaatagcaaaaaaaaaaaaa

SEQ ID NO: 12215 - DNA, 1613 bp, Homo sapiens
  misc_feature (1)...(1613): n = A,T,C or G
aataaaggtgtatattatatataataaatcgccaaccgctaagcactaacacgcgtcacaagcggagaacacccggcagngagggncaagtggtgaggtacagagaagcgtagaccactagctaccacaacctcaggtatattgngtcgcgcggctacgacttgtattgatcaatattgtacgtacacagatacagactcactaggactgccgtnatagtcgctgtgtntaagtgtcgtagcacctataatcagcggtgantgacgtgtgtctgtacgtgtatctagtnnttctgtgcgttcgactgttctcatcgcgtaccagtttgtggtcnccgcgggccagaaccgtaacggacacgtgntcttactgtcgtctntacatgatgatcttcatatgtcncatctcctnnccatgcgatataagagtcaagcacacacgaatatccgattgtgantgacagtagagtagctncagcagcagtcgccagactcatattagtgtctcccgcgctctatgaggtcagcgacgctnagccactcgtgccaacactgcgtgactctgacccagagaagacgcacatgtcctgtcatagtccttcaacctacctacgactcgtgatactctctctgacggaacgcataatctgtgcnacccaccacactagcactctcacacacgtatagactatctgatagtgtatgncntctagataacgactattatagtgattccagttatatattnacgacatctcagaattcgtatgtatgtgnttcgtattatgattgcttctctctatctcggcactatcgctgtngctcactagagtctcacctgaaaggtcaggnccattcatactatacacacacgatcacatantaccccatactactnatacgtcaagatctagcggtcactcagccatcgtaatcaagtgtangcagtacgcgagagctcagagattcacactgtgctacgtactgactgggtncattactactgtcganaatgtgagtaatgtctcgtanctttgaatgcgctcacatgagataagtataagatanncnctgtacgtctgccccagagaactatcgactcnaacttagatgagtgtcgtcagatcagttctcncgctcacctctataatangagtagtgctntaagtcgcagttactcggtcactgctnatacagacntcgagtctacctatcgatgtnacgtgtgnccatcgtagtgctttgtgtgtgctntgtcnactacncttcgaggagactacgcacatatagataatactacaatacactatccacccncaccgcatatgtcgcatcgtcgcatagtgttcatgcattgagctacagtggatcgtgtgtgtgatagatatctgatattttatattatctntctataatagctgnagatggtctgatctgtatgaccgnncgcatacgtgtagagtgctagagagcagtgtagtgagtagtagataggatgctaatagtagtgnnnagagtagaggaancgncncgtagatagtagtcgattatgtcagattagatgtagtcaagaacangcncatagagtgannagtggtgttgagtgngtgtgag

SEQ ID NO: 12216 - DNA, 385 bp, Homo sapiens
ttagttggtggaccactgggtgatccctgccatctctgcagtggccgtcgccttgatgtatcgcctatacatggcagaggactgaacacctcctcagaagtcagcgcaggaagagcctgctttggacacgggagaaaagaagccgttgctaactacttcaactgacagaaaccttcacttgaaaacaatgattttaatatatctctttctttttcttccgacattagaaacaaaacaaaaagaactgtcctttctgcgctctaatttttcgagtgtgcctttttattcatctactttattttgatgttaccttaatgtgtaatttacttattataagcatgatcttttaaaaatatatttggcttttaaagtaaaaaaaaaaaaa

SEQ ID NO: 12217 - DNA, 735 bp, Homo sapiens
tttttatggtcaatttaatgaatctttagtatatgcttagatcctacaaatttttcctaaaagttgtacagtttaactttttacatttaattcaataattcattttgagttattttttgtaataaagtgtaaggcttaggtcaaggtgttttctttactttgatttagtaattgatgtttgttttgatgctgttaaagtctacttgttccagtaccatttgctgaaaaaaccatcttttctccattgattaattttgtaagcccataacttttaacatcaaaaaagacactactttatctatattttcttatatctaagaaaagcagtagtttttgtttagaaagtgctaattgtgtgccaaagcactatcctaagcttcttatatatctttacccatttccttgcctcaatgactcattactcatttaattgtcttaataactccttgaagtaagtattattgtttccatctcccagataatgaaactaaaatttagccaggttaaatgatttgctcaaagtcacaaagctagtgagttggaaagaagggattcggacccaagcgatattcccctaaagactgtgctgttaaccttcatgaatgctgcattatttacagtgcgccagatatttagcaaaatactgaacattttgctgtttttctcactgttatcacaaggcatttcaacttacgtaataataaaagactctctcctcaaaaaaaaaaaaaaaaa

SEQ ID NO: 12218 - DNA, 951 bp, Homo sapiens
  misc_feature (1)...(951): n = A,T,C or G
tggacttgcgtgatcatgatttagaatgctttgctgcttttgccattttggtgtacgtttgaataaaagggatagcttgaaaggggacacaaaggtaagaaagaaaagaaggcctagaattaaagagggagaaaaagaagcgtgagtacccggagagctgcgaggacgatagcagccgtctgcggctcggaagaactgattgtagatctacaggaagtgtgctgttgtgctgctggcggaggccgtccctgaggaagtaggagaagaccactagggctgtgtctaagtcacagcgaaaagttgttccgtgagacctcttgcataatgactctaaggggcttcagagacattctcctgcgaggtaactgtgactgtgatgtggggagagtgtgagactgggaagcacaagaccggcatgtgatacagcctttcccaccacttgactgcggaactgctgctgtgaaccttttgccctggtggcattattgacagcgttcacagggctcattctcagcacagtgctcgggccattgccaactcccgcactgtcacaggccaacgcgcctcagcgtctcgcctacggcgctacacccgaatgaacctgcccgacgtcgtcgggcctccccctgccccgaccgaccgcccgcgatcgcgcgtcgtccccgccaccaaccncgccgccccgtcacacctgacccacacccccccccccgtgcactggccgccgcgcccgtgactcccccacaccgccgcaccctccgccccgcaccccgcgccgcgcactccgcgccctaccgtcgctccccgccgccgccgcccgccccccctctacccacgtcactcccatcccacccgcaccctcacacccttcaccctcccttcctcgattcctacccatatgccccctttcgttggtgtgcccctatcgctcccccgtttatccctgtttcc

SEQ ID NO: 12219 - DNA, 415 bp, Homo sapiens
cctaggaggaactctactctgtcttccagctagagcgcaatggtgcgatctcaactcattgcaagctccgcctcctgggttcaagcaactctcctgcttcagccccccgagtagctgggattacaggcgtatgccacaacgactggctaatttttgtattttagtagagacggggtttcaccatgttggccaggtctggtctcaaactcttgacctcgtgatctgcccgcctgagcctcccaaagtgctgggattacaagtgtgagccaccacgcccagctgaagaggagtcttagaaacttgcacctagttgcctctggacttcattccacgtcccttttccttttgtttacgttactttgtatccttttgctgtaataaatcctagccatgagtataactaaaaaaaaaaaaa

SEQ ID NO: 12220 - DNA, 200 bp, Homo sapiens
cttagagttacttgtttcctgtgatggaagaagattcatcgattcctggattcacccactggacaaggatgtgagcgtcctctacatcagcggctttgacagcagcacacctacatttataatttacttcttgaatccctgttcaaatatactgacagtacagtaaagaccttaatttattagcatgaaaaaaaaaaaaa

SEQ ID NO: 12221 - DNA, 474 bp, Homo sapiens
ctcaggtccctctaccgcttctgtactgatgaccaccaaatgtttatctcaagcttatatctttcacctgagctccatatccatgcattcaactgcctatttgatatctgctcctgtttgtcttcaggcagagcaaatgtaacatgtctcaaacgaagcatatctttttcagtggattgtaccatctttaccccatcatcaaaatgaggaatcaagacaacatcctggactggcttgggcaatgaaacctgtgttaataggatggatgtcattaccaagcagaagttgtaagactcagtgtgtgcttcaccatggcctatacccccagccacaatgaatagggctttacatctggtggagcctctgtcagcctcaactcctgagtgaaaacaacatggagcagaaccctgcttgcacataagcaacatgtggcataaataaaataaaatgtttgctgtttcaaaaaaaaaaaaa

SEQ ID NO: 12222 - DNA, 934 bp, Homo sapiens
  misc_feature (1)...(934): n = A,T,C or G
ccttccaggccagcacgggtgcagggnatcaactgggncgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacagtgccacactgtcggtgcaccagctggtggagaatacagacgagacctactgcatcgacaacgaggcgctctatgacatctgcttccgcactctgaagctgacaacgcccacctacggngacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgcaaggaacatgatggcccgctgcgatccgcgccatggccgctacctgaccgtggccaccgggtttcgcggccccatgtcatgaaggaggtggacgagcagatgctgggcatccagagtaagaacagcagctactttcggggagtggattcccaacaacggaaggtgggccgttgcgacatcccgccccgggccgaagatggctccacttaatgggacaagacggcactcagaacttgtaagccatttccagcatttaaacctgttcggccaggcctttttcctgttcaggtgagggctggtaaaagggtccccg

SEQ ID NO: 12223 - DNA, 193 bp, Homo sapiens
gcgaggaagcgagtgagagaggcggcaacggcagaggacgccagtcggagacgcgagaacggaagacgaagagcagaggagacgagagacgctcgctcggcggaccgcgcgcacgagaacacaacaccagcggctcggcgcacgccggcgcgacgacacaagaggagcacacagacagccgagagaagaagag

SEQ ID NO: 12224 - DNA, 1199 bp, Homo sapiens
  misc_feature (1)...(1199): n = A,T,C or G
ctnagtgcgggtggagggagggaggagagggcatgacctttttctgtctacagaagagatgaagaaagtgagtaagtatagtaaaatggtgagtggggtgggagtagaaatnttaaaancgaagtgatactaagtagtacattatgcgactgaatgcctgcatgtacctctagtgagtgggcgacgaaagaagactagaggacacgatccacgccgaccggcggtgccagaaagggctccgccccctccacaatataaaccgctaatacaagcccacccccaccaacgtaaccaaagcacaacacgcaggaaagaatacgacgacccgacgcggcgcagaatgcatatactaggcgaccacaccaacccgcaccacgattactagaccgacaacaccgcccgcgcccccggcacctacacacccaacacccccgccccgcatatcccattatatatccgttccaaccgatttgctacacgacgcacaatcgcactatcctacaatacaacgaagcgaagacacgcacagaacacgcgacgcgaggcgcccgactcacacgcggcgccggcgcgccgccgactgtctcaataaaagataaatgacaccaacgtgaacgagacgaaaagtcagccaggtacaaccaccaggtagggcacatgtgcacaccttcagacccaactngctgatcccctctcgtgcgtacgaccactgtgcacggggtagtagcgcacagacaggagacagcaggaccagtctccctagatgcgtggcaagtgtagacaacgcacagatagaangagaaaataatgaaccatcacacgatacacgagtcacgctctcccacgccaagtaccggtgttcacccgcgcgaacggtgccctctacacgggatcatatggacagatagagcacgtcaaatctactcgacataaatatcacanctctccgtgagttgcgacacagcagacgatactagcacataggcgatccangagagaagtagtatccgcagtaagtgatacacgggagtccgacgacacgagagcatatgatgttcacccactctacttatgcgacgtcgaacggagccggacagtgacaccagaattaatagaacgcctcaccgagaacacgaccacagtatagngtcgcttggacgagagcggcacagcggcacgagtagaatggtaatcaggcg

SEQ ID NO: 12225 - DNA, 210 bp, Homo sapiens
ctcagcgacaccaaggaaaagactgaaaaaagaagcaaaagcaggacacatcattgctcccttctggaggatgcagccacaagctcccatcttggaagcagagaggagccttcaccagacaatgagcctgccagtgcctgtatcttggatttcccagccttcaactctgagaaataaatttcggttctttataaattaaaaaaaaaaaaa

SEQ ID NO: 12226 - DNA, 226 bp, Homo sapiens
acgcatcctgatttgggactcagtcttcctacaaggcaaaaagaggagacctggatgctccacgtggtccagacatggagcaagtaaaccgagctctcgccacaccgcacagtctcctcagcctcctgcttaatgtgctttcattggaaatgcttattgtaaatgatgacacttttttataaaccaaaattcaattaaattcaatacatatttaaaaaaaaaaaaa

SEQ ID NO: 12227 - DNA, 230 bp, Homo sapiens
  misc_feature (1)...(230): n = A,T,C or G
cttagggaaactataatggatancttgcttggatcacacgtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagataaaaaaaaaaaaa

SEQ ID NO: 12228 - DNA, 323 bp, Homo sapiens
cttcaggaagacaagggctgaagatatttctttatcaggtggaacagaacctcttatatgaaaacagattatcttggtaggatgcctgctgatgttggctttgagtgacgtgaccttcaacgcttccttaaacatggacatgaaaaggatcagcttccagcagattaagtgaagtcaagaaaactaccaagaaaaaaaaataataaaggcagtttaactttgaaagcaattttactcaatatttctaatttgcctttaagacttgtaagagcctagcttaaataaacagatttctagatcatatcctatcaaaaaaaaaaaaa

SEQ ID NO: 12229 - DNA, 920 bp, Homo sapiens
  misc_feature (1)...(920): n = A,T,C or G
cttcaggaagtncagggaccccaaatggagggaccggctgaagccatggcagaagacatggattgtgaagatttcatacaccttgattagttccccaaattaatacttttataatttcttacgcctgtctttactgcaatctctaaacataaattgtgaggacttcatggacgctagtcacttccccagtcaatacccttgtgatttcctatgcccgtctttactttagtctcttatcccatcattttcgtaaactgaggaggatgtatgtcgcctcaggaccctgtgttgattgcgttaactgcacaaattgtacagcatgtgtgtttgaacaatatgaaatctgggcaccttgaaaaaagaacaggataacagcaatgttcggggaacaagagagataacctcaaactctgaccactggtgagccaggcagaacagagccatatttctcttctttcaaaagcaaatgggagaaatattgctgaattctttttctcagcgaggaacatccctgagaaagagaatgtgcccctgagggtaggcctctaaaatggcccccttggatgtggccatcttctgtggtcgagctgtagggatgaaataagccccagtctcccatagagctcccacacttattaggacgangaaattcccgcctattaatttttggtcagaccagttgtcttctctaaaccctgtctcctgataagatgtattgatgaccatgtgtgcctgaacttcattagcaattttattttaccccagccttgtggtcctgtgatcaaccctgccttcattggcctgnggattcaataccttggaagacataacctctgaacccacaccctatctaccctccttcccttgaaatccaataaacctgctggtttggtgttgtgggataccgaacaccaacttgg

SEQ ID NO: 12230 - DNA, 294 bp, Homo sapiens
cttaggaggcactgaagaagcaataatttgaagttaaaagaaagagaagatttgttcttcatggaagaagagtaaatgttattttatttctcctttccttaacttgaaagaaatgaaatgaaagaggagagttattaaggtcatctctactctccctcctgctgctccacactggtcttgctggaattccaaactgtctctttaagattctttcagagtcgaccatgagcttctcaaagccttaacccttttacgaaatcaagattacctgtcaactctagaaaaaaaaaaaaa

SEQ ID NO: 12231 - DNA, 549 bp, Homo sapiens
ctcaggtaacgagctcagctctggaaatggtgacgcattccttgtatcgtcattccagttctgctctgtatctacaaaaagttcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccattttaaatctgtgataaaaagaaagactaaagaaattttcctaaaggaccccatcatttagaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtaaaaaaaaaaaaa

SEQ ID NO: 12232 - DNA, 236 bp, Homo sapiens
tcagggcgactctggcggccctctggtctgccaaaagggtggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacacaaaaaaaaaaaaa

SEQ ID NO: 12233 - DNA, 154 bp, Homo sapiens
ctcaaggttaggatcacagaccaatggaacagaagggagactagaaatagacccatgcaagtcagtggagaaaggatggattattttcataaatgctgctggaaataaatttgaatggaaaaaatgaaactggatcaccacaaaaaaaaaaaaa

SEQ ID NO: 12234 - DNA, 885 bp, Homo sapiens
  misc_feature (1)...(885): n = A,T,C or G
ctcagactaccctgctggacaagatgctcttcaacttggagggaagaagtctggtttccacattctttcatattttattgagtacattataacctaaacctacccaccttatacagaccaaaaattcccaagtcccggagcacattcagggcgctgactctgggtcccgtggtgatctctccagctacttgcagacgaatcttcactatctccaatgggttggtaaaaatgacctgagagcctccagcctgtaggcaaggaagaagagacaggcagattccacatcagagcccgactggcagcgtaaaaaaggaaaatccagcaaagcctccacatcttgctatcttgaaaaaaaggaggtgaaacttccttcctcaggggggaatgacagtttgacacttaggccaaccctggagaggttcagagggatggtcccaaactctgtctcagatcaatctacctctgggtttgtttctagctgaaatgtcaagattgtttctcagaccagtctttccaggatcaccccagccatattcanaataacaaaataaacccattttggaaaaaaaaggcggagccagatgtgggcagcaggtactcattgaaagaaaagagatagtaaagactgtctatttacaagcccgagctaaattagagctacattattntttccttttgggtaagcgtcttggagcagaccactgctttggttcttggatgagagcataaaactcttggtgcctaagtagaggggaaagcctctccgttcaatctaaatgtttatctaaccaactctgtcaggcctggttccccaccaaagggagaattaaagataattcagttcattcagacaacagaaacttttaggcaagtggaagggacttt

SEQ ID NO: 12235 - DNA, 435 bp, Homo sapiens
cctcagtgctacagtcttactgcattagcaaagaatttcgcctttgaagaccaggaaaacaacaacatggaaatgcagcccagtgcctgcaccagactggatccttgattgtttttcgctagttctttactacatgcctgcaattctagagctcaaacttctagacctcaagttatgcaagttaatgagagctaggctgagagaatcagaggatataggggagaaatggaaggatgagaagaggaaatattgacattgttaaccccaatgcaaagtctggttttacatttgcttggcagttgtttcattttaagaacacatttagaaagctgacttcataaaactatttgttacccatcctggtgtcttgattgtataatttcttccctgcaataaaaaagattggttgttggtgttacttgaaaaaaaaaaaaa

SEQ ID NO: 12236 - DNA, 474 bp, Homo sapiens
ctcagatatacatcacctgccacctgaaggtcaccctagctgagcaggacccagatgaactcaacaaggcctgttccttcagcaagccttccaacagctggttcccagtggaaggcctggctgacatctgtcaatgctgtaacaaaggtgactgtggcactccaagccattccaggaggcagcctcgtgtcgtgagccagtggtccacgtctgcttccctgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaaaaaaaaaaaaa

SEQ ID NO: 12237 - DNA, 173 bp, Homo sapiens
  misc_feature (1)...(173): n = A,T,C or G
cctagagaaacttctttataaatctanttgcctgaaccatatggaggcctttgatgggaacacatgtgcaaggccacatcctgaaatgaaacacacctgtttaaataccatatgtattcccaggactcagagactgattcaataagatatgggataacttaaaaaaaaaaaaa

SEQ ID NO: 12238 - DNA, 382 bp, Homo sapiens
cttcaggtggaatctcattctgtttcccaggctgcagtgcagtggcatgatctcggctcactgcaagctccacctcccgagttcacgccattctcctgcttcagcccctcgagtagctgggactacaggcgcccgccaccacacccggctaatttttttgtatttttagtagagttggggtttcaccaagttagccgggatggtctcgatctcctgacctcgtgatctgcctgcctcggcctcccaaagtgctgggattacaggcgtgagccaccacgcccggccgctcttttcttaaatatctggtggaggcctcaaaatcaaaatgtctaaaacagaactcatcatcagtaaagccattcgtccattaaaaaaaaaaaaa

SEQ ID NO: 12239 - DNA, 296 bp, Homo sapiens
  misc_feature (1)...(296): n = A,T,C or G
gccttagcangttgccctgccacaanctttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaggacatttgtagactcaaatgctcaatttactgagaatgttttcctgcctatgttaatatgtcagaaaattgatagcactaaaacaaaaataagcataaaatttgggattttgattatcaaaaaaaaaaaaa

SEQ ID NO: 12240 - DNA, 241 bp, Homo sapiens
  misc_feature (1)...(241): n = A,T,C or G
ctttggagtgcaanagagataaagataacagtactaacagctgcacttctattgtcgggaattcctgccgaagtgataaatcgatcaatggatacctatagcaaaatgggcgaagtcttcacagatctctgtgtctactttttcacttttatcttttgtcgtgaactgcttgattattggggctctgaagtaccatgaagcctgtagaactgagaaggagaagcttacaaaaaaaaaaaaa

SEQ ID NO: 12241 - DNA, 418 bp, Homo sapiens
cttagatggctctttgctctgcttccaggatcctggatgtctcagtctccccaggtgatcatgtggcctcagaagccagagctagatgtgctcctgatcttgtagcccctcgtcctatgcctcatcaaaaccaggggtcattggaatggactgaagaaggagaaaactagaaaggatctgagggaagtggtctggctgaaagcttgacgtggacagagtcctggctctcaggcagacacttaaattctcctggtgctgcagacatcacagctgaatccattaaaaagaggatggcaaatatataaatcatgacctcaaaattccttcaatctctcacaggacaccagggaaatattttattatccctcaataacaaccagggtcaggaatgaattggaattctttaaaaaaaaaaaaa

SEQ ID NO: 12242 - DNA, 280 bp, Homo sapiens
aagggctactttgatgtttcagagatcacatgactcactctctgggcaccagctgtacctatgctttctcaaatgtttaatgcatgaggttccctatgcatgtatacacacacatacacacacacatgcacacttgagcaatcagttgctttcttcctagtgaatctatactttttcttatgatcatctcttgcagtaacattcttactcttctgagctgtaagggtgacctttcagctattatgttatcaagaagaatgcatcaggaaaaaaaaaaaaa

SEQ ID NO: 12243 - DNA, 239 bp, Homo sapiens
agatatgctttctcgtatccattacttgatcttttgaagtgaaattggaagttgctgaaagctcatcctcatgtccatttgtctccctggccttggataagggtaaaatcaagttttccatgtaaccttagaattttcttttaataatctgaaactctttggctgttgctatttagcttttttttaaacaaatggaataaaaagccgttttacctcatatctttgctggaactgattgg

SEQ ID NO: 12244 - DNA, 276 bp, Homo sapiens
ctcaggacaaatgaaaacaatgacaaggtgaactgaaaaaaagactcccctcaatgcttggaacagagatagtatttttctccaatcacttgtttcattgttttggactctactctgatctgcaaaacttcctgaagaagaagttgcctggatccaagccatagatggagacatgggagaaaccagcatatatagattcattgctagaccaaacccttccatgtaacataatattttaaattattactagtatttccttcaacaaaaaaaaaaaaa

SEQ ID NO: 12245 - DNA, 589 bp, Homo sapiens
ctcaggggacgactggactggctggttgattgacgaagaatttaagtgacatcagggggtcttacatccaatgtattgtttggaaatggatatgcaagagaacaaaaacctcagaccatgtatcctgctcagagcattttcttacagctcctgacaatagcttcttatagcagacagaatttcattcattgagttacaacggcatgcctctaggagaaggatttggaaaagaagatctcatgatatagatgccaacaacttgcttagatatcctctcacagaaaattgaaaagctatgttctcttactttaagttaaaatatgaatattttatcatattactataagttgaaatatctctagataatataacttggattttttgtaaatgttgacatttacaaaatgttgaaacacaacttcttaaaatgcatgttataaaatttatataatagttatttgacacccaaaattgtataataattataaatatatttgtatatatatatcaccctatcatacttttctataatgaaaatatttttatcaattaaaataattggtcacatttcctggtaaaaaaaaaaaaa

SEQ ID NO: 12246 - DNA, 1309 bp, Homo sapiens
  misc_feature (1)...(1309): n = A,T,C or G
cgtagctcgcagtgtagtccacaggagagtgatcctattacaccccgaagaccggngtggcctttctcacgggcaaaacgaccgacgctacataaatgttgactcgtgaccgagcgcctccgcgcgatatgttcatcacacacggaggggccgtatgcacacgctgcaattttatctaggcgcatcaaagcgccccacctccacactaaagtggggtaacagcgccgacacgaagtcttttcgacaccatacaggagcccgtgagccgtaaagatatgtcacggggacattctctcaaaaaagaacggcccacggttgctagggcgcccgaaggagaacacacaagaaggaaaggttgtgtgttgcctcgaacttatattccgagggtataccttataaatataagcgcgagcgtcggaaatggagacgcccacacgcgacctcgctgcgataacccagatgagtgtggagcaccactcatattatttgcgaatcgaaccagactgatacatcgatacggtgggcgcccaacatatactggggacacttcattagtagacatcatgggcgcaaggagttgactcaggcgcggtgtgtggcggaatacaacacacatatctcaggccgtgcagggtgtgactttccacncaactcatcagtcgctcctctatatatactccccgcgggtatatctctgaccctaatcatttcttttnttgtatggtattgtagccacaatatcgctgtacgcacgacgaggcgagcagtcgattatgaatgtgtaacgacaaagatgtgtcggtcgactgtcaaactcatctcgaccacgttctcgccgagcgtaaaatacatataacagtgctagcacagttcgcgcccgatcagcaaactgcaaacgtttttgtgccgcaatgtgtggggggcgtaaagcacagagagccaccacggatatggtggtggtcacaggcaggttcacantatgcttggtgcgggagtaggagcagagtctagtgcgtattattagcgagagtggngaggccgctgacgcgcncacggctgtcatcgatggcgcgcgagaggctagagagggggagatagataggggagtaaacaacgcgttagtgtagccgataacgactgacagcaaagaaagcaaccctccgtgttccgtattatagataataattntgctacgccgcgctatcgacacttgtgatatcacccgctaccgccgacggactgtgtagcataacaccagttgtattgccgtaccggatagagctccatagtattttgcctccccatctgt

SEQ ID NO: 12247 - DNA, 1229 bp, Homo sapiens
  misc_feature (1)...(1229): n = A,T,C or G
aagatgaccacagtattaagactcactctccaaccgcctcgtggggaaaccaaggagattgacctgcagaccccacacacaccacacgtccgcagacgaaagtatgatcactccttttacagataacataacatactctgccacatacgcgatacgtcgaccccctcgtctgtgttcggacgtaggacggaggctggctcggcgtcatcatctgcggcgcgctaaggttcatgcgatgaaacccgctcacagtcgcctcagctaattgtaaacactgtccaccacaggcggatgtcataagtcattccaacgcgcaggcgcgaggtacgattgtcggtcagtacgcgccggttctaattgcgtcattatagctctgctacctcaacctcactcctgagtcacaaacgaccgcaagtacaccagcccgaccgcatcaagactccgcacccgcgtgcggctatatccggaaattatcagcatagacgactggtctgacgcgagatgagcgtgcgcagtactacgggctcacgacgcagttactaagagcgttcgatcgtcagactcgcatctctatcaaataataacatcaaagaagcagtgaagtgcgctgtcgccgactcacaaccccgtcgctcgtaatcccgagacacgtgaagaagtagacactcgtcaacatcacncgaacaacggcatattcttacctagctgcgtcctctatcgcatcactacgatatcacaataaaatcccaccgtacgacagcccacgcagtgcgatcgaccacacacgactgtaacaggacatcgaacgataggataaggcgaatgtatatgacatactatccatcaccacgcagtgtcgctcctcatacaccccgtacgcgtgatctcgcatcattcgtctctaaggagtatacgagagagtcaataagcgaacatatcagtgactctcctatatttactcatctttagtgagcatggtaccagccgatctagagccgctaaccaatntctgtatacctccctagcacacgtaaccgtaaatnaatgttcatgtggacaggatagcagtatgtcacagcgcgcgctcgcggaccgtccggcatgagcgcgttacactatatcggccgactgcgacgactcgccaatctcgccgcgacgtctacacacttcagatgcgctcacgatacatcatcaagtgtacacagatctccctgtctcgacgagcctac

SEQ ID NO: 12248 - DNA, 903 bp, Homo sapiens
  misc_feature (1)...(903): n = A,T,C or G
cctccagaaaacctcacaaacgggaagtttttatatgttctctagcctcatgaaggcatttggttaactaaaaaagaatcatctcatgaatggtgcggaaaatgagtacaatgatttttgccaagggagcagcaactccaggatctttcaaagtagcagcgagtggagaacatgaagtatgctacccatggccttgaccaggttcattcaaggcaacccaggaggcatgaaatttcagacaccaaactatgttcagttggatacctgatatgactgaagtgaccacgctactacgtgttctggctctctgagcagcttatttcatcaatttgttacttgtaggctttgaattgtgcctggcaccaaatcaatgcccaataaatctatgagaataaattttgatcagaagcatgtagtcatcaagaaacaaccctttgcttgatgttgaagaattcagttatcattttcaccaaccagatgcacccagaacaatcaaaatacttcactgtgagaggctttgataacaaactggaactttggggaatgctctttattggaccgacttttgactcaggaggaaaaaaaaagcctaattactgaacgntgaaaaatgatgacaaaagaaacataaaatgaacatatggccttctccatgatacatgctgtaatttaccctgtttctattacgcttagtgttatccatcttcttacacaattgctattctccattatacctaggaattggggactttaaaagtttttcctgtctctcgaggattggaccagtttgcaatttcaggaacctctaactctctcttacactaatctttcacacggaacaaatataaattggcctcttgcctaacggtggccttatcgcactcccttacgaggctataatac

SEQ ID NO: 12249 - DNA, 935 bp, Homo sapiens
  misc_feature (1)...(935): n = A,T,C or G
aaagacccacgcaattgagcagacagcacagatatataactacgactgaccactaccgagagatccatcacatacccagccggcaagagacgctgtcaagattcacaaccgaaacactcttggtcgcggggtagaagcatcaaacaaaggtctattattagaacacgccacatttacaatgatancggctcatcggtaatgagcattaaaatcacatacatagttactatactgatgaagttatatataatttgggtatcagtagtccaaatcagagcaaccaatggctagacgtactaacaaataaaattgtgaaacaagaacgtaatgtgagtggtcagacacacaacaacccacttgtttatatattgtttattattcacgatgatcatattcctcccaaaccgtgaagacagcacagatcatgtaaagaatgcatacaccttggagtaaactcattaagacataaaagtgactttctggggtaaagctcttatttttgatcctaacgttttgatccatggagggaaaacagaaagccgtaattaatgaaacgcaaaacaaaaataaatacgaaataaagcatgaatatggacgtaatggcacttttccgtgtatacatgcgtgataattaacacagtcttcttgttacggacaatgtgttagtcctctgtgttccagattggcatatttttccatttatacatagggcattggggacttttaaaagtttttccctgtctctgttggattggacgatgtttgcaattttaggaaacatctgattattctttcacaaaaaaatttatcagtaaggagaaaaaaaataaaataaatggcctatgttggctaaaatcggtggagctgttgcggtccaacctttctcttgttctactcgcgcgcttcccccaaaactaaaggtactaaatatacgg

SEQ ID NO: 12250 - DNA, 601 bp, Homo sapiens
  misc_feature (1)...(601): n = A,T,C or G
acataagtgtgaagcatagaggcacgagacgngaaactacacacattgatcgcgctgagnccacgatcatgctcgggagcctcacttacagtactcaatataacacacctagggaggatgctgggntccaaacactactataacttaggccctcacttcacctgtgtctgtcgccagcgcgtgtatcgcacgtgtgcagcgtangngagtggtcgatgtacacaagtaaatacaaagacaaacgtaggacacacactataataccgangnaccgctggcatgaagagtagtatgatagcagatgtcactagaaagctataggtcgtgtgctgagaggggaacattatacactttgatccatntcgtggcacactgtagacatcatgtaatagtnataatatacgnanagcactacgcgtcttgaacaaaggagagtcaggagcaaatagataagaagagagagattgtgaaagtaggaaggagcattcgggactagagaggngtgggctgataataaacagacaataaattaaaagcatagaatgaaagaaagggaagaaagaaaagacagagcggcattaaagaaaaagagcatagtccc

SEQ ID NO: 12251 - DNA, 320 bp, Homo sapiens
ttagagtaactgggagatgaaatatgaagctctatgacacacttgatcgaatatgacagacactgaaaatcatgactcatccccctccagcacctctacctgttgcccgccgatcacagtcggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaactaaagaaaaaaaaaaaaa

SEQ ID NO: 12252 - DNA, 941 bp, Homo sapiens
  misc_feature (1)...(941): n = A,T,C or G
cttaattctggtaagattgaataaacaaacaaacaacgccctcaaggataactgcaggtagaccttaggatctcctcagagccagcgctgatctcatccacagagggatcacatgacctcatnctgggaaaatataaaccctacccacctgcctgcccatttggaaatgcagactggaggacgctaagttcattcttacctatgtactaacaagtacacaagaagatgctcaatatcattagtccttggggaaatgcaaattagattatattgtgattccagtgtacacccactagaagactattaaaaaggacaataccaactgctggcaactataaaaaaagaaatatggcctcgctgacctcagcggaggatttctgcgcacgcttccgcttagagatggcaattaattatcctatttaactgacacactacacatggacaatgtgactgccgcaacatgaaacaatcactcaaagcgcggaagccacgagcgccccagaacgcgctatagcagttgaacaactttttagcgaatagcccctaagtgcagataacataataagatctcaagtcatgccccttatctatattcgcgacccccatagacaacttaaaattctgtgctgattgtgtaggttaaaccccgaaaggtctctatcattactagaaattatttagtacagattagcagtaccctcgtgtggtaaacgacgggacatgcctccttactccattcccccttcccccagcatatgttcctcaacgcccctgaagccgcccccctgataaaaacagtaccgatgacanacataggtaaggatctccttccaaaggttagggtacatattttcttttggtgagaagagaatgtaatgaattaagagctcccctatgactcttctcgacatagtgatacccaatgcangaactgaacctgg

SEQ ID NO: 12253 - DNA, 357 bp, Homo sapiens
cttcaggagtaccgatcagttgcgtctttggaggtctcacaccgaagaaactgtgactacccgggcatcagccccgaggaatgcgcctctcggaagtgctgcttctccaacttcatctttgaagtgccctggtgcttcttcccgaagtctgtgaaagactgccattactaagagaggctggttccagaggatgcttctggctcaccgggtgttccgaaaccaaagaagaaacttcgccttatcggcttcatatttcatgaaatcctgggttttcttaaccatcttttcctcattttcaatggtttaacatataatttctttaaataaaacccttaaaatctgctaaaaaaaaaaaaa

SEQ ID NO: 12254 - DNA, 1587 bp, Homo sapiens
  misc_feature (1)...(1587): n = A,T,C or G
gggggcgggaggacgggacgggggcggggcgcaagaccgcggcggagagaaaccgtggcggggaaaacaaaaaagcgccggcggggacgggggcgaaaaccacccgcgcgcggccacgggagacaagccgagacaggggcgggtgcacgggggggcgcgaaagagacgaccggacggagcagacgcagagcccgacgcgcaaacgccgcgcacagggcaggcccaggcgcgaggggcgggggcggcagagggcgaggggggcggcgaagcgggnccgcgcngcgggagacggagcggagcgcgacagggagagagcgaggcaaggcgcgaccgncgggccgcagaagacaggacggcgcgaaggcacgcgaacgcgccgcgccacgcgacggcgagcggggcagcgccgcggcgccgcgcgacgcgccgcgccacgtaagaagcgcggaggagcgacgcgggcgcgaggcagcgcggagggcggacggagggcggagacgagcggcgccgaacacgctgtgtggcgctcggcggcacgacagcgcgacggaccgcgcagagngcgagacgacgngnacgcggaggcgagccgagacggcgcggagcacgangcgangcaggcgggncgacggcgcagacgcgcgacgagcgacgcacggagccngagcgcncacggagggagaagcgcgcgagcacgcacacacagaggaacacagcggaggcgcgccgcggcacgccnacggcggnggaggcgggcgcggcacgcacgcgagaggcaacagcacgacgagacgaggcagacccgcacggccgcgacggancagcgagcacgagacgccgcancgcggcacgggacgcgcggggcgcggaccgcccgccggcgcggcgggcgcgagangcgggnaccgcgcacgacgcgggcgagcgccagcagaggcggccgcgacggagcgcacggaggggcggagcacggcgcagaagcgcgcgggcgagagagggcgccgcgcgcgcgacgccgcgccgcgcacgcgggacggcgcggggggaccgcgcgcgcgggccgcgccacgacgcggnaacacnngagaggcggcgcgcgcgccaccaggggcgggccgaagagagcccccgccgccgcgcgcgcacggcggggggcgcgagnnanaangcacggagcgagcgcgcgagcacagcnggagacgacagcgcaagcngcggacgcacgcgccgggcgacgaacacaggagaagagcaggacagcgcgcgcatgagcgatcacngtggaggggncgcggacgccgcgcgccaccagcacgagnacacagcacgcctacgcgcgtcgccgcagacgcgctcgaggttcncgcgcgcgncgacgcacgcgagtagacgccgacgagtncgccgcagcgggcgtccgcgagcgtgangtgagacggcgcgagagcnctcgcgcgcgcncncgcgacggcggcgcanagagagcgcgtcggacgtagtagaggcagcgatgtgcgacgacggagagcgggagccgntgctacagngccgcgaggcgcagcgctgggcgagnagcgacccgcgccg

SEQ ID NO: 12255 - DNA, 714 bp, Homo sapiens
  misc_feature (1)...(714): n = A,T,C or G
cttcagagttaaaaatcccctaacgtgaagagagacttgaatgtccagatggaaccagctctcccattttacagatgagaaaactggtgctgagaggccaggtaccttcctgaagcacagaaaggagcagtagccttgcctcctccagtggcaaacacctgctagcctccagcaacctcaatcaacttccccagagtcaagcacgtgggacatcacagcaacctgcagaaatactttactggatgcagggatagcttccggacacctgatggtatggcctagaaggaaacctatgagttgctatcccttgtcgtctctgaacctgcataaagcagagaggtgcaggaacaccaggagaacagacaggaggtggccacactaaggcaggaacggcaccagagagaagaaaggaaagaagaagggcaaaggatgggaggcgctaagatgaggaggcaccgcagatggcagcccccagagctgcacctcctgatgatcacaccatgtcagctctccaccgacagtgcccatcatgaccgcacacgcggccactgcacagaactctctgcccattgaaaatcagccattcctatagcccctttagatcctctgatcttcggggaaggcgaaacatctcaggagaaatagatcaaaatcggcatggaggagacttcagacgtctgaanactgaagatgagaattggaaaaaaaaaaaaa

SEQ ID NO: 12256 - DNA, 184 bp, Homo sapiens
ctcagggaacttgaagaaagaagatagccccctctcttttccccagcagtaagacaacggtgtcctcttttactctcatttgaaaacatcctagaacataacttatgtgaaggcttagtataaaatatggacacaaacaggatccaacgtaataaaatgtttttagcggagaaaaaaaaaaaaa

SEQ ID NO: 12257 - DNA, 175 bp, Homo sapiens
ctcaggtgacgaaataaagcagcatgcacagctcaagctgcctcttagaggacacaggttactgaatacgttttcaacaaaatgaactttcaaggcctgataaattctcaaaacattgatctgaagtttggctacatattaaagatatgatttggatttgtgaaaaaaaaaaaaa

SEQ ID NO: 12258 - DNA, 318 bp, Homo sapiens
  misc_feature (1)...(318): n = A,T,C or G
ctcagnagagacggctgaagattagtttctagaacattcaactcctaaaactgggtaaatggctcaattatcaaacaactcacttcaagattcctgcctttctgtgttcaccaatcctaaaccattacgtcttgaaatgtgcctaaccaaaccagatcctcacattgaaagttcagtcttatctactcagacctagatttccaaccctattcacatttcgccttaatcctctccttctggacactccgactcttgtaaaatgttgtcttttctgactattataggtaataaactcagctttgcttaaaaaaaaaaaaa

SEQ ID NO: 12259 - DNA, 471 bp, Homo sapiens
  misc_feature (1)...(471): n = A,T,C or G
cttcaggccagctgatatgcactacatcgctctctcgagatgctgggcaatgaaccactgctcccagtcagccacacgatcaagaagttctaggtcaccagaggacaacaagctacaactagacctgatggagaaaactatgtatcaagcagacattctggactttgaagtaggtgcaattatgtataagaacaggtanttctgggaaatcacattaggactcagaaaacagatgaagagaggagattcgttgtgaagattaaagatgatatatgcaaagtcacaagagcagatccagcatattgtagaagcttaacaaatggcacaaacatttaaattctttaagaatttatgctattttcaataattctaaattcaatcattctaaaagaatgttaaatttataaaaatagaaagtctttgagctatcttgttaatatacattgtttggtatgactaaaaaaaaaaaaa

SEQ ID NO: 12260 - DNA, 223 bp, Homo sapiens
ctcaggtgacgtgcttcagtcagtggagtgaagacccatttctatccccagtcccgcttccaaaagtgttcctcacctccagaggatgcagcaacaaggcgtcatcttggaagcacagagcaggccctcaccagacaccaaacctgccagcaccttggctttggactttccagccttcaaaactgtgagaaataaatttctgtgctttataaaaaaaaaaaaa

SEQ ID NO: 12261 - DNA, 288 bp, Homo sapiens
  misc_feature (1)...(288): n = A,T,C or G
cctcagnagccatcgagttgcagtggaattcagctgatgccacaccagtcagaagaccctcatagaggtatgaaatcagcatgagaatacagcttcttcatcatcctgtcccattacttcaccttacactctgaccaatcaacaatctccacacttcagcccagtccaaaacccttaaaaactctagccccaaacttctcagggagatggatttgaggttttctctcatctcctagtttggtgacccccagattaaacctttttctctgctgcanaaaaaaaaaaaaa

SEQ ID NO: 12262 - DNA, 169 bp, Homo sapiens
ctagcgtgcatgcagtttgaatattgtgcagaagaaatgcccaagccgaccccggacctacagtgagaagcagaacagcccagagaagctcagcccagggcaacagagacagcctagtcaacctacagatctgggacaataaatgcttctgcttttaaaaaaaaaaaaa

SEQ ID NO: 12263 - DNA, 950 bp, Homo sapiens
  misc_feature (1)...(950): n = A,T,C or G
ctacatataacaaattaaaggcaaaaaaaaaaacgccttgtttggtttacgnaacgacanagcttcaaagaatacaccgcaaggaagcatcacacagatgagaggaaaaccattaaaagacggctattggaagcaaagagaacacaaaaaaattgaatcacgacagtaactttggacaatggcgttaattgctgctgaaaactcaagttaaattgacacaaaaaacgtccattgcatcaattaggaaagacttgaccataactgatgcattttttttagcgccttgctacctaaggtaccaaggttaacaaacttcaatggctgagctatctgaaatcgcgcgcggaaccattcttacaaagtacatcctccttctcaaatacttattttacttactgccaatgccatcatcccgccttactgcaaaaacatatttaaagaaattcaaaagaaagtacagcagttcgcaaactaccataaccactcttactccatccaccccaatctcgacacctgaccataaattgcgattagatcatacgcccccagaatagaccgtcgattcaaaataaaccacccttcctattcttccccccctgatcttaaatgtcttctattccccaacactcttactcaccccacgcctggttctttcacacgcagaacgcctatactccccaatcatcctacttaccgattccacgcgcaaagagacatgaccaactggatcttagctaagtatccgttccttgcactgcatacaacacaactcatttaacacaactctgaaccacaacaaagcacgtccaagaatccaacactccctcgcacagacacctcaactctcacacttctactcgcccggtccctcttctcaccgtctcattatttttctcacgtaccccggcctactcaacggtcaatatctcgccccaccgcacacattcctg

SEQ ID NO: 12264 - DNA, 958 bp, Homo sapiens
  misc_feature (1)...(958): n = A,T,C or G
ctatgctgcagtgactatgtactgtaccggtctacgcagcatcgcctctcggtgctgatgcggttaagttggcaccgttctcgcgcgggagtcgtggctatccatacctactctatcgtcggtgccgcctctcccgcgtccaactctgtgtgggtccttccgctgcttgccactccggggcagcgtgtaaggttgcgcgtcggtcgcgcatctttgacctcggtctcgctccgcccgagtcgggcgcaggcagtctccgtctagtgcgcggccggccgctcctccgcgattgctagacatagcgcagatatcgttgtcgctcagtatagcccgccgtcaccaacccctcctcgtacgcctccccgccgtgcggtgcttcggcgcacgctacatctatctccgccgtccgtctccacgcataagagcgcgtgagtcgtacgcgggagcgcccgggggggtggcgagggtggacgcggggggtgttgaggtggcgaagtctcgggcgcggagctcgcgctgcgcccgctcccgagcgcgaatgtctcgccgctctctaccccgccgccgcgcgtcggcccctcacaccgtgcgccttgccccctcaagcgctaacgcgcatcaggcctctctcattccagtttccgaaaaattccctactatatccccccccccgacccgatcgacaccgggcgatgaagtatggtcgttagacgcatgtcacgtcatcgtccggcgtggcgggctatttgccgctgcgccgctttggcttccgttcggtccccgccgccggcgcctnccccgtccctccctccccctccgccttggaaattgttcttctttttcttctctcccctggcctggtttctcctcttagagtttccctcttgtccccccaaagagcctcttctctctcctctccctctttccnccccctcctcctctttcctcctctcccccc

SEQ ID NO: 12265 - DNA, 895 bp, Homo sapiens
  misc_feature (1)...(895): n = A,T,C or G
ctcaggggaccataattagcagttgggaggagcttcaaatcctggcactctaacacagagattgttcacttaagactacacagtactacttatgaaaaaaaactggcagaagggtattttacatactgtaaaccacacatacctttattattacttgccagaggaaccccttcatcttgcctaactgccattgtgtgtatgtagagcaatttgggtgaaagaagaacatgtttcacaagcttaagtgtggatgcttcacatttctgggattagtgctgtaccctcccccaaattcatggtgttggtggacaagaacctctcctcttcatggaagtgaacagacaccgcgacgtggccatgagaccacagagtacgagatggaaaagagccacataccgctgtgcaagtggtagtttgaactccttgggtgcaggtacagaactccactgcccatctgactaaatgtgatgacagacagacaccggatgacccgcagcttcctcagccggccatttctacagttnttcccaccccaccttgtagacgttacacgcgctcatgactcaaagcgtccctgtctttcaaaattacttacaaagagcctcttttgaccactgaagcanagattntttaaaagctcttctgaagaaagggttaatcatcataatacaatctccaaaaccatgttgtcgctcaggctatggaaaaagaagtggtgtgacaaaagnaaggagcagacgactcagagaccctgaggagcaacaccagccactgttatgctttgaaataacagttaatgtgctttaggaaatgaattatttagtctaacataaccggctggatttccctaaaagctggcttgactggggactaaaaaatcccttaagtttgactc

SEQ ID NO: 12266 - DNA, 711 bp, Homo sapiens
cttagggaaaaaaaaagtttcctcaacatcaagggactaacacctacagagtagccttaagaaagcaatccccaagccccatcatataaccgtggaaataacagttaaatgaatcctaagtcaaaatgaattaatctgttcctacccatataccgacagtacactacccctcagaaagcatggacaaggcactagggacttcaaataaacagccttaaaagttactgattgacttttagtggtcacataaccatcttgaggaagagggcaaagagggaaaggagctcctgcctgtccctgtttcctgggcagggcattcagcttacatcatgccatttagccctaaggcctcctttctaggtattaggggtggaaatatttacccaagttggttgattatttaaactgcccaaacttatgaagtcaactattcgttgtttcaatctccaagtcagaatccagactgagttctttctcataatggcaaatacagaacaaaattcctgacgtttctcaatgaaaaaaatagtttatgtgcctggtttccaggattagtcattgtttactggactgcaataagaaatatcaaaaattgacaatcttgcccgacagtttcatctccacacaaaaatggataagtataagtataaatcaccactagtttttaatctccttatataaagaagaataccacaaaaaaaaaaaaaaaaa

SEQ ID NO: 12267 - DNA, 1902 bp, Homo sapiens
  misc_feature (1)...(1902): n = A,T,C or G
tgtctgcggacgcggtctatgtgtttctctcgttggngctatgctcacgatgtctacgtctaggtctatgcgtacacacacgtgctccgtagatgcatcgcngnggatatgattgagcaccggtgtccgcgggctgcgactgtgtagcgttagngcggaagtcgaacagagtgacgcgctagtagcagtgagnactacgtgcgtctatatgactgaggctagacatctcgtnactgcacctcatgcgnaacgtngctgtttgtcgtgcgtctcanacgtggagcatcgcgctcgtgacaaagcntaatgtcggtgctgcgcgctacntgcgcgcatactntagntcatagcgtcagacaggtncagcgcacgntctatatacgcgatcgatatgatcgctaatcgatcgcgtacggcgataattgcatatgtgatntcagcgcganagatgancgcgacacacgcgacatgcgtgcnggagccgcgttgtaccagcactcgcgatagtaagacaatntntcacgaggtcgntcactgtntctagatgtcgctacatgttgctatgtcagcgcactgcgcgtcgttgagctcaactccgagcgtgtacagcacacctcagntacacgtactcgatgagtgcgtgagcantaagcgtacgtgctcgatcaagcggagtgacacgtgcgttgtagcgngtgcacgntcnatagcgcacagcagcgctgatantgtagtactgtngaagtacgcacgcacgggacnacgaacgacggcngtgncgatcacacgtattgaatgacancacgctgacgantgacgcacggtgatgcatacgatcaacngggnagtanactctcactgcgcactgtatgatcgngnacgcntctatnatcanatcntntganttagcattcantcgtgtcgcntcctggtaccgatcntatcagtccgagcagcgtcgagattcgtatcancgcgcactcgtgtcngtaggtgaggacatgagagcgcagactgcggtgcgtacgtatcgttagtacgtctcgcntcgacncactncgatatgntgcgtcgtcatacncagccantngatgtcggatcgancgtaccaacngagatatgatgtaacgtagaggaacacgagatcgtcgtgacaatctcggcgtatgcagcctcgcngtngagctgtagctgctgtcgatactcatctgncacgacgancatgcacatcgtggancatancagacgtatgacgcagacaaatatgagatacgtacgagtantgggctatncgcnacgancgtactnatacgcagactgcgtagtcatngaangtcatngtatgatgntnncatntcgtanatnaagttangctgctcgccgtctgctgccagtgtgantcanctggggtncagcangcgtangangtagncagacntgttaccatctacgtganctgctgcagntatcatgctgcgtnatctgctgtntctagacgtcngtgctgtacgtcgtcgctgcgcgcatcntgctgctactgattgcacgactactgangacgcgncgactgagctgtcgcatcatncgncatcgnggcgatcggcangagctctagcngctgagtcgnacatcnggnnagncatcnnantagcagctactagacacatgntgcgtgctcgtgcgtgcgtgaggacantactangctntnatantncancgctacctgtngtcgccgcgcgngtgtgcacgatacatgactgctcngtanatgtattnntctgcagatcncatactcacatcactgctagtatcngccagcactcagtcgctgcgcgagtatgatgactatatgcgctgatcngagagcnctacgtcgcgggaggagcacggagacgagccgag

SEQ ID NO: 12268 - DNA, 600 bp, Homo sapiens
  misc_feature (1)...(600): n = A,T,C or G
tggagntgcgatactcatgctgcagaataatgcatggnaaagtgtggacatcggtggacgttagagggatactatccatcattgcgganncactcgcactcttgcatgcactgagncctctatataggggtgaagtcagaggagacggaacgcgagggagcgagggacacgagggcgcgcgtgagcgagagnggngntggactctctcctctatcactgaacatgatgannatactactatgcgatattgagtcgtcgcgngacggactgcggtagcacgactatgcactggtgangagnnatcgtacgctgttgncaccactanactctacgtctcctacgantaatcatacgattgtatacgcatgacggtggggtatcacagtagagtactacaatcgttcgaaggagctatattgacgcatctctagatganacactcatggaggatgctcnggcgacggtagcgacgcggggctacagggtagcggccgactagcaggaggaaagagagagagggtagggacgtagggggaccagcgcgcgggngcgccaacgattagagagagaagagcaagaatanacggcatcgctgagctg

SEQ ID NO: 12269 - DNA, 275 bp, Homo sapiens
cctcagaaagaggcagagggagactaacacagaagaggagaatgtcacatgaccactgaaggagagatcacagcgatgcagctacaagccaaagaatgccagcagccaccagcggctggaagagtgaaggaatggattcttccctagagcctccagtggagggtggctctgctaaaaccctggtttcagcctaacgaaactggtttcggacttctggcctccagaattgaaagagaataaaattctgttgttttaagccaacaaaaaaaaaaaaa

SEQ ID NO: 12270 - DNA, 754 bp, Homo sapiens
atccaacgtggagattccagagaacatagtctcaataataaaaacaatcgatggattttcaaataagaaaagtcaagctcatgcacatatacaatacaaatagtccatgaggcataaaattacaaaaaagaaaaacagattcaagagaagtaaggaggatgacagggctaacgttaataagaataggattgcgcaaaaagtaaacacattgacatggaatgaagttgatgagcacgttagtagggaggagctaacaaatttaaggtaattaacaaacaaaagggatgaataatctaaagttcaacatagctggggaggccgcaagaatgcaaatagtcacgggtgaagataaagagaaaacaaggaccatcttaacatgtcagtaaaaaagataaaatcaagagaggaacttgacaatcgctaataaagccattagcaatgttgagaactctctatcatgaatacagccatggggggagccatccccatgatccaatcacctccctacaggttcctccttcaacacttggggatgacaattcaagatgatatttgggtggggacacaaagcctaaacataccatctgtcaatagccaacattcccagcagatggagaaatgaatgtctttgtcctaaagggtaaggatctgagcatcacactgcaacaaatttatcttaactagccccttgttactcttgaatatactttgtaaaataaacttctccaggattctaaaaaaaaaaaaaaaaaaa

SEQ ID NO: 12271 - DNA, 902 bp, Homo sapiens
  misc_feature (1)...(902): n = A,T,C or G
aattaaataaaaaaaaaaataatnattttaatattaatataataatatttaaattaaattaaaaaattttttagaaacacgctgatgggaacatctgaaaaaacagtcatttgcaactgacgttgattaccattgactgtgtatggagtgaaagaggaatgataaaaagcgaactatgagtaacataatgaataaaaatacataataactatcataatcatcaagcagtgggtatgaaaaaatacaaagaagaaaaccaaatcaatctagaggtgtaggacaatttatatctctacacggtttacctagacaatccctcccctcatgatatgtcccactgacctcaaacccaccactcccatccccccccacccgtgtataccaccccacccaccccgaacgtgcaaacccaccacaaaaccccaacccgaacaaatgaaccccctcccacaccaccccacccacctaccccccccccaccccacccaccccacccagagtcaacgttcgctgccacttcctcactcctctaccactttatcgccagactatcgataacatctagacaacacgcccacacctcaataagccggcatcacccagtgacccgtatgtcaatcccaacctacacccccatccacccccccccctccccaccaacctatgtccccccaccgtacttacactntctatctctccacccctccctaccctcttctaacccaccattatccccaccccatccacactccgcctcctcaaccaacacccccccccccaacacaaccacaacatccacccccccacctcctcgctgccccccaaggtccacacacaccccaaacactcgataaaactaatacactcaacacacgcataacaactcacaccaattatcacca

SEQ ID NO: 12272 - DNA, 898 bp, Homo sapiens
  misc_feature (1)...(898): n = A,T,C or G
ccccccccccctcaaacccaacaaaacacngttagggttactgatggagctgtttagggcaactaacagggaccacatctggctcatgggcagaagggactagccttgcctcagatgagactcgggactttgaacctttgagttaatgctggaatgagttaagactttgaaggactcttgggaattcatgattgtattctgaaatatgagaaaaagaggccatccatgaccctccccacaatacagcagacctgaacaattatttttaccctgtacattgaagataacaccaaccagtgtatacacatgttcaacttcatcacaaccaaaacaatgagtgtattcatcatccagaagtttcctcaagcccctttgcatccctcacccttgccctctattgcgacattctcgatgcccagataaaactgatctgtttcctgacaccattgcttagttttcattccccagaactacatccatgccaggccgacagtacacatcatgctacccttgctaaaccagcacgattctctcttcgtcatacccgccccatcctccactcgctcgccaccgtctttctgctcgtatccacagtatcctttctgctaccggttacgccctcgatcgttccacgcttcgttacagcacataccattctcccagtttcgttacgtttgctgcacttcgctaaatcctcctgagaatcctccgtggtgatgctccaccccccccgccttctcccctcaaccaccacctgtcggctccaggcgaccaccttcgtctccattcccacagtcgccatcccctctcccctttcgcaatttggctcccaattcccccaacactcgagaccggtcctatggcctctccttccctacaaattggccccaacctcagt

SEQ ID NO: 12273 - DNA, 790 bp, Homo sapiens
  misc_feature (1)...(790): n = A,T,C or G
tttgccccgggtttcctttttttgggcttctccggggggggcgtgtgttgtccttcgggggggcggggtgccctgctgcgcccttgtccctctgtgttcccacgggcccctgcccttttcctgtctctccccgagctcgtgtgtggtcggcgttgtccgccttcctggtgctgtttggtgtgggcggtgtttctgcccccttttccttggggggtcttgggctccggctttcggcctcgctgcgttccctcatggcgcgggggggtgtttttccatttctctcccgttttgtctaggcttggtcttttttctccctgggtttttggtcggatccccccgtgcagccctgtgggtcgggaggctttcttggttggtccttgtttgttttggtctgttttcttcttgttttttttttgtttggggggtctttgggttccgtgtctttggtcgggcccgggctcttcgggttgtctgtctttcgtgttgaagcccctttgttagtcttgctttgcgcccttaaaacccttttgtctgcctttttttggtggtgtggcgttgtccgtgccctttctctcttggcttttcgctgtctgtgggttttgtcgtggtcccctccttctccttgtttggtggtctgctttcttttttcctgatnnatgtcgntctntgttnttnnatttnttnnctttctcgnnnnnnnnanannttatgtcctcccggccaaagcggggngcgtngcgccgagcttttccttctgggttccccgtggctgctctggctgggggctgcg

SEQ ID NO: 12274 - DNA, 921 bp, Homo sapiens
  misc_feature (1)...(921): n = A,T,C or G
atattcattcttcttcttctgataatcgcggtttgtgttcttggagatccttctaaactagatctccgcacatcaacatctctccgggaatctccagctctataccttggcctgncgctcggaccccataccgacnncctttcgtcgcgctgctgggggtgactccgggctctaggtctggaggagagaggtcaccataactaacagnattcgtagttaaatagttatcgtaaacgaatgatttctgcatgtcngctatgtgtgttatttgactctctgggcgtgnctctgcgagtgtgaatgtgggatcttgagtagagttcgtccctatggatggtgtagacagtaagcagtggatgtgtaccatgcgggctacatagggatctggacatagtgaggggtcttctgtaatatctataagtaaggtggctgggggagtttggtggngggacggtccgtggttgcgggtgtttgttgtctctgcgtgggtttttctctgtctgttcgtcctgcctctgttcttaataaactactctcccccttatttctccactatactaggacaagaagaacaagggagaggaggttccataaatagggnacctccctcctctcggccgggtcttaaactaaatatttacttttttacaagtttcctnaaacacctaaactttcttaatccgttggtgacactattnactctcctccgatatcctatactcttcctaactcctctaacccatcctctaacatgatcaataaattctcttcatctttcctttccctnnctccctgtccttcccttttccctctnnncacatcctcactaccctcataccaactccnnnnncttttcnnctaaaannntnnnnnncnncctctctattnncncnccccnncctcatttnnnnnnnccccttt

SEQ ID NO: 12275 - DNA, 898 bp, Homo sapiens
  misc_feature (1)...(898): n = A,T,C or G
ctcaggaaacaactgtccagattaaaaaagtacctaagacaagtggccttttggcaagaacagctgctcaaagatatgaggaaactggagcttcatcagacaatttaaaaccagaaaatgcttactgatccctgatctccagaacataacaaaaaagcaagaaaataactgaaaaacagatccagaagaagcaactatcatttgagaaaaagaactcgaaaatttaaaaatacacaaagatattaaaaaatatattcaaaaacaatgttagaaagctatcaaaacaagaataagatcttagttaaattgtaatttatgaaataatgataaatggaaacagaggaaatatcttgggatataaagaaaaaagataaaaaataagagatatgtctcatataaaaggatatgaataaataatctcaccacaatagcactaagcagaatgaatgaaaaaagatccacaatcgcatagaattaagaatgccaagaatgaagagaagagccttaaagcttccagagagaacaggatacttacaaagatattagaatgaaattggtacatttcacctttgtaacactggatagcagaagacaatggagcagtaacctcaaacttaattctatgtcaggccgaccatcaacaatgaggtaaattcaagatatctttcggaaatgttagcaggacctcataatttttggattccatgcatccctactcaggggggtttgccaccaatgangaccaaccgctggaaatgaactttaataaaaaaaaaatgggcttcgtggcgaacggtgagcttgcggcgcctaccttcggaggctattaatagactagtacatgatagtgcccccggcgtctgagggggaagggtgaaaccaccaaggcgtatccagt

SEQ ID NO: 12276 - DNA, 833 bp, Homo sapiens
tatcgcggacgtaatattgcgtccgccgtacaaactcctttctctcggggtagcgggaaagatttgagacaatatgagtcctaacagcggggtctagcagaagagtacgacacatattcgacgagatgtcagaattctcgtaaatggtcggataatccgtttaacacgcagagatacgtatgtttgtgtcgctgagagttgtattagaaatatattgtagatgagagtgccgaagatcattgtctagaagtgattgtttgcccactatctaaattaaccgctcaagttaattcgtgtattcaagctccgttgaactttcattgcgcatacacgaccggtaactctttgtaatatatgtgtgattaacgatcgtaagactgcatgaccgtgtatgtttgtgtatgttcagggccatgttataggatactggtcatcggtaactagattatgttctagatcggtgatggaccgcttacttctcaactggataatcgtataaaaactgagtaggagagaagagacaagagtcaatggatgcttccaaaagagatacagttgtatttcaacagagtattagcatatgagcgttgggtgactttccacgattggaacagagcgagtagtacatggcaaatggaacaagttgcctataaaattattgttcatttcagcctaaaggtatcagcagatgaggtaaattcggagagatcttcaagaaatgttaccaaagagaactaaaaatgttgtcttcctatgcatccctacatgatgggtgtatgcctaccgaatgagaatccctcagctagagaatgacccttaaaaaaaaaaaaaaa

SEQ ID NO: 12277 - DNA, 714 bp, Homo sapiens
  misc_feature (1)...(714): n = A,T,C or G
gggaggaaaacaaagagagtgccagtactgcctattnnacacgtatcaattgcataaatcttattatactctgaagttattatgaaataaacgtttcctcgtgatcacgaggcccgagagcgcgtacttaatataaaacatccacaaaagttatgataatggaaaannaacgcgcataactagtacactcccaagaaatcgcacgatgcaagcaaaagaagggatagaaacaaagtatagatatgctcaagaaacacgcatgattatagcactgacgtaacacgtaaatgggaaccacactagtacaacagaaacgtcacaatagcagaacaaaattaagtcagtccttggcgccctctgtcggtgtgcgggagaggatcagtgactggactgcattcattgctatggtattgagaaaaggatcaacatctggtagccttaatacaaaagacnccacactttatggatcatctgtcaatacacagatanataaaatggctcatctggtcttgtggtcctcacgcaggcactgactcagctcaagagaaaagcttcaactccctatgatttcatcttcgacccgaccaaccagagctcgtgactcacccacccactacccaccaaattatccttaagaactctgatccctgaatgctcgggaaattcatttgagtaaaaataaaactccagtctcctgcaaaaaaaaaaaaaaaa

SEQ ID NO: 12278 - DNA, 757 bp, Homo sapiens
  misc_feature (1)...(757): n = A,T,C or G
tttcaggctccacctccaacanttggtagactacatttcaacatgagatttggtggggacaaatatccaaattgtatccgtatacctgagcattgaatgggatcttacacaggacggaacagcataatcaccattgacccattgggactcatgagacactgcaacaggccctaagaggcatgaggggaatttggggctcataattaggtcattggacctcaggactatggcattttcacaaaagagaagagaatgttcctaaccacaggcatgaatgcccgggaaagctgccacctggccctagccctcacagagcatggccctgcctggggcctgggtcagtcagaattattgaaaggtcacctctgcattacccaaggacacaaaaagagattcccttccttctgaggagacttgatagaaggcgcagttaccctgaagagcaaagtcaacttttaagcatcaaaagggctggaattagagtacaaattgagcactgctggctganaaactgccacactcaaagacaaagtggcaactgtcagtggaccagatagccatctgtggcccctgtgaactgaggctgagatattttggcaacacctcagcccaggagcataaaggccgtacccattcagatttgaggttaacaacattggggccagtcaagagtagaggctctgccaccttcagactctctggcctcgtttacagcttaactgaattgcttgggaagctggaaacaaaaaaaaaaaaa

SEQ ID NO: 12279 - DNA, 1695 bp, Homo sapiens
  misc_feature (1)...(1695): n = A,T,C or G
tatactncgcggtancgggntnctngacatcntngtcacgctagtacgancngtgtcgtanaatgtcagagtgtatctcgctgtatcgatatgcaccgcactgacgcgtgtgatactgctgtgcgcanantcacactgcactatcgatgacgacagagncntgtgtgctgncgctcgattagtaccatacgtcacacacataatagcantctcgncgagncacgtacgtctagtataaaanatgtgtgacacatcatacgtatcagcgtatagtgataatcgatcgnttnattcngtcaatacttantgagcatcagtcgtgctcagagatgtatcntctgcacgtgncagcgtgattgatacatcgacgcatctcantactcatntncgtgngacatcagcacgctaccgtcacactgctgataagtgtgcttanccatatgcgctctnattcagattcagtatnctactctactaagagacgcgcgacacagctgttctcgtgtgcgcgagacncgatctggcgatacatactagatctatgacatccatgtcgaagantatcgcattgtntgntagagtacgtcgcgcgttcgctnagtgatatacacacngtntcatacgnagcgacagnctaaattgtgtacactgantgacatgctatcgtcacgtgacgttcgagtgacgactcggancgtcgcacgnactatcgatcatgcacgtgtagcgactagtctaccgcagngctacgtcgatcgnanatgcgcancngtgagcgtatccgaccagcagtcaatgtagcgcacancacaatgctgactcgtcacantacgntatgcancacacgcgctacatatagagctcatncgtatacaatgacagagtctgatccaagtgttcgtctcatctacgtgtctgagacatgcactcgcaacaggtncgaagtcgctgttctcatctgagatcgaatgacagtactgtantgngccgaacgcggcgcgnagtcttgaattatgtgtanctacgagacgtatgactagtggactgacattctactatagtggtagagtgcgatngataatggatattagcgttagctagtgcgtgntatcgtcgcatgagatgtatgcaccgagaactgtgtcgcataggcggagtagcgccagcgatcaattactcgcatcactagctacggacgataccaatcatgcatacgagtatacgtatcttcgcaggcactgagtctgtgtgtgcgtctactatacatatgcaatgaccataggcgagcggacaatgtatatatgagtcgaagtcacancgaaatctgcgaacgacgatatgnangagtgtctcacacccttagccatngcgtgcgctcaaacgtgctagatgaacgttatgtanacgattacatcgcacacgcacnttacaagacanctgcgtactagagacacatgtgatcaaggaccatgtctcctatacatctcgtatgattgacaagtggttgtacgtgcgtgatcagctgctacaacatataacataaagaatatagatatggagtcactagcngtntgagtctcaaacnagtctgtgtgtgcagtttgttatgcccgcgcctaacgccattctctctgtttttcggctcgtgataatctctgcctttataactgatgtaggctgcatgtagtagtcgtg

SEQ ID NO: 12280 - DNA, 1205 bp, Homo sapiens
  misc_feature (1)...(1205): n = A,T,C or G
cagcttcgtgacgttcgtactccgagctcttatactcagcttccgtattcgnatggttatgtcttgttctctacgctattntagtttctcttctactctccatgcgtgctcgtccgtttgcttgtcctgtcctatctctaatgtcgcacctcttcaagtcgctcgttgtntcttgatatggtcagttggccagtgtcatcttgttcgtctctgtgccgtaccttgccagcagccggtgatggatggtttctcctaatcgtcatgtatcggcgcgtgagctttgactgcctctctgctaccgcgttctgctcactcctgtggcggcgtgtgtactcgacctctgcatgtgccatgctactcgtcccttcactcgcttcctcttgtttacgtcctccgcccgtctcgctccttctgcatctgctgctctctctccttcctcttctgctcgcgctcgctcaccttcttattcccgccgctcgcgcggtatgactgtcttgctgctctatgacttgcctgctagagacggggcgaggcgacgtccgctccttactactcctttccgcttcccttttgtgtgggtgagggcggagtatgatccgcttggcggctgtgtttgctgtgcgcgcttccttcggccgccctctgtgttcctccccttctcatatcccttctgtcgtggttctcgcttcttatctccctcacatccctcactttctacacatcatcttctaaagcacagctatttctaacccctatatttattcacagcctaacagttactccttggtgattgtttattgtcgatgtctttttcatttgttccgtacctcatataccttgggttcttattcgtcgtcttctgcccccttcgctttgctggccgtgggtgtcttgacgagcgtgtcgtcctcgcgctatgatctggcgtgtcgcgcggacattactgttgtctcgtgtgtccgtgttctgtgtctcttccctgctggtggatgtagccttctctcttccttcgcgctctcctcccactctctactcttacttctatcctctgggtgtcgaacntctccccttctatcncgttctcgctntncctctttttgctttttttttggttttctcncccatctaaaaaatnttttttttttantgtttnccccanacgaggattttatanattaactctattcatctattcactctaacta

SEQ ID NO: 12281 - DNA, 895 bp, Homo sapiens
  misc_feature (1)...(895): n = A,T,C or G
cctcagnaaatatcgaccagctgatcattaaattatatggaaatataaggggcccaaaattaaaaaacaacctttaaaaagaagaacagagttggaagactcacatttcctattttcaaaatttattacaacgcaacattaatcaaggcagtatggtactggcatcagaatagaccaatgaaataaagagtccagaaataatactcttacattatggtcaattgacctttttttttcttttccaggacagggtctcgctctgttgcccaggctggaatgcagtggtacaaccatggctcactgcagcctcgacctcctgggctcaagcaatcctcttgcctcagcctcctgagtagctagggctacaggtatgcactgccatgcctggataatttttttaaaaatttttttgtagagatggtgcctcattatgttgcccaggctggtctcgaactcctgggcttaagcaatcctcccacttcaccctcccaaagtgctaaaattacaggcatgagtcaccattcctgccttggccaaatgatttttaacaaggatgcaatgaacattcaatgggaaaaaataatctcttcaacggtgttgggacaactggataaccacaaacaaaggtatgaagatgaagccctacttatatatccaattaactaaaaatgtattgcggacctaatgataagcctaaactttaaacctttacgagaaaacatggctataactttgtgacctttggtaggcatgatttcttaatatgaccctaaagcccagggacaaaggaaaacagataattagactcctcattttaaaagtgcctgcttaaaggtccttaaaaaaggaaaaccccctcaatgggagaattttgtgatcatgttcaaggacttaa

SEQ ID NO: 12282 - DNA, 901 bp, Homo sapiens
  misc_feature (1)...(901): n = A,T,C or G
ctangggtaacaagagaccatggctttatacgctgactcaaatgatcaaatagagagacagcatttgaaggactagaagaatacatgaatgactgcaggacagggcctcatttgctgaccagagaggatgggatccaggacatgaatagaagagttgaccataaacagaagcctgaaattgtcatcctttctaagagcagaaaagcagaatatgtggtacatgcatgttgtgtttgcaaatacggtgatgagaacatatggaatttctcctctgatcacctcttttcccagtgaaatgagatacagtgtttttagctgagaatgaggaactaggagaaagttgatgttagccattgaaggcgagaggagttgtgaggtgactgtcttgaaagaatgggagagtaggttaactagggaaagtcataaaatcgcctggaagcagtggtgtccatttgaacattgtgttcatgaatttaaagaagcaccattagaatggctatgtgtttttcttcagccacacatggttgggttccaagtatggaggaattagatttaacaggactgcgtttttcttggtgagtgtgatgaatttggagacaaccaacgaggaaacaagtcattacttggggaataatatggatgaatggacatggattcttattggaacaaaaaggaattagagtcataatggaaagggcgaaagcggtcgaatcccactttggagaatcacggtttgaaaaattctgagggggtggccctagggcttggaaataagagcgcttttggaacaatggccaaacggaaatcaaggggtggcggaagccttctaaattccaatgaaaggggggaatcggggaagccatcgggcgaaccaaacacaacacttggcgcttgaaatttg

SEQ ID NO: 12283 - DNA, 730 bp, Homo sapiens
cgttaaatttcaccaatcatgcacttcgttccgggagcattacacaccatggctcgagtaatttgtctcacataggggaccaggtattaccataccaataccaattacaaggcagtagttgaaatctgtatcccaagaatctcacaagccatcaaagagaccgagtccaattgaaaagcatgcaaaggcctctgtggggctctgggactcctgcttggaacataacctgagaccctttgggaaagaagaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaacaacctgtctctggctgcaattaccaaggcagatctcctggctgatcacacggaagttatagtaaagagcttactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaaaaaaaaaaaaaaaa

SEQ ID NO: 12284 - DNA, 1106 bp, Homo sapiens
  misc_feature (1)...(1106): n = A,T,C or G
cttttcgtgtgcgcttcatacaacggacctacggtcactgtatcgatatgacatgatcatgtcgcgccgatacgtgagacattggtccggtttcggctgcgcgtcgcggcggagtctttactatgcaatccgtttctgtacgacgctcgtgagtgtcgatcgacttgctcatataggcttgacgatgcgcccagtagaaagtgcgcgcgctaatatgctgncacgtcgtcttgcgccacgtctactcactgatggtgcggcagtgagactcgcacatagatagtttgcgacaattacatcgactccttgtccgcatgtacgcaccacttacgtgccctgcgtaggccgattgtagcggtcgtactacgtgtcggcaaccactgtgaccatcacggcgagcctgcatcgctagagcactaacgatctgcaactaacaatacatttataacctacggacgaagtctttacgaactgataccgtcgttcccactctctagcaagaagaaaggacttcaaagcgtgtgctcctgttacaagatccgaagcgtaacgccgtgtaataggccgaatataaatatgaatacgctancaattatgatacatatacgagatgtgatcaagcgtatcggcttattcgcaccgagacggtgcagtatattctcgcgttgtgtatctcccttaccattcggtcctttgtgaaaccggggccggtcgcgctatcagttactccccctctcggtcacggatcatctagatatcgtcgcccttacgcgagagcgaacgtaactacctccacctcacacacccgtctggtcccgcagttatcaccgcggacgttctctgtgcttcaactcccgtgtgtatagatatgcaatgacacaatggacgatgctccttctgcattcgattagttcactcctgtaatcttttgtactacacctagcagacattgttatttaaacttcctcttccgtcagcagtaaagtcacagatctgttgagtgtgtccgaggtatacaataaaaagtgcttcgtggcataaaccgtgaagttttcgtataacgtctgcgtccgtcggatattgagattccacgcgccgccctcgcc

SEQ ID NO: 12285 - DNA, 724 bp, Homo sapiens
aaatgcctttttccttttccaatccccactcctacagctcagatcctcacggatcattaaccggactattgcaagtagacccctaagtgatcttgcttcaagatcacttcaagtcaagcctctctcctaatcactctcgacatttcagccacagttttatttctaaaatattagtatattcatttcactcttatgattattttgaatcactctgtgaaaccctgtttgtttctctgagtaaagttcatcctcagtgatgtgttatacaaggctttttatatcatgattaacacaataagatgcttgattatgaaacttaacgtgtctgcatcccactccctaggcttcaagaagaaggacagaaattgcatatttttgaaaaggttattctaatgtacagctgggtttgtgatccacttataacccctggaaaccactaacctgttctccataattttgtcatttctggaatgtcacataagtaacatcatacagtatgtaactctatgggattggctctttttttgtctcggcataattcatccaggttttttgtgtttaccaatagtacattctttgttattgccaggcagtatttctacatatgaaagtatcatagattgtatagccattaactcattgaaggacatgtgagttgtttccacaatttggctattatgaataaagcttctacaaacatttgtgtcaaaaaaaaaaaaaaaaa

SEQ ID NO: 12286 - DNA, 900 bp, Homo sapiens
gtttttttttgacagagaccaaacacacctcaagggaacgcctgttgctacagacacaacagcaacttctggcatgttcctgacccctgtggctggggttctggcctcagagaagactggccctgggcacagggaggcagggaggggctcggtttgccttctgggctggaagtctgggtggaggttcagcctggaatctgttggaagaacttggctggctccctgcaaaaatgaagtgctcatcttcctgtctacacggggctcttggagtctggagcggagttcctgcttcggccgaggtccagtggcactggcctgcgtgtgatacccagaccctgggagggggccatcacagcccgagtgacacataattcaactcctggccctcagaatggcaccttcccagagcgagggttggcacccttgtagatgcttgaagaggccctattggatggttaccctttcgccccagtgaacgttggctgaccccgcctggcaggggactctcatattagcaagcactggtacttttcctgatacttgcaccggaccgggggaggacttctcatacactaggcctccccgggctcattttttccctccatactccattgctcctggcatatgaggggcggggctctcgtgtaaccaatccctccaaacgagaaaggactgtcgtttgaagtcgtgctcacgcagacccggggtccagcccccttttatgtgggccctccgaccgccaaccatttcgtttccgaaccaggtcactacaccttcctccgaaattttccggattacggtttgtatggtaggcgagattaactcgtccgaccccgtatggagtcttttgataaagggctgccctccacccaccttcagcaactaaaccactcttaataa

SEQ ID NO: 12287 - DNA, 711 bp, Homo sapiens
cttgtacgcattattcgttctcttacaattgtgttacagaaacgtcgttttcagctatagagtcggaggggcttaccaaatttaatgaaaagtatgggtggtaagagcttaaagcgttatttgcgagcggtagcttgccactgcttgctcggaaatatagacgaaggagtggcatttatgtggtaagtgtaattgctcagtccgtcgagtgcggcgtgagaactgagcaaacttttatacttttcatatatgaattgaggaaacaggagagcgtctttttcttgatctctgtgcagagtggaatatatatttcccttcccatgcgtttattaaatactgtcagcgtgagctgatctaggattccttaaatcgatttctccttaccagattaaatagggaatggtttgtttgaggtttgtctgccagccagagtcttgggatcctgtcggccttaatcagtttagtactgtatgcacctggcataccttttagttgttctgtaaccgtggtataatggcaatacattcctcttgagattaatatgaggtttcaacgagttgattattgtaaatagttttgattcaacccagacacgccaagccccgtaaatgtaagctattattgtcattttaaggggtatgtgcctgtgaagagggagtattcttgagcagaataaaaatggtattatcttattgaaaaaaaaaaaaaaaa

SEQ ID NO: 12288 - DNA, 749 bp, Homo sapiens
aaaataaagtttgcataaattttactttttccatcaaatgcccctagaaattcaaaatcattatcacttaattatataattttccacagtctttgtttcttgctttgtgtaaatttatagcatttgagaaacaccacaatctggtataatgtaagaaaagattcttgtgggataattaaaatgatagagtgaaattgatacatgaaacaataacatgcgagtaatacatgcagaaatacatacacatgcttaataatgaaatgaaggctggtgaatttatgcatcaacatgtgagctccaatattatgagtactgttaaagctacttttattctccccacaatcccatatatagtctgggtgcaaatatgtcagttatagctgttgaaagtaacttccataaatctgtagcttgcctttcaacttttttatgatgtctactgatgaacataaatcttatatttagttaataatctttatttatagttcatttttattttgaaataaaattaatcctttccgaacatgaagatataaaacgtcctcttgtatttcgagaaatgattaagtattttgtttttcacattgaaacatttagtttgtattgaattaatttttattaatggttcatatatggattacatttcaatttcttgttccttttggatgtccaattatctgagcaccattattattaatttctttaaaaaataaacttatttggtttagctgtaaaaaaaaaaaaaaaaa

SEQ ID NO: 12289 - DNA, 924 bp, Homo sapiens
cttgctgcagtgactctcttatcatccacgctcaggtgctgtatactgaattacgtttatggaggatcgatttttcaagtgatgtcactgcgaaatagtggatatgcagatcttactagcactgcctcatcgaagccttgaaagaccagcgaagtgcggagcatgctggttaaccggaggagaacatcaagatccgagccttttagcccactcgttcgtttacagccagctgcgaaattcctttctgtcggactccaggtctactaagaggtccaagaagtcaccgtcacccccagactcctacaattatggaaggaggatatcgcttccggctctctagcttaatctctactcgacaaaatcctagaagtacgcaacaattagctcggcgcgcatagaggcatacgcccaatcctatatacccagccgtacccaatcccgctccactgttacgccatgccgccttacactcatattaattattaactgtccaccctgacaatcgagccaccgctcgacaacaactacctattacaacctttcactctaaaccccctagttcacaacccaatgcacatatcagctcaccttcccctcaacacccccattattacgctatcatccactacccatctccgtactagcccgcatatccccgcgcttcatcgcccctccacataacacacttccccacaccccccaaatcaacatacccatatttaaactctaatttccgaaactctcgcaccaactactacagcccacacatattactctcccccatcgatttatcttatcccacttcctgcatattaataatcaaaccggaaaaaatacacataccgccacccacccacacctcattataatgcaacgctccggccgccactccgttatgagccagatccccactcccgctcgcag

SEQ ID NO: 12290 - DNA, 938 bp, Homo sapiens
  misc_feature (1)...(938): n = A,T,C or G
ttaagcggcagtggctctctcatttaacacgctaaggtttgtagcggtgctacaacatagtgaatgtttgnagcnccgcnacactcctgcagcctccgatctttattagaaccactaccgcctctagtctagaactgatgtgaaacaaaaattaaactaccaacaaagcctcacgccaaagcaaataccatctaccttagcccatgttccaaccctacttaacaccttcaatacttccaccatcaccaatactacaccctactcaacaccccaaaggcgcccaaacctactctcacccgcactaacaacaaacgagcagaaagaactagataatcgatacatattgtccacctcaccccttcgccatcccccgaccataatgttccccccctcctccaccccctacgaatctatttaactcacatcctcttataccactacaacacataagcaaaccacgtactgcccagcttctattatttaaccctcacctgccaccatcactccttacttagcacgtcaagacacaccctcccatatatcccaccctacatgtattgcccaacccgccccgcaccacccaccctcacatcctcaccaaccccctacgtcgtgaactaatataatactcacaactattcgcctccgcccgccatctcggcgacaacacacctctcagttgccctaacttaacctaccacccacccatccacccatcattaacatatcaccacacaactcccggacttaatccacctataataacatacagatctctacacatatcgctcgccacccccaacttaatcagatatctttcagttggcttgccgccgcctaccatcactccatattctctatcataatatctcactcaccaaccaatagtcacagttccgattatcccgctacccctctcttcgctcatgttgtccccg

SEQ ID NO: 12291 - DNA, 235 bp, Homo sapiens
  misc_feature (1)...(235): n = A,T,C or G
aangngcnaaangaaacanntttccncgggggtngaggatatnannnncaacntggnaaanggngntttccncnaangcaantannttgggnaaagncangggttttncccanntncagacggtttaaancgacggcnantaattgaataacgaatcncctnnaggngaattggggtccgggcccccccntcgaggtggccgggaanganaaggctnatagggcaataagggccc

SEQ ID NO: 12292 - DNA, 381 bp, Homo sapiens
cttctaacagaatgcaaaggagaaatggaagaaagggtgtttaatgaattgcaagaccatgacttagaaatgtgattaagtctgtgctgacgaacaaaagcacaggaagactctacatcaatggcatgtgattatgacaggcataaacactaaccattatcaattgcccacatgtttccaaggattggtcctgtttgtctccagcgaatcctggtgttccgggttagtgctgcgttaggaaggggaattgttattcggttccacctgcaagaaatttagcacaaaaccatcttcacaactatgttcatatctttagaatctattttacatggttttcatgttctagcttctgtgtgcttggaaaagcactaaagtttacca

SEQ ID NO: 12293 - DNA, 257 bp, Homo sapiens
agcgggggaagattacattcaacttcagacagcttggaaaaagttagaagcaaaagatgaatctgaatgctgtctgatagtccatttttaatcagaggagagcaattttcccttctcaaagaatgtctcttcacatcagcaggcttccagccgttttccccgcctcatcagtctggcagaacatcctcgatcttaaaagagccacaactacttttgcaatgtgtagattttgaaaacttacttaaataaaacagaat

SEQ ID NO: 12294 - DNA, 871 bp, Homo sapiens
  misc_feature (1)...(871): n = A,T,C or G
annagaaaaccccnnnaaaaagagggggnttnttnttagnagtnttctngnccccnctttntatngggcgctnttattnatacncantgntttttttttcccgggnnnanatanccccccantntttantaggggaanaaaccncattttatcacnccccctatatganagnaattaaaanaacacngnnttngcnnacacattntangtaatcncantnannanngatnattnctttatatncatangaagaggagaaaatncggcccccaataanacgntaaanacncncnnnntntccccncgggggnnggggcgcgatttttatatataanatannanntngngnaaaangggaatnatntnttnncaaggaccatttaagatttggggaacncanccnaggtttttnccncaantaccanannggtntgaaaaancacggncccnantnanntnntaataccncccnncntnangggnggaatttgggnnccggccccccccatngnagntngnnggnttcgaanaatntaanaggccnananggncttantccangtnaaatggctaanccagtcaagtgcttntgacacnacagtctcagtaccttaagatcantgcttctcttnattaaccaccngcacagganaatgtgaannaggntacactttcctgggnatccctattggtngtctgtcaccagataattgttgagggatcttctntgtacctagctcaggctctaganactagagacacagctatgcaagacaanattnatgtgtacgcgatcttgtatattactgattgtaaactgcaacacacatgtgaaaaaaatatataaagggaaaaacttcaagtacttaat

SEQ ID NO: 12295 - DNA, 791 bp, Homo sapiens
acccttgtactgaataagcttatggaggatctaattatcaagtgattcactgagaaatagaggataatcagctcttaaaagcagtgcctctctcaaagccactgaatgacctgttgatgcggagcatgctggttgccaaaggaggacatcagatcctgcattatgtccactgatcttttatgtccttgcacattcttttgttcgagtatgttctaggaagggtccacatgtcctgagccttcatactttaaacttttgaaagggatttgctatagctctctgcttatcttttatgccaaatactgatgttccaatattagcttgtgctattgatgattgcataatttacatattagctgaacaaaatgatcagttctagatagtgctttctttctgtggacatgatgataggattacaagagggaaatggacagacttaggtagatatctttctctagcaagctggtcactacattggctgatcggaatgtggaatcttgatataaacttaacatctttagaaactactgatgacgatcacataagactgaaagaatatacttttacgctaaagaatgagagtctaaagataaccttcgcttgtactaccgatttgccaattttgtggcaattttgggactaaatttggtccctttttgggaactttgtcttatcaattgccccctcacaaatgccccatgttgacaaataggaaagttgcgggcgccgcctcgggtggacttccagctttctttcctttattagaggtgaatttctaccttggcgttcat

SEQ ID NO: 12296 - DNA, 355 bp, Homo sapiens
  misc_feature (1)...(355): n = A,T,C or G
cggntacaggctggaataacaagttacgaaatacaaccttcatcacagctgagaaggatgtgagagccaattctgcactgcaatcaccagctcacagcacttagttgaatgtctcctctcctccaaaaccagagccaaggccatcagcagaaccctcaaagtcatctgagatgagatactgcaggattaaatatgaacttttcctcaatggtttgatggatcaaagttatagtgtcttcagcaatttttatccaattatagtttgaagagttaagctataacttaaacttacatttaagcaaaaccagcataagcgaaaaaaagtaccacttcaaaacagattcaaaaacaagaa

SEQ ID NO: 12297 - DNA, 1379 bp, Homo sapiens
  misc_feature (1)...(1379): n = A,T,C or G
gaggccgcgctcgcccggcccccagtgaaatacgaaataaatgataatccgcgatttcttaacgaactgagataacccttatagattattttcgcacgcgcgtaacgagcgcacactagaagtgctatataaggagagtatgaaagagaagtgtgctcgccgccaactaatagcgagacagcgagtaacgtaataacataaccacaccctaacgccacgcggggtaattgactacctataccgaagcgctctacgatagggcgcaatgtgaaaatagggttaagcgttaacttagtagagtccgccctgcagtgngttctgtcggaggccagcgtggacgggatcctcgcagcaacgcaccctctctataggtcggacaccattcgttacgacgcaccctcacagcggccggcgcgcgtttacccgcgacgaatattgtccagtagcctacctgtataacacccgcaccccacccgctctatgtacagtgccggcagagtacggatatccaatgactggatctggatgggagacacaacatataattatcggaccngacactaccataacaaactaagagaatagttgtggatcgacagtcacgcgatagtgcaactgtgacttgaccatcgcgcgcagcattgaatgtncgctaaggccaacgcgaccgtaccggagcagccaagatagttatccacacgcgtcgtgccgccgattctcccacgtgccagagagtcgttatcctgaagacattccacgcgattatattgaatactaccgcccgatatgtgatatccatactctgtgttatgcgcgagtcggagtgcatgctgagatgtgtgccgaagacgccacaacgggacgctgacatgccatatgtatacacactagcagtcgtgaccagttatacggcgcacgcaattataaccggcatagctgtgcacacggaattctcgtcacctgagttacagatgcacggtgtgcagcgtgcagccgatacatattacagagaatgatacacanataaatagtatgaagaggaggcgcagcggcggaacctagnatattagcagccgaaggcaaagataacgcgaataggcaagacatgcagcactnatacacataaacttacatgatccaccataagtacgctcgctagcgtatggtagaggttgccgacagtctctcctgacctctcatgccacgcgcagatgcgctgntagatcgatgtgatataatctatcacgcgactaacgtcagctgacagctccgcttcaattcacctgtgatcggacgacttatatatatctcgcacaccgtcgtgcgcgcgatacactgactatcagagcaaatgatccgtcgcgacacagtgcggcggg

SEQ ID NO: 12298 - DNA, 210 bp, Homo sapiens
ggatcaagtaattcatctgcctcagcctcccaaagtgctgggattacaggcgtgaactcttgtgcctggccagttcctgtttttgtaagaatttttttttttaactggaagagctgttccaattgctctgcctagctcctactaatagatattaaccgcctcagcctgaaccagtcttgtaattcatgtgaacacacttcatacacgaat

SEQ ID NO: 12299 - DNA, 327 bp, Homo sapiens
  misc_feature (1)...(327): n = A,T,C or G
tntannnctggggtnngcccccnnaattangcgnntttttananngncnaggggnagtagcaangganaaanccgngnatnngncttntaaagnttntnggcanttcgagggctttttnctccnaagttattttnnnngnananccnngnttttggngganacncnnattanccggctataaaannagtangaatncccnctcncctccngcccaaanggtccnaagggnnaantnattaaantaannnnnagaagngnaaaaancngccnttattataacaaaancnccntctnntcnggcncgtttgantanttccattaaagca

SEQ ID NO: 12300 - DNA, 704 bp, Homo sapiens
  misc_feature (1)...(704): n = A,T,C or G
ttaatnaaccccgctacagatggagtctggctctgtccccaggctggagtgcagtggcacgatctcggctcactgcaaccttcagctcccggattcaagtgattctcctgcctcagcctcccaagtaactgggattacagccttctgagagaaattgagtggatccggagccggagatattggcctcaaggtatgagccagcaacattctgagggttctaggaatggcttctcattatgggagcacttggttaaattaaactaccacagtgctcagagttctaatacagtgagctctgcaatgtgcatgaatgcagataaattacacagggctagaagaatggacttggcacctcagacaatttcagataaatcaaaatgtgctcctggaaaagggaaaaagaaacccattatttgcatatctgccgaggaaaagatacaatggaagacacaaaataatgctgaaatatggaatggctcaggaaaggaagcctcaaagaaaaagacagactattcctctaacattttatctttgggtaaaatgaatggtttaataaagctttcaaggcaaagaattttgttagctaaaagtgagagtggagaaggcgaaatcaccaccatttaccaccatcccctgccatggcctgttagcacaaaaaaccctggggaatctgagttcatatcagaaaagtggctttttcatac

SEQ ID NO: 12301 - DNA, 792 bp, Homo sapiens
atgtttgtattgaattagtttatggaggaactatttttcaagtgattccatgggaaatagtggatcatcagcttttaaaagcagtgcatctttaaggccttgaatgaccagttaatgcggagcatgctgttaaccaataggagagacatcagatcctgcgttttgtccaggtgtatgtttactaggtgttgcgtattcttttgtcggactgtgttgtaataagggtccagaggtcatgtgccttgagactttagaatttggaattggattggctttggctttctgcttatctttttagccaaatactagtgttccactgttagcgtgtggtattgatgattgcaaaatttacatattagctgaacaaaattttaagcttgagagagtgctttctttatgtggacatgatgagaggattacaggagggaaatgcacctcacttaggtagagatatttttctaacaaactgggccctagatatgccttgaactaatatggaaatctgttatagacgtataatctttataaaatctgtcagaagtgtatgtaagattgaaaaaaaaatatattcgcataggggatgcgagtttcagaataacattggttgttcaaccggatttcgcaagtttggtgtaatttaagggatgaaaattggcgcctcttgtggcaatttgtttgatcgattgcacttttaaagttcgataggttgctaacaatggtgatttagagtgttcgtgattaagggcgtcacccgctttgatacctttacacaaaacgtgtaatttagatagt

SEQ ID NO: 12302 - DNA, 794 bp, Homo sapiens
  misc_feature (1)...(794): n = A,T,C or G
cnaaantnangnagtaaagaatgaatnagttttnncaatataggannacantnatattagaanaganacnnantgagatnncacanaatnacntggtataatanannttatatcangcgatnnggcnnngnancancnanangagagngccgaggnanaaaaaaagnttnacnatanacctatnatancancnnanncntccnatattattttataatgtntgccggggaaaggnttganaantcaaaaggaaaggggaaaccttttnaaggnaaaatgagaaagaacgagagncanttgccccggttcattggccttctnccccaaaggantanttcnccngggntcctgtgcagggcccccaatncaaaaagtatggctctctcttaatngntgcaagaacaaccccagggacagacaccttgnagtaaggtnaatagtgtgccctctntaaattcatttctatccanaacctcaaaatgtgaccttatttggaaacagtctttgcagatgtaattagttaagctgaggtcatactggattagggtgagtcctcaattcaatgactgatgtccttgcaggaagacaagaagacacaaagatacagncagagaataaagccatgtgacaatggaggcagagactgaagtgatgcagatacaagccaaggaatgccaaagattgccaggagtcaggagctaggaagaggcaaggaaggatccttcccaagaggtagcgtgaccctgccaacacttcagattttagacttctagcctccagaactctaagacaat

SEQ ID NO: 12303 - DNA, 122 bp, Homo sapiens
  misc_feature (1)...(122): n = A,T,C or G
cttcaggaagactatgaagtcaaggtaagaccatccacanaaaagatgcttgccaaactcccaggttcctggcttaatgaataatgtgaataaaatgcatgtttagtccaaaaaaaaaaaaa

SEQ ID NO: 12304 - DNA, 910 bp, Homo sapiens
ctgccctcccgttttactagcacaacataggacgactcagggtaacccaaagcgctattttttgtcgccactctgtttctgagtaatgctcacgatgaggctgattttccaccgctcttctgggatcggggaccccagaaaagaccccaccgccagagagccaaagtggaggggcgaccctcctcaccttttcctgcctcagactcccaagctcgctggaactacaggcatgcctcaccatactttgacacttctacttccgtcggattctaacctagaccttactggaatgttgctcttcacgcaagtttctctcgcacaacattgatacaacccacacgagttctttaagccagggggtacctacttggcgaccacaggatcatcttgtgctaaaccttgcgctcctattgcaatacccactttctatgataccaagccccatgaaacaaagcctcccacgtcgatccgcttacatgcctctttagagtcccaatatagccttagcacgtccaacacttcctaccgtaaatgtcaaacgaccggcttccggccctacttcctacgcaaactgttctaatcccaccgctcctctacccacctagccccctatgaattccctgtccggcccaccccgcacttcttctgccccgctcacccctgtacaagtttaccgaagcgcggcacccccgcagtcttgagtgtcacagccccagtggccaccctaaggcgatctagaccatccccactatcctacccccaccactgcgtacacatcggcgtttgttgtccgtgctacctcggccacgtacaccatactgtcaattcgagttgccagctcactctccaggcccctctctcaccgaaccccacctctaacccatatcaacctcccaccacctaatttaac

SEQ ID NO: 12305 - DNA, 899 bp, Homo sapiens
atctagctaacatttaattattcaaacaaacaacttcatgaaactcatggacaatgtgaacatcaatagctgctattatcagaaaaaggactaaccagatatgatgtcttctgataaaagaacacaccactatctacaaagaagacttgacaaaataaatcaaatctaaatttgatcatcaattcaacaccaatctatagggaacatagacaaaggaagcgcaaaagaaaggcaccacaaaagtgtaaccagcaaaattgagagtgtgaactctacaaaacaaatgatctggtttcttcaacaagctgttgaaagagaagagagaccatatcgagatgaagcccattgattacaagacacaccaaccaatctcatagtaatctttatgaaaaatttgcgataaatataactggaaagaacataaggaaactaagttacatggccaactgaccatggaaacacaatatggaatgctggaaagaagacactttaccatctacagatcccaactcaccccagctccaatcttaataggctgaaacaacttcgatgagatacttaccctcatcacacctctagttattccacctcacgaatggggtaagactctccctgatacatcatcactcgcagactgacgagataatcttgcaggaactgtgcctcaaaagaataaaatagcacccattaattaataaacctatacgcctggggagtccgcatcaatcaggagagcacagtacacctgaagctacagtaccgctttccaccactaactataaccctatgcggaaggtaaaaatagcaatatcagccactccgactgattcaaacaaagctaccgtctaaccaatccagctcgcttatctatgccaccctcctcctctgcatcgatctgt

SEQ ID NO: 12306 - DNA, 872 bp, Homo sapiens
ctccgggtgaccagaaagagttttcacagcagctcgaatgctatcttttgaaagtcctaaatacaagcttttcctgtacttggacatcggagctcctggttattgagcctttgaactcctggacttactccagtgtccccctgctctccagttcacgattcttcagccttgaattgggagttacatcaccagtggctcgcctaatttgtaggcctttggactgatactggactacaccatccgcattcctggttctctaccttcagatggcataatgtgagacttctgggccataatcatgcgagccaattctgataagtttcttcttatatatgtctatatgtattctatcagttctgtttctctggagaaccctaatacaatgtgtgaacctctctgggagaagattctggaaggccggacctgttttttcccctagacttcaccccatcaggttttccctttgctgattttgcctttgatttagaacaaatcatagccatgagtatgacaatgtgatgagtcctgtgaatcctcacagcggatcactgaacctggaaattgccctggagaccctcgaccaacgtagtcttaagcacttaggaatccctccctttttgagtgcatctggtttgcttaattccactgttgctagagaactaccctaaataattctagtcaaatatgttgaaactgactgcctggaaagccaactttagctaatgtaaaataagcaattttaactggaagcgctctttggactcgcgcggcttgattatatatgccggttagggacagctactaagtggattttccaacatatgcgaaactcacagagttagcctgtgactcaattaccaggaaaatgagta

SEQ ID NO: 12307 - DNA, 1100 bp, Homo sapiens
  misc_feature (1)...(1100): n = A,T,C or G
gcagtgactatctgttccgtccccacactctactgccagacctaacacgctcacctctcgccacccgccgcgtcatacgcgattacgccttgcccgcggggtcggggtgcttacgtaatgtaacctttgattgcaatagctagagtatagccacagcaagtgccccattacgtctttttatttataactctagtaacttaagtgcttgcgagcgcagggcggtgaattagaaatatagacggatacaacctgctgtttatagaatctggcctcgcgtgagcgcgcagcgcgtgtggtatcttgacgtacggtcctgcattggtcctccatcccctttttatttattgctcactaatctgacgcgccgtcgtgcgtgcgccgccttttccctgtgctccaggccgcaccgaaaagagcgacatgcggcgccgctctctggtgccttccaacgtacaacgacgcacggcccgcgcacacagcgcggttgcgtacttgagggtcggtcgcgtacagtgccctccacttccctacttcctaatcggttcgctctcatcgctacacacacccattcccgcaagactcccgtccctgagctgtacatagctcttcacgcgcaaccactctactcacaccacaccattagacaagatatcgagacgtgaggtcgagcaccgtnatctgattacaatgtgagactcgacgttgtaacttgtgctgtcggccacgcggagtcgcacgcgtgcttgtgcatccctccacactactcgtatattgctcggcgcgatttcagagatgttgggttcgcggtgcgcgtgtgtatcgcccacgaggcaccgcgacagctctatcccactcacgcccgccctcgctcgcccctctctatgcccgccacccctgcctcgttncattctctctaactcagtccctttatcttccatatatcttataaccaaagcggtgtgcactcacgcacactgagtgcttcatgcggggcgtttctttctctatcgtgctcatcccctccgcactctgcctcaattgcggcgaccgggtcgccttcattggccacacgacgggggcccgggttgtgtcatcgttag

SEQ ID NO: 12308 - DNA, 862 bp, Homo sapiens
  misc_feature (1)...(862): n = A,T,C or G
cctangaggaactactccacggcctgcgattttcaagcaggaatcttgtttctaaatcttgacacagtgggatcaaagaaacctatctgtttctattactgggaaaaaagtgaatctcaaaatgaaaaacaatctgcggcttcaaagagagagagctgacagcaaaatatttgaattaattagagaactacaggttgttcattgacgggttctttttgcaggcatattctgattcatctgtgcttgtttccacggagatgtggttggtttattttgttgttaatataccatatgagcatgaaggaaattagaggaagctacctgatggaaaactaaatttagacatttccagacagtctgagagaagttacaacctcctgggccaggcagaggatagttcacttccttgatgaactattgccaagttaaatgaacattatctatttttacaaccctgacattctttttagacatgacaccccccaatattagttttgaggtcccctggaccgcctgctcacgttctgagaagtcccatatatcaaaataactttccccctttcttcactataaaaaataatcacgattgtcgtacggggtccgctcttgcttacacaccttttttcgaaagcccacatgtgcagcggctgctttatatttaggatagtaccggtcctttcccgggcaactctctgcataggccttagatcccccccccggaaacaagtctttcgtcatcgcggccatttgttcccagcttatactcagggagaattatctacacagcgccacttccccactcacctgataagatcaattctttatcggattggtttcagagaccttcccgctagtatctctt

SEQ ID NO: 12309 - DNA, 872 bp, Homo sapiens
tagggcttgacttcattcagtgacgaaaggaagacgtgatgagatgggacaaccaggttttgagagaatgcttgacttggcataagaccaattttattagccaagaatgacaagacacattgaacagaggtgtcagacttgtgagaagtatataaaataggattccaaagcagagagggcagttgaacgaatgaagaaagtgacctctgctctgaagtcagcttgtgcacttagtttctgtccctggaatcagacacagtgagaatcagagacatttccttaatacaacaaagtaatcacaacatgatgcccaagaaagagactggcaccacatggaacattctataagtgtgaggccatcttgacccagcctcctttgctttggaatttctaaacatgtcaggaaatttgttgatctaccccctccaagtgtttggatctcggaaggcagaccagtcttattcctactgacactctccaagcacctcctcccaacttcaggaccagcttttatagcactgtggtgcaatttttaagagcacaacagggagatcaatcaaagtcggtccaataccaacaccctgaattaccagcctgggtaatttgagtaaattacttaacctctctgaagaatcaaacgctaccccaactctctttccctgccgttccagccgtagtagacgccttgcctcctcacctccgtccaccgcccactcctccgtctaatccgaatccaccccgccgatggcccttgtgcgggattctgggctcgcgctctttgcgagggggtatttagcgggcacctcgtgactccaggacagatctttcgtcgtcgggagcctccgcccctcaggcctctatcgtcgcccacg

SEQ ID NO: 12310 - DNA, 939 bp, Homo sapiens
  misc_feature (1)...(939): n = A,T,C or G
ctctggagaccattttgcactgttgcttgggggattctacccacataagtcagcatgttacttgctagataaaagagcaatgaatggagtacttcaacgcctaaatacctgacgtgtgacagcaaatgcctgttcccatggagctgctgcttctgagaaagcttgaaacagacaaagaataaggtagaaatgacctcctcactagagatgaaaagaagctgtcctggtgaggaaattggatcccagcttttgccgctaagattcttctcttctgcctctggttttctttattgttcacccccagaagcaatcgctctctcacaaggcaacacacgcaatagagtgaacagtgattctacagtctgattctggaaaaggcgaccacagtggaaagagtgatccacacaagtatagggcctcctgattaaaacactaagatttcatctcacgctgtgcctttatactgctgagatactaaagaggacactaaagatcaaagtgctactttacaacattttgaagaaaacaactgctacctgtgtattagtttgtgcagatgtgtctacacagcttagctgtgtctgcaccaccttattagaatcaaagtatttctaaagtacctaaagccaggcccaaaggcctaaaaactgtaatccccaccactcttgggaggctgacgtcaagtggatcaccttgagatccaggaaattcacgaacagccttgggcaccatggtggaaaccccatctcttactcaaaacacacaaattatccacgggatgtggctactctgcctgctatcccgtacgactaagcaagctgaagtatgagagataatccctcggactcagaccggaaggtgggatgtgagtggacaaagacaccttgcactcacgtcgtgggacagacggcatccgcctcacaacacaacnaataatac

SEQ ID NO: 12311 - DNA, 973 bp, Homo sapiens
  misc_feature (1)...(973): n = A,T,C or G
cggcgggcgaaacaagcggggaagaggaaagaacttaatgtgccacaaaagccctgggttcgggcacaaacggcaaagaccaggggacagagagaggaaggggataactacctgcagganagggggtgtcctctttgctgagagcttcacaggcctgcagagacatctgaacaacctgcctacaaagaggagccaccctcttcagagcctcctctctgctgagaacagcacacagcaggatgaccagtgggcagagaagagcttccttctccaggggggggggtttgctgacagctgaacactccatgggatgacctgcctacagagaggagctacccacttgcgggctcttgtgagccattctaacactaagtgaaagtcttcttgctgttcgtcacgcgggagaggagaactaaagtgggctgcgctggcctcgagcggtgggaggtgctggggccgggttgccttgagtggagggggaagtggatgagcctacgcgcacctgactcagctgcgcgtcgggcgggttcgggtgggaggaaaggcggagtggacctgcgctacaggggcggagaagtacgtggaaggcacgataggcgaggcgggtagctcgaagaaggcgagccagcgtggaactaagaggcgcagcaaaaggccaggggcccgccgacagaggcgggcgggataggcggttgtgttgatggctgctccacgctgacggattacacagaaatagcggagtagaggaggatgagggcgacgaccgacgtgagcagcagggaggcaacgcgttcgccgtcggagggggcgtgcgcgccagggcggggagaagccgggccatccgccgggcaacgccgcgtgcgctccatgagggaaggaaggccgactagggtcaccgtgcggggtctcggggcgaggcgagcgacggggagtgggcgcggcccggccaggcgccactcgagcgggccgcggg

SEQ ID NO: 12312 - DNA, 747 bp, Homo sapiens
  misc_feature (1)...(747): n = A,T,C or G
tgaacnttgaaccagtccagatttcaaattcttccccncgaaatcatcccattgctgccttaatcacccccctacatgtgaacaccatggcttcttttcctttcttttttttggaggaagggaagttagctaaaattgttttttttggaatgataaataaacatgaatggctgaatacagtgtattccagccttaatgctcacccatgaaaatataaaaagtaaacttttttccctatgtgttttatacaattacccttctcagagttatcccttctcctgcccttactcaattttgcaagttggaacatgcataccactttttctagtctagttgggtctccggcaaatctgttctgacttcaacatacctgcttggtacaatctaccagggaaatctctttgaatggttctagaaggcctaacaggaatgtgtaaaactaaagcctattctactaaaaaaagttgataagatgactctggttatttaattaattttttccaactggtataactcaaatgagcctgtcatatcagcttgttccaaatcatatcagtttgttccaaagctattcagaaacttgaaagcaaattcagcaaaactctgcctttaggaaaatgacctaatgactccgagcctatattttctgatctctaaagtaggtataatatttttcctttatagaattgttgtgaagttcagagatcatataaataaagcacctgatttgaaaaaaaaaaaaaaaaa

SEQ ID NO: 12313 - DNA, 182 bp, Homo sapiens
cctacgtcacacataccggccgcaaccggactttcagggaccaaacacagtgcttaggtggccatctcaagccaagaagagagccttcaccagaaatggaattggctggcatcttaagtttggacttcccagccttcaaagctgtgagaaaataaatgttgcctaagccaaaaaaaaaaaaa

SEQ ID NO: 12314 - DNA, 100 bp, Homo sapiens
gcgggagtgggagcgcctcgcgagagaagggggaagaacgctaattagtaaactactgtgtatgggcattcaatctgtttcaaccggaaaaaaaaaaaaa

SEQ ID NO: 12315 - DNA, 751 bp, Homo sapiens
  misc_feature (1)...(751): n = A,T,C or G
gggttatcagtcaaaaagcccagtatcgaatatggcagagggacttggcaaatgaccctagttggccccggctaaaccaaacctcccactctgacatgccggagagtggcagaggagtgtcttacagcaatccagtatttgagagcaatgaagaacaactctgaaggacatgtgatatccaagttgatattacagagaaacaatgacaaaagggnccagtttcattgattttaagaaatgagactcttgtaacatcagctggagtcttggggctacctatcaaatcatggtgacaaactaaagtctgtttgataaaatactgtctatagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctatactgtctgggttccttttctctgtagtacttttcagatttgaggctttttcttctgtttctggccttacccaacatattgttaaggataagcttagcctatgctgcaataaaaaacaactctcagataaaaaaaaaaaaa

SEQ ID NO: 12316 - DNA, 911 bp, Homo sapiens
  misc_feature (1)...(911): n = A,T,C or G
gcagcgttgcagaatacggcaaaaaacgnnggccctggtggaaaactaaggagaaacgttcgaggaatacacttttgcctacattggtggatattatgaactacttttacattacattacacaacttcctctctgaatgattagttatgtataaaatttggagatattgtgtagtgacaccttagtgtattatttacagtgaacatctaatttgcatacagaattctcacaatttatattatagtattatttcatggagttccagagtataaagataattttccacctcaaaaaaatatgaaatgtaagaacttttacattttaatgagttaatgtaatgttaaagttgctaggagactatggcctctttgagaaaactaattatactgttaattaattatgaattaaaaccaaattttattgactactatttaagacttattgctatctattggttgtggcacaaaaaaattttacttgtatcaactcgatattgtatttagttgtctttttatactgattatataggacatctttgatagtttaaatgaagtatgcgggagaaacaatgactatgacagctttcttcagaacttatggacgaaaattcaactttattatgcttaagataaccacgaggtggttaaccttgaataggaaagtgcatcaagattgctttaatagacgagttatgggtgactgcacacttggagaaactctacttagtgccacatatacgacgatgcgtacgtatcgcgtagatgtatgagtggacattagggtcgtttacaggtcccctacttatgatcagcgataaaattcactgtgactccccgcgcgctncgccatgcactggtatgtctgccgccagaggcgcgtgaaattatgcaatatatataattcatgctttg

SEQ ID NO: 12317 - DNA, 900 bp, Homo sapiens
  misc_feature (1)...(900): n = A,T,C or G
aggcggggtgacagttggggggagannnaacttttcgtttgtaactgcccgcacnncctggagcgctgtaccagngaagcncnnagccaggaggaggaatnctcttctaaagaacatggcagacggggggcgaagagatcgctcagattatcgctagaacgaaaagcacagaagaagaagaagtgagaggatggaagcaaaagttcaaggcagcacagcagacgctggagtggaggaaagtgagaattaaaggccctcggcggtttttttttggagccggggacagggacacccaccgagaaaggcaagcggccgagaaggaccggcagaacggggagagaggcgaagcaaacaaacgcaaccaggggggaggccaaggggcgccgagagcagaacnaggcgcacggcgagagcgccaaaggggggggaggaggaagcgagaaagccaaaacgaanagccgcaggggagacacgagaagaggaagagggggcgacaaacgccggagaccacgcgcggcccggacaggcgcacgaaaaggcgggaggggcgcaggaccgagaaaacagggaacggagaagcaagagcgaggcgaacaacgggaagagggaggggggacacgcggacacgccacagaggccggggcgaagggcgagcgagggcgagggggggggaaaggaggggagaggcaacgggaacgaggacacggcggacaagagcagagagcggcgacaggcagaggccggaggcagcgcagggcggcaggagaagcgcacagaaggaaggcgagaaggaggcggtgaagggggcnggcaaggcggcgcggggaaggagcggggggtaagcaggagacgaggcgaagaagagcaggaacgacgaggaggtaagaccacgaggaaagg

SEQ ID NO: 12318 - DNA, 1063 bp, Homo sapiens
  misc_feature (1)...(1063): n = A,T,C or G
cacgtcctcgcaacgggatcgagttaagcatcgcgaccatgtgtatccttactttcatctttctttgggaacccacgcctctcctctacatcgtgaagcccttagcgactgtttccacttctacatgctcacctcctacgtgaaccncttnactactcaccttacgatctcaccannacatagtgggtcctcccaaanaaccggtaaccctgaacacatgacataggacaaccatctaactcacacgtgggggnggcccgctcgtgnacgcgtctgctcacagcgccctcaccacccctacctacgggacagacggcatggagatgaactacaccgcacgccgtctacgaaagcacctgcgtctgggaccatgccatgcaaccgacaagacgccagagggacgcaggcagcgcattcctcccgctgacanaaccccagcgcgcgcaacgaataacacaagatggaccgggagctgacggaggggaggagaagcgcggacgcccgcggcgcagcgtgaggggagcacgcggcgtgggcgaactcgccggggggcctccgcgcgccggccgacgggcgaggaccccgggtcgaaccacctcacgatgccacgacagccacagggcctgcagngacaccagnacagcagnncccggacccgctacgagcgcgaggaacgaggcatcatcgaaaccctcttcgacccttaaccatnnannacttactaaacccttncattcncccctccagctccgttccgttcaccactcacgncctccccgttgacccctctgatcccgtcgcgccgctgctctgtctcctcccgctattncacctgccctagtcccgcccgcgcgtngtctccctgtccgaccttncctctgncctcctnnntnccccctctcccctncctnnnnctnctcctctctncctcctnncctcctctcttnntattctnaccaccctatnncctttccctnnnactttnnctcaatnnnccttnttccncttntatttnctcttccttctncccttccactctnccttnnncactccattnccttct

SEQ ID NO: 12319 - DNA, 244 bp, Homo sapiens
ggcgaggggggacaattagcagcgcaacgcacgcttgacgatatgggcctatctaatgtgtgaagaggtctccatgagggtgtgaccatcacaagcgcaggtggaagtggtactctgcttgggggctgggaggggcacaatgattgtaactttccaaaggcctccccagaagcagaagcctatacagcctgcagaatcatgagtcaattaaacctcttttctttacaaattaaaaaaaaaaaaa

SEQ ID NO: 12320 - DNA, 510 bp, Homo sapiens
  misc_feature (1)...(510): n = A,T,C or G
tacgattctggagacaagaaagtccacaatcaaggtgctggcagatccggtgacagaaactctggtcaggggagcaaacagacaacctatanaatgggagaaaatatttgcaagatatgcatctgacaaagttctgacatccaacatctataaggagcttgatcaaattcataaggaaaaaacaaacaaccccattgaattttctgatgactaataatgctgagggcgttttcatgtagacctacatgagctgaccagtcatattctgaatgtcaacctatctttccgtaaaacataactatcataggtaccttacaaacttcaggtttataagacgaggaattgtatttgatctgaaatgcctaagtggacacagttctgccaataatgtgccacatccacctttgagcaaacagaagggctggatggatctccataatgtataaaagaaaaaaaaaaataactttttaataaaaataaaaaatgagacctgtattaaaaaaaaaaaaa

SEQ ID NO: 12321 - DNA, 1050 bp, Homo sapiens
  misc_feature (1)...(1050): n = A,T,C or G
ggcgaggcggcgtagatcggaacggaagaaaaancttaaggtgccacaaaagccctgggtctcggccacagcagggcaaagaccaggggacagagagaggaaggggataactaccntgcagggaggggggtgtgctctttagctgaaagcttcaaaggcgctgcagagacatctagaacaacctggcctacagaagaggagccacgcctcttgcagagcgctcctgctctgcgtgaggaacagcaccacagcgtcgagtgacccagtggggcaggagaaggagctacccccctcgcagggcgggggggggttgcgtgacagggtgaacacttccagtgggatgaccgtggctacacgagagggagctacgccacttcgcggggctgttcgtgagcgcatgctaacactgaaataagacgcgttcttcatggttcgtgcaccaaagaaaaagaaagaaccggggggcctcgggtgggcgctcagaggggggaggtgctagccggccggttcgccctttaggggaggggggtaagtaactagaggcgctaggtcacgtgagcgagcgtgagcctccgaggaccggcagggctggggcgagccgggatgtaagcttatttcacaggggcggggtgatactgaggtgtgcacacgaggcagggtggtgagctgcagggagcggaccgttggagcgaatgcgccgacgaagcggccagcgagcccacaaaaaggcggggtgggctgacggtatgagcggagacgtggggccagagggccggcctgccagagagtcgcggcttaagacggaacgatgggaagagcgcagcgagggagtggggtgagaggaggggtgcgcgagcggagaggcggcgggcagcgcacgggatgcgcagccgctgcggtgaggcggagatgacgggacactgcgcgggagatggaggcgtcgcgcgcgccagagcgaggaccgactcgcggtctgcacggcgcgagctgcgtcacgagacgggtatgcggagggagtacgagccgcgggggtagcagggcggcggcgtg

SEQ ID NO: 12322 - DNA, 142 bp, Homo sapiens
cctagatgcacatgctgtggctctaaggattaattacatttgcttaagataatgcaacatgagaaaagcagatcaggacggaatggcagaacaaggattttgcttgaaataacatcactactaattgtcaaaaaaaaaaaaa

SEQ ID NO: 12323 - DNA, 886 bp, Homo sapiens
  misc_feature (1)...(886): n = A,T,C or G
ccggggggccgccgcagggcaggacaaaaaaacttcagctggacgtgggggggtaggctcccgagagccaagacaaggggtttcccctgccaacaacccctatcagtccggggggccaaattatccaccctaaatctaccaccaccactctnnacctctaccccccactacccctctctacaccacatccatcctaaaatacctcacctcaaanatacttaaactnncaaaaaatccctcaaaaaacttaaaactggggggggggagccctccgccctgcggcttgataaaaaagggataaaggtgtggttgtctcatcagggctacaattccgtgggggggggggcttccaacatgcccacgtgtgtggtggggaggaacgggcaagaggagactggtgtaaaggatccctagattccttggtggcggagggctctggatactctaccaggggggcaggagtgggggggtgcaggcgactcggtggctgggaaaacaccgttctgccttttggggcccgctgtcgcgacaccgcgaaactgtggggacgtctgcgaccgacccgtgtcggcgttgcggtcgcacccaaggcggagggggacggtggggtgcaaggaggtcgggggtctgagggagagggggttagtgcgccggggtcgccaggcaaactggagtggatgggaatcgcaggcgcggcggctggaacgagcgcgttgggtggtgcacgcggctgcccgcctcgaggggagaaacgcgtcagcgggggggccacggcgaggaccagcggcggccgcggggcccgcgcggaggcgcgggcgcccgcctgcgagcggtgaggccgcgcgtgggggaagctgggagcgaagcgggcgccagaggggggtag

SEQ ID NO: 12324 - DNA, 891 bp, Homo sapiens
  misc_feature (1)...(891): n = A,T,C or G
attaattatgttgtattatattaatattgtatcggagagttcacgtctcctttagtaatatcaccattcagttctgcacatcaattgggaatcgattttgacgagggtgaatggtagggaaggggagcatggtggagggctggaagaggaggaaaggaaatggaaaataaaaacggacaaaacataggaagaaaaagagaaaaggggtgggttcgaatgagcgaacaaactgtgactaaatctctagtttgcagattgaaagaattacatattatagaaagataataactaaacaaacgaagaaacataaattaatctatatacttggcttaaagttataatacaacaaattaaacaagaataaacagaaaaagaaaaatacagagaaaaaagaaaaaaaaaaccgagaactgaatgaatcaggaggaaacgtaaaaatgaatacgaaaaagctacggatgggaacagcgagtaaattacaagaacataacgaagagctcaaccttagtaaactganaaatacgantgtctgatagaaataataaaaaagttgctattaagcgtttgtattccacttttccctatnantctaatagccgcatattttcccacttcccagcacctctctctgtggggntttctatgacggtactgctgtgcatagctgcagtagcgccgggacgcctatgactcgtcgtcntagattttaggtgtctatctatacgtgccccctcgtacctgccttccggctctccgcgagcgggaaatcgcttgtgtgcttggcctatgacgaataccatttgtggccacaaacgtttggcctaaaattttttttttttttgttcaatttatnacttttcccctaatatttcctncnccttncctctttct

SEQ ID NO: 12325 - DNA, 1075 bp, Homo sapiens
  misc_feature (1)...(1075): n = A,T,C or G
ccgccagccgcagcggaaaaaaaaacctcacagcacagctgtggctgtanagaataattactttgcttaagataatgcaacatgagaaaagcagatcacgacggaagggcagagcaaggattttgcttgaaataacatcactactaattgccaaaaaaaacaaaaaaacaaacaaaaaaacaaaaaaaaaaaaccgggccctcgttggcctcacacggaggagctctgcggcccgttccctttacgaaggggcaattcttgaccccccgggggggggactccgtccccccggcccttcacactggcgcgacgcgccacaaggccaatcaaacgcgggaagaccggactcccccaaaacccgggccataacccccgaaccagaccccgtgcacactagaaggcagcccaacccgcgcacgaatccgacgcaaggcccccctcgcctggccccgccttcaccaagcgcccccgccacccgcgcggcagtcacgcccccaaagcccaccgcaccgtcatcaaccgagcggcgaaccgcgccgcaccgcccctccaccgcacacccgagaaggagcaactgacgagcacagcgtgccgcgtcacgctccgcgggcgcaaacccggcacgggtaacgcgcagcgcacgccacgtcaactaagccaggacgaacccgacagcacatccgaacataacacgccacggacactcaaccccacccgccgcgcacgacgacgaaaggcccacacggccgaccccgccacccgcaccccgcacggcagacgcgaangcaggtagacaagcacaaacgaacgagacagagcgcgagcggagcacacgccagatacgacgcacgcgcgcctctcgacgccgtatacaantatataggtagcgataggaccagcgcggcgagcaccgtcagaacacgctcacgatacacagacgcacacgacacgtgccagccaagcgcacagcngtacgaccgacgcccgcacaccacagccgcgttcgatcaccggcacacgaaaggcacgcgcgacacgctctgcgaccacgcacacgtcgcgncacggagcagcg

SEQ ID NO: 12326 - DNA, 761 bp, Homo sapiens
aaggctcactccaataaagggccccgccgcctgtgcttttatcacaccagcctctaacttaaactccaatgactttttaaattaacccccggtaccgggacctctcatccagtgccgtagataccttcaagacgggagggctctttttttcggccccggagctgggatgatgccactaggacctccctttcacgcgaaaaattaataaactttttaccacccgcccttaagggcccaaaaaaaaaatggtccttataattttctccgactccctaaagaaatttaaatgttgccaggaaactacaaataattgtcggccggcaaatattcatgccagcaattttgccactgtggcaggcctaagggggcgaaccatcttgggggaggagggtgaaaccaaccccgcgccccaacagaaaagcgagtggctttttaacccctgcttactaaaaatgggctgggtcgcggggccctcctatctaatcctaaaagaggtggggcccagcaatattccacttaggaagctggggtcctggaaccccacacccacaaggaagggatcctggcccacccccctttttaaaaaatggaggcccccgccccaccccttttttttttaaggggaaaaagcaaaagggttttccatggacccaggcgggttaatcattcacccaaagaatgacccctggcccccaaagtgagaaaagggccaaaattttgccccccacactacattttttcggaaactaattattgggggg

SEQ ID NO: 12327 - DNA, 1439 bp, Homo sapiens
  misc_feature (1)...(1439): n = A,T,C or G
tattttttctcctcccgccgcgcggattccggtcgttgcgtgcggatccgccttacaatccgtgaatatccccacggacgtatccgcattgtaccggccccgctaaacataaccatatgtcacgcgaccagtgcactgtccgtatccacatcgcttgtggtaattgtgcaagtgaattataagagcccggctctccataagtagtcatgattacgcgcgtatcctccccgcacccgatacacgttcatacccctctatgtgccccctctccagtgtcagttacgtctatcgtcctccgcacgcgcaggatgaatatgccacatgaatattgcgcccgcccccttgaggtaaaggttgcaatggtagtacggtagaagacgagagaagtgaaacggacactcgttaacacaatgttggggcgatggggatagtgggaggctttatcggtagtcgacagtcacacgcacgttaaacagcgcagtcgtctatgacaacttggcagagcttatcgcgacggattattgtagatactacagccgtaacctgtgcgagagcaatgtcgctaaactaaagagactctaagtaagtcgcgcgcgctctagtcgtattcgccttgtctgctgactagacagtcgcactgtgcagtatatgtgtgatcgtgtatctacgtcgcanattcgtcgactnatagtcgtgtaacagtgtcgtacgcataccatnttcgaatatagactatgtaatgtntctatgatagacgatgagtggcgtcatcagcgtagagtcatgcagagtactcatagttgtctgatngaatagactaggtcgcgcgcgatggatcgacatgcatggnagcgcagcagatatattgtgctgacgtgtatgtctccgcacagtgatgagacgcctcgattagactctcaagtgaatcgctcgcgtctgtgtgcangctgcgagtgtagagagcgtacgcgcgacgacgatgagtcgcaagagcgacgtataagcgaagctagtatatagtgtgtgatgagctaggtgcgtgagcagatgtaggtgctactgtgttgctgacagtcagagagtcactgtacgcgatcacacatgcgcacaatgcangtatatactcacagtcagatcgcgagcagatcgtgngtgancgtgtcgagtagtgtagttctactgatggctacgactcgatcaggantatnttganactacagcgagagagatagccgttggcacagtagtgtgtcgtgtcgatatcatatagcacgaggtcactgtgtgatctactaatgatatacgagtaatgcatactgnatgctgtcttcaccgcagcacgtccatgtcacgtgtagtggtcagctccnantgtatngtagtgcntgcncacgtaatatcgcantcacgtcgagcgcgacatcgactcatgatatcgt

SEQ ID NO: 12328 - DNA, 567 bp, Homo sapiens
  misc_feature (1)...(567): n = A,T,C or G
aaattttgttttccaggcctttnccngnntaagtggtgaacctgtattnggntttngaaactnaaaagaaaccaanagngtcccntgccccttttaangnttattgttccagcanaaaaaatcccagctattaaatatttaatttccttaacttcttccagtttatcataaagaaagatatccaagataatattgagattgttattaagggaaatntcttgagaccaaagagaaaaaggggacaagagtcttttgtggaaaagatcactgagaggaatttataagcctaagaaggaattcgtcaggaaaaagtgagcagaagacgcttacaagaagagaataaaacacggagagagatcctgcagtaagaaggaacatgtgtatttatgagacttaaaatggttcatgttcctgggttgcataaatgggagacaaagggacagtcctgtttaatgacctcagaattaggcagggactagagcaggaatagcagcataagcatatccttccatctaaagttcaacaagtaaagctcttccaaagtttttgctatgataacatttgaat

SEQ ID NO: 12329 - DNA, 161 bp, Homo sapiens
  misc_feature (1)...(161): n = A,T,C or G
taatagaagaaggacaatagaagagaaggaagaggggccttcatgtgtacagcgccggagggcctancagggcaaaacagcgggagacaaacaagggggcgcatccagtgatttttcggggattagaagccaaccacagctaaagggaagccgccgcctcc

SEQ ID NO: 12330 - DNA, 953 bp, Homo sapiens
  misc_feature (1)...(953): n = A,T,C or G
ggaacaaggggggggggngncggcggagccgcggccgcccgggaaaacaaaaagaagaaactaaaggaaaaaaaaagagaagcctccagagggaggaaaacccgcgagccgccgcggcgcgcggaaagacacagaagaggcctcagaaggggcgcgggggcccacagccggagcccaccccccgagcggcgggcacgccgcaccgaaccccgagccccgcacacgcgcaaanccccgcccacccgacgggccacgccgcccgcggccaacgccggcgccccccccgccccgcccccccgcccccgcgcggagcaaccgccccgcgcccagaccccgccgaagcggacgccacgcgcggccgcaaccggccagcgcgcagcacgccccccggcagcgccacagcacggcgcaaggagggaaaagnggggcgggaaaggcaaccaccccgccgccacccacagggcagaagaggcgaacaggaccccccagcacacaccacccaccccagcgagcgcgcgccaaacgcgccgcgaccacaagggcgcggagaagcccaacggccagccccgcgcgccggcccggcgccaagccgcccccaccacaagcagactccgacgagagaagaaacgacaccccgcacgaaagccaccgacaaacaccacccaccccccccaccccaacgcgccacgcgcacccagaagaccacaccaacgcgacccccacagacgaaagcgccagaaacaaagacgaccccaagcaaaacacaacacaaaaccggcacaggggacgcaaaaaggccacaaaacacgccggaagagagacgcgccgccgcgcaccagaacgaggggcgacacggaggacccaaccaacacaccgccacccgcggcgacaccacagcgacagcgcgcggcggcaccgcagaccagaacacaggcaggcgcccaacgggaata

SEQ ID NO: 12331 - DNA, 661 bp, Homo sapiens
  misc_feature (1)...(661): n = A,T,C or G
attnccccagnccanagtantttnataaaancccggcccantngaattttttaantnctccttcnaataaagggnntaatattggggntccngggggccccccccctnttgaaggnncangcggggaataaataaggnntcatnatggccnnataaaanggccntnntacacaagtttaaaatttggaaaaanganagttcaantntttttctncaccacnaaacaagttctcnaaacttaaagcccncagtgncctcttttnantttanccnacccgctaaagaaaacttttgttgaaccagctttgttaagatagttaccaggacaggcctggcgcgggtggttcaggcctgtaatcccactactttgggaggccgaggtgggcagatcacttgaggtcaggagttcnagaccagtctggccaacatggtgaaacctcatntntactaaaaatncaaaaattagccaggagtggtggcaggtgcctgtaatcccagctactcgggaagctgaggcaggagaatcacttgaacctaggaggcggagnttgcagtnagcccnngtngcancnntgcacgccagcttgggngcacaagagcnggactccntctcaaaaaagnaanancanatgcggccnccctcnanganggtnaatttcga

SEQ ID NO: 12332 - DNA, 530 bp, Homo sapiens
  misc_feature (1)...(530): n = A,T,C or G
aaacctgcantaagtgattgaaaagtagaaagcatgtggncaaataaataggctactggcttgattaaccccaggaaatctcaagcagcactggagttctgaaagaattaaggggtgtggctggtggaaagctgacaaaactccctcagagggggcaatagcatggatatgaaatagaaatcagctaaaaatatttattgtgtccattgtactatataccagtcattaaaaacatgtgaaatagagacatttttataagcttgtaggagaacattatatgctttcatggaagaaagacaacgtattatagtcattcaaaaatggatgtcaagtaatatagtgaatatagatacccaattgcagaggtaaagctcaattgtgtagaaagagctttagagttgggtcaggtgaaagagataaagggagaaatgctctatgatatgacttatagatgaagtctggggataacagaaatattctaggaacgggatgatggtgaatatattgctgctcgtgaagacaattctaat

SEQ ID NO: 12333 - DNA, 551 bp, Homo sapiens
  misc_feature (1)...(551): n = A,T,C or G
aaagnggttttattggggttnaaaaattttttataaccttttnaaattcgattgagtaggtgattcggaaatgacagtgttggggaatattgcattattttgtgggtatatgaaancagatattgtaaagaatagattggcttgctcttttttagtaataaaactaaancaatcnccaaaagtaaaaccagaancaaagaanctatancctacaagactttgattccttaaaatgaatggaaaatagaaagtagaaacttgctttctgacttgtactctgctgaatctagctcattcgataaatccattacaagcaggtggttcaaattcctaaatcagaaagactgaggtttttcaaaacttcccctacactgtctttctttttatccagcctaattctggaacctaataaaaggaaaataacaacgtgatatttaaaaaattaaggagaaaagactgtaagacttgtaaattgcaacagatgtaaaaatatttctagaaaatattttgtaatcaaagaaatattgttttggcaactatacaaatataat

SEQ ID NO: 12334 - DNA, 972 bp, Homo sapiens
  misc_feature (1)...(972): n = A,T,C or G
cacagaaagcaaacgatacaaaagagacgggggggggggnctactcgcaactaccgncttaaaatgnattgacaccgcctgcgggatctctaacccggggcgcatccagtgatttttctgggagtaggggcctactcccacctaaagttgataccggcacgccatgggctgtttaacacatcatggccttaaactggacccgtggggggacaatatctattaaccacggctccagtgggcccactacccgccgggcaaataacttctatgcgggagggctttttttttcgcccggggggacaaatgaggccgctagatcccccccttaacggctgcacatttatgaagaatatcccggaacgcgtgaaggggtcttctcccatataaggtacctggggaggtatctagactacaatcggtttttggagcaggggtccgggaaccccccagaacaaagggccttaggtttccttgtacagggaccgtctcaaacatcctgtaattaagccgggtcgggagtgtgtaaaagacgagaggccctcatacttgcgcgaaattcgtataaggcagtgctgagaaagttttttctagacgggctaatacatataagcccgggtacatcgaggacaatgtgtggtcaggtgaggcgaatatgcccccctcctcaccagagaataaaaacccagaatcccggagggataatcgggccatttggggtaccgtaagtaaatatatcactctttcctcccggcgcaagtttctccacatattaatctaaacacctgtgcggcgccgtgctattatagagaaggaaaggcatcttagtgtccgttcatgaattcctccngcccgcgggatgtaagtcgcaaggagtattagttgaataggttgggggggagttggactcctaatagagtaggagtcaatgttgtgtggtgcccgagaggtggggtttaggggaaggaaggtgaa

SEQ ID NO: 12335 - DNA, 1112 bp, Homo sapiens
ggggggaggggcggggacgtattacgacaatatattttggcattttcccgaccctacgtaactcgtaaatcattcactcggcgtgtcgcacgctcttttcgggggacgttatatgcaagtgcgtactaaatatagatggcatagactaatgggacaatctgattaccacatcttcgtagtatacgccgctccttgctgccgagggaggttattgttatgtacttctacgtgaactcacagttaggtcatcgtggcagggacagactatcaaaatagcgagcgcagcgggagaagtgaattcctacgcccttgggcgcccgtgctatcgtcggttcaattatgcggatactatgagtggtgcggcgtggcagggcgggcgtgagaacgcaaggtaggtgctaccgtatgcgtcgcgtgatactatagtgtgtgctggcccctgggaggcgatgagactagaatataaatgatgtcaagggggaggggttcgatggctgccgagcgcgattaccgcaagacgatcgcccacccatctcggtgagtagcgccccttatctccgcgttcaccgcatagattattgattgcgacatatacgcagctagatttgaatccgtgcgcagacgcggatgcttaccaggaatagcgggcgcactgagtcagttgacgcgagtacgccggtccgccgtacggacaggatattgcggccgaggcgcgcgtggagtgcccacgtgtaaatccgttggatcagacggctcatagcattatatgagcgcgattatccgggtgcgctggagtacgcacaatatcccgcacagctagacagggcaccggcatgatgcgcgagtatttgagataaccgccagcaggttgtagctctgccgacgcgtgagggcgtcagtaagtcggtgatcacgctagaagatacgtataatcgcggtcaggatgtggaagcacgacggggtgcgccgatgatgatgcaagcactcggcggatagtgagagcgagagcggcggagcgtcatgtgcaggaagagactatatgtccatgactcgtccggcgctagcaattcagagggagaggcagtatattggacaagaagtgcctatccggt

SEQ ID NO: 12336 - DNA, 1956 bp, Homo sapiens
  misc_feature (1)...(1956): n = A,T,C or G
caatggagantagaacagagtgagaggtatgagaggaaagcagaannaagacagagaaagngncctttgngttnagtttngtactnnaagaaagcganagagagaggccctgcnggagaagggnagaganacgaaccagagaganggagangangagggaagcgacagcngagcgcagcacgcaagcaaagaaacacacaaacttgtgttgagaggnagcacgcgacgcagcggaggaagaccgagagacagncgaggaagagaagacgcganangcgagacgcgagacanagangagagccgagaccacacgagcgagagcaagaaggagagaagacgagacgacngcaagagacggagacagacacgcaaagcagaaacagcacaaaacacgacgaagagagcgagaggcgncgnagaagcagcgcagagagcgcacgacgcgacagcagcganagcagacagcacgacgcacagaacagacacnagacgagnagcgaggcacngngcgcgaagacgacagaantcagagccagcgacgacacangagcagacacgacgtggaccgcatgtgnctttttctctgtagtagcgnangncgacanggacgcaagcgacaggagagagatcgacgagaaanagntgagagagacgagacgagagagacgaccatngacgagcgcaaacgtacgcgcaccacgatacatacgatacacagataccgacgtgccgggctggctaccacaggcgacgacagcaggacgacggggcagcggtatgaggnagcgcgacagcgacggagagagcagaggaggcgacacaccactcacaaaagaanacagacaagacancagtagaaagagnacacacagcgacancatatcacgcgcnctgcacggcgacagcccgacagagcaagaaccacgagacacgcacgcagagcgagcgacatgcgcgcncatcgacgaagcgtgcgagagaacnagtcacgcagcngctacaacagaganctcgagcgtgggagacgagagangcaacgcgagagcgctcatgatgagngacgcagcgcnagcagcacntgagcggcatgagnagcagcgacgcgagacacgaccagcgaacacagcgagagactaaacgctcagatgacagagacgcgagagcgtatgcgtactgcgcggaagcacggagagatgagattataaaganagagagangcgaagcgcancgcaacgcagagncgacnagcncgtagntngcggcagcaggatcaggcgtgtgtgcagcagtacgagaacgctcagcagcgcgaagaacagagcgcgcgangcntctccaacgagcgacgacggacagatgacacgtcgaangacacgagcacganagagagatagacgacgagaagcgaccncgacagtcagcgagcgaagcggatgatgaacgnangacggaacagatagagagacgngacagacnacgcatcatacagacatgcaatgcgaggtgagnagacgcgagacggagcacaacancaggacacatgaagagcacacagacagacagatacacagagagcatagagagangatgtagggcgcgagcagacgaacagagaacgcacgcatgagccgaagtacagagagacagcgcagagaagcacncgcacgaacgagnacgcgctgnagcgncacgantacagcagcggcgcancaagatacggaacgcaccacacagacagcancgaatcgagctgcgagaagcaagcgggtcgatgagacagaatgcgngcgcatgngagcgcacacgacgcgacanagtgaccaaaggcagctgatcagagactagcgcctcgcagtgagtggtcgcaacgacgcgacgcgacgcagangagcagacgcantagagangtgacacngcacacgacacgatacaccagtgcgacagtacgacacatag

SEQ ID NO: 12337 - DNA, 947 bp, Homo sapiens
ctcaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcagggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatctttctttgtgtaggacaagacaattgaaccaaagcttgtttgtcgcaatggggtagaaaattcacgtgcacaaagattagcacacttaaaagcaaagggaaaaattaacttaaaactgcataaatattaaacctaacccggattgttattggtagaaggctcattgtactgaacaccttgataacgtatgaaataactttattactcttaagggagacggatttggagaatttgaactctacatacctgatgactatatacctcgacttaccttaacaactatgactatctgtgccgatgagctggatatcgcttcgctatgctcttctattctcggcctcccgaatcgcacacacattcactctgctgttcgcagcgattctctgtcctcctgccttcgccacctcaccccccacgacctctgttatcgccctctatattcttttcatcacctatctgtcctgcgtacatacgtagt

SEQ ID NO: 12338 - DNA, 912 bp, Homo sapiens
  misc_feature (1)...(912): n = A,T,C or G
cagcttttattaatggaagagaagaagcacttatggagaagataaaaagtttgtgttgctaggaaatgacaccctaaggacagattatggctaagaagagaaaactaaggggagaagacttagcagtgggatccatttaatgaagaaccaaatagtcttgactcaaaaggccttgtgaaaattcctgcataaaatctgacaaccgcaaattacccaaaaagatttctaacttggaatcactaaggacaaagactcctatattcttgaagccctacaagctggaactggacaactcgatgtaaatttcaggagacaacccccatgcctgatgtgtgggccactaagggagtttaccaaaacatccaatgccataaccagagacattcaaactaaaccaagaaaatgtttcaagctcaaatccagaaatcttgtcaactaactgccctctgaactcagagactgagtttataatttgtcctaagccattaacctttgttaatagcttttttttgttttgtttattttttctggtttggttcatgagggcatttgttaagaagcatactctaatcccttggtatatcctcctgatagttcccattgtaatctcccagctgcattctctcaaagggtttgaaggtgtatttgcagcgattagtggtatactangtgggctcactgtgattactcgaacacctgcaagatgaccaaaggaatgtgtcttcacaaggttgacattgtggcttataagtttattgttaagacaaagaccaccctggcatgagaataactgacagtatggctatgccttaatttttatcaaatccctcatacaggttgagcttgataagggggaagctcgtagctaatatggggaaggcattggttgattaacttctgccatgccccaca

SEQ ID NO: 12339 - DNA, 749 bp, Homo sapiens
  misc_feature (1)...(749): n = A,T,C or G
cactttttcctctaaatgctgcttgaagtctttaaatatttaataagtgataataactcaagctgctatttggaaacctaaagtagacacattttgaatcttttgtgtgtgtgtggttttcaaataaagttagtaatgatttctggatccaaaaaaacccagaaattttactaagtaattntgacttagggttgaaactacattcttagaaatattgagatgagagagaaagctatgctgacagtctgctgaaaacgataatagtgaaatagctcattattccactacagcattctccacagcggtcggggatgcactgacttcataaagattttattatgagcctattacctatttttcacacttttctctgattatcttttttgacttttacctcaaattttaagaatagactgttttataatgggaaaaatctatgggctggtaatcctgaggtctaggctcttctacatctgtgatttaaaccatttatttcactttgttaatatgaagtttttttctataaaattgaggcaaaataatagatactctactatctcaacattgtagccattataaagtgagataatatgtatagtcctttctcagggtccctacttggttcatattcaatcaacaaatatttatttaatgcttattatgtgccagtctctgttcaaagggcttgaaatatagcagtaaatacataaataaatgaaagaaggaatgaatgaaaaaaaaaaaaaaaa

SEQ ID NO: 12340 - DNA, 890 bp, Homo sapiens
tgagattgtcagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggcttatataataaatgcttctagcctcccgcgtgtcaaaatcctcacctccttcataaccatcctccaaaaccactcccctgaccaatataaatttcatggctcgatcatatgactccatctccccaccaatcgacaaccccctcccatggtagcttctgctgagactcaaccggcccagacctactctctctactttacaacctggaacctcctgtggaaatgacaatggcgttatgtcactctgcccacgacattccgcacgcccacccttccttgaccatgattctccactcaccccaccccgccctggagacaccacacgctctttcatcctgcgccagctatcattagaccatcccgacagaccataactcccaacccctacccccctctccccgcacacatcccaccacaaggatacactttttctactcgcacccctcaagtgctgctctttacttgttctatattacttcactcctcccctacccccaccgtttctcactctgctctatcttagcccccgttccactctccacctgcctcctcctc

SEQ ID NO: 12341 - DNA, 161 bp, Homo sapiens
  misc_feature (1)...(161): n = A,T,C or G
ctcagacnttagaaaacaacagcaaaccagaagaggacgagataatccacctaagcaggactacttgaaaagaagcaagtgtggaaactatgaagccttgtaatagattttttttttttttttgatgagctgcctctgctccctctggaaaaaaaaaaaaa

SEQ ID NO: 12342 - DNA, 1052 bp, Homo sapiens
  misc_feature (1)...(1052): n = A,T,C or G
agaagagaacggcaacaaacgagcagaaagaaaaggctgagggaaaacaacgacaangcgctccaggaacaaacccagagagaacgcgactgcctgaggacctacgaggtttgcaaagcccaacgaaggtccctgacctgagcgccgactgcgctgaacggcacacgcgcaaagaacgagagccgcaaacacacccacaagaccaccacgcacgcgacgcgccacacaacgggaagcgacgcaagagggccacggagcgaggcgacgacagcggtacacggccgacagaaattttttgcgagagacaagaacacaacccgcaacaaccgaaagacgcaagagacaaacaacaccgaccagccccacaaaaaaaagaaccacaaaccaagaccgacgacgcccaacaaccccagcacgacccacaacacacgcaggaggagagaagaccaaaccgaccaggacgcaccaggaaagagaaaaaaacccaaaacagcccacacccaaaaacacaacggaacacccacgggcagccagcagcacagcatcccaggactcacccaaacagagagaaaatcgcgagcccgccaccgacgccggcacacgccacaccacgaacacaaacactgcgaaaggaggaacaatagaggcaccggcgcacaaatgaaggagagtaggagcagaacaagagaagcaacgcaaacaggacaacgcaagcagtgacgcaccacacaacacgccnaccacaacagaaacgaacgagacgatcacccgcgcgacggaacagcgcgaaaggtaacgggagagcgtgagcgagacaaacacatacacacaacgaagaggacggaagacgaacgcaaacgcacacgcggcgagcgacaggcacgagacgagcaagagagcgcaccactcgacaccccacaccacgagccagcgaagacaagcgagcggcgacccacaatcgacatagaagactcgaccacaacgcgaaggcagcgacatacacagcacgcacacccgaatccacacacacgccaccaccagcccccaccccg

SEQ ID NO: 12343 - DNA, 642 bp, Homo sapiens
  misc_feature (1)...(642): n = A,T,C or G
cttagaaccgacaaaactgaagcccgttgnaaggcaagtgacttaggcaagatcacacaactgcctcccaggcattccaggaaaagaaacacaatcacagatacttgtgctaccaagaattattcttgttaccccaagttttgatatcccggaatgccaaagagttttccccaagagcatcattcctgggctcagcttgcagtttgaccacctggatcctgtcatcagcatgacccggggccgtggtccttcttgggaggtgtcatgacatcacagggaaaagcataggcttctgacgtcatgatataattcctggttcctcagtttactagctggatgacttgaaaaactgctcaacctctctctggcctctatgttctcatctaaaaaatggaacccacctgacatgacaacctcacagaactgttgtgaggaactaatgagattatgtaactaacatgcttgctatttagaaagtgttccattgttttggccaggcacggtggctcatgcctgtaacaacactttgggaggctgangtgggtggatcacttgaggtcaggagttcaagaccagcctgggcaacatggggaaacccgtctctattaaaatacaaaaattaaccaggcaaaaaaaaaaaaa

SEQ ID NO: 12344 - DNA, 315 bp, Homo sapiens
gcttcagacaacagatctctgaagttaaaaagaaagaacgagacagaaaggaggaaaaagataaaggaaggagtagaaaaaggaggatgaaggaagagagcacaaaagaggaagaaggaaaaaaaagaaaagaaaaaaagaagtcatgaattttttaaactctaagatttggtttaatctgatctaagaacaggctgtgttataactctcctttataaattagttttgttgttgtttttatcttaaccaaatgattggtggagaatgactttaataagtttataaagaaattcataacttggaaaaaaaaaaaaa

SEQ ID NO: 12345 - DNA, 159 bp, Homo sapiens
  misc_feature (1)...(159): n = A,T,C or G
tcagacnttagaaaaaacagcaaaccagaagaggacgagataatccacctaagcaggactacttgaaaagaagcaagtgtggaaactatgaagccttgtaatagattttttttttttttttgatgagctgcctctgctccctctggaaaaaaaaaaaaa

SEQ ID NO: 12346 - DNA, 413 bp, Homo sapiens
cttcagtggacacttttactgggttaggcattgagtctccaggtttggataacagaggcgactcttttggaacagggaaagctgtggtgaagaaggcaagtcatatccatgttgtgtcctggcctgataggaggttatcagcaagaaagggagaagtgtgtatttcctcgttcacttacacgttctcaatgtctatctattaataccctcaaaccagtgactttcattcatgtttataaataaaattatatatatgaataccctatcaaattaataatgattatttctgtttactggaattatggaatatttttccttcattttgctgatctaaatgttcattgatgattgagataacatgtttttcagaagagaaatattaaaagcacaatttttcttgaaaaaaaaaaaaa

SEQ ID NO: 12347 - DNA, 406 bp, Homo sapiens
ctcagcgaacagactggaaacttcccattctacactctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcacaaaaaaaaaaaaa

SEQ ID NO: 12348 - DNA, 322 bp, Homo sapiens
  misc_feature (1)...(322): n = A,T,C or G
ctcagagtgacgaaagtggactcctagnaaagatgactagagattcagtagctatcatgtgctcatgaggcaacaaattggaggatgaaagtcccagtgctggcgatggtaacgcagagagggagcaggtgcatcagaaagcagctgcaccagccctgagctgaccacatttggatttcctggctgaagaaatgcaggatgagctgaaaaaaataagctcctagttgtttatcactgcacttgaatcttctgatccttgcagccaaatattttcctaatataagaagataaataaagttaagcaataataaaaaaaaaaaaa

SEQ ID NO: 12349 - DNA, 330 bp, Homo sapiens
aggacctggacattaagtaatacacgaccatgactggaatcatacgctcctgtggtcatactcattttcattatgccatcatcaagaagtccacaggaatagcatggatatgagctcctccggggactcattcattgtaaccacttgaagagaaagatgatcgcttataaaactttccacccttgtaagtgctagaccagtgaattgcacacgctggagaaataagaattttataatatacaactgtcgcggctcagacgaggcactcaataagatagtgatctggctaggctaaatagaatattattggcctcgtcggcctcagacaga

SEQ ID NO: 12350 - DNA, 916 bp, Homo sapiens
  misc_feature (1)...(916): n = A,T,C or G
aaacgcacacctaactcctcaatacttttaatacagatgccaataaatacacaacatcgaagatatgcacacagaactaactggagacactgtggaaccaaactgtcaaaagagatcaacaggaacgcacaatgaaaaactacgtagacaaacatagaaccaacgagacaacatgaccaccgggaacgtagcacgaaccagggggagacaggatcactatgccaacggaacctacatagcactaaacaacggaaactaaacaaccacaatacaacacagacgcctcacacaaaaataaccatcaaatacatacacgacaccctctataacaaccaaaccaaacaactatcaggacccccacttaaataccttatataacaacaaataactaaacacataaacataaatcaaaagataaaaaataagatatctacacgtcccctagatgacaaacaggcgcactgacaaaagaccccatgacgccactcagcgcttgcctgtttttnaccatgcataaaacctatgcgnncaaagctacgcagaaaaggaaataaactaacaataaccaacaaaaaacaacaaaaaaaacaaaaccaaaaaaacacccacaattaacaaaanaaaaaatctaacaaacatcanacaagccacatgaaaacaaaaccaaagaaactcacacaccatccccctcgctgtgcgaacctttatgatgtaggncaatactaataagtatagccacaagagtcaacgattccagtcatgttcatctattactttatgttcaggtcttcatcagggttgataatgccagtagagatggttttgactgcgctgtgtgtcgtcatgcatgggcagaggnacataataaataaacaatatnacaannccttcctcttttcctntatttacctcttct

SEQ ID NO: 12351 - DNA, 407 bp, Homo sapiens
ctcagcgcgcagacctggaaaaccaccattctactctctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtatccctgacctgactcctcacctcccatcctcagatgaagcaccacttcacataagctttgcctgattcgtcgtttctgcctacaccacatatttccctcaggctttactgaacactacgcacatatgcatttattaaatcacttttaacacttttctcacaaaaaaaaaaaaa

SEQ ID NO: 12352 - DNA, 1115 bp, Homo sapiens
  misc_feature (1)...(1115): n = A,T,C or G
gatcttgatagtcttnccctcgcgctcacctgccctcccaacacacgcagaccccaacagcaacaccatcacaccacaaatacgcgatgcacgttactgagcccgcctcacacaatacacgtcatacgctgcatcctaatccttctaaacgtcgcccaacaccattgcctcctgagtcccctaaactacacacgttgtatatagacacgatagtccaccaagaagacgtccccccttctcaagcctgatcctatccgactacatgttcactactcctgggactcccctgcgccgcacccgtgctcgtccgctggccagtcaagcacctccctcttctccacgcccctcccccccccctcgccactacttacaactcatcaccccgtcaccgtactcacagcgacgataaccaggcagtttttctcttcctggcctcagcagtgattaaccactcttccggccgactgcgctggacctctcatcgccaacctcattcacaattanctcctttagtatgctaggatgcactttcgtacccagcagaatactgatcttcgccagcgcgctgtcgctccaccctctgtatacagcncactgcgcgacgtgggtgccgatcacgcagatatatacatcttttacggcatagacgcggacgtagaattatagtaccccacgaccacccgtccgatggtcgcggctgttgatagtccctcgtgttcacaatttatgtgtttccttacggcagaatcacatgccgcaaatacagacggccacctttgttatgtataatgtactccgtacacatagtagagatacttgatactatcttccncacctaactcactctttcattgcctgccatgatncacccgacactcctgttgtaatgatcactctcctaacaccgacgccgtgcagcaggggacgcacattcgttgggcctcatttgaacacaagaagagagatagntattgcatgtgctcttggtatacgcacatctattatttatggtccactttcgatgcgtcccactccggctctcttcgagtacgacacgcctatcagtcgccccacagccgttcgcgtacgctgaatggtgggtacagcacagaggg

SEQ ID NO: 12353 - DNA, 1351 bp, Homo sapiens
  misc_feature (1)...(1351): n = A,T,C or G
aatgagtgcaggctgtgccatcggcgcgcgacntgcgcgcgaaccagcaatgtgaagacacgcgacgaacagagcggagancacgaaaagagaaagggagaataaaatgagcgtaagattatgatcgtatcatgtcatattataagtttatcttttcgatatagggttggatatgaattagtcaatatgatatttagaaacgaaggagcaaaatgtgacagatgtgttgtaaatagtactcaatatgatagtntgctgttggagtgntacgcacagaatgaagaagtggtctatagcgagatgataccataatcttttacacccgtacgcgctgaaggtcgacatcatgtcgttgtagtatgttcactccntcacttgatacaantcgcagatctacatcccgagactatggaatagcgcgagcagcgccacgactaccaataacactaccaagcaacacactcggactcatgacgtatttagatcatatgtatgtgcatcactacgtacacctcatactaataagacatgctgttaccgctgttctcacgactcgtcctggagcaggaattcgcgccttgtagtcgacggccgtacgctccctctcgctctctctccgatcagctctcaccatgacatctctaccacaccctggacgtgccgacttcctatccctccttcttactcgctgactcccccgtacggctgctgcatgtcgaacacacagtcaccgaaggcggacgtcatcagctaatgaccctaccgtcataacgtcggaacgcagctgcggcccgtctgaacgctcacgactctcggagaggagtgaacgagcgcccgcatgaccccgcgagcgataccacgcaatatgcacttacatctgccactgaaccacactgctccctctccgctttgatgcgccatctccactatgtcatctcccatttcatttcacgaatncngttctacnacggagattttgctgcgttatgtctccaccctcggaagaacacagcccagtgccattgatgcgcagcagtacggtgcgcngcgccgtaggcgcgtggtgtcgctcgtcgcgtctctatcctcttatctcccctatagcataaagccacatcataccgcatcagtgctacatcgtccttagaccacaacagagactgatgatgctatgagacgtcgcgagatgatcgcgcaacaatatactgatacgagacaatctatcagccgatcactatccaactattcactcgctgcccttcactgcctctccactcacgctcgtattacggcgtctctcaccctcaatactaacagttccatcgtctttatgttaatncncgatgatgag

SEQ ID NO: 12354 - DNA, 1775 bp, Homo sapiens
  misc_feature (1)...(1775): n = A,T,C or G
ccgtcgcaactgatttactgcgacgcnatcggacggccgcgcagccgtctcttctaggtgcggaacgtcggcctctcgcgagcgtctacnttgggcgcgtgacacacagcctactcgtctactactaccgagtcgactcgtgcacactgccatatggtcaacatgatccgcggacgaaacgcgcgcctcgtgcgtgagtgcgtcgatgaattgctgacgcagaacgacgatactcgcactgacggacagnataagcgtcttactgcagtccatgatgcgcntcgcggtatctgatatacttggnagccatactgggtagcanacagagcacatcatacgacgctgtactgcgttgactatatgttgtagcgatgcaggcgagtgtgacggatctgagtcctcatagcgacacgaacggcatagggcgatgatttcgctcatgtgctntcagcgacgagctgcgagtacttcgtcgtcagcgcgctncgctgcgcgtaatcgnaccagcaaccgctcgctnacgtgcagtgagctgagcatctatacgtgcgtgtcgcggcgntagtgcacacgtcatacgtatatgtgactcatgctcattgagcacgcacgacgtcgtatctatacgacgtgcgatgctatccgacagctcntgtgtctgacctaagccgcagnagagacccgggnaccacgctgtagcccgcgtcacatgcgacatgtatgcgacaggaggcgtgtagactgctcgctataccgctcgatgcgagaacacancgcgtccgactcntacgnctatcgaggtgctcgatgatagttgcgcagtacgcgactgaccgcgtctaacagctcgtataagtcactcgtgcgcgcgattgctctacgtcncgtatgctgntngcagagtncacgactgccgtacgcngacgctactcgagtgcagccacgtgngcacgtcgtgcgctatggacatcgattgcgaacagntantcacgcgngcnatcgccngcnacgacnagacgcgagactgactctacgctagtgtacncagcgcgtctcgcntcntcagacgtcntgcccgntcatctcgccaactgattacgtctancactctacatagacatagacancatactcaagtgacgtcatagtatatnacatatgctgtagtcaactctgctcntgctcgagcgagcgatctncgtacatgcgtcgtcgnctcgtgcactgtcactctanactggcggggactcatcggatggcgtgcgacgncatgtgatcgcgtgtgcgacgtcgtgntgncagccgtctgcggcgctcgaaacgatcacantnagacgtncggttcgtgccgtcntantgacacagcagacgacatcntntgatgactcgttctgtgatntccatgncatcatcgagctgctagctcatcgtagtngtacgcgtcgtactnacatnttcntantgtagtncgatacgcntccngcanntnactccatcntggtngcgtgntantcagcgcgatacgtctcattgctnatcaggtcagcacgactcanctgtcggcacgcagtaggctggtcngagatatgnacgtgatcgtgagcatgcgtctcgtggtcgtaggatacactgtgcgtgatcgactcatgcgcagtcactcaacngtacatactcgctagntctgcgtnantgagatantgtagatcatgatgctatattatgtcntncactacgacgacgtgtgcgtcagtgcgctcacgcgtgtacatacgcgg

SEQ ID NO: 12355 - DNA, 1173 bp, Homo sapiens
  misc_feature (1)...(1173): n = A,T,C or G
gtcacgaaagaaaaataacgatactgacatacgaacccgcgacacgctcgaaactatttgttgttgcccgccataatagttgagaaggaacacgccagacgccgtagtcggtggcggccgtcgcaagggaaccaacgatcataactaaaataaggcaaggcaacagctacgtaagagaacgacgtgactcatcattccgcaccgcagcatgtgatcgcacaatcactcatagtcccactacactagactattccggtgtctgtagccggcaccgggtcgtggatacagcgcatggtccatgagacgcagaagcgcgtgacccaccattatcaagtgtcggcgcacgtgacagagtgagtgaatcaatacaggctaagcaacaacactcgcgcacaggacgccacacacgcgacgttattagtaaggatgtcaaacgcacatagtcgtgcgttctggcgtatcacacatgcgattgacttcggaacgtgcatatatatacgtgcacttagtatcttaaatcattggaccggtctccgtcttgtcctctgcatcgtcgactcgttctcgtatttcgctacagcctattatcaatataacagccggcaggcaccgctcagcgcggcgcctgtatccgtccgaagacatcttcagtatgatccacacaaacgggagtacgtagtggngcttctgactcgtcgcgtcatcaactgctaccgtactcgatgtggagggccagcgtgaccggtgtatgagattatgaacaattcgagcacatcatgtacgatcaaccgcatatcagcatgactgtcacttcaagagagcacactcgactatacgatcgagatagccaacctacagacagagcagactgcctgacaccagtgatactatatactgtacacgggatctaactcgcgttgcgagctaatgcggtgtgagaggagtgagagaagcgcagcacctcaagntgtggcgtggtcacgaacagccaagatgatgattactcccaccaccactaacgacactgagatactagcgatgatgtatgattatcgatattgcaacagacacgcggcgctgagcgaaagcaagatgcgatgnactacgctgccacgctacaccgagtcgtaccacgatattggtatcatagcggagactgagagcaaccgcaag

SEQ ID NO: 12356 - DNA, 1461 bp, Homo sapiens
  misc_feature (1)...(1461): n = A,T,C or G
cgctgatcctcgtaaacgaccagagatagtactattcaggcgtcgctctacccgcgcagacacgacgaacgcaccgccacacaacccacgtcgacgccatcttccagtacgtcacacccctctgctctgcagagcacggtgacacagaaggacccgagccgccgtagcaatcgggaatagagcgcggcggtcaacacagccgtataacttcttctactactcataatttatctactatgtcttattgatgcttgttcgctcgtttctntgctattctttagatttccttcttataatcgtcagcaacacaggagacgacatacatacgtagactatgatcgngtcacgtacggtaactgcctctgtcgtcggtagtatcgctactggacacagttaagtgttctgccttnagacgccggagacacgcccgctctancaacgtcctgctacacacacatcgtcaacacacgatgtacagcaacagagagccgaagaatcatacaatcacaaacacacatcccntaatgagtgatacaggtaagagggcgtcgancgagctagcactgatcaaggatgcaatatagtagcttccanactcacagcactcgtcatctcatgtggacgcgagtacttacactctcttcactaaagtgtccacgtagtgctcgcactccgctctcgttcactaattcagcgccctacacacagccatacagcctcctatacacgtcacaggacgacgcactagtctgagaatccccgactcgactctgctccgaccgaacacattacacgctgagtaccgctaacatctactagttcagtatctctataacgtagtgtgttagtgctgtggtgtcggagcgtcgtgagtccgtcagctgcgaccgcgagctgcgactgtcgtattgctcccatagcgcgtatgacacagacccagacaancacaagaatacgagtaatctactgcgcgtatntacgaatacttgatgagacagttcaataacgtaaatcagcaatctcgtacacgcacgccgctacgacgccgtgcgtattgcaactcgagtgttgtcgaggcatcactcgcgcctcgtctgtgacgctgcgagggcgagcaatcgacgctccgagttctcatcgccgtcatatttgattagttcgtacacacgtacataacgcagtacagtgtgccaatatctctctacgcacatacgattgtcggcacatactacacgatagcgacatagacgatacagacttgacatcaccatactcacatgagatgtgctaatacagactgatgacgttaggtagagtgtgcgatctctctacgtgctcgtgccgtgcgtcctctcctcgaacatacgctcatantcangtagagcgcatctatacctacactcaccgcgccgacggtagtgtatgagcatcgatacctagacataacgtatgcgtgtcgat

SEQ ID NO: 12357 - DNA, 1543 bp, Homo sapiens
  misc_feature (1)...(1543): n = A,T,C or G
tgtataggaaagtggctacagttatttatcctatctatataacagtacacacgttcgttatacctagttcgcgnatctacatcactagtgagctaacntatggacgtaatatgagacacgcnctcctcttcatatatctcaacgacctcgacgaatagcgctacacgatgtgtaccnctcgcactacactnataancaccacaacatctacactgacagcgatagcgagantnaggcattagtgatgacatgtagtattgctccgtggtgagtataagttgatctgtcacgtctntcaaagctctatgcgtcantgcagacaagagtactgncgctgtacgcaggagagtcggctncctacgtatatccgcagtncactgtccttatagctggcctcaccagtccccgtgctgcgacgaccatatcgcggctactattataacgcgcccgcgcccatacacccataactctatacaggccacatatgagacacatcagaccatccacgtagttcgcgctcccgagtcgcctagcccgccactagtactgggcactgcagataccttatctcctagagtatctagtaggtanttagattgtatncctcgtgtcnctactgctcagcgacggagcgcagtaatttttatagagtgcaaccagagtgancagtagacnactcactgtgtctctctgagcgtctgcctccagctacgacgtcatcngataggagtgatactagagcgtaatgacgcacntctgatgtaaaaccatcactacttattctcatcatgtagaatggggcccaattagtaccanaaatataaccatagcacaacncgataacagatanactgaacgataccggatatatagacnactctgtcgacgcgaccgtagccgcgacactacgctatcatggttatcatatataccataatcgatgagttatcatctgtacacacggntccgctattgatagtgcacaacaatgaaaagtgattctgttacaacatcgcactataatgatactcaacgagtgcntcatagcgatctatgtgactatgatcacaactagatagtttattatttatcacagatgagagntcagtgcagtgcagtactcacgatgtccagtatagagccattaagtatgcgactcaccccactcacctactagaggacgaggcgtcggaccagcgtcctgttatcactctaacatagaatgacngagtagatgacacatgtcagcacncgctacgtatattagtctcatgcttactgactatacagcaacggtacactaaagaataactacagctttatatttctgtcctcctccgcgcgagatcacaggcgaatgcggaacgagacgcataacatagtagccctactgtggttcttggatggttgttgttcaagaatgataggttcatcatacgcgtatccacacacactatgtaaataatacaaggatgatccccccaacgaagtatattatatgggctactaccactgcctcctctcctcatattgtgtacgatag

SEQ ID NO: 12358 - DNA, 364 bp, Homo sapiens
ctttagggaccactaaatcaaaaaaaataatacaaccaacctacaaaagataaaaagcaagaaattaaaatatgccatcagagaaaattgcatctcctgaaaggaagtcaggaagaaaggaaggaaggaagagaagagaataaaactagctccctatcgcttgccatatacaaaaataaaatcaaaatggattaaagacttaaagctaagacctcaaactatgaagctactacaagaaaacattggagaaaatcttcaggacatttgtttgggtaaatatttcttaagtaattaatatcccacaagcgcaggcaaccaaagcaaaaacaaacaaatggcatcaaatcaagtaaaaaaaaaaaaa

SEQ ID NO: 12359 - DNA, 2094 bp, Homo sapiens
  misc_feature (1)...(2094): n = A,T,C or G
atagattatgtaaatngtatatacaagcgcaatgagagtgcacatctgttacaacagttgatatctcgttatcgtgccatatatgactagacaccatgtaatgtataanaancatcacagcccccacgcgtcgaagtaagcacatcatnctgtgctccagtcgagcacatacacagcgtgcctacnctanagcgccaacgccagacctnacgacattacatcgtctcgcgtaagtatgaagtgcgatacctggatgtagctgcacgtccgagagtacactagacgctatcatcatcgtagaatatatcactcaccntctgcgtggagggtcctatcctatcaatttcaacccctcggtgtgtctaattatacgagcatccgcccaggatggtctccgtacccactcttatattatcacgacaccgcagccacataagctcttcagangtcgtgcagacaacataatgcgtatgcngtgagcgtcntctccgtcancagtacgatcataggtaagacatataagtacctacagcaacagagtatgcaatatgtcgagaatcagatatactaccacacanacacgtgatacgatanacacgcagtcgcncgtcncagcccgcgcccgagcgacacgatagagcataggagcgttcntgatattcttnctatgagtgtgtnactctgagtcatgcgacagcgcacgacacantcatagataccgctaacgtaaaactatacaatcacacagtatatgactcgcgnactcgcgatgctacgacngatctgaaggagntgctctcgtcagnggtgcatagacgagaacacgctggcacatcacncnngcgcgacacgcgagcgactgcgcgtgagtcctngncgangactgtcgatgcacnatatggtgatcgggcactcgagatgtaccagagatagtgtagacgtacgacagccactcgcgagtactctgatacgtatntagacgccggacagacagcagcatgcgctanatgtatctgacagataggcncncggatatcgcggnncatgcacgcgcatncacagagcgatctagatcgtactncactacntcgctcactcatctacacaactcgagntctantccgtaatcatacgantcatacgtacgcnagtacgtcaagctccgtctgacntgcaccgaccgtatgacngacacgtcgtatgnagnatctcgtatgcatcatntagtagtcattatactcggcanatcagagaagtgagctcacagngntgttagtatantgaagtaaantncaacacagacgacgaatagactatcactactgctagtacacgataggcacagtgtatnatacgtctacccactacatcctagtcctntnnctcnntatacgatctctcgtacatgtanatgcgtgagtcgcaaagccagactacntctatntactgcngtagcagagtcgtctagtgtccgcctncgtagctgatcctncgatcacgtcccgnccccgctatgttagctagagatatgcactgntacnagtgtacatagntatnanntnatgatagctacgttatcactctgcagtaagttgaagcantcatgcatgctcctactactactgctacncagcagcacnactanactgcactcgtaacntcgctcatcaacgtcaactatagcatacgctgacatactactgactagctacgacactcgancatactgcatcatgctcacnacaacntactactctctgtcatcgtacattacctctcatcatctnatcaccactacagacgatntancctancacgatacgtcaacngtntctngacgcatcacgagcancaancnncntacatatgataatgactcaancatntactgcncagctagntncataagnangcacagcgnccacacnaggagatacanttaagtagacgtctactaactacgctactntcaccactactgacgcgactctcgtgtnatgtatagcattgacacgnattatngaccanagtantatnacgcagcatacgtacatgacgttannctattcaatgtaatgtanatnacagnagcag

SEQ ID NO: 12360 - DNA, 2001 bp, Homo sapiens
  misc_feature (1)...(2001): n = A,T,C or G
cgaggtgcagtacatgctagtagcatcatcatatacagtaagacacacgacagcgcagaaccgagagaacgacacatgaacngtttgcagagagagtgagngagcaccagagcgcaggacacggagatggctgtatcgtttgagagcgtaggagnganagagcacaangtcaggatgattaatgagagagactatctctgagcgacgaaggcgaagatatgctgctcatcgctatnatatcactatgtctagtngtgancgcatgactangtaatgatanatgtcagtagngtatctattactccaccactctacatgnctactacgccagcgatctgatgatcgcgcgtcactactcactatgatcactanaccatcgacatgacagagntgcgactccacacatcgtgtgncnantgcantcgcantaagatctcattcgctgcaaatgacgtcnantgnctcgattcntccacagtgtacagnagagtcagtcagcgcatgatgtacgccacanancacatgtgcttgatagtgtctctgactgacgaactctcgtgacgtcgcgtgacaacagctgtcagncgcatcactcaatganaggcgtagtnatgaagtntntagcgatgtttctatgcatctgtcgatcgcantgagacatgcgacngngtgtacgtctactgtatatcgatgtatagtgagagattacgtacagcgtacganagtgatngagtactgagatggtagcgcagtcgtctgcagtcgcgtcgctngctcatgtcgcgcagtacgtagactacgntanaccagcactgacgtcgngactttgcgcggatagacagttantcgtcanctgcnaggagcggagtcatcgagtggtcgtagagatatgtgagagttactgaagcgtctgcaagtgtagcgctcgtgtacctcgtgtcgtgttagatgtatgtctcacgtctcgcatatntgctcacgcgtctgacgcagagacatagccacgatcgcacctacacagatgactctagtagatcgantgagtctttgcatgagcatgtcgatacgacgnttcagtaggtctgcatattcgtgtcgtgctagtgtgngtacgtatggtgtgtgtgtgcgngtcgtggtagtcgcgatgtcgacacgtaccgcttcacatcagtgatctcgtacttcaccgagacctgccacgcgagtagtgtantntgccatnagacgattggngacgagtatcgtcactgtgctcacgcatagagcntcgccatgcacgagtntagtcgangnagcgcgcgacacncatacatcggatanatattagctagcagtccgtcagtgagtgacgcgacgccgtcancgatncgtgacacgtctaatgatcgatgcgtcgtcgactgtagcagacacgtgcgtgacagatgacagcactgatcggctcnangtgctacctcgcgctgtcatagcnctacncgcnatatatgnacatgcacngcgactcgacgcgatggcgcacgatgatatgcggagtantgcgntcgtgcgctgtatgtgatgtagtncagattctgtatatcgacggtgcacangcgcgcnacgcgctatcgtacgctcactctgngatagtgaggacgcgcgcgtgcaccggcgcgtcgcgtgcgtacttgcgtcgatatagtagtaagtcgactcgcgcgacggtatgtcgcacgnncgcntgntgtatgacgattgctgcactatntatgatactgncncacagcatacgcgtcgacgntcacgcgtccgatctgcgaagnagatgtatcgatctatatctcgcggntgcgctgtgntgtnatacgtgcntagtncgcagatttactgtatcgctgtcactcgtgcgtggcgcgttgtatctctatcanatatgtactcatcagcagcgctcgacttcctntanacagtcgccgnacatcgattagnancgcgatacttcatctagagtctannccg

SEQ ID NO: 12361 - DNA, 1563 bp, Homo sapiens
  misc_feature (1)...(1563): n = A,T,C or G
agggagctctggccaaattttgtgtacgtgtcncnnnnaaaacnnttttcgttttntgttngactnaccccncccnnnnncnctggnnnnngnnnganaancngnnnnnncgnnnnngnngggngnggnnggggggnngnnggnggggnnggggtgttttgggnggngnggcngngngggngngaagggcgcgcngnnggnggtgngnnnnggnngggggggngngaaaggggcggngggggggccgngnnggggnngggggagnnggggggggnnggngagagnnnccgcgcgggccnccggcnccgcgggcggccgcgggcgccgcgcgggcgcnacgccgcagcnacagggcgaacgaagganagagggagnagngagagagcgcgacggcgggccgcgcaggacgcgcccgcggaggcagcagagcanagaaggagagctatttgccgtcggattactcgacgcgnacgagcggcgnncagccgcggcgcgccgcggcncgcgcgccggcgggcggcgcagacgcgcacgcacacaaggagnacgacgcacgcgcgcgagagcgcagcgcggcggncacacgcgcgccgcggngcgacgccgcgcccggaggacgacgccgagcgcgacgacacgcgcgccgcncgcccggcgcgggcggcgcggccgcggacgaagaaagacacgaggagagcgnccgcggagaagcacacgcacaagagcggaccgcggcggcacgagcgcgcgagcgagggacaggcgcgccacgccgacgccaggcgngcagaacaggcgcgcgcgccagcgagangcgcacacacgggagcgcaccgagaacaaacgaganggaacggacagaccgcgacagacgccgcancagcaaggacgaccacgcgncaaagacaagancgggagangcagccagcancgagcganagngcaggacnacacgcgcgaacgcgacgcagcancgcgcggacggccgcgacagccacagcgcaaagcaggacggcgaagccacaanagcggaaggagacgcgacgcancgaagcgagcgacgngcagaaacanaacgagacggcaagcacagacgggcgggcgagcgacagagaccgcaccccggcaccgcgcacagagacaggagccaggaggcagccacacagagagcaacggagacagacaaagagcagggacgcgagagcgcgcacaacacgagaaaaganccaacgcgagaacaagagacaacgcaccaacgagccggccggacccaggcgaagccacacgccacgaccccgcgcgcaccgcagcgcgaagagaaaaagcgaacggaaaggcgggagacgagagggcgagaanacggcccgcagcgcgcgacagagcggcgaggcgcagagcggcgacaggagcgggaagagacggcgggagaacgcaagcaagacgagaaaccagcgccgcgcganagacgcgcgagcagcgacagcagacgtaagcgacgccgagagatgaccggaagcggagttatngatgcggaagtgaccgcgacggtgggaggaaccgcgg

SEQ ID NO: 12362 - DNA, 969 bp, Homo sapiens
ggagagagagagagaaagagagaagaagactctcagggacacaacaagtggctatctctgacaacattaaagcggactacaggaatgtgaacaacagtatgacctttttgacaggggaggggccagaaattcatcttttcctcaataaagggcaagcaaccatcaaagaaaaaaaaaaagaaaaaaggccaaagaagaagaagaaggaaaaaaacgggcctcatgcggcctaagggggggagctctgaggacggttccctttaaagaggggaaaggggggaacctcagtaagggactcctggggcggggacgttagggtggggcgagcgggatcaactcactaaaagggggggaagcgggtatgcacagaaacaggggaaaacccaggaaaaaacatgggagcaaaagggcagggaaggcggggaaccgcaaaaagggcggggggaaggagagtttacataggcgcgccccgccgggacaaggaacaagaagagagaggacgaagtaagagcgggcgaagacccgccaggacaataataagaccagggaggtgaccccgtgaacgcgactaaggcgcgtctctaagcacaagccgcgcgaaaacgagagaccagggaggcacgttacagcggcggagagagcggggggagggcgggacagacggaacaggggaggaggacagcagtagggaaggaggcgagggagaggcacgagcgggcgtgggaccagaaaaagcgggcggaaacagaagacagggcacacgagcggggaacgcagggagtggcgcgacacggggaagagaaagtgaaggcggcagggcgaagcgagcgaagaaaagagaaaaaagaggaggggggagcaggcgtacaagcttcggaagtgcgggcgagtacgcagggcgcgaaaagagggtgggcgggtgcggacgggaagcgcgagaccgagcgagagagagcggagcgcggaacg

SEQ ID NO: 12363 - DNA, 1443 bp, Homo sapiens
  misc_feature (1)...(1443): n = A,T,C or G
ggggtgcaagagtggagcagtcgcccgggagaggattgtcgttttagacgtgcacacanaaagcaccgtgggtcttccgcgcacagacagcggcgaaagnaccaccaggtacagtatgagcagagagcggaggatatactcactctgcgagggggagggagcgtatgccgtactttagcttgatgacgcgttcattaggtggccttgcaaccaggacagtgctagaacaataccctagcgcgtagcaacaggagatgaggcacgaccgcgtggtgtcaagtagtccgtcgcctactcctagcgtcgaggaatacgaccccaggcaccgcgccacagtatccgagcccaagtggaggagcgaagaggaaacggagcctgacgccgaccatgcgcaggggggctgcgcgtcttttacgtagaccagtctcgatcctctcgccgtgggtgatgtacgcgtcgccctaccagtagtgagggagacgtcagcccaacgttcacgcaggataccttcttagtccgagtccctacatcctcaaacagcgtagagatgaccgacagtcctcgcgtcgtgcctacgtatacaattcctctcatatcacgacagacagtatcgtgtgccgtcgtangtgacgcactccacgcacgcgagagggacacctgctccgctcggagcccgccttgcccctgtctgcgctgccggcgcgcgcaaccttggcatggcacaccgtcgccantgacaacacgtaccgtgcactcgtcgcgcgataggagatcgtgagatagagcgacgtgcgtaacgcagcagccgcgtcgctcacgctgtcgctgtgccagtgagtcggcgagtacactcagccgggcgtacattacaccaatgtgacacgccgcgcggacagtacgccagcgagccataaactcacactagcgcagcgagcccatgcacgcggtcacgtgcggntgtatgggtgaggcgcagagcctcgcantatganacagcgcctcgtgcggcaggtgtggtacgcgatgtccatacagtgtggatgaacgacggcgcggcgccggagagcagacgggagcatatgcccgacggcgccgacgttctcgtcaatgagtgacaatgcctactgcacgacttgaggcccgagacgcaatgcgtcgccgccgcgcgtggacgctggcgcgcgtcagcactctacggacgataccgatccactcgtgagactgaacgatctccacctctgctcatgtagagtgcacgtcgatgtgatgcgcgtatgtccgtgccgtgttcgcacatcacgcgtgcgagtgctctncctagcggcgccccgtgncgagtggtgttagtgaatgttcgagagtatacgattactgcgctctcagaacgctatcctagtatccgcatattgtgtcgtactcactttcatcaacgcgcacacctct

SEQ ID NO: 12364 - DNA, 357 bp, Homo sapiens
ccataaaagccctgggctcggccacagcagggcaaagaccagaggacagagagaggaaggggataactacctgcagagaggagctatcctctttgctgagagcttcagaggcctgcagagacatctgaacaacctgcctacaaagaggagccaccctcttcagagcctcctctctgctgagaacagcagacagcaggatgaccagtgggcagagaagagctaccccctccagggcctcctctttgctgacagctgaacactccatgggatgacctgcctacagagaggagctacccacttccggtctcttctgagccattctaacactaaataaaattcttcttcatcttcatcacc

SEQ ID NO: 12365 - DNA, 552 bp, Homo sapiens
  misc_feature (1)...(552): n = A,T,C or G
gagtttgatgtcgacagttgatcaggagcttatatctgcatgccgactatcgctacgatgntcggaatgacatctcgcgcgtgcttcttgtgtcactgcgtacaggcgcagtcgcgtctgaccctagcacggcgcgcggcgtctagtagtatgctgctgtcgagcgaatgccggccccatcacgtgtgtccactcgactctacttgctcagctgctatgtcggcgatgcttttgtgcatctcgcctctagccacgagcgtcgtgtcacgatcacactgcttgtgccacagctacgtgcactgtgggctgactccgcacacaacccgtatactcgcacgtcactccgtcccacccgtcgcccccgtcgccttccgcacgcgcgcagtggcgaaccaactcagtacgccaaagcgtgacgtgacaatgtgctagtctactaccaactcacaggctcgaacgacccaccggtctatctacttcacatagcgctgtcgcgtaaaaccatcgcgtgacactgggtgcgcaggacgctcggacatacagctagggttc

SEQ ID NO: 12366 - DNA, 673 bp, Homo sapiens
  misc_feature (1)...(673): n = A,T,C or G
agtgtgggcggaagagtacatctgacagtgcacagattatctttcgcctcacaccgtatagaatggttgcgcggacaacactagtcttgttatatctgtattagcgtaacgtcggattctatgtatcactagcactgcgctnaggtgaataacgatttgatagggagcctgacggacggagtgcgctcgtagcagcaacgactagatcctacagcgtgagtggaagtaggagcaggctcatatatatatatctccgagtgacatagccgtagacgttctatccgaccggcacgcacatcaactcgacgatacgcgatgtcntgctatgagtgagtctcanctatattagcaaaacacaccctcactcgcactagcacgagatgctgatatcgtaccccgtcacctagcgtgtagctgtacgtcattacatanagatccatacgactcgccanatacgtcagtgtncacgaccagactcatctgattgcactgtataactaccgtatgatctgcaacctgtcgctcnctcgatcgaacacgtgaantcgcgtagtgttatgcacagacaactctgtccgctcagtcgatccaactacatatcacacacgaacatgctagcgtagtatgcacatacttgcagcagagcatacgcgactcctggtatagctcncga

SEQ ID NO: 12367 - DNA, 942 bp, Homo sapiens
gatactttgcctaagtttgaggaataagacaaaaacgtccttgagaagaagcatctgtctaacaactacaaccaaaaggaattcaggaggaaacgaggagatgatgatgaggctggaggtctgtgcctgcctccactatctgtcaatagttttggatcagattcgttttaccattcattacattgaattctgcatgcaaatttccattagaaaaacttcgccatcttccacaagaaagggagggacagaggaaagccgctaaaaaggaacatggatttatacacaagcggggtcttttatagctttacggaatcctcattctcaatggatccatcattagcctcaaaaactgagcaatggaataatctttgctcacatcattaatgttttcaaacatcttaatattatgatgagatttacaacagcctgccggaaaacttatccactgcatcaaataatctgaaacgcattccactcacaacggtcgtgaattatgaaaacactgagagactaagtacaatcccttgaactttgtttgtaacgtagacaagatacggtcattggatgaatcgcacgaaactcctgactgaatgaaaacaacactaacgcacataccggttagatatttttgatttaagcccgtgcaccattgctaatacaaaagaaaaacccacaacaccgagcaagattatcaacccatagacaccccatacatattaaagagatattacatcacaacgaaaaaataccgatcattctatacttcgccaccgattatgtgtgcggaggctatatccgacgcgagacagtagccaactgcgcatcgacgccccggtctcgcattttctggttttgaatttgcatcatcaatttgctgtccgacaccgccggcgaactgaagagcatatcagaaagagagaattttgcagcgtgtagttggtg

SEQ ID NO: 12368 - DNA, 812 bp, Homo sapiens
aagtcgcgcggtggagtgagtatgtcggacttcccgatttctggtaaatacttctgtgggtgtgagtgatatgtggggttgacgggtgtgtgggggcattttatacatggcgacctatggggccgccggaacctttaagaaaatgcatggccatttatgagatttcatgatgtaggatgtggagtcggtaatgggagagtcgagagctcttggatgtgtctctttggggacaagtctcttgaatctttatcgcactgggacactcctgttcgtctgtaactacactatccatatctacctttctagtgcctctaaatattctttgtctcttgttggtactgggtcgcgtttgtgataataatatttagttcataaaaagcggaagtgatgtggcgttttagggagggacaaatggatcggaggcctgagtgttccacggacttggtcttctggggtgcatggcgatgcctgcggggggggtggatggtttattttagatggagttatttgtctgtgaaatttgggttagggtcggaatgaggaggtcggggcgcgtgtaaaagagtggggagtgaaataatcattaatccttttatgcatggttggtgttgggattgctttgttgggggagtggggccttggttcgtgggatttcctcctaattctatgtttgaatggtataacaaatttgttccatagtattgccactagtggagacagtcttaagactccagcctcttcttcatatcctggattcgtcatgggttctggtccatacagttatattttggccccaaagtttctgctaagag

SEQ ID NO: 12369 - DNA, 741 bp, Homo sapiens
ctatatctttttgaataccctgggatccctctcccagaaatggttgttaatccaacagattttttaagggtgaaaagaaaagacattttcttaccatagggttattgacacttagggggcacgtttgctttttaaaggacccaaaatttgaagaacagccaattagtgtgggatcagcaaaggaaaagggtggccctctttacccaagactggccttataaacttggactttttggggctaggagaaactgacgtatgaatagcataaaatctttgaggaagaggtcaagtttcagactgcaggaataaggagtcggatttcctgtgagtaaaaaagttcctttttaaagtttgttttaagtgagcagtggccgatccaaatggccatacttccgaagtcccccagtttgacaacctcagctttttttagacccagaaatcaaattgtcctcaatcaaatggccttcccattatttaaaccttttactttttttcccactctcccattatgaaaaaatttttataatttttggaacatccctaacccaaaaaaatagtaaaagcttgaggttatgaatagccccattaccccgtttgatccttatgcattgagtttttgaatccaactatcccatgtcttctatgaaaatggacaactattatgtatccctgataattaaaaattttttaaaatgggaaaaaaaaaaaaaaaaaaaaaaaaaaaaaaaaaaaaaaaaaaaa

SEQ ID NO: 12370 - DNA, 807 bp, Homo sapiens
  misc_feature (1)...(807): n = A,T,C or G
cgagcgggctgagatctgatcactgacactacagtaagtatactagtcttctagtcgcggcatcgctctatcagtggcatatggagtnatgtgagtatacgcgtcgctatgttntgacatttnctacatcagctgtnatcatnatcatgtatatacagngtactgctgagtcacacactgctcactagatctagcgctcatattgatagcccaacgactctnacgacgacgatgtacacgagctgtgtagcgttaaggatctggactctcctgcgngtaccgctacgcacacacagcacgcagtcactgcgctatattatacatagacggtggntgatacccagcgganagctatacaccatacacagctgagcgtggcncgcgaggatcagatgaacacactcagtcngcatcgtgagactacgcacacgtgacgctgcaagtatgatatgcataagttgcgtactgcatatanttcantacggcgtggtggtactgctcgttagctgtcgtctgcgcgcgtgcgtgcgttcgtgnagtgcgtggtcgncacggtcattctgcatgaacgtaacatnccgtctgnatctctgtgcgtgttgccgatcantatctacctgnttgtacatcatatacacatcgagtatcaccgcactactgcaatgtctgagatagcgtagacacgagtgnantatgtgctacggtcggcagagntnantataatgacgagagatcagacgngttacnatctgtangcatgntctgcgacacgactatgacagcacacgtgatgtagtgacgtgcact

SEQ ID NO: 12371 - DNA, 527 bp, Homo sapiens
  misc_feature (1)...(527): n = A,T,C or G
atggagatatttatacatcgaactggtgcatcgtgcgactccttccgcagggtcacggcgcgcgcgcacgtcagctcggtacacgaacacggtggacgatacctgttctcgggcgttgacctagaattgtggcactctgattattgatatccttaaacgtttatcggcgttggacgatggcctgatgtctgccggagctattggcccggcactcacatgcactacctacgagcatctgaacgacagagtgtgcctacgcgcatactacacgtggggcgcagtatatggtcgtgcgcgttgtgtcatggcccgactttagcatggcancatacgtattgtcgcattggtgtacttgcttgcacatctgctccgtactagactagcatgagctcgtcgtccgttcgcatanataggatgtcatcggatagaccgcgcgcgagtacgcacgcagcaatgagtcggaggtaatatcttgctctgtgtgactgctaaatatatgctagagtatagtcataacgacaaggctt

SEQ ID NO: 12372 - DNA, 571 bp, Homo sapiens
  misc_feature (1)...(571): n = A,T,C or G
gatcgaggagatatgcgagcgcatggcgcacacgtctgatagccgagatcgcggggcgacgctcagtagtagacacgtgtcttcgtcgtgtgttaccgctcgacttcagtagacctcaacgaacgctgagcgaaattttctcagacaagtgcgcggtggtcgaacagtacctatatatagagcaatcatgtaatataaagggcgcgccggcgtggagctgtagtagacgaggagcgcgggacgagacacggcatcacacacgccatacctcgctacacatcgaattataatcgagaacagcgcgccgagtcacacgtgcaggatgcgcgtggcgcatacgggtgcgccgcgcgcccaggcgcgaccaccgctcgtctcgctcggtcccctcacgtcgcagtagaccggtgcagaacgacaaatatagtagggatcacagacactgcgcgatgctagcccgatcccgcaccttctttctctcgtgttatatcgatacgcgatgagacgaacattctcactcgtttgtgataagtttaatcttgaaggacgccttgcgtgganggtggcgcat

SEQ ID NO: 12373 - DNA, 241 bp, Homo sapiens
ccaggtctttaggatgattccctaatccaatatgatgtccctgggagaagaagaaatctggacacagacgtacatgagcagagggagggccatgtaaaaacacagaaaaaaagatggtcatcagaagccaaggagagaggcctcagaataaaccaaccctgctgacacctggattttggacttccactctctagagctgtgagaaaataaatttctgttgtttaagccaaaaaaaaaaaaa

SEQ ID NO: 12374 - DNA, 908 bp, Homo sapiens
gttagtgccacttgactaatagaagagggggctctggttacctccaatcactttgaccagaccaccttgagagaagttcttctccactcagactactagcttccccagtgagatcacctgcagaaatatcttcacagacacgcccagggcagtttaatcattctaatcacatgccaaaccaacaaagtttccctttcagcaaatgatgaacaggctcactccctgctgaaacacttagaataactattgcaatacttgataataactgatattggtaccaagtaaaaaaaaacaaataaacggcctcggtggcctcaggggaggatttctgcaggcgcacttccctttactgagggtcatttcatcatcctttctctctgtctccgtgcgctcagttccttttgttcactttagcagtctctcctcattttcacgcccgaatccagtcgtcccacgacgccgtgaactcccgtgcctcaagatgtcgcataacgctatgatatcgggttggatcattatataggggtcgtagtggagtttttaattaatttcgacattttgacggcactgggcatcccgccgctgatttgcctgcacgttctcttacctatgccactatatgcacatatgtcttctataagtgtccccgcgcatttgattttttagatctgcccactactctacttgttacatgccttgttcattagactccctgcccgcctctcattccgcgtgcttgttcccgtcgcccgtttcgtttcttctgtctccactctacctcacatcgccctcacccagcttctatactttcttccgtcctttaattatcattttgtagcatcgatattggccagttgtgattattgtcttcgccgctataacattacatctgctttttatctagcctg

SEQ ID NO: 12375 - DNA, 201 bp, Homo sapiens
tttggggaaaataaacatctgacatcccctttatttcaagagtgtgtgtacgtggtgccaatgaagatataagaattggaaaagaaatttgagaagttgagagtaatataaaagattgtttctttaacccataaatacaaataaaagctgccttgaattttttaaaaaaaaaaaaaaaaaaaaaaaaaaaaaaaaaaaaag

SEQ ID NO: 12376 - DNA, 811 bp, Homo sapiens
  misc_feature (1)...(811): n = A,T,C or G
atttgtagatgcgcatgtgttgnnctcacacgccacacgctctgtaaaagcgaactggacaaccagaacaggaacttgggcggggtgtcgctggggacgggggtgatttgcggttaaggggggggagaagaggacagaatcagcnnngacaaagctgtggtgaatcgttgaacacgtgaaccggctaactgctgagaagggggaaaaatggtaatcaggggcctaacccagcggggcgtggcccgatnacgccgcgtgagtgagaggggactcagcgacacgcccttggtttgtgggcgggcggcaacagaatcataaacacaagaagtgccaagaggacccgngggaatgggagaggggggaagattggggcctgttttggcataggggctccttaaagcctttattaagtgaaacgagtaggtctccagccgcagataggaacgggggattaatgggcccagcccacccgagagagctgggagcatggccagaccagggggtgaggggacgcggcccactgaggggcggccggttggggcgaggtagcccccgccgattgccgtggtgggnagaggcgtgtgcacgtgggccaaacaagggctagtgtcggggatagaattggagggttgagggcatgacgaagactgtcatttgacagtcatgcaaatcaggggcggtgcgttttagaaaacgcacccaaaaaggacaaggaaaaaggaaagaaaaaaaagaaggcctcgttggctcagcggggagtgtgcggccgaacctagaatagcgtaaccgtcggcactgggacagaagtgca

SEQ ID NO: 12377 - DNA, 855 bp, Homo sapiens
  misc_feature (1)...(855): n = A,T,C or G
tcgcttcgttcggggccgtggccgagtggtcggcttgccggctgatgtgaagtgtcgcctgctgaggcgccgtatgagggagcgcggtgggacgcctcgtattgcgtgtggccgcaccggatccttggggccgccctggggacgctcggggtccggtgcgcatgtcgtcctggcgctcactcttggcctcgtctttcctttatggcttggtatatggttctactaggcgtcgcgtcgtggacattgacttctctcgactattgttgggccggcacacacttcctgtctccactacgcattttcttgccgtacgagttcaaactcactttcatagtgtttagtggtgcgagtgttataagctattttgcctgtctcatgttgtggcagttttacagcttgctnggctggttgtaggctggattgggcggcgctgggatcgtcttgtgagtgagagaagcggggtggaggggatgggggggagatgtggacggtgccgtagtttgtgccccgcttctctatctaggccagttctgagtgtaactgtgatccgttagagccgggtcatcaatgtagcaccccccggcgagggaggcgtgggtcgcgagctcactccgctaaaaaaaaattagtggcgtgctttttttggcgtcggggtgggtggtgttgttttattttttttttttagttttgtatatgctctgcgcagcaataggttgtcgttgatgggttcgagggacgactgggcgactaactctcaggctgtcgagattatcttacacttcacaaaggacgttgccgccgggtcctctcgctgttaggtttaggcgtgaaatttggcctgtagtccccccagga

SEQ ID NO: 12378 - DNA, 131 bp, Homo sapiens
ttcaaaagaacagaaaaatgaaatgcactgcatacaatcagaagagtaagtattgtttagcgttttatatgtgtaggtatttccatgtgcatgtgcacatatagaaaataaaaacaatttcttggtgtgat

SEQ ID NO: 12379 - DNA, 166 bp, Homo sapiens
  misc_feature (1)...(166): n = A,T,C or G
cccagaaatagcacaagaacagcaaaaatgaaatgcactcgcataccaatccagaagagtaagctattgctttagccgttttatactgtgtatatattctccatgctgcactgtgcacatatnagaaaataaaaacaattctcttggtgtgataaaaaaaaaaaaa

SEQ ID NO: 12380 - DNA, 934 bp, Homo sapiens
  misc_feature (1)...(934): n = A,T,C or G
aacatactatctccacaaccaaaaaaaaaaaaagctctaggaaacccagtcctgtgttttgggaagcacaacattttttcaagaacaggctggaaaagcacggcacgtaaaataaaagatttttacaatacaataacaaatgtgtgatcaatgtactgctgggaaatgaattattattaagcgtcaaatgatatgttgtaaaatttcttaacacctcatattttaaccattttcacattgctatggaacagaataaattctctgctctctatttgagctaagacccgacaccaatcatatctttctggtaaaatgaaacaattatgcatgtaagttatttactctgaaatggaatatatcgtataaaatgagattcaaaaattaataaataattatttatttaaacattcaaatcatatatcaccttatttattactcattccattatcaacttatcaacaaatacacatatttcttctctcctttcttttctgccttgtacttcactccactttcacttatattgggttattttgttgcctttctttattttctactatttaccctatatttcctcctcatcattccccttttttactctgcttaaatgaagtattatattttattctcaataactttgataacccctaattaataacctgtaatacactatgctctatatgaccagaactattactctgcctctttaataaacattattcaattgcttaccactctgtattattaatactgcttacacctatacccgtgccttattctccctggtttttactcttccccgcgtattcaccctccaactacacaatgtactccttattaccaacntctctattatataatactaatgctattcatcctcacaaacgagatctcttcatgccaactacttatctctactactgtaactatttta

SEQ ID NO: 12381 - DNA, 1104 bp, Homo sapiens
  misc_feature (1)...(1104): n = A,T,C or G
agaggggngagaaagaagaaagagaagnagaanagggngagaggnnnnggnaggaaggngaggatgggagggaggaannaagannnaatctagagaggagagagaggnnnnagagaagggctttttgcaagagangaaacgcccggcaancaaggaaagtaaaggagagaaggggacggaaagaaangcantagacgggagagaggggaaatanaagaataatacgagatatgagataaaagagaagaataggtaagccttacatcatacttaaccacgagataacacccaccccaatacacagacaacaaaacagaaacaacgaacacaatccaaaacgaacaaagggacaccacacagggctagaggagttggagtgcgtgtggcgagcatgccgaatacncgttgcacatgcaccataatgcaggattagcttaatagttacattaagtatttcgacgtgtataacttagaattataattatattggttagtctatataattgtaatctatttataattaaaagatatcgcgtaactgcacagttctgctaaaaagaaagaattatacatatttattataatgaacgtatataatgtgagtatttgagttagataatgaaacagacaatactgtacttttgatgtttgtcgacacgatcctgttatattcggcctccgattcagcgattgctatccggtagctgcacatgcgatggagtctaagtatccgacgcgcaacaacagtagatgatgtataacttacgctgacacaagcgtccacctgaacctcccgtatttcactacgtcatatagagccttcgcatcgcggctccattccctctatagtgccacagctttccaacgcgtgtctgttgccatttggtactgccgctatagttgaaatacactgacttaagtaccgaatcacccaccagctctacattcctacaggataccctattatgttgttactagagtgacacgctagtgtgcgtgctgacaataggacagtgtctttataggagtgtggattattgttatacgttgtaatgtacttagtctctacgatcaatcacacgaattaaaacaaaactgctaacg

SEQ ID NO: 12382 - DNA, 1048 bp, Homo sapiens
  misc_feature (1)...(1048): n = A,T,C or G
agttattccaatagaccctccgcgagaaacgacaaccctctgggagaacanaaagctgagtgcttaaaatagctacaactcccttctgggagaccagaaatagcctgacacttctcggaatagttgacaaatcaactcttaacacggcatgtctcctcgatcgcacgatctatgtcagagagtgtatcgatactacccatgtcacaagatcgttgctgatagacatgtagtgcaaaagcatgtgtccacgagaatcattgcatcctgatgcaccaaagcggctgaacagaaggagacacactgagtctgcaccatcaaaagcgactctctactgcactcttacaggagtttgttctccctaccgttgcatattcccaccactcacccccgacgtgtacatacctcccttacctctgtccgaaaaaccctatttatccatcacacgcattgtattcaacccacgcgcatcatacgattaacccgcgcctcgatttaacttctctgagtcatgatatcccgcggtattttctttctgcacttcgcactatccaatgtcttttggtaatcatgcccgtgcgtatcgtacccgatcaccaaaaaaacccgaatcgtaacgcgcagagaaaaaatagcgagacccaagatataggccgggcatgcctgcaaatatcctcgataaatcccactactggcttaccctggcagcttcctcagacagtggtgaggagacccaccacaactaagatttccggtgttttctcttcactgtccggtgtacaagcacacctgggtgcatctagggagagagacaaatacagagagctgagaaagaccggtcgagaggacagacaggcaactgtaggaaacgtcacgatatcatataccccgatcaactctctcatccctgctgagtaggagtgtataaaatcaacccgtgctcgaacagtgacgcggccctcactatgatcgcacagcgcggatgaaaagaaagatatgcaagatcncccgcaaagatccgaccatctcaagtatagaccccgacgctaaa

SEQ ID NO: 12383 - DNA, 1119 bp, Homo sapiens
  misc_feature (1)...(1119): n = A,T,C or G
aggtactgattatattattacatatgnnnctctctagttctgtggngattcttgtgcggttgtttgactgtgaactattcaccagggagtgaggcgcgttgtaccttcgtagcgtgtcgtctctgtttgtctagaatgacggtgggtgggnnggccagactagttatcaagtganatcttctgggagcagcgggatcgtgtggtcagttgcttttgggtggccagtacttgcctcagcttgtggcgggttagaggggagcgtaattagnggatggggagagtggacactgtgagagcacctggattgtgtgtctggnacctctcaagtaacatgtagtcgtgttgcttgttcgcctgagtgnagtattgaagctctcctctgagagtggctgtcatgtntgcgttgtggtgtaactctatcgtggtactgtatttaatccacagcttcacacacgcacacgctagaaatgnntatccatagtctggtcgtgtggtaaacgaccgcagtggccttgcctgcttgcgggtatctagtactgttacgtagatgtatcaagattattagttgaactggtagcgttctggcttgctttgtgctgtacaatgtgcttnacagatactgttgtatactctacttggcgcttcgcgtactaatatgttttaggatanttctcatttacttccgtcggtggttgatnttctatcgagcttagagaggtcacttgttgtgggatgggccttcctttactttttatctatatattctttgaggttaataggtagatagagggggggagagtggatatttcatcagcgtctatgtacatatactcataaagggtggagactgggctcacgtgtgtaggctcgcgagtggggttgaggttgggaagggagtgattggcgctagcctttnttggtaggagcaaggcagatttgttccacttacgattacttgtccacatnggaattatggcttgtctttatatgttgaaataaattaaattaaatatatgtgctctcgttggccttcaccggtggggtcagttgcgatgccgaagtgtattggtttctggtgttggttctagataggtgcattgtggtgggattgtgtgtagt

SEQ ID NO: 12384 - DNA, 306 bp, Homo sapiens
tactccccatccaaacaaaaaaaaaaaatcttcagccacggtggtggtgttaactgaaaccacagaaagcagaactttggataaggaggggctactatatatcgaagagatatctgcactcccatgtacactgcagcactattcacaataaccaatgtggaatcaacctaagtatctattgattgacgaacagataaagcaaatgtgctgtacatacacagtggaatattatttagcattaaagaaggaaaccttgtcatttgcatgaacatgaaaaaaaaaaagaaaatggcctcgctggcctca

SEQ ID NO: 12385 - DNA, 945 bp, Homo sapiens
  misc_feature (1)...(945): n = A,T,C or G
ctacaccacctatcccctaccaaattctaactaccttcaggcacctctatagaaagaggaatgtggacataatacgcaaaagaaagattatgtaaagacagtgagaagactgctgtctacaagccaaggaaacatgcttcagaagaatccactgcttccaagagtttaatctcaggctaatggactccagaattatgataaaacaaacttctgttgcctacaccattacaaaaaaaacaaaatggtccccctcgcctccgcagcgcagctatgccgcctgtttgtttccacagagggttaactcctgaccctcccttactaacccgctgatcctcgaccgttttcctgttgctcgtcgtcctagatattcccccagccgcacttcctgttcccccccgcatcacgtgatccacgtcgtaattcactcgtgattttcattgccccatcacgcgtcacgagccgttagatacggcagacacgatgggattgttccccttccgctccacctncccctaatcaacattccatattattactccttatgtcctatgtatagaccttggaggcgcctgtgaagacacgaaactgtccctcccggtatccccttcctacgtccccaatctagcgaatacattcaccccaccacaacctgtcccccctaatcacttccactacgcctggcactcaccctgcacaacactgcaggatttcaccttcgtaatgcatactatctcgcatgtggatctctcaatacaacttctcttgagcccacgtggcagatgcactccatcacttgttaacgcccctgagctagtattatcacatcatccccatccccacatcacggcctcccctttacaccaaaacttcgactccaacaaataaaaaatagcggcttccccanggtagatcactatagccgcgaagatgacgacccgactcgca

SEQ ID NO: 12386 - DNA, 971 bp, Homo sapiens
  misc_feature (1)...(971): n = A,T,C or G
cgacgcccacacctcccttcaaattccaattttccccttacctcggttccgcgatccttctatccacacatggcctacctcttccacggacggcttatagaatgtcagcctgccatgaagcggcctctactgcaccttggatgagtccaatgccctggggaagaagatcatcattcacgacattgttgacactgacatttttggcatatcacaacaggttactcgccctcctggaccacggtggctgaattaatgcgccaactgttttttccctcacccagaaaggaaaattcttactctggaccatttacgacctatacccacgcattgtgaccgacctgccgcttcacatcttccgtgactgcttccacctacagggtcgctccacgacactgccacattccacagcgcgggatctcgatcatttgtgaatcaacagagttactcaactgcccttgtccccctggaatgcaaaaaagcaaaaaacgcgttgacagtggcccgtaacccggcttttaccaacccgtatcgcgatcgaaatcgcgcgacgtagcgacgaatggcgccgttgccccagcggagggaccttgggggcccctccccttggggcaggttacagcatgccccgtcctcactgactcccctcacctcgcctctacgtcccgcgccgtgcccttcccttcatctagaggtgctcctccccgctttccacggatcgggggcacacccctaaatcaaatcttggaccctgtggccgcgagccgtcgaagccgtgaataggcccctctgcgcagtttctcgttacagacctggcaaccaaggcacctaatgaacagtcccttcttgctccaggacgggcagagatcacgggcgttctcgaacccggggctgtgcccagggcaaggcatgagaccgtccgggcatgaccgcccctatctgccttaatccatatnacgtacccgcgagggcgt

SEQ ID NO: 12387 - DNA, 1382 bp, Homo sapiens
  misc_feature (1)...(1382): n = A,T,C or G
ccaaatccaccatatacactgtataagctcanaatcatgaaacacacatacactcaaattagcgaccgataccgctactcatctctctgcgcaacgaatatgatatgacaacaacacaacacatcaactaatacgangacataatagatataatatacatagtaaactatactcgtactaaacatcgactgcatactactactctaacgaatatacaacatagtcaaacaaacgtcaacacgtccaatggtatcgtaacagaacaaagacaatactacaatacatatataataaatnaagaaaaacagccaaacactatcnactctgcacacataaacacagagtaacattcgctacgntcatgagaacagaatacacaacaatcaacacaaagaactcatacagtgcgcagccacactaataaagtttacacacctacatagataatactataaccataagcatatatcttaccacctgtacaccatacaacactactgatatcacccacacacatcgnngttccgtcgcaccaacaactcagacctcagccattatcacacttatactacttctccagcggccttaacacaagactcacaaacaacagaggaatatgcgnctcatctacaaccatcgactcctcatatatgagagtgagatatagtgagagaatataggtaaatagaaagaagaaggagagtataaggtggaaataacaaacaaacgaactcaatcatatacatatggaactcacctcacttgcactcagctgatgagattacatgacataagacacactctctccctcccgcttctcctcgcgcgcncacctcttgttncctctctnntccgtggttgttctgtggtttggtgtgtggtcgttgttcctgccgtctgcgcggtgtcccggtgtgttcgctgctgttgtggaagatagaggagtggttcgggcggcgncgctggcctctctgcgcgcccgtcccttcccgtcgcccgccgcggtgggcgncngggtgcccgtcncgccctttctcccgtcgctctgttgctgcgctcggttctccctctngcctcggtgntttctctccccttccgntcctgngccggtcgccnccgccccggcggcctctgtctctccctctctttccgccgccggcggtctcgtgccgcgctccgtcncnntaatnccnttntcctcttctctcntttctctnncnnnttctctccttnntctntttgtttttcccccgctnnngaagagtttcgggntgttnttngtntcncgtggcncaggnnnncnncntnatatcacctcttctttttctcattctcttcctcctnccctcnnnnnnctttntnnnncnctttctctccccccc

SEQ ID NO: 12388 - DNA, 1045 bp, Homo sapiens
  misc_feature (1)...(1045): n = A,T,C or G
actcgacacggacactatgtaagcaaccagacagagacagacaaaanccgtgnngttggtngactngnanaaancaaacncgcttgnacggggacacatctnattancaagaagtaggngnngcacagngggaagacaaatgattttatataagaaattggtaaaagcaaagtttgaccaagttcgaagagtaattataacacagatctgtatacgttataacataagtaacatgacacaatgaagtagcctgccatgtgagatattgtaacaaggataaacaagtggacccacaaacaatgtgacaacaccagcggcactgagtggtaaacaccgcagcacaaaaccccagtttttttttttgggaacccactagggccgtcaccccgcgggtcgtatatccgccccccgctcccccgccataacagagcggtgcaattaccgcgatccctgaaataccctaattatgcgtcgccgccgaggataatccaggctagccgcgtcggccgaataacccgccgcccaaaggctggacatgcgtcgtgtatacccggaataaatgcctgccccccggtcacaccgaagcgatggccaaggtgctcaaacccgctggaaacgctaccatacgcgcgtattgccgggatgtgatacgcgagatcaatcctcgtgaatgccgacaataagcccgcgcgtcactcagagaggcgcaaacccctcccggctcttactacccacttcagcgttcccacggcaaggagatgtgcccccttcaggacggagtctgcgtgttcccgaaacaccgaggtatgcacctcgggaacagcggggcgtgtccaaggcctaggcgggggcaagaaaaccgggcaggcgcaaagcaccgggagtatgctcgatgccacggcccagccgaccgtgcaaccgcccgagataagggtggcctccccccggaagccaataagcccctgcgcgagcaaggaacgaaaagcaaagaagaatagtagagactccgccgacaaggcaactccggatcatacaacggtgcgaa

SEQ ID NO: 12389 - DNA, 1636 bp, Homo sapiens
  misc_feature (1)...(1636): n = A,T,C or G
cagggactgactgtcgcggctgcaaccccgcacacacagtaatcggttactattaattagtattattacgccatttcattatacactacgcgtgatagcgactgatgattctgtgtgtatatacgcgcagctggctatctaaatgtcgctatgcggttgnggaacagtgaagacgagttggtgttactgggttctcggagagacacatacttcactcttattgactgcgtatccacgcgaatgaagataanattacgcantgtgacgttgtcgtctaccacgcgcngcgagtacagttgcagcttatcatcaatcatacccagcgtncaccgctgatctatgacatacgacgcgacgtatctagtgatatatgttcagtacagctatagttgtatatgagacgcactactccacgtttnttgatagaccgcagagagaggccngtcgngactattgtcacatgccactgctgtccgcatcgtctctcgatatgacgagctagatgtggcagtatcataattgtacgcacgcgatcacatctatcacgtaccgcgagcgtgtgagtatgctccgcantacttntatattgcgcacatatacactcaatcatcaacngtagctcgagcactccgngagtcntcatgctcatagtaatgtcgaacgacgcgagtaggatgcgcccatagtctcaccatnggagcgagacctgatatgtgctcattacttatcgttcgcgctgctagaagagtgcgaaagactcgtagcgtattgtaacataactctatatacgcgactacgtcattacgcgaccacagtacaagcaatgagtctacacgccctctctatatatgcactctgtcgtctatcctccgaatcatgataactagaaatgcttaatcgccgcacgtattaccgccctgatacggccgcatataatattgtatgttntcagcaatatagctcccgcgtattgatattgtaagtaagctccgcgaaacatatcatcagtgtcataagtattacgcgggcgtgtaactcgtatacanatatcncactgtcanatgccatcgcgcagatgttcacatcgttgtctattacgctctattcatgtgagcttactgtttccggnagtagtatntcagtcgtgtatgttatgaacacgatctgaacacatcgcatatattatatcgccgtctgtaagcgcgatctgccgtgtgttctatccgtagataattctcgtatcatttctcttgagatatgttcgcgccagaggtgtgtgtcagttgtgtaatatatatagagtacagtagtgatgaactgatngtcattagtacaagcggtgtctcgacatcgggcatcgtagcacgtctgatgtagacctcgtgttagatatgtcgctgaagacagcgctgctcgtagcatacggtantgagcgcatatcagtcatttatcaatagagataacacagaactagatctgcgcgagatagaatcatgagagagatagtacgtagtaacatagtatcatcgatatatatcgattgatgacatatcgtgcgtgcgcgctgcgcacgccagctgcgtgactagacagcacagcatatggagcgcgtctcatatcaagtcggtagcactag

SEQ ID NO: 12390 - DNA, 663 bp, Homo sapiens
  misc_feature (1)...(663): n = A,T,C or G
cnncttagnagagaggttntaaagaaaaaaagaannccnnttttttnttttttttaannaaaaaaaaaatgttncccagannatttttccccccaaaggaaangggggattttccccnccccnaganaaancncncccancttggganacnaannttncccgttaaaangtnnaaaaggaagggaaagaagggctgcangttncggcccaccaaggggggaaagnccaaaggggccattntttggcaaaggctgggggcctttcgaanaagncccggtanaagcttggaggggngcactttttgcaatttgccccccaatggagggctcntgntaaatttaantatgggctggtaaattntnaaaaaactgtttatttctggccaggtcaaaaaataatcccctnatatataggcntcatgtaaacttttaaaacggtctttcacatcccttcaaaatgtataatctcatgaattacagtctcatgaaaatatagcaaataaatatttggaattataagagaggaaaaagtaaagaagtgaaaaggatttgccctactccaaacaaagcaatgcaattgtgcaacggaaggataagtcataagaaaacagtagagcgttcagaaaaaactccaagagtgtatgtgggaatgtagaaattcaat

SEQ ID NO: 12391 - DNA, 763 bp, Homo sapiens
  misc_feature (1)...(763): n = A,T,C or G
atacaacctatgaagttttccgaagatgcttaagccagagaagaagagtaaagaatcgccccttgatccaaaagtttaccaacagaaccattctggaccttgcactgttttgactgtatagaagagcagacaagagggtacagtggacagcttatcnaagcttccatctctttgtcaggggggaagaacctgagctatggncttgccacgacggggttagagttaaatcacactccagaagaagtcgggttgggaagtcattttaaagaaaaaggattttcccgataggtctcccgtaaaaaagccaatctctcaagtctggctcaacgaataacagaccacacaattggatttccgcgtgtcggtgatttaaaacttaggggaagaagggataattctaaagagagcgaaggtaaggagtgctgtccctaagtgcgataaacacactacagaccgatcgtgtactttggtttctttattagtggaggtggcgaatatagaggataatgcatagaaatatcgagacatgtatgagtcgagcgatggagaaatatataatacacctctatacaatctccaaaacaaataccaagatagtattgaactgttgcgcgacgagccatagtaacatgatagagctactntgcgcnnctgagggcgcgctagctacggaagaaganccccgcgggcctagtgggaagagcccggtctgaacacgccaacaaacatacctccgaagtgagacgacactgtgtggtagttg

SEQ ID NO: 12392 - DNA, 391 bp, Homo sapiens
atcggttggaaaagttagaaccgtgcaaatgcaattgatgtactacagacataatacaaagatgggagatcatcaaatttaaagtcaatgtacctgtaatctcagcactttgggaagctgaggcgggcggatcacaaggtcaggagatagagaccatcctggctaacacagtgaaaccccgtctgtactaaaaaatacaaaaaaaaaagttagccgggcgtggtgtcgggcacctgtagtcccagctactcgggaggctgaggcaggagaatggtgtgaacccaggaggcggagcttgcagtgagcagagatcgcaccactgcactccaggctgggcgacagcgtgagactccgcctcaaaaaaataaaaataaaaataaaaaataaaaaa

SEQ ID NO: 12393 - DNA, 648 bp, Homo sapiens
actacaagcaggatttttcttgcttttttgcagcgtttgacgctaagatccatactacgatagactggctagtccctttggcaaagcacgtaaattggggatgattttattgatcttgactacttctcaaattttggtttttaattttttcctttcagtgtttgtattcgggggttattcgacatagaactcgacttgcccttctttcgccttcccccgttcaccagttacttattcacctttttccccatattagaatatcacgttaattgtaacgatagagtcgcttatttgtagtttcacctatgtcgacaccgtatatctgtagtcctgcgagaatttgatacacataaattagtaatccgactacgaacctttattagccgtgacggtgccttttttgtgatttccttttatatcttgttcacgacccacttgtatattataacactatatgaattcccaactcgtcgtttttacaatactagtatttcagaaatttgtggtactacgatcgagctcttgtaggctctcgtgcggatagtttagtacatactcaaatctgtcctgcgtctgtatactcatcgtcgcattaatataaatcaacagcgcatttattgtaatttaaaattattcttggtgaggctg

SEQ ID NO: 12394 - DNA, 1276 bp, Homo sapiens
  misc_feature (1)...(1276): n = A,T,C or G
gcccgacgcgcccgccacctgccggagtagaacgataatatttatatcatccgccgtatgtttatccctcgcatgtgaccctacttctatnaatctatacgcacccggcatcacagttctgcgcgtgtgttggtgcggcgcgtatgtgatgaataatggtgctcgatccttgagtgtagtatcgagcccctgtcgagacgtagtttaagcctcgtcgctcctgcccttatgtgtntacacagcatacccgcgggactcagcagcattcggtgcttatccgcctggtatcgagaaacaagacatattgggcgctcgatatgatatggcgttgggtggacgctagagccgactgcaccgcgctcgtccgactccttaatcgaattctatataggcaccctctccgctcgcgccgttgtgcgcccatcttgtattcacagctttatccatcactccccccccctctggcgcacgattacacgacgcagatatgctattaatcatattgtgtgtaagattgagattttttcctgccacttccactatatttagtatagatctatatctgccctcccctgttgtgaacatcactagcgatccgcgaatgcgnattatcacccgtgtagtacgcagactcactcgcactttgctatcacacccattccgtctgagctccccgtgtgttgatgtctacgtattggtgtccacccacttatacgatatagaccgccagcaacatatcgataaactgtgatctcgttgttatcaagtgtaggtattcccagattcacccgccgtacgtaaatcatanatattccgagcgtcgatgtgttcatcgcgccaagtatgcgtctgtcgatcctactagcggatcccactntcgtgtcgcgcttatgcgcatgccgctgcattatccacaagataacatctcacgatacgtacgacgcgaacgccggcatgacggacaatatacgccatgtcatgctattactcatgcgcacaagcgtgtctgttgtgatacatacttcactcgatcctnctatgtatctcgccagatgcaggattccgtgatatcgccgccgctaagctgactcatacgtgcgtcggactgtcgtcgcatctcgtagaacactatctatatctcgntgatatacgagtggagcgtgtcgctgacanctatatgtactacggtctgatgagtgattatcatcangcaccgcgccctcgcgactgtcacatagttgaccacgatatctacagaggatcttncgtgtgttgg

SEQ ID NO: 12395 - DNA, 494 bp, Homo sapiens
  misc_feature (1)...(494): n = A,T,C or G
gcggcgtatgtgatttaggtacgtggtcggagtggaataaaacgtggaggacttttaggggtataattgtaggtatcttatgtttacagctaccatcagcccgctccaacgcccgatatattccgcggccttagttcgtggcacaggcggccggatgatcgcataacacgaaacaggacgtaagggatcaaggagaactattttaactatgatctaaaccagacgcggccgggtggagaacgtcgatacacgggggcgtacagcggctgatacactggagtagacgtcccacacactatttcgacaaccgacggtgtgcacgtcgaacaccataaatgttgtgannnnnnnaagatgnggggtgccagactgtacgctggtcgatgtgattatgtatgttgagcgctgtcagctccacgcgcgactgcgcggtccgncgtntgcgtgcgggactgcgcaagnaaactccnctcngtgnnttttctaantnnnat

SEQ ID NO: 12396 - DNA, 750 bp, Homo sapiens
  misc_feature (1)...(750): n = A,T,C or G
acccaccagaagacatcgctcaggaacaaagtgtagcgtgttcagctcttgaacaatataaaacaagattgctatgtgactttccatgtgatgtgctgaaggaaaacttacttgttttaaaaaaaccgtttcttgctattgtgtgctgtgttagattacatattaagagaaaaaatggcctcatgatatacctgatttcgccaaatagttatacgtgtgatgggtacgatggagggccgattgccctaaaatgatttgctacacacccgcacgaaccacccgtcgcacctcgacgcgccgtgagacgtcggcgcactcagtgcctttgagggaggaacggtaggatgtagttgggaagagtagttttatgtatttttatttttgttttgttctttgttgtttgttttagtatgtgtgcacccacaccacccgccctacctagagacccatgggacaaaatacccgagaagtagcaagatcgtgcgacagccacgcaggtcgtggtggctgccttgccgtgagtgcatccaacctcgtcctcctctgccaagctataccaaattacatactcctctttgcacgccgacctccgcgacgtgtcccgatctttttgtgaaggactcgggctgtgtgttgattatatgttagacagaaagtnaaaatcgaggcaagcccttaatcggagttgtatctctcaccggcgcccgtgtactttaataatcccgcctccctttttttgtatgtacctta

SEQ ID NO: 12397 - DNA, 582 bp, Homo sapiens
  misc_feature (1)...(582): n = A,T,C or G
anggnaatcccaanggtttcccggggtnnccaanttttananancnaataaaacctagcccaatngnaaagggccnaaggnncaanaaaggggntccatnnaannttaattcagcannacgcnaccaagttgagataaaatggtggccgggaangctanaagtataatttctccctccnnggactaaggatgttcttttgncagcaacngcatccaatgttaatacagaagtcttgntntgttgcncaggctggagtgcaatggnatgatctnggctcactgcaagctntgctncctgggttcaagccattctcatgcctcaagcctcccaagtagntgggacntacaggcgcccgccaccacgccctgataattttttgtatttttagtagagacggggtttcactgtgttagccaggatggtctcgatctcctgacctcgtgatccaccaacctcggcctcccaaagtgttgggattacaggcgtgatccacggcacccagccgactggtatgtaaatgttaaagcagcattatggataaaagncaaaaactggaaacnnatgtccatcacttcancaat

SEQ ID NO: 12398 - DNA, 820 bp, Homo sapiens
  misc_feature (1)...(820): n = A,T,C or G
tgtgcgtcggtctttcgtcgcctgttgtctgctgttgtcgtctggtcttggtttctttccgtcctctttgttgtgccggttgtgtttctttgggtgcccctgtggcccgccggccggcgtcctttgcggcgtttctttttggcctttgcggcctctgcggccccgttttcgggccctcggtgggtgtccgctctgttgctcgtccgtgttcgtgggcgtcggtgcgtgggttggtgcctgtggcgggcccgggcctgggggtgggttcctcccgctccgttcggcgtggcggcgctgccttgggtttgttttggggttgccgcccctgttttctcccctgccgtccctgttctttcccctcgcgcgcccctcggttcttcccgcttctgtgtttttccccggcgtcgtgtcgggggggtctcctccctgccttttcgttctccggggggttccgggtcggggtcgtggccctgttcggtttcttcgtccgccccccctgttgcggcgtcgccttggtggctgtgtttctgtttcccccgtgtggtcggggccttcctcaaaaaggctcttncgcggctggtcgggtgtcgtcccctggtgttctttgtgggggggggcttctcggggtctttggtttgcccttctgcggcgccctttttgtggccgggcgggttttcttcttgcttcctccttgttctggtctttctggtcctctcaaatttcctcctcctgnnnnnnnngtgnntgtctnccggcaacncggggngcgtccccccaaatttttnttcgggcctcccttgtcgtcctttgcccttccctc

SEQ ID NO: 12399 - DNA, 234 bp, Homo sapiens
tcgtgtgttactactgtgaaaaggtgctcagcttgacgaatagaaacctaccctgcattgaaaagaacgctgctggatccacatcctaggttcagcttttatgagcagtggggctcaggggaggggagatttactaaatacatgatcctgaggaagtataaaaagaatagtaatacaagaacactgccctgcaccacgtatacactaataaaaaaaacacccacacggttcctg

SEQ ID NO: 12400 - DNA, 773 bp, Homo sapiens
  misc_feature (1)...(773): n = A,T,C or G
tcgtgtgtaacttgagcacacgctanctgtgaaactctggccttgaagttgactcagaggattagattcaagatgtggcaaatcttatggatgactgtggaatgatgggggcacaagtctaaatactgcatcctgctctgtcatatcctagatctgctattgtttttctcttcgcttcttatgttattcatagagagttgtaagacctacctcatgttcccctgtngtgatgatgacagacaatgtgaaccagagatgtgtccagtcatttgtctaggcaaggcctgaaatgtgttagaaagtccagccaatatcagcaaaaacacagctggctcaagctgactacagtcacatgatagaacccatctgagaccaaagaaaccactcagctaagcctagtttaagttgctaacctgcagaatcatgagctaaataaacagccattgttgaggaaaaaaaaaaaactttacccctgaacaacaaccaaccaatggccctttttgcccaaaccggggaacttcgccgccccttccatttaaggggggcgtcatcaagaggctcccttacttaattccctctcctcggccttccgtcctcggaaccgcgcctccacttactctaaaggccgatcccccgttccccccgattccggcgttaatccggaatacacacgtttccaccccgccccccgcaggtccgatcttcccaaacgccttcactcgggcccccttttccacaggttcccccccttggtcgtccccaccattcccctc

SEQ ID NO: 12401 - DNA, 803 bp, Homo sapiens
cctaggtgagacctcgctaccttttgagagcctatctctttgagtctacattgggactgacattctatggctttgctactgagagagtgtgccgatcagtaaatgtggtttatgggatatcagcagatctgatctaactgtacaagtggcacagcttatttagaggtagaagcggaaaggtctttgtgaagtcagcacttttttcgaggtgccagaatcaatgaaatctggacttatatgggcaagacacacagatggttctcatgtgcatttttaagatctagagctgtcctgatagttataacatctcttctctctggaagctgcagatttaggtagaaaggaatcttttcttgtggctcttggatgtgaagcttatggttccatttctcattgagcatttataaatgaaccttatgaattattattttaaaaaacagatgccaggttccattgagataaatatataggtattgctgcttcttaaacaaccagcccgctcgataactcataagtcagacaccccccgcgcggtaaaagcggaaaataacaccccaccacctattctctctccctcattcccctctcgcgaccccgcctatacgcccgtcttttcggcctcccccgtgcctacgacatcccgcggttcccctttgttcccctaaccgccggtgtatacacgcgggcccctcgtttcccttggggcggcacccggttcgatcgttcgtccgattcccttcaaccatacgccgatagcccgcgacggtgtcctgtctttcacgacacgcccccatcgtcccata

SEQ ID NO: 12402 - DNA, 762 bp, Homo sapiens
acaacatctaagaatggaggctccccccttcccttgcagggttaccagcaattaaaaagaagtactagggaggcaaatatcggcagtatacatctaagcgctggtcggaaaagaaggaactcagcccaagaacttgcccaatctgatactggaggtgccactcaagagccactccctccaagatgttttcctggatttcctcagcctaaagtaatccctctttttcctggctataccatctggaacagatgacttccaaggacaccgtagtaaagaaaaagagaactggaagcccatgtgccttaatcgcttcatcctagagcttcctgagacctccccggaggctgatgctgccgtgcttcctgtacagcctgcagtactgtgagccaaataaacctcttttctttatatattacccagtctcaggcatttctttatagcaatgcaagaatggactaatacaaagttcattccaaccttcatggatggctttgaggggttcaagacttcaatggaggaagtcactggccacgagggcggaaataacaagacaactaacattagaagcgaaccccgaagattgactgaattgctgcaatttcatgataacacttgaacaggtgacgtatcggttcttatggagaagcaagaaagcggtccttgagacgaatttactctgttgagatcttagaacttgctcgaatgacaccaaggactagaattcgcccaccccccctaaaagcgcccctcgcttccaaagac

SEQ ID NO: 12403 - DNA, 778 bp, Homo sapiens
ccccatccagccattctataagcaaggccgaaaagcgctaatacaagtctcttccaacctccacgaagggcttgaggggtacagacttcaatggagaaagtcctccacattgaggtgatatggccagggggctaaaattagacgtggagcccgagagtatgatggaattacgccattcccattaataaacctgaacgaggtaaggtaatgcttccttatggaatgagccaaaaaaagtggaattttttacatggcaatttactcctggttagagatcctgtgaaccatagctgaaatgcccaacaaagcctttagaatatgacataaaccttagttgataaaccagtgccagggtttgagagggaatgcctccaattttgaaaaaagtttcactgtgggtaaaatgctattaaatagcatggcatgctataaagaaaatcttttgggccaggtgcagtggctcatgcctgtaatcccaaagtgctgagattacaggcataagccagtgcacccagccgagaattagtatttttatgtatggttaaaccttggcgtctagccatattttatgtcatcacccaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtacctcaacacctgaaatctcataaaaagttaaattttaaaaaaaaaaaaaaa

SEQ ID NO: 12404 - DNA, 525 bp, Homo sapiens
tctgatgaaacctcgctctgtctttgcagcgaggaaccgcatggcgcgatctcggctcactgcaagctccgtctcccgggttcacaccattctcctgcctcagcctccggagtaactgggactacaggcgcccgccaccacacccggctaatttttttgtatttttagcagagacggggtttcaccgtgttagccaagatggtctagatctcctgccctcctgatctctcctgcctcggtctcccaaagtgctgggattacaggcgtgagccactgcgccctgccttaaaaattattcttagctcgcacgccgaacaaacataggtggttggctagttctggattaacgccattgcctagttgatccctggattacaagacaatgaatatttctcatttgtcacaaaacttcatgatgctatgattaaccatgaatctacaccactcacttgcatcaatatgcccacatgattgataccggggaatcttggtatcttaagagacacagtgcccacaccttgttcc

SEQ ID NO: 12405 - DNA, 737 bp, Homo sapiens
cctgagcaggcatccagcccaaagagacctcaccagctttgtgaaatagccatgctctatcaggttgcggcggcagagagccatccatcaataagcggctgaaagtgcctcctgcgattaaccagttcacccaggccctggaccgccaaaacagctactcagctgcttaagctggcccacaagtacagaccagagtcaaagcaagagaagaagcagaggctgttgacctgggctgagaagaaagctgctggcaaaggggatgtccccagtaagagaccacctgtccttcgagcaggagttaacaccatcaacaccttggtggagaacaaagaaagctcagctggtggtgactgcacacgtggatcccatcgagttggttgtcttcttgcctgccctgtgtcataaaatgggggtcccttattgcattatcaaggggaagggaagactgggatgtctagtccacaggaagacctgtaccactgtcgccttcacacaggttaacttggaagacaaaggcgttttggctaagctagtggaagctattaggaccaattacaatgacagatacgatgagatccaccgtcactggggcggcaatgtcctggctcccaagtctgtggctcgcatcgccaagctcgaaaaggcaaacgctaaagaaccagccactaaacagggttaaatgtacactgctgagttttctgtaaataaaaataattaaaataaaaaaaaaaaaaaaa

SEQ ID NO: 12406 - DNA, 376 bp, Homo sapiens
  misc_feature (1)...(376): n = A,T,C or G
ccctagaagaacagcatgctcctacttgctcccatccctattggccaagaactgaatcaggtataaggatgctctggactacctgactcccaagagcagtagccaacacacctccgaggaagaaacagtttcaggtacagctaaggcaacgggaaaaagaatcaaattctatttattcagaccaattgaaaaatggagtaaccaagataatggaataatacattcagtgcctccgcatattaagtctgtacggattttcagttttcaaaaacttaaaacacagtaaaatactcttagtgctataactacccagggatgatcgggattttgctcagcaattaaaagcatcactgtgaacatcanaaaaaaaaaaaaa

SEQ ID NO: 12407 - DNA, 668 bp, Homo sapiens
  misc_feature (1)...(668): n = A,T,C or G
tgtgttgtcgggcgcccgtttcctctcgccctttgtgtctgggcctttgccctctcccctttttgtcgtcccgccctttcccgtctcccctgtcccgcctaaccctgtgtccccccccccttgcgtttttcctccgcgggcttcctcccttccttttttgtgcctttcgcgcctctcccggccccttttccgtggcccttttgttttttgcccttttccgggccctttctcctttgtccccgccccttgtttcttggccccgggtccttcgcgggcccggggtcgttaccccggcctcctttcgggcccccgccacctgcgcccggccncctctgccccccctccctttttggccactccctgcttccggtttaccgttgtgctggcccccccggctcccccgggccggctgcccccccccttccgggggtcgtccggcttccgggcccttttttttgtggggcccctgtttcctgtttccctttttcccgcctgttttgattttgggtccccccgctcctgggtttttcccccctctgcccccccatttttggtctgcccggtttttcggttttcggctcttttcccccggtgcttcctttttttgctctccctcccccggggtgccggggttttgccccccccttcccggcgtccctgtgaacctc

SEQ ID NO: 12408 - DNA, 498 bp, Homo sapiens
  misc_feature (1)...(498): n = A,T,C or G
cctaggtgttaacttgactgaactgtaagatgccaggatgtctggtgaagcattgtttctcagtgtatctgtgagggtgtttccagagaagattgacatgtgccagtggactgagcataagaagacccgcctttaatgcaggcagactccatccagttgtctgggggcctgccaaagataaacaaagaagaggactctctctgttctggggcaggatgctttttctcttcctgcccttgaactcagactccagatgcattggcttttacactctatgatttgcactagtggcttcccaggggcgataggtcttttggcttcaaactgatggctacatcatcagcttccgcagttctggggcttccagactaagccatgctacctgcttctttggtgctctagcttgtggatggcttgtggtggaacttctttacctctgtgatcatgtaagccaatactccctaataaatcaccttccacatnanaaaaaaaaaaaaa

SEQ ID NO: 12409 - DNA, 751 bp, Homo sapiens
  misc_feature (1)...(751): n = A,T,C or G
tttttatgggtagtggagattttgagggtggtatttacagtatttttttgcaaaaaaggcttctcaagaatttcttgggggcacattcatgttttttccaattattaaggcgggcttttatttctaccaagtttataaatatggtccgggaggaaataaanaaatcggggttgtgattaacacacccttatatagggcggcgggggttgtttttttggttattggaaggaggcccaaattttttttgtgagcgaattttttttactggatcttggtgggggggttctcccaaaaaaatagaaactggccccgtggtgttagaaaaaaaaaacccccttttttatggggggggagttcccccagttttttggggggctatcaaaaaatataaaaaaaaggggttttttttttttgggggggggggggtttttttttttcccccctaaagacagacctcccgagggggggggtgttgcctttttttttgtttccccacgggggttcccaggggggaaaagggtttttgggtttaaaatgtaggggattataataattttttggattttttgggggtttagcccaaaaaaaggcccccccccttttgtggggttaaaacattggggggggttttgggggaaatttttttcccttggtttttttgtgggaaaaaacccccaaaaattccccttccccctttaggggacagaaataaaaaaaaaaaaaaaaaaaaaaaattttttttcccaccccc

SEQ ID NO: 12410 - DNA, 753 bp, Homo sapiens
attcgggcgggcttttgttgcggtgtagacctgctgctccggttggtgtcgtggtcctgccgcgtgacctttcttctttcggccgtggtgtgggcgcgggctggttgcgttctttacctgtgcgtgtggtgtgtcctggggtccctgtgcttgcccctgggttctgtctgtttggctctttttttgtgggtgccgggctgttccttttgtgttcgcggccgcgcggcccggcggggggggagcgcgttttcgctctgcgtggtttgggggggggttgcctctgtctacagttttattcctgtttgttgcgcgtgcattcattgtgggccgcttggtccctgaggcgtgtctgcctccagggcgtttgggggcgcttgccctggtctctcggtccttggcggccccttttctgttgggggggggggtgttttttttttctgcggcctgggcgcggggctccaccagggcggggtgtgtggtccttttttttttgtcgtcgcgggttccccgggcggggggggcttttgggttcccgtctttggggtccccttccccggttcccgcttgggggggtctcccgtgggtcgcctggttccctggttttctaggggttggtctggggggggggcgggggggggcgttctttcccctcgtttttttggggggccggctccccctttggttccgctcccccctctttgcggccgtggtgcggcccgcgccccctacggactacttcccccttctggtttt

SEQ ID NO: 12411 - DNA, 2065 bp, Homo sapiens
  misc_feature (1)...(2065): n = A,T,C or G
ggggggggggggnnnnnnnnnnnncccnnncccccngcggcccgggcgcntnggnggnngnnttnttnnaanntannctgtgttctccctgcgtnnnggcggggagggagcgcactaactactcacntcagagngannganngagngangagcaaagccgcaacgcacacnaccnatncntgaancagcancgaagaanangtatcatctacaatggngagaaaangcgatagcggccacctcagaagaggctgctgacactatgagcatggcgatgcgagtcgagcgcatcgcgcacgaccaccgacgcacaacnacgcatatgacgagcgagagaggaggcgaangacagtgagagcacgagcggacgatgacgaggacggcgccagcatactcgctcatgcngngcagagacagnagnagcaacnacnatctcagcgctacggcccacaccagccaacgaccanacngacgagcncgaccgcccgacaggcagacancatcactacgcagnangtcatacgcaacgcgacgctcncgtacacgagaagcaaacatacacctacacctgaggatatagacatcncagaacacgcacggcgcgcacacgacagcgacagcgatcacagcanacgctcagcgcgaccgcagacngcacatgaccactacgcgaccgtcgcgtactcgcacgcgctcaacagacatgngtagactcgtgcgcggcgagacagagttgcggtagcagangcngcgcgcgagnacgcaggcgagacagagtgactgaagtatgagcgcactagctgcagacancggctaatgagatgcagcgacgagagagatcagatgacgagagcgagcgcagcacctacagcancagaggaggagcagagatgagccaaactagcaggcgacacgcgacgataacgccgcgtgcgtcgcgcacggagatgntcaacanatcggcagncancgtcgacacccacaccacaanaccgcaacacgaagcccgagcagcgngtgnggccgacagccatngccagcganantctccactgcnataccagtgnacgcagccantancnacgacactgngcgcacgtcgtacaccactgcgcgaaatcacgctagagcgtctgcgcgtgcacncgctacgtgaacccgcgcggatgcgacgcagggtcgcacgtagcgcgcagcgcagctacacacgngagagacagntacgtgcgacgtagcagcgcgccacacatacacaacacanaccgtagacgcgcgcggcgcggcccgcgcccangcgatntgtctagtagcagtaccaccatcgaatcacgcggncgagagcgaccgcgacgagcagcgagaccgcgtctgcgtagcctgaacaancagcagacggcgagacngaacgcgacgctaatagnaacagagagcacagcgccgcgacaccgcacaacaaaccaggtgtngccgagtagtatcagtcgcgcgcgcgacgcgagtcgcgggcgacagcacacgcgcacagactgcccggcgcgcgaccgcatacnacgaccatgtcgcgcgacacaacacggagagcgctgagcgaccgnaccgcgcagcggccggagtcagacacacgtgcgagcgcgcggtcagagcgctgacgtcncggagagaagcgacaccagcacgcagaatcacgacgacgcgcgtgcagagcgtatcatccgtcatcacgccagccgcccggcgccgacaccgaacacgctcgttcagtagtgcgacacgcagcgtagccgacgcgctgccgaacacaaccagnagtaggcgccagaggtctcgtgtctcagaccgccgcgacgacggagcacgtaatcagcgcagtagcgcgagcctagattgccgatcgacacacagaacgagcagnacagaaccgagagcgcgcggcaccgtcaagatgaagcgtaagcagacaccacgctcgacgagtcngacgcaggcgaagcggtcgagggcgagacagacancaacaacgggcacaacacgcgcgccgngcccgcagagcgacgtccactgccgc

SEQ ID NO: 12412 - DNA, 717 bp, Homo sapiens
tgctttgctacgtgtggtgcatattccttacgatgaggattataagtatagtaccactatcatttttcggtgcactattgctggaaatatacatatgactacttgtccagttcagaacaaaccagaccctctgtcagattcctgcatataactgctttacaaaaccacttcttggggtcataaatggtggccttatcccctgcgggtgtatttctattcacctcttttccattctgaacagtattagaaacagtgggatctttttcctgttcctgggtaattgctaacaactacagtgcgctgaaagtggagtaaaggatttccccaaaggattccaagcacatgttccttgcccttgaatatcctggtgcctataggaacatcaagtgagatatctatggagtgcgcccctatttacatagtcttaagcatatctgtatatatgtataacctcaaaaaaaaataaataaatgggctcccttgactacatggggggaactctatggccactatcctcgagtgtcgggtaataaatggaccctcgctcactgactctttggactcggatcgccgcgtgcggtgaccggtgatagtggctcatgggcgggcttctgggttggccaaaatcccggggaaaccgcggggaaggattggggatcaaaggcctcgaacacggaaggaggtgtatcagggagtttgactaagcacccaccactt

SEQ ID NO: 12413 - DNA, 409 bp, Homo sapiens
  misc_feature (1)...(409): n = A,T,C or G
tttaaaaaaagannnnnnnnnnnnnnnncnccnccccccnntcccncnccnaaaaanaaaaaaattatttttttttttanagtgagtatggnattggtcttagccgctgcaggtagcccttcttttctgtggnattcatcatctatgaacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattgagtaataaagtttgaagcgattaaaaaaaaaaaaa

SEQ ID NO: 12414 - DNA, 1325 bp, Homo sapiens
  misc_feature (1)...(1325): n = A,T,C or G
ggaaaaccgagnnnnnnnnnnnncccccccccccaaccccccccnccccntgtacaaaaaatctagttntaggcccattgcaccaacctcttntatncgtggcaaagaagaacgtctctgttcatcacagtgggactgtcagaaactacaacagagatgaagttcagctgccccggggacctagtgccacaccagtagattgttcactctgtggtaaaaaaataagatatgttagactgggattgtcttcatcatcatctttatccagtcttacagcaggggtgacagaaaaacattcctcaggactcatacaactcactgtgcaatggacataataggtgatccttctcaagcttatactggttactgaaggtattgatttagtaatatgccaagaatttagatttatggcatgtttgtttaactggagctctaagtcagtccctttcttggccgggggataccttaaataaattttatattaccttccaaccattatggagccctaaaaaattaaaatccttggaaaaaactttttcttccccccctttttccagtttacctttttttggtgcttggcgggtcccccaattatttttgggtttttttggtgggggaggaccccccaaccctttaaaaaccaaagcaactttttttaaaaagggcgggaaaccctaattggttgcaaaaagttttcggaaaaaaaaccctaaaatgggcgcaacccccatttaaaagggcccccttaaaagataaaatttttttttaaaaagcaaagacccccctggggaacttcccaacttttcatccaaccggctggggcaaaaaaggggtgcctcgaaaatttttttatgaaatatgccccaaaaaaaaggggggggttttttttccaaatcgggaaaagttaaaacggggctttaaaaaattttttaaacctttttggggcaacaactcctcgttaacaccccttttttctccccgatcaatttaatatgtcctatcgcccaccgaattttgggggggccccctctcagaaattgggtgcccctttacaaaaacccccggttgggggtaaaaaccttctcttttctccggcgactccgtcttttttcagccccttttttttaattctaccacaagggggttttaaaaatctctcagttgggaaaattcccttctggcggtttcacatctcgggagatttttcggacttaagttaccttcttaaggggggttcctctttttcacggagttttggcccctggccttaaacgggctgggtgtattttccagaagttgttttcctttatagaaaaaaaagggct

SEQ ID NO: 12415 - DNA, 784 bp, Homo sapiens
agatgttcttgagacagacaacttggtgtgcagttgggaaataaaggagttctggaagacaaccacaaatggagaagaaaatgtatattctttcaatgtagcatatcagaatggtgaaaatatttgaaaggctagttttggatagagaagttgttgtaacttaatgctcaggctttggtgtaggtatgaacttctatgttgcattttccaaatttgtttttgaaggacctctaacaaatggcattacatagaaatgcactgtatttacatagaatttgaaataaatgaaaattaattgccctttcgactaatttgtagtggactcataaaaatgcttttttattctgtaaagcctgtcaatattcaaattcctccagcataccatctgttcagtctttggtgcatctgcaagctctatctcatggacagagagattggagagctgtgcagctttacaatattttatgcacatggagacattgaagccttttaccagtctattactactggagaagcttatgatgggcgctccctaaattgcacgcctccgaccccatgaactaaagcatcctcctatatctccccccgttcagccactggtacacttataatcaccaattcacctcccactttacctcccctcccttcctccccccattcccattcctttcccatctacgacccattttatggtatttctgctttcccatttccccccctcccggccctccctattatctttcccctcccctcccctatccaattgttagtccgtgccctcctt

SEQ ID NO: 12416 - DNA, 142 bp, Homo sapiens
  misc_feature (1)...(142): n = A,T,C or G
cagagtgcgttggacggctccaccgagagaggaccctggnaacctttgggagaggcaccttcagcagttcccacccttcctcgccagagagtcaggatagttttaataaatcaggtcaagcccttaagtaaaaaaaaaaaaa

SEQ ID NO: 12417 - DNA, 445 bp, Homo sapiens
  misc_feature (1)...(445): n = A,T,C or G
ggtttttatttttttatcnctgtccacaccttgcctccaggctcttagaagcatcgtgtggagcctcagaacttacatcatggcagaaggcgaagggaagcaggcacatcttacgtggctggagaaggaggaagagagagcagaggaaggtgctacacatttttaaacaaccggatctcatgagaactcactcactatcacaagaacagcagggaaatccacccccatgattctatcacctcccactagccctctcctccttcaacactggggattacaactccacataaggtttgggcagggacacacatccaaaccatatcatcactaattaatgtttctgaaagctagagttacattacaaccacctgaggagcttttaaaaaattacagatccctgagcttccatctagattgattaaatcaaaatatctgggcttgaaaa

SEQ ID NO: 12418 - DNA, 747 bp, Homo sapiens
atacagagtgcaccagtcatgacgcgagcaacgcatagatatatcaccacccatgggcgccgcggccgttgcccaagtgtaaaagcatcagggtaaatgcaatactatacaggggtatcaaaaaacaaaatggcgttatcgcccaccaacccaaaggatgcttgaatgcttgaagacctgatacacacacccatgtatattcatgaggctctcaatttcatggcagcccatagttctacttatatgagaaccaaatccctgtggagactataccccctattttttctgagattaatgtactcttggagcccgctactgtcgttattgatcacatctgtgtgaagccaaagccccgtggttgcccatgagaagtgtccttgttcataatcaaacaaaataagcgtgactgtaatgcattcgtgttcaaacccgcctcaaggattccataagtgttgaagtctcaactgcaacaatgaaattatcactcatgccagtggtccgtatgttggaaagacagctaatgtccacgtttatagagacatcccagcccttctcttttatagggtgcccgccatgaagtgggatatgtagatgtaacaatatatcttcatttgcaataacagatcatggagtgtttccgcgtataagacagtcacggtgtacagcaatatgtaataagatctctttttgtgctatctctccaagtagatgaatgttatattggcctcttaaaaaaaaaaaaaaaaa

SEQ ID NO: 12419 - DNA, 1079 bp, Homo sapiens
ctctccacctttctctctctttctacccatcgaaataaccccggtcccccttaatatgaacacagcaaacgatttcagtgctaacacctgcacttctattgccgggacttcctgccgagtgataaatccatcaattgggtacactatagcaataacgggccgaatgtcttcaccagatcttctgtgcgctactcttgtccactttctatctctttcgccattgcaactcgctctgattatctcggggcgtctggaagctactcattcacgtcctcgtatgaccctgatgatatgcatcacgcctcacacgaatcaaaataacttccttctatctactacacgcaagacgtcctcctacaacggcaggtcacaatctgacattcacactctcatcatgcctaattacctattacctcctacggcgcgtagtaactgcttacttctccttcatatatacgcaatgcgcttgacttctcctgatcttatccaaggcctttgaactttagtactccatcactcgcactcctgaagcaaccagatttccctccctgttcactcaagttggatatgtctcctttgttaacctcaaaacccccaccatcccgctaccacattcgcttatagcctctcctcactatcttcgtcaattgcattcatttcggcgatcctccacgctagctcggcgttctacacattaaccaagatcatccttctctctcttcccgctcacccctcttctatcactcgcgtgattagagctaccaccggtcatttcccgcctcttgcccgctatcgtccttcctcccgaactctcctccactcctcccaccacatctagctcatattcaatatacacatactggctccctctctccttctctcgttcggttctcctcctctacgtctcgctcttccccttttaccctctacgatttacacgtatatcgacgtccatctccacccatacccctccattgcgtctccagctatagcacctcactcaccgcgaccgatggcgcacgccctccgctcgccacgacggtcagtcacccggccacccacaccatcccgcgcactag

SEQ ID NO: 12420 - DNA, 654 bp, Homo sapiens
  misc_feature (1)...(654): n = A,T,C or G
ggcgcgcgcggcccgcccgcgcgncgnccggcgcgccggccccggcncccggngngccccccggcnccgcccncnccgccgcccccgaagcgcgggcgccccccgccccccgcccnnccccggggggggggggggnnnnngnncngcccccnncgggccggngcgcgcgccncggggcgcggncggccncgcgcctcgctgggcaggcagttttttttttcttttttttttntttntnnnnnnnnnnnnnnnnnnnnnnnnnnnnnnnnnnnnnnnnnnnnnnnnnnnaannnnnnnnnncnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnncnnnnnnnnggggnctnnnnnncnnncnccnnnnnnaaanannnnnnnnnnnnnnnnnnnnnnnnnnnnnnnnnnnnnnnnnnnnnnnnnnnnnnggtnnnnnnnnccnnnnnncagcnnnnnnnttggntnnnnngggtnnnccccnanncaaggcnncngngttttcttttgttattttttctctnagacccgcgnccccccccccnncccnnnncnnnnnncnnncnnnncccctttttttt

SEQ ID NO: 12421 - DNA, 159 bp, Homo sapiens
cctggaagcacataaagattccattcccagaaatcaaggtttcaaaacatcttcagaagcaaagtaaacaaaatggaaaacaaatctcgacaataattttattcataggaaattttttcattgctaataaaatctaggaacactataaaaaaaaaaaaa

SEQ ID NO: 12422 - DNA, 266 bp, Homo sapiens
  misc_feature (1)...(266): n = A,T,C or G
aggaagacgaatctcactgaacaaaaaattggaaaaaaaaggcaaacttangagnaacagaggccagcctcngaggaanagacnagaaccaacagaagaacaanacgcggaagctttaaagaggagagaaaacaccactnccaanacccaccatncncaagaacaagagaagaaactactcggggagnacnaaggcaccaaggggaaaaggganagaagaaaaagaaaggagatcggcaangaagacaaaaggaaaaaaaaaaaaa

SEQ ID NO: 12423 - DNA, 891 bp, Homo sapiens
  misc_feature (1)...(891): n = A,T,C or G
gtgatattatattagaaaacccttgaaaacaatgcaagtcaggagaacagacccagatcctagagacaacgacgaccacagaggacacaggtggctttttagaaggtggcctaccacctgtcactatctgtgctgtatgataacctgagtgaaaaagctgtgattggattgaaccactgaaggttgagaatcagctatgacatggtagcattacctcgtttattgcgtcgttggaagactggggaatctatatctattatgtatcaggcccttaactaaaaacacgattaattttttaaaaatgcacctntggaataacgttaaatgtgtcaacgctagttcaacctctcaaatacttacctaattggtccacatagttagatccatgcccaggggatcctctatcactaccacttantaaagcggcttgatattgattactatgtgttggtctttatgcacatatttaggtgccgcttactatntactctatactctcacatcccgctactacgcgcccactgcgcccccggcacaaccctccctactaactatcatattctcatttccgatcgtataatcatcaaatggactgataaataatctaagcgccaaccacaactaatgaagtttcnctatacttctgtttatatttttcttacttttctcttcatttgtgtcattaatcgttcccatgtccacaaactctactctcctatccatgtcttatgatcttccctagctccctaccatctgtcctgtccagcagagcacgtagncccaatggccgctccgttacccacccgccctttttcattttacccncacacatcattccaatctttccacccttgccgtgacgtggagccatcgcttcgccggggccaggcg

SEQ ID NO: 12424 - DNA, 787 bp, Homo sapiens
gggcgcgtgcgcgccgctcgctgcgcgtgttgcgggcggcttgccggtctgtcgcgccccgcctctcttttggttccgcgggcggcgcgccggcgccgcacgtggtcgcctgttgccgtccctggggtgtcgggtgggcggttgtcgcctgtcgcgtgtgtggtgcttccccgcggcggctgcgcggtgcgggcggggcgtcggcggccttagtcgtgtgcggcttggggtttcgctctcgtttgtcctctgcgcacgccctctcccttcctggtccgcctcgtctccacttcctcggttctccgcgtgtgcgcgctcgccgcgtcggcgggccgttttcgcgttcggggcggcgcggcgctccgcggggggggggagggggcggtctgccgggttgtggatgggttgttccgtggggggcggcgcggggtggcgcgccgggcgcggcgctcggctcggctcccccacgtctcccggcgcggcgtgggcggctccctcgcggtggctcttcgcgtccccgccctcctttctttcgcgcggccgtgctgggtctgcctctctggcgtcggggggcgggcccgccccgcgggggtcccccccgccccccccgccggcggctcgtgttcctcgccccccccccccccccctctgtttggcgcggttgggttcttggcttctgggggtttggtggccccccctcctcgccccttgcccgccgtccccgcggcgccttttgttgttctctggttctttcttcttttgctgctgcctactttttccgagcagc

SEQ ID NO: 12425 - DNA, 763 bp, Homo sapiens
cctctcctacccatctcacctctcgccctcccacactgtctccttctcccgccccctttctcctcccccctcatttcccctctatgttacgacatctcgctctcttactgtcgcgcccagcgctatccacgtcttcgctatccctctttccccagtcggacccctctccgcgcttccgcgtaactcgtgacgcttgtgtaccttcccatttccccctcccacctccttccccactcttgtccgttctgtcttaactgggataactcgtaccctccaccaccccccccttctcccgtgcccgtactcgtcccccttggcttcagtctcggcagtgtccaagatacggtttcgtcccttacttccgttgcccccccctgcaactagctctcgtttttgtctttgtgctcatctggtctcctttcttgcccctcggcccctcgattcgcccgcgcccgtctttgctgctgtgacgcgtgccccgtcgttggcctccctcccactcctccgcccccgcattgcgcgacttgttggccacccctctcgcgcccactcccctttcccctcttctccggcctctcttgtgccccttctattgctcccccccccggatgattactgctttgccctgcttctcctcctcctccgctctcccgttgtctgttaatttttttgctttccttccttccttcttgccctcttgtcttatgatcaaccccacaagaacttaaaagaaacaaaaaatataataaacaccccccacccc

SEQ ID NO: 12426 - DNA, 903 bp, Homo sapiens
  misc_feature (1)...(903): n = A,T,C or G
ataaatgaaaatataaatgaactaaataaaattgagtaatctcaatttaaatagcgacgataatatcaacaataatatataagaaattagagagagtcacgcatatgaggagaactcatgtgatgattgagaaattactggaaggactaagtatatgttcattatgacaaaaacacacaatggataaccgcaggagacataataatagtagaatgatagagaggatatgagtgtagttttgaaaatagtagtaagtagaatatatgggcggtagtcgaaacaaatatgagtagagaataaactggacgtggcttagtcataataatagagttatcgtgctgaactcgaaaataactagaagtaagtatgccacacacctctcagaataataataaaagcacaaaataataattcattaggcaaatagagaacttatgaaaagaaaaatagcaagcacacagaataaagtgggagactggtgtataaacaaatgaggttacttaattgttcaaaagaggagtttgtgtgtaaaatttggacaaattgtagtatattgaaaaaatattgtataaatgcgtggcgatttgtatttttttatgatcgtgaaatttattaaatataaatttaccagtttaccaacatcaaaataaacaaggtaatgctagcagctatgacaaattcccaaactccagtggttcaatacaataaaagttttttcattcaggtgaacatccaacacagatattgacagttggtgggccaccttctgggaacccgaactctttccatcttgtggttctggtttttctccntaaagtttggagggccatgtttcatgccaggatttctttttttgatgcaaatctcctcttttttccctcttcttttcttnttcttctcttc

SEQ ID NO: 12427 - DNA, 527 bp, Homo sapiens
taggttttcagacctgtcgatgtgcacttaccatggtgggaaagcagttttccctcctgactccagctgatctttgattttattgcctacccaacatctacccagaccacccaatggataaaaaggccatcagatgtggctattttgagaggttgtctctggctgtagaaaacattagtctgagttacaaaaaaggacatatggattcctgactagggtgaggaaagcagatcaatatgtcatcctgccagtagccctaaaccctgatttccttttctggccgcattctggaggtcacatatcctcaatagtaaagacagagggaacatttaagaaagcccaaattccagagtagacagcagcagaatggattttacttcatacagcatctctgctacacattatcccttatgaatgaaaaaataagcatgagctatctctccctctctctgacaaacagttaaaatgtttgcatttgttctcagaaaactaataaaaagcaactcttgaaaggaaaaaaaaaaaaa

SEQ ID NO: 12428 - DNA, 887 bp, Homo sapiens
  misc_feature (1)...(887): n = A,T,C or G
ctcaggtgtcaaggagccagaggtatcagcagggcagatgccaggccctggggaggcagagctgacagggggctcagaatggacaagggcccagcgggaacacgaggcccagaagcagcactcggtggagctgtgggtgcagttcagccacgcgatggacgccctgctcttccacctctacctgctcttcatggcctcctccatcatcaccgtcatatgcctctggaacacctaggcaggtgctcacctgccaacttcagtctggacttctttttgccaaagaattccagaaaccagtcaggctctcatgtcagtccaaatttcagccttgtggccctgtcaaccgcctcatttttaacccagtcctctgtgtagtttcagaccagacctaaatagtctcctatgccctccaaaagtcgggtccttgctcctgcatgccatcagccccactcagccctcccatacctccctggctcctcaagattcaggttcctaaggtacgtccttgattaaatcaccccaatatgcccctttgccaatagtattgccttttccctgaattctgttatggtaaaaaaatcttgcgattgagagcctcctgcacaaactctcacccaagaaaaaggatcttcttctaaaacaaacccatccatccatctccattctacacaacaccaatcgggccttacgccctcacgggggaaacctgcgccctttcctttacgagggcaatcatgacctccctccttgctctttcacctgnctcttgtctggccaaccgtaactctcatcaaagcgcgatcgcttttcccaaacgcggtactcccgacactcttgtccaagcctcacagcaccaccttaaaagcccccccgccttaccctgaccc

SEQ ID NO: 12429 - DNA, 756 bp, Homo sapiens
atttctctttttggggagggggtgctatatttaaataaaaaccctctttttgtttttgttaaaaaagaaacaaaatatattttcccacaaaaaaagtttttggaccccttctttttccaatacccccccaaatataatacctttaaaagggctggtttctcatatctcacaaattttctgtcagtgtctacaaagatttttacttagtctattgttaaaatttcccttataatctctcatctatataaatatatttacattaaattatattatattgacaattgcactatataatagttgacaattgtacatttattctttatgtgtatatatatatttagctataatgtactgctacatattttacatttttattactgatcatttctcttaaaaaatttttttctcattgtagagggttaaaaatattttgtagagtccttgctcaagtatttgaatatttctttgaactcaaattcatggataataaactcttgaatatccacaacatccttcttttttcctagatactgatagttttgttgggtatgacattttgtatcactgtgaacttcttttgatgtcattctaccacttttagcttctgatgttgtaaatgaaaaaatacatacggtactactctaatttttttctttgtaagaaaatgttttccccatcttaaagtttgtgattttttccttatgctagagttaattatatttggctgcaagaattctcctaaaaaaaaaaaaaaaa

SEQ ID NO: 12430 - DNA, 1176 bp, Homo sapiens
  misc_feature (1)...(1176): n = A,T,C or G
ccaactcctcactgatatccacctccgtccacagatattacagtccgaccaacaactagcgcgctgccaccgacagtgatcaagacgcctacctttgtgtgcatctatccacgacacggaagcgagaagttgagcaaacgacaggatcgctcacacggctatactcgcagctgagtaggtatcgttgtgtctgatcgcacgccttgtgagtgcacatctatacggtattccgcntctatcgatacatacactatcccaccactcacgtatgcaaccccattatagacatacagatcactctcgtccagaattataccaactccgcgagacagttcagactcatcacgacggcgccacggcgctcgctcgacacgcggacgcgatgagcagttcatccctatagatgaatagttacaaaatacagataactttctttatgacacctagaccaattgcgtttcatataatttcagaatacctaatattaacagtacattaactgtcagtagtacgttgattgaaaatcaagaagagtgcaaaacataagatatattccgaaatccgcgcacacatataacgaatatgtcaacgtaacagaaaccaccgatcgacattccgtgacccgctttccctatataacggccaccggtggaaacataaggggagataaaccggagaatcgcagtttgcaaaaatatatcggcgccccctgacgntcggcattccacctcttatatatgagcgcgagtgactcccaccacgccccggctttattacgcctgattgttgatagctcatccaccgcgtgcatatactctatctcgaaagctaacattatatcacccctgtccaaaaccatatcgacgcatatcaaagtgctgttatcgtccatacagaatacttgtagtacgcgagattgtccacctgatataacttcgcacgtagaagatagatatagccgcgaccactgatcaatcgccgcgcgcaacaaatcatgtacgcgcgcgacatacggatatcggctcctgctccgcagcgtaaatacataatctcgccgcatttatatccgccgcgtatacatagtaattaccgccgcacccggtatatcatgacaagcgctgataatcgcgccgtgtaacaactgtgatctcggcaacgccgtaagctaataacggg

SEQ ID NO: 12431 - DNA, 1068 bp, Homo sapiens
  misc_feature (1)...(1068): n = A,T,C or G
ccccaccaccccccccatcccacccaaagaacacccctccaggttaacatggcacttgagtcactgggcaactctctggacgtcagtggcaagcccggccagaccgatgtacaaccaaccacccatgggaaagatctcctggaagtccgtggtcaccatttgggcctgcatccccaagtgcctgtctgcactcatagccacactgctcttcccctttatggccatcgatggatcctccgccactaagacacaccaccactgcatcgcgtctcaacactaggtcatccccctccgtccttacctacgctctctcctctcccctcatactcctccaactccccttacataattcaccgaactggagtatcagtacctccacaccaaatcatatctcaccagtgcgtactacataatacctattatgcaccatcccccctcacgcaccccaccatctccctttatcccatcaccacccccctactcttcttcgaacatattctctatgtcacccaaatatcttaacacatataatccatcgcaacacaaaacacacatactcaccacgcccatcataaacactcccccactgttctataatctacttcccactctcacccaatcctcctccacacacaaccgactctccatctgactacactcaatcaacttcaacatagatgcgtcaccacatccgtccaccacactccatcaaccgcacccatgaacactcagcgaccccactggaccantagtattatatatgaaccgtatcccccactacaaacgctctagatcatataactaacaatacctaacgcgcactaccacccatccattctacacaatctctccaaacaaactgacccgctgctctccatctctcaccagcanctctcactctttatccgaacccgacatctctagactcctatatcgtatcatatcttattcccacgtctcccacaaacacaccgcttccattcaagctccatacactcccccttaactctcattctacacccgtcacccacatctctcttctcacactcacctcacacatcctcaccg

SEQ ID NO: 12432 - DNA, 1569 bp, Homo sapiens
  misc_feature (1)...(1569): n = A,T,C or G
aattcgcatctatcttccacacgctctcgcttnactnaatattgactaactancgcatatgtcntctgagtgcgatgtctcgctacntatctgtcttgtctgacacgtgtgctctccgacgccgtctccgacgtatgtgtctgtgatatgctntcgtgcgtctctacatatcgtgctgtagtangatcatacgatgatagacgcgcgntactcacgnctagcgcgcgtcgagaggtagngntgtgagtcactcaggctcagtcagacgcacgcgcacgaccgtatgcctcgcgacaccncangatcnatggcatacagacgcggtagtcgttatgcactacactacagtcgcncgacgacgacatnatcatccggcactacgtcaccgatatgctgacatcgaagctnctcgtnaacgntcgcgacactaatgcgctactcgactcgatactagcgactactatgtgtcgagantgtcatagacacgctcattcgcatgccgatacgacccatcatgcgctaagttcacgtacgtncccccgtagcatacaggatctgtctcatacgctatgtcctcacatactcaccaagccatacaccncagagactctgtatcgcctntgcnctcntnctgtgtctgagcgctgacgagctgtacgactatctagcctgggtcctactacttatgttgtacttacgtagctcatagcggtatgtactgctctcgcacacgngtcctacagatcaatgagcacgagagtggcatcgcgactagtactatgtacggtcactgacatagactgatattacgtgnacgacatcctacacactcacagtgagcaataatagcgcanagttagcagcacgcgtgattagagcgtgcatgctacagtgacacctgactccaggagtcancacctancgcagttctcgcctctcgntaatgagtccgactgctaattgattatactagggtgcatggaggccacgtcgatcgagactcttcattgtgtctgngttgctgtttcttatgtgtgttatctatctctctgtgtagttctcgtcgctgagtgctcttcttgagntttcgtcttatctatacaccactctagttgtgttgttcatttcgtctctatcattaaagtacacttacctatattaagctctgcaacaggtgcgcgcaacggacgaaacaacaacaacacgataccatctagatcgactcagccgtttcatctgcgtaaccaattcgctggttctctttcctccatacaactgtacatctacagttgtgttttattagtacgatcgagtcatttattcccgttactgactactctgccctcctctctgttgtattacgtggcgcgnctcacgactcgaccactcttacgccgtcctcatactacagaacttaacattattaataaattccgccctacaaaaatatactaaataatgatgtgggtcctccgtctgcgaaatcctacgcgtgtggtagttgtttttccgatgccaaaannnttntcannctntctttctttcttcnttattctttcctcnnattca

SEQ ID NO: 12433 - DNA, 251 bp, Homo sapiens
  misc_feature (1)...(251): n = A,T,C or G
cagaacaggccccacaccaacacccccaaacagaaccaccttcagaggtaaacgnaccagtnaccgtttccagaanaaaacggtcaacaaatgtatgctgaataagaaatactaattactgctgattgaagggagaagccagacgtactgatcataaaacaccagtgaataaggctattcccaccactgaggcatactctgggcaacactctcaacatatcaacaccgcacacacccgacaacatccgcag

SEQ ID NO: 12434 - DNA, 682 bp, Homo sapiens
cttgagggtccgattaacgaaccgtgagggccgcagcggggggtccgtgtccgtgggtcaaggccccctgtttgttgtgggccaagggccgttctgaacaggctcatgggggggggaccacgtttgggccacgaatccggataatttcttctgatgcgcctctttcccgggccgtatgtgggggcggcaaagaaatacgtgggggtttggtaacaggcgcttttaggggcgggctccggttctccgttccgtccctgaacgaagtcgcgggcacgagtagaggggggcaaattaggtaacggcgtgtgggtagaggcctgggcccgtagtttttttctagacccccccggtgagagggggtttccacccccggggggtgtgggggcggcccatgcgtgttgtcccgggagcgcccccgacaagggttgggtgggccccttcggcatcgtctgacaagcggtaccaactggtaagggggctgcgaatcacacatttgaaggggacttttcgttgccccggcccaatgtcacggagtcaattgatttccgtacaccctgtttatcgttgcccggagtttgttgcattccttgctcgcgtaacttggggtgcattcccccatttgaagacattaatttcttgtcatttcttttaaaatacagagtgaaaacaagaacggaaaccc

SEQ ID NO: 12435 - DNA, 168 bp, Homo sapiens
  misc_feature (1)...(168): n = A,T,C or G
gggtgttccgtcccaacaagcgtcaaanttttccaggttgttcaatggaacaacgggtgtcacaaggggttggcccctcttcccagagtcccccagcccacccgtttttttattggcataacggaaatttcggatggggcaatttatcaagcgggccaaagattttgt

SEQ ID NO: 12436 - DNA, 1642 bp, Homo sapiens
  misc_feature (1)...(1642): n = A,T,C or G
caaaccccaaacaccacaagnaacaacaaaccgcacagcacacacgtttttttatcatngtctaaagacactgataaaatttttttttagcgacatncaaacaaaacgaccaacaactcctataatacggcaccaaccatttgataataactatacacaggatagaatacgcatacttgtacacgtgtccattttccccacgtgcgcgttaattagtcttctaccgacgcgccgcatgactcgaaccgaagtacagatggggacttgcggacaacaggaaattgtagcgcagacgtggcatatggagatagcatcgtgtgatacgcactatgtcgagaacgtagactgccgtgactacccacagcacggaacataagacgtacgacagtgaaacaaccacacgtccccctctaaagccaacaatgagcgcaggggacgtcgaacagctctagacgtgaaacagaggatagaatcccacagtctcagaaagaacactcaacaacacctcacactcctgttcagcaacaacacgaacccaatccaccgactctcacaactgcttacgcaccatagtagcggcccactcgccccgacatgcgcgtagcagcttacctagaaccgccgtgctgccgcgccgccgttgacgatcgaggaatatacagaccatgccgccgtgccgcacaccaccacatttatcacgattccccacacaatcacccccgcgtccgccggtcaataagcagtacggtataagttaccccgcgccagacctaatatctttatagttccaacacctacaattatatcccattactcacatgttacttctgcgtttaaacancacgtatgatcacgcgcgctaattccgcacacacacagcatgtcacccgcgcgcccaanatataccagccgcgctattccccgcgtataatctataagatttacgccacgccgccgcccanacagccccgtcccatatatatcaccaacagttaatatataattcgcgaccgcagcccccgcnggttacgtcatatcgacgtactggcacgcccataacccgacgcatcccccaccgcctacataccccggcccagattgcatgcacactgtcacctnacgcaaactcacagcacgaacttcccaataaaccacggcggttcgcgacgcgtgattatgacgcagattcgccagccacaattacagtacgatctcaacctctaatatcatcactagcacgatcaccgcatttctaacacgcgctnacttaaatccagtgcgcgctgcgcgcccatgtggcgagtaacatgatacgccacctaacctctcctccgtgtcagcgcgccagaccctatctactccgcatgctcacgacatttagtgatntgcttctgctgtttctatagattaccacacgtccattacatatgataccaccaccgagacttctctcgattatgtactcacagcatacgacaacgaccatcaacagagactgagcgctacgtcggcgccaantttgatcgatgttatatcangntgctaccgcntactcgcgaccgactgtcgcccatatatcttatcacccaatcattctacaccttccccccggctatagtataactccatagtatatctcgcg

SEQ ID NO: 12437 - DNA, 880 bp, Homo sapiens
gaagaaattgaactacaatgcacctgtggggcagaccctacctgaaggcaccccagagatatcctaaattgggacaagaagattgggtctttgaacctctgtgaggaccaattttgggaagggggctggccctaagagaagttttaactatgacagaagcctttcaatgagggagttccttgagagtctcacctgtgagctgccttccaggattgaatgttaatttagggcaaagctacagcatccactgcataccacccgctgactagttagaatccatgcgctttgcatgatggagtctcgctctgtcgccgaggctggagtgcagtggtgcaatctcggctcactgtgggctctggctgccggggtgtggcagttgtgctggctgagcctgccccggtgccgcctccacccgtgacccgcgcccgtagccgattcacgtcccgcttctcgccacccccatccccctctttttccccccgttttcctccgtccccttttcttgtccgatcccctttcctccttccccccttttttccgcacccccgcgtaaccgcgccccgcccctcgcccctatcgccccgtttgccttcgccgtctccccccttctttcccccgcccccaaacccctccaccgtatgacgcccctaccccccgctccctttccccgtcgtcggtggccctggtgtctcctggccctcttatctcttccgcccgtatggcttcgccctgttgtccccacgtcgtccacccgttttttgcccctttcgtcctgtgctccgcccaccgcgctttcttttctccgcccgcttcttgtaacccgaccgtttccgccctctcttgtcttcccctcgtcgttccccgtcttttcgcactttcc

SEQ ID NO: 12438 - DNA, 406 bp, Homo sapiens
  misc_feature (1)...(406): n = A,T,C or G
cctagnaatttcataaagattccatttagaatagaagaagaagatagtgcacaaaaggatttggttagaaattgaatcgatttatggcaatgaactgcttcctgctctgtatcaagaaatgattcatttggctgaggatgcacttccctgcaaaggggaaaccaatactgtgcggtggagacgcctaggttttgaagaccaacagattgagctcaattctagcttaaaaatttgctacctgtataaccttggtcagcacctccaaatgtcaattttattaattgtgatttaccttttatttaatcaacaaaaaacgcttaaggggcaccttctctgtactgggtattattccaactgctgtaaattcagcaataaaagatacctgtccatcacaaaaaaaaaaaaa

SEQ ID NO: 12439 - DNA, 1101 bp, Homo sapiens
gaaaagaataaaacaaaaacacaattaaacccccccttactttcaacatccgcaccgcctcgtccgattagaaacatattattcttcaaacacaaccaaaagaaatgaaccccactcccccctgctccgccattgtatttacccttctaccccaatcgctcctcacaataatcataggccatgctcccctcggtctctattaatttatgatccaagtgtaccacaccagagcgcgctccccacatgaccccaagttccatcaaccaccaagaacaaagaaacaaaaacaaatattaaatgattcacaatcatcccaacatttttttttcttccttgttccttttcgattttcttccctctggctaaaacactacaacacacgtctatgaaaattaacctcaaataaaccgccacatcaatccccccacacctattcacccccgatggaatacacaaatctatataccctccctttataaattaacctcgcctttatatcaacccccctatccatacacccccagcataatatttactatttcctttctcgtctttctctttctctttttcccgacccactctcgtcgccgcgctctccccctccattcctacttatcccactcaccattattaattatagatatcacaagcaaacaacaccaccgatctaccttaactcacataacacatacccaacttatcccctcacgtctaaacctaagcaaagataactacagaccacaacgggtcaaactattaagataaatcactcccagcaacataattcacccaccccccatctcaccacacccctaaattatcctttcacccaaccgacaacgcgtatcgctgttccctatattttttcacccccacgtaatctccgtctcaacacccctacaccttccacaatatactaaccgcattatcacccccccattcacttaccctataataactacaacacccgcctccaattacctattcaataccccgtcaatcctaacataaatattcctccacttactctctctcacttttatccccattaatctcatccaccatagataaataaccacacaaataatcacccaccccacc

SEQ ID NO: 12440 - DNA, 293 bp, Homo sapiens
  misc_feature (1)...(293): n = A,T,C or G
ccgtccccccaatattcccttcccgcccccccccncaacacctcaaagccacacaancccagttctgggggaaacangcactctcgaccgacctatgaaaaaagaatttacttgggaaatcaaaccgaacttcaccttccaccactgcgcaaactaaggaaaaactcacagcagtaaatagctgcggttggcaaagctgctttggctcaggagcagctatcaggccttgataaggtccacaagtctgctgttctaaaatcaatttttttaaaaaaatggcctcgctggcctca

SEQ ID NO: 12441 - DNA, 1112 bp, Homo sapiens
  misc_feature (1)...(1112): n = A,T,C or G
gacgcgcccccacagccagatcggacaggagaccggaagagggaccctcggtaganaaaccccggnccagggaagccttgntggnnnnnaatctncccccnccnggggggggggggggggggggggganaggtgcncttgacgggagggtttttaaacacccttcgttccgnggngagagaataaatttaaaaagagaggtgaagccactcacgggaacgcacgggcaccccaggaggacacaccaagcaaacaagcaggggagcgaagcaaaaggggcggcacaaaacaaaacgcaaaggagaagcgacaaaagccccgcggcacacagggcacgacacgcgctttttatctccactctctcgcccgcgggcaggcaccggaggaagcattcgagagcgggcgcaacacacacgagcgaggaggggcgagagaccaacggcttctcttagaccgctcgacggccacgaacagcngagcgccatacccggcacacagacacccaccccccgcagccaaccaccgcggacgaacaccacaacaacaccccaggcgccaccagaaacgacagaggcgacacaacacacagcacacaaacacccacacgcccacaccgcgcctagcggcggcacaggagacggccgacaacagcccagcacacacgcagagcgagcgcgccccgcagcccgtagacacacaagacgagaaccacgcacacgaagcgcacacaggcacacacgaaccacggcacgcgcaaccaacaacgcgacgcagccaccccagaccacacccagccgaagaaaaacagggacgcaaacaccgtaacgcccgcgtgccgacgaacagcgagtgccgccggctactacacgcaaaccagcgcagcacaatcgccacggagcgtacacagcccccaatccgcccgcgccgcgcgccaccgacggcggagaggtacgggcgcgagagcacaccagcgaagggcactgcaccaccccagcagggaaacatacgacagagacaaacaagcntccgccggccccgccgcaccccgaccgccagaccacacagccgacgccccgccgcagcggtaacaccccgcgcacggacgacaacccg

SEQ ID NO: 12442 - DNA, 1387 bp, Homo sapiens
  misc_feature (1)...(1387): n = A,T,C or G
ttacagacatggtattacagtgaagtaaaattaaaaaaggaaatcgcgaaagttaatcaggaagcctacaaaactgggaggttctgccaccagatcccagcttcagaaacgcgtggggcgatgatagagcgagaagattcatataaagaggtaatctcacagcccacgaaacgattgaggcatagagaatagtaaaattctggagcgcccagagacctctnatgctgataagcatattngagttgatgtaacatatcgcggcaagaagcaacggaggctaaagctaacaatatagagaatccgcagccaatgagacaggtgatccgcgtactgaaggagcacttgagcgctgtagtaatatttcaagaagagaggatatatgagcaacaaagtgacgaagaaccggatatatttaagcgntcgtgtgtgattgcagagggaacaactagtgccaagagaatacgcggaacgagaggataccagccacacacagataatcatatagtataacattcagtcaagccgccgtccgacggtgagtaagagtatactgagcgcagtagtacgtctatcttagatcagtgagtcatgatcncaatgacatcaaatatattataccaagagaactntgcgcagctacttccgtcaattaagaggcaggcggccacgagatgagccgagagtcagtgnacgagataagtgnctcatcatacacatagcacatgatgcaccgagatgtgcgctgcgtctctagtacagataatacgtaacgcatcgcgagacacatgtattagcacatggacgcgtagtctatcgactacagtcatgagagacntcgcgcgacncgccgcatgcggataggaagaggcaatacacaggagacnctcctcactcagatagacgagtgcgtcatgagctctatcgaangatcggaccncagcgagagacagcactatacagcgtatatcatcacataagaaggtaacacagcacacatcactcagtgttgacagcgtagcgagagatgagacatgcagatgagcncctgctcattggcactccctcgtccgagctactactatcttgaggtcattcctatatcccatctgacgctgttgtggctagctcgtcattcgagtgcactttatcgtcgagtagaacagacaccatcacgcacgtactacacagaacaacagtgtgagatagagtcagcctcaaagtaaacncagctgctctgcttgtagcattctcctnattcgtacacgatagagaaacgacagacggatcggtactcacagacgagaaactcacgntcgagtgtgacgtaatagaggtcntgatacggcaggctgtgccgagatgatcacgcggcgagcgtgtctatgat

SEQ ID NO: 12443 - DNA, 1145 bp, Homo sapiens
  misc_feature (1)...(1145): n = A,T,C or G
cacactacgcctaacctatgatacccaaaacgccacacacatcacaattttgctacgaatcagacgcactccatcctcttcacgacgacgcaggtcgggcactactctcccagaaggcggttctcttccacaccgtaaataagtgataatttattccctatccaccatgaatgcagtacgcatgcgtgcattaagttaccgatcgccgacgggtacctgccgcgcacggatctaatatgtatagataccactatatacgcccgcgcgttatctttccgaaccatgtcaccgtgacataggttagtatcatgcccgcctgtgttcgattatctccatcccgtgtttattacatctgcttgaagctatgattacagataccgagtggtcagcgaatcgagcaccaatgtctgagcacacagtgccctaaatcattacaactgcgctgtctgatcagagttcaccggatatagtttcctgcacacaatccctccctaatcattaactagcatcagagtaaatagctaacttcaccccactacaatcatcaaccctcaatatagatcttgcagtctagaccatcttatagagaatacgagccaaacagctagatgacgaatcagagtcaacgactctagtatgacgtcatcgcacgtcagttcgtgtccgtattctacttgttcaaccgatgatacctttatacgcagcgcaaaggtgggagtgaccaagcagcgagatgatgagtgtcacctcctccgcgccaatattgcgctggctctggtaatgctaatattaggccacttcccgtacacctgcccctatattaggcgcgccgcgcacctaccgatagcatccgctctcagatctcgggagacaccgcaccagaaactagcacagtgaccgatacctcctcgatcctacaccgtgggacgacccgctgcgacgaattagatgtctcgttcaatatttacagtatanctcagttacactctccagagtctgcacccgccgagctacgacgaaactattgcaccgttataatcgcgtgaccgcacgacagccatagcagcccccagtcgttcgtgtttgtcgtttaacgcaacacacggtaggcaccccaacctcagctgtgtgcttactactcacag

SEQ ID NO: 12444 - DNA, 469 bp, Homo sapiens
  misc_feature (1)...(469): n = A,T,C or G
ttttnnaaaataaggcncccccccnannnattnttnttgggacaaaggtngttccatgngccntggntnccncaccaggggggtattttgtttgatagggggctcctnntaaaaaactgaaaanntnttttnttaaaaaatnnnanaacccctcttncttgggtacaatttttttttaaaattggcaagccaaaanncnantccccnaaatagcnctccanagancnngtgnngaaatnttgtttaacnnctntttaattttcccatcngccntggatccgaattntagncntngtnttttnaatattcnnganaaataganggctggcnacccatgggctntganacagcgcttcaatgtggtaaaataattagaattgtcatatccactctttgtaaaattatgaganctgttatttattaatagcaaatgtcataacataatccaactgttattttcctatctaat

SEQ ID NO: 12445 - DNA, 932 bp, Homo sapiens
  misc_feature (1)...(932): n = A,T,C or G
atttttacgctgtcggcccctaccgaatcacaagtgaatagaaaaattccataaataccacaagtcaaatgaacttaccagccatataggtatatgctgcatgggaggcgaatacgcccctcgatagacaacaagggataagacgagaacagactggtccaggtatcgtatagatatggacatatacaggcaaaaataatgaaagcaacccnccgttcagttgtctcgatgaggtataagaggggtcaaccattgtgtgaattacactaataaaacaagtctcttaaatacgctttaaagagggttggcaaggaaaaccactcagaaacgggtaagcttttggaagtcccactgacctagctcgatataatccagcttaaccatggggagataatagtaaacctccaaatcagattgccctgtaatacgcaggagcaagtccagggtaatacaaagaagctgcatctcctcaaagacatgcttattctcgtgaatgtaatcgcagctgttagtgggttgacccttaaattgatccgaacatctgtctccgaaatgttagaaaccctatcagaatgatgatttctgtgaatgtagcttcatttaacagcaatgctcaggatgtaagctgttttcagcaccttgtccaagcaaatgtaagaaataacaaagtgttgaaagacgcggtgaataatatcacagccaaaggaattacagattataagcagggctttagttttgcttttgaacagctgcttaattataatgtttccagagcaaactgcaataagattattatgctattcacggatggaggagaagagagagcccaggagatatttaacaaatacaataaagatggatgcggccgaacaccgcggtggagttccagtttaggctctccccctccccacttatctttcaactggtggaga

SEQ ID NO: 12446 - DNA, 282 bp, Homo sapiens
  misc_feature (1)...(282): n = A,T,C or G
ttagcanngaatcgaataacagcaactaacattggaggaggacttgtctgggagagcagccattttaaagaagagcacattaagtgacaaacagtcgcagctgatctactttgcagcatcgccatacatgcctaactaaatattgaaatcccgggaaaaactcactgtgcatcatgttccagaaactagctttgcaaacagtcttttcagatgtgtacattttgtgtatttgaggcatataatatatatattttcctccatgttcacccaaaaaaaaaaaaa

SEQ ID NO: 12447 - DNA, 163 bp, Homo sapiens
acaacaggacacaagcaacaaaaacctcaccccaaacaaaaatctcaatagcatgtaccgtcgtatatgtcacaccagactaatgtgtatgttcaagtacgaggctctacaatgattctgtaacatgcaactattaaacaccaatggcccaaaaaaaaaaaaa

SEQ ID NO: 12448 - DNA, 822 bp, Homo sapiens
cgccgcacgcgagtggacggacttaacctgacgagaagacaccccaactcctttacttagacctggacccctaccttttaccggtaggaaaaaaagtctatttcgagatgaaacaaagactttaatataacacctagggctatgaaatggcatataacgaaaacctcagagaatacccgttctagactgtcagcttgtggcaaacaattcatagcgtaagggctcaaaagcaattccaaccaacagaaaactggatcagctgacctgattaaattaaagggttcctgcacaatagaagaggctatcaacagggtaaacagacagacagaaaatgttggccggctatgcgggcaacagagacctaatacccgctatgtctaagaaacctcgtcagatccaccagcgcagcatgaaccgacctggtaataaccgggtaaaacaacaggcgcaggctgttcttacaagacgtacatgccgccctccgacatatcaataacccctccatagcaccaggcaggaaacgaacggccatgaaaggtagggcgaagtacagaacagaagcagagaaaatgggtactctaaggcgtaccacatccccccccgccacaacgtcagcaagatacgggaaaccgcgcacatcgctgcgcgaaagcacacgtcccgagtcttgccgacccacgcgccgtcaccctcgtcgacgccgctgcagcccgccacgccgcccggaagcgcgacgcgggctccacgccaaggaaaccaactatcccctaaccacccacagagacacggcgcgcgcatgccccatgcccgagcgcgggacag

SEQ ID NO: 12449 - DNA, 883 bp, Homo sapiens
cctcgctctccttctccccttctttctactcattatataacccacctcaggtttcctgagtgtgacatacatcctgaagaggcactcagcacccattctcaactccttctggagtgtcttcctctactgcagaggcgggaactctgagagccatttttccagtctcacttgcagctgaggttctaactgtgaattaggttcaaccaattatatgcatttgcaagagatttggaagtcagaatggaggcagaagccacgtactactgattggctgtaaacactggcaagcatgattgtggtaacaccggggctttctgaccccatgtctcacagttcacccactgatcgcatgggagtccacagacatcacagcggcggtgacatccctttctaatgaacatattccacttaaaacactgccgcctccggtgtctctattcctcactgacaggcctcttcacttcatccctttattagccatcacttcagtatttcctacatgccccgctcttcccttccatctctctccaatcatactcccccccccccgttccccctctccacctatgacctatcttccctaactataacttcgctttctttctcttattttcgcccccacctcccctaccctctccccgcgttacctccctactatcccccaccctccccccattcctcatcccccctcttattgactccaccccctttattccctccaccgccccacgccaccaccatccacctccctccacctctaaacttgcccctcgtgcaactccgccaaagcagcacttccatcgcagtcgtcgttcgcggtccttcacccccccgctatttccactattacaacgtcgccctctatttcactctatcaccgccc

SEQ ID NO: 12450 - DNA, 370 bp, Homo sapiens
cctgatgaacacaaactaacctaccaggtcaactactgcagagacagaggagaacgctagtcggtcaaagcaactttgcttctatgcagtgtttctgcactcccttggacatctggaaatcactctctctatgcttggaatgtaacttatacataactctaatacagtacctatcaaactgtattacagttgtcttatctgtaacaaaacctatttattatattatatattactttaaaatgtttcatttagatatcttcagtatctagcaaagtgggcagtgggtgcatacttagtttgctgagtgcctcctaaatctcagcatattctatgttgaataaatatttatcgatacttaaaaaaaaaaaaa

SEQ ID NO: 12451 - DNA, 1206 bp, Homo sapiens
  misc_feature (1)...(1206): n = A,T,C or G
gtgagggttaacagaggttnanatgaggtnnacggtgtgtaagagaagcnaccagtgtttatcgagtgcctagagagggtnacagagcgtgcaggtgacgcgagcgtgttcaggttcgtcgtgncnctatgcgcnnccagagagtgtgtaacggtgcgcntcgtattgcgtganagcagcggataggccaccacacaggtgactcgttctcggttatgccgagattgcaancagacgaacgggccantagtgcggactagcaggtcgatagttggctatatcgtagactaatgatgataagtagtcatatgtnnactgtaatgatataactccgatatantccagacgtgttacaaccttacatgctatatattgatcatacaacgcaaatattatcatacgttaagtatcntcgtagtcgagnggtgctccggatncctcacccgccttcactttaagttcatcagaccctncctcacctggaccccctcgacgcgatcgagagaggacggtgtcactcgtgggaagttaaggagtgcntctggatgtttaatcataatgtctcctcgcagtctgctgtaccatgctcatcagttatcggacccccctgtctncctcgcattggtgtccagagtcttatgaatcgcgtacgccccatcagagaataggatcctgctcgtctaacgacgcacctcgcccatggctccaacatcatgcaaggcaacgcgccctcagatcctctgcgcgtcacccgcccccaccggcacacctctacccagttcctagcggctagcgggccggttccgtacgcagcncaacgcgaggtgataggactgttctttgagagtgataagggctccctcacgctatcgtgagtgccaccgccccccgccccgcctcgcgtactccctctccaacgcggcgcccgcgacacccgagcgcccacaccggacactacggcacccgttccccaataaggacccccgatgtggtagcgtcgccgagctcatcgtcctctaagggttncaggaaacagctagaagggtacgtaatgtcataggacgcacccnccgccgctaccacagtccccgtcccacccaccacgctctcccggtcctcacatgcgcctctcgcctcccccccagagtccggcggtgcccgccacccccccccctaccccaccctcagctagtaatgattggcact

SEQ ID NO: 12452 - DNA, 747 bp, Homo sapiens
tgctggtgcccgtgacaacggtgctcgtccggagacagcgagccttctgaggccgcctcagccatgacgtgtgccgagctgaaggacctgggtagactatgcgaacatcagatctctggatctgccaggacactgaagaatgacattgtaacttgtggtagtgatgtgctactccatacaaatagaggtgagtgattctgcagctctctcatacggagtgctctaccactgggatagatatactggagaatgcttactgtgagattggggatctaacggagctgactatcctctcctaagcatagaacctcctacactatcatgaggaccgatagttttcgtgtcgttgctgctgggacccaaagatgggcatctgactctctggaccctctcttttgaaaggggaaccactctccctggtagtactacctatattaacacatctgagctggagacatcaaaaccttagtggtgcaggaatgtcaatagctgccttattgcactaattaagtcaagagagatccttaacttactggtacaacatatacccccacaacctccttaatgacatgtaggcaatgccagttaggacataggggtagaggaggatctccagggtctgaaaccaaaccctttgagaacaccagcccgtgttggcagatgggatctattgactgtaatctgggactttcagacaaggaactgcggtgacatggctcccccgagccacagagtggacagaagttt

SEQ ID NO: 12453 - DNA, 757 bp, Homo sapiens
atgtttagccctccagactcatttgagcggttctttcaggcagaagggattgagatgagcgcccctcgacaggttgtctgaaaagataccgaccgaaaagggagtgaaaacttctcgcacagtttaaagacatacggggtcaagatagaagtgtttatgatactacgatgtttttgctatggccctgatgttgaacgataaataagatcagttggggtgcgcttgtggccccttacctcaggatctcgccgttcttgtgtccgacgacatagaaggcccgtcccttgtattattacaaggttgacacggatatgttagcagagcaatgtaatctggttcccctattgtcctgcattgacgacttttaaccaggggcggctttcgtagaagtattggcaaggtatagggtcacggaggtcgtcccctttagttcatatagtgggtcgaggacatcattcctatagctccaccgggcgaaggcggctaggggtcttctttgccatgcgggctacatttgaagtgctttaggcttccgcgtctgtatagtctcccattaaagtgggcactcaacacacagatgagggtcgccttcttcgtatgcaccttctacctggagggactcttaatccgacgggtctgttaaatcttcctatgttacaaagtaacaccgtctcacccccgtcccgaagtggacgtagtgtatattcagtctcttgtcaataaaacaagtttgttcctccaaaaaaaaaaaaaaaaa

SEQ ID NO: 12454 - DNA, 794 bp, Homo sapiens
ttttgtacaatccctccgacaccttagtaaccataccctcgatcggcacccggaatagtcccatagaggcgccccacggtctggaacacggtaaaaaaagatgcccacttgtaatattggaaaagaaagttgctcgcatcaggactgtttttctccttcaaagatcacgggtcagttggggcttgggtggtaaaggcatctttcccgatggcccttgattatcccccttaattaaagccccaggctcgtggtgacttgtgctcggctgctgaggggttatcgtggttttctgggtccgggccccattagggacaccgcccttggtatgtgttagacggtcgaatggttgtgagttagggattcatgggatccggtgccctaaataatcctggattgagatctttacccaggagcggcttttcgttaagtgttgtgccctggattggttcagaaaggtcatcccactgagtttatagggagggggggggatatgtttcatatagtatcgccagcaacgatgaaaaagggttttcttttccatggaggttccatgttatttctttgtatttgcgcgtatgtctagtcccccccccccctgttaacatcttcacaaatattaggagagcattcttggtatgagtcttttacctagagtaccttaatcagaggggtttttgatatcttcatatgttacaaagtgagaacctctcaccgccggttcattagtggatgtagtgtaaattcccccgcctctaaataaaacaaggttagtccgcaaaaaaaaaaaaaaaaaa

SEQ ID NO: 12455 - DNA, 798 bp, Homo sapiens
  misc_feature (1)...(798): n = A,T,C or G
tcaaaattcattcccaatcccgtggttggaggttccattctcataggtagtttttatctggtgggcagaagtcgcccagtttaaataggagcccatttggcaatcaatggttgttgttccaattacttgacgtgcagagggcatcaagtcctttgcccatgcctatgtcttaaatggtaggacgtaggagttcttctagggttctacgggttctaggtccaacatgtaagtctatgaatccatcgtgaacataaccatggcatagaaggtagttctagccagttagccatcacctgagactaatgaacccagaacagcctgtttctttttggtagtactaccaggaagagtggttctcctgtgatatggaaagatcaagaaattcagattttatttctctactctagaatcaatgtacatggagagcagcagtcctaatgctgagtctatggtgcgagtgctgctggtgctcagcatctgctcaaactgctcagtttgctcttagtaagcacccacatatataggaaacccatcgggagggaactcagtctaagagagcaaaaaggattatcaactgtcactgatttgcctgggactgcccagaattttagcgtcaagtttgtcattcttgggatcttatcagtccagcagactggagaaagttgatcgtcactttgggtacaacagctgtgaggactgttccaggagtgcatgggtgaggagacctcaggaaactcacaatatggcggaagcgtgcaagggaaagcacgcacatttgggccccacagtntggccagg

SEQ ID NO: 12456 - DNA, 1036 bp, Homo sapiens
atagagagggcgacaactaagaaaaaaacgagagaatcttctgggaaacttagagtggagggttaagaggacagaacaaagcggcgatatttacgggcagaccgtgccatttacagggcacaaaaagccgcccacgaagacaagaataagccgctcaccacagaacagaaatgagacacccagcagtagcgcactagactagaaatccagagagcgcagtcgacacctaccccccccctacctgctagcgctccacgacgcgcagaaactacaaaggtcccagccccacaaaccgcgaacgcggctacggataaacgtagcagatgacgcccgcggccgacgaacgactttaaatccgtcagagccacgaacggaccacagaccaagcttgaacgtaccaaagttataggaagtgagcaccgagctcagcgcagacgacccacacgaggcgtgtgcccgcaccacagcccaacacgcagaacgcggacaacatgaaagcagaacccgaggaacagtaatcgctccagctccgcacgtgatccgtaagtgacccacacagtctgggaagtaaacatctacgctcagctcaccgtcaggactaacactgaagcaaccaaggacggcaacacacccaaagtagagacacatggtccgccccgccaccacgcgggcaccgcccgctacatcgcttatgggcaccgcgcgaccggccggcgttcaaccacccacttaaagcctcgatcacgcgccactcgacaacaaacccgcgccaagatcggatgcagagcaccgcaggatctccacgggattattagcgaaagatatctctcacgcgcctctgcgtagagtacatgttaagacgcatcagacggacacgccccatactcacacgctcgtggtatcaagagcagagcaggaagagacacataatatctggctgcgcactgcagacacacattcgatcagtcaagcacataatggcgacggacgaaccgaggaactcgtctatcgaacaactaaagccaagagcagcaac

SEQ ID NO: 12457 - DNA, 1515 bp, Homo sapiens
  misc_feature (1)...(1515): n = A,T,C or G
gaacgagaaaggtggnaaagaggagaaagcgagacgacctcaagggagaacaagcacctgcacctcgtccaaaggggcggaacccgggagagcgccacacgcaaagcaggcacaggaaggatcttttacgaaagagaagagagacaccacaaagaacaggaggaccgacggggacagccggggccccgcgccgcgggccacacgagccacggagagcagcggggcggcaccagcgaacgagagaagaaccgcaaagcaacgaggggccgaagagaaagacaagaacgccaacgcagatacggggcggcaccgccacacgcctccggttgttcgaccgcgcgcgcacgcgcacgacggccccgacggnggataggagcggagcggcaagctccggagagcagtaactacagataacgaagcgagaaggagaggttcaccgcgancacccggagcgagcagacgacggacgctacggcagacgacgaacacagaacgtaggagacaaccaccaacaagaacgcgacaagagcacgacagcgagcngaacgacaccaggtaggtgagccgcacgaggagagaagacatcaaacgagcgacgacacagcacgacaccggagagaacncacacgacagaatagaaacacggcgcaacgcacgaaccgacnagagacgaaacgcggatacggcagcaaacacggacacgaggcgcgcgacgccacaccacaccagccccgacacccgcattagcnacagccaacgcggcacacacggacaacacgccagccgcaccaacaacagacacacgagagcaacangacgccgacggacgacgcgcacgtagccggacgcagcangcgaggagcagactcacgcgattcctagcgccagagacaacagaccatacagacgccacacaggtcagaggaggcagacaagaggacaacagncgcggcgtaggcaacctctcgacacgagcacacgacatctcgacgagggtcgacaccacgagacgcacaagacgcgagnaagcacgcaagagagnagagcagagaaggacgacagaacgagcangagcggtgcgcgcganaagacacngatacgacatccacacgacgagaagagagcgcgcacgcagacgacagcgaacncgacgcgtagcgnancagagcgagactagngtagcgacgcggctgcacgcgancgaccgcgcgaccgaacgcacgcgacacacgcaactcacacgcgagcgcantccagcacgccgagagaactacatcgtcgacacctcnaccaacgcgcacgcgatcgcagcagtagcgnnctcgtcacaacagcagtcgcaagatgtacgtgctatcgcgctcgacacgacgacgactatgcagaatgagatgnacacagtacagtgcgatgagagatacgcgacagacccngcacgacacgacatgacgcgcacctgcnacangcacatcgcgcgcgcgntcnacacgancaagcgcgacaagtgaacgccgc

SEQ ID NO: 12458 - DNA, 771 bp, Homo sapiens
ctagagaagtcttcctcacctgtttagtatctgcgctgcagttctacaggaaagaggtctggatgcttggttcttccctttatttaccagtttccagggtaacgtattggtcccccagaagctccaaggaggacaatgaatattggttttagtatctttatgaacgcatggatttttgacatatttgaagtgttttaatctcttggtttgatatgatttataacaatgttcagttcatcccactttagtcagtagaagcctcattgagctgactcctgactttctaacatgactctcaagctctgacggtgttcttgccgtcagtgtgacaagacattccaggatcttgtcataacattttcttctatgttatttttgttggtgctctgaaggttcttggttaactcacaagagcagctacattagcgtgccagattgaagatgcgtcagactgtctgacacgtctaccctgtctggggtaaggcagggaaattcaacgaggaaatgggctttgagatggataagatcatgttttttgacgaggcttctaagaagaaagcgggagcaacaaactgaggaagaaccctgggatttcacgacctttgaccttcttatttatcccttttggcctaactcctcggagaccctgtgcccaatgttctccaagggccttgtggcttcatcaagaactgcttgttacaactttttaatcgcgataaagggttcgtcccagggcacaggctgccttcggaacataaacgccagacctcg

SEQ ID NO: 12459 - DNA, 905 bp, Homo sapiens
agggagattcacggaggcagagccccatcatcagaataaggaatgcctgttactatgcatctaacaaaggactaaaatccagaatctacaaggaactaaactcaacaagaaaaaataatctcattaacaagtggggaaaagataggaacagacatttctcaaacgaagatatacaagaggacaagaaacataaaataaaatgctcaatatcactaaccgtcagtgaaatgcacgttaaaaccacaatgagatgccacatcgcaccggtcggaatggccattattaaaaagtcaaaacaccacagatgtcgacacagatgcagagaaaagggagcacttatacaccgctggtgccgaatattaattaatccaccctctatggaccaccccactgacatccctccaccacataccattataccgacactccggccccccacgtactatacatgcgtctcacccctaagaccccccaccccttctctccttctcattctcacctatatctccttcacccgcccccacccacattaccatcgtgccgcactcgtacctctccttatcttcccaacttcttatccaatcataacctgtgccacatccagccctcctcccactccctccgatatgccccattgccccactgcccacccaggtactgcgctagggcaatcctacagcccacataattaacccagccacatccctagtccatctgaacgtattgtcatagccctactcccctctacaccttctctatccctcccatcctcactcctacctcctccccacctttaagcacaccctcccgctaccgcctcaccacgccccgtatgattttacaaccactctctatccctctctactccccccacgctcctcacggtctcctccccctaccccgcc

SEQ ID NO: 12460 - DNA, 1431 bp, Homo sapiens
  misc_feature (1)...(1431): n = A,T,C or G
ggacaccgcagccccgcataagtgagacaacaccgccaggacccgcggataagaagcctcacacggatcccattgattgggtgctataccgctgccgccgcatggatcatttataattttcatcccgcccgcgagtaggcccgcgcgcccattgttgcccaaacacagagggatatgcccgcgcatagtaagcggccgttgggcgacgcggtcgcgcgatcggggggatccctaggttctcgttcccgaactcccaatgcttttcgctagattcgatccgaccgacccgctcccactccatcagcaatgccgtgtgtgatttgactcatcattcggtacttctcttattcgcgcaatcanccacccacaactaaataattcaatccaacaccacacagaaactcatatttcgcccacacgtctcagtattctgttgttctatcagttcgcacttcgatcgcagacgaatagcgaggacgcgcgtgtgcttctccacctcttacactaattctctaatgcctgcgcactcacgtcgtcgtacgtttgcatgagcactgcgcgaattaaacagtaaaggataaaccagactctagacgcgccgcggctgcgcgcgcgcagccctccgaactcgcggcatccacaatcgtcanatcactcacaacgtagacgggcgacgccacacacgtcagagatatacgtccgtataacgcggcacgacgtacacggtgacgactctacntgctcggtcgcggctcggcgtcacgcgagtaatacgacacccacatcacacgatgctacgactttcgtatattaggcgtgtcgcacacactcacttcactactctatccgcctcgtaccacgtctatagacgcctcagtatgacaaaatanacaactatccacacacgcaccgccccgttccatctatattntgtgcgcactcgagaatgcatctgctcgtcatgctcgcgacactcgtatattatatcgtgtgtctncgctggccgctactatgtagcaatgtcattacctacactattaccgccgcaactcaccgcgactacacgaatagcacgcacagtgctacatgtanatgcnagtcntagtttctatggtatatcgtcngagagatataatatctgtatccacgtaccagcgcaaccgagtcntcgcatatgctaataccgccgaggtagacaangctgtctgcagcgatctgagcgcgtctcacgttccgtcatatgtgccgatcgttctcgcgcagaccgcgcgctccgatctcgccgctacatagggttaaccacgtgagctgtagatcagctctcaagacaacagctggacacattgtccagacgcacccgtcgattcgatcgcgtactatacgtactcgcgtacaacacgtatactctcggtcacacactacgcgtaacgt

SEQ ID NO: 12461 - DNA, 1614 bp, Homo sapiens
  misc_feature (1)...(1614): n = A,T,C or G
gtagagtgggtnatagaggtgtgttnnacactgtgagtntaggtgatagtanagcagtagtgaggcacacgcttcncagatggacgtacatctgtattcgcacatagctcaggattgtttagcgacagcgtaacgaatcctaacacatcccaacagcgtgtcnccactcatggattcagcagacgcgntcatcgtgttgngnaacagtggttgagtncacctgctcctgcgctcgtctctacgtacaagactcgtaggtgtcgctgacgcattctccacaacagagccgagcnaattcatgcatcactcactgcaatcacatgcgannntggtagatcgttggaagtattcgagtgnctatagctctaactactgagtactcatcgntctatctggcaccancattctcacgtgcgcgactcagcgacgcantccatgtcgcgtacgcgtgcgctcacgcatgacaacggangtccatcaacgagtcgctcactggcgtactcaagcgcntcacacacacgtcacttatatatcacactgttatactctcgacagctcctctcctctcttctctcgtttcacatcatgaccgcacgagtgaagagtgagatcgcgtatcgtgtnctgctagctgcgggatgaccagtgtcganntagtggcatagtcgttatacgcgatngttaactcacncagtactcacgatctaatcacgtgacgacgctacactgctcatgctncactctatatctaccgccattntntaggagantatgtcagtagactgttgtgtgtcngtaagtggcttccttcactatatgtantgatgctgtgatcgcggatgtgctcgatagatcgctgctcccgcttcattgcgtgctcacgttgtctacgtatcgtgntctctcaggtcagccaactggccgcactatgtgcgtccntcagtatgcgtcctcatatagttgatatgatctncttctagaagtactanttcatgtggtccacatctcgtcgcgagcgtctcacagagacantcntaatgcaactagtgcagtcgagttgcncgacagtgtgactgtgctcatggtgctcntccagtcatcgacactatcgcgcgccttctcgtcaccactgcgcanaccgcgtgacgcacggcccacatactatggctagtcgctctacagatgccttccatctgcggncntncttctcagcgttctgtttgttatattgttaggtntnaccagacttatgtatgcctctcattggtgcgttcggcgcccnacgcgtcagtgcngatgtgtagncncgtgtgtctatgctnatattactcgatagtgatacatcanctgtcgtctactctgattagtgtctcaaggagatatantnttattggtgaatgttctcgattgttctataccgcgagagtgcatactacagatgtatctntcttatgtgntntcaancatcacgctccgtcgcactacacgtctcnctcactctagtgtgtnaccntccagatgagtcgcncgtgcgactcagcgacgtagtcagactatgccnntcacgcgacatattcgtgtctgagctgtagtccacngctacgagtcgcgtcg

SEQ ID NO: 12462 - DNA, 1715 bp, Homo sapiens
  misc_feature (1)...(1715): n = A,T,C or G
ctgctagtgtaacaggatgttgtcaatagtggttacatagagctganngctagaagagcgcnctcgtccacgncagagatgagcccganatacaagaactncaacaacagggcgtganatctagagagagcgagctaaccatgtgnatcgtatgtcnatcctggatagtgctgagctgagcgacggatagtaaggtctgtnnactatgtttacgtgnacccattagatagtcagtgttcgagcacncacagactgtggcaaccgtntcatcgttctactgacaactgtgttgtgttattcttgttgcgcgcactganactcgctacgttacacttcgtctcgtcactggtgactcnctatacatactgcaactgttgtatactgacggaacacctacgaacnncccagtcgcggacnccgtcagtgcatcntcttncactagtgctatgctcgcnacttccgtcgcatggacgtcttgtacgtantatagtcatgtttctcatccatcgcgtcagtgtntactacagtaattgttaagtatatgcgactgcgcgactcgagtttacgccaactgctctatcctcatcttcctctagttgacatggancngagcnacgtaatagcgtgcctctatgtcgttanttgacgtgctatattagcagtgtncgctgactctttgatgatgtgtgtgatgttcgtgttcncatactagactgcgtgtactattagtcgtgaatactttgtttcaacacgcatttaccttatatattcatgcacactcgtagtntacgatctgtatactctgcgacattgacntgatatgtactgcgttgaactgtncgtgcgtatacgtcttcttctcgttgtttatttctcgtcatgtattgttctcatacgtgttcnctatgtgctttgtgtaccgtctgtgtcaattgtgctatttagtactatcttctatatcctactatttttcttatcacgccntcagtgattgatgctcttcgcacattcacgtcgtctctagtacatgtacacaatcgttagcgccccgcctgacgctggtacgccttctgtgccacgtgtcaacttatgcantctccgtcgtgtanagcgagcactgagctaggtcgtctactcttgtttcttggctattagtctctctcctgctntgcgcgtngcnnctcctcgtagatgttgtcgtcctnatgatctactgacgctctganacactcatcgagtcatattacntcgatatcttacaagcactcgcgcactactgcgtnttctatcgtactatacatgttgatagtctcttcacctcgttctgtgtagctccacgctcgctctactgcctctcattcgttctatctagcgcgtctaagcntactcgcgtctgtgagcantcatacgcgtgatatatggtctgtatgtatcgtcctcatagtgtatatatntatccttatatgtatgatgatgatcattggtgactacatacgtcagtgttcnagcgctgcgctgtgcagtctagtngncttgcgtatgctatcagtctacgctntgccngtcgtctanatggaccatctagtagcgtagcgtagtgattcactatactgattnagctgctatngtntngcgtttatctcactgttgctcntcnntctcatgatattgtagattnagtatgantgtgctacgngatantcatctgaacgatg

SEQ ID NO: 12463 - DNA, 1156 bp, Homo sapiens
  misc_feature (1)...(1156): n = A,T,C or G
agtcagagggcctgtaaagagaaaagaacgagcaaaacacctcagggggaactacagaaggagaccttacacggaacaaaacgaaggaaagagaacaaagcaggaagagatcacgatttttaaacgagctgcgcaacacaacaacagacgaatgattgactagagcgcctcagagcctaataacgccggccgcgcaacgagtattgattggcaggcagccgagtgttagcagacgctcggcagagcctgaccggcagagcgagagaagcttaccatatacacttactctcgcccatcaccaccacatctttattgcgacggggaacgcagacccgggcggcgcccaggtagcgaggccggcacgaagtatcgcgcgacaccgagcggcaatagcgcgtgcaggagatgagtgctataagcgtattctactacgattcatccctgcggacgacagcggtcatatacgctacgcgacaccgattttcacacctacgctaaggctggtccccgcagcctccgcacctccctgcttctgtcttcatcgctgtgtgcatatatgctgcgacgagcctcccgtgctttcctcgtaggtcgcatgtatcgataatgcactctacgatgtcaccagcgcgcgccaaaacgagcgggaggaggagctagtcgctgtcgagacaacgcgccgcttacagcaaatcgcaccccatcgaacgcgtacgcagaatgcgacacgacgtcactggctctatcgcagtccgagtgagacatagctgcccacgcctcgctcccggcgggctcggatgatcgagaccgacacacgctacagtagaggcgagaggtagcagagagggagcggtacgagggaggctgagcagtatacaccgcagctctgatccgcgctcgcgaacgacacgtccgcatacaaagtagatgcagcgacaaagagaaagcaaactcgggtagatactagtccgtatcgtacttgcgactcaacaacatacgacagggatgagacgtccgccgaaccagacagtnaataatatatcaaaactgctacatctactataccacactgcagtcgacagtcactcgcatcgcctcgccgtaacgaccatggagtggncaggngagcgcacgaacgagttgagtgcacgcagct

SEQ ID NO: 12464 - DNA, 1302 bp, Homo sapiens
  misc_feature (1)...(1302): n = A,T,C or G
aagccgcaacaagccgcaaaaggcaccacaaaacgaagcgcttaaaaggaaaaccaaaaggagaaagaaccttgaaagggggcgcaaaccgagaacggggcgggggagcaaggaggcgaagaaggggacctttgagagagagggacacaaggaaacccccagcggccacacaccgcgcagaccaggagcgccgccgcgcgccgctacgcacgcacaaaaacaaaccacaacgacgccgacagacacaagagggcagcacccgagccacacggagagaggaccaagcggcagcacacgaacacagaagaaacaagagcacgcgcggacgagcagcagcgacaacacctcaacgcgaccacaacacacagcgaacgagccgcgagcggagcgcagagcaggatcccgagggccgccacgcacacgcagcgaccacgaacgacacacgcagccgcgccggccacaaccgcnaacaggacgacgcgcgcgcgagcggcggagcgcggccgagggagggagatccagggagaggtggacgcacggcggcgcgaaccggcgcgcacgcggacaagcgcgcaaggagccgagaagaaccaccacggccatcgacacagctgtcacgccgcgggaccggagcccctctgacgagggataacgcaacacgcgagggcaggcacgaggcggagcacggcgacagagcagcaggaggaggcggcagggcgagacacagagcgcgcacgacacnctatagaggcgacacgcgaaggcggcagcagaccacacacactcaaacctgagagcaaggacgtagcagacgaaaagagacggaaggcagacgaggcgcagacacgaacagagggaggaggaccccaccacgcgggcggcgaggcgcagcgacgtccggcgagggggcaagcgaggaagcagaaatgtcggcaggcacagcacgaaggcgcacccacgacacgcagacaaaaacagagcgaaacacagaacacaagcggcgcccagcaggacgaccaacacgacggnacgggaaggaaccccgcagaggaggcacccggagacgcgcgatcgaggggccncgcgagacgccggcggcgagggacagcgagcgggaccgcacccggccagccaccgggccgagcgcgcggacgtagaggcgaagagggcgggcgaagaggaggcagagaagagagggcgggacggacacgcacgccgcgagcagagacgcgncacaacgccacgaagacaccgcgccacaagagaggaacaacagggacgcgacgagcacgcagacgaagc

SEQ ID NO: 12465 - DNA, 1802 bp, Homo sapiens
  misc_feature (1)...(1802): n = A,T,C or G
gcgcgagaaacaaacagcgaagagcgagcaaagaggacaaggacgagaaacccctgccagagggagaaactangaacgcannaaacgacggcctggaacgaagcgcggcagaaacgcgnaacagcgaagagcgagcacaaacagagccgacacgccaacaagangaagagctgtgtacaangaagagagaggaganaacanagcgccagcgcgngcgcgacgatgagccgggcgagagacgcgcngcacgcgacggcgancgacgncgcacgcgccgacagacgcgccagaacgcgcgaagccgcgcgcganaaagagaggagcggagagagcgccgcaggcacgaaggaggcaaatgcggaaggacaaaacgcgaaacgagcagaagagaagaccataacagaccaaccgcaaccacgagaagagccgagcagcacaaaccaccacaccgtgtctttacgtacccgacgagaccgcacacgacaggacgagagactgagcacgtacgganacgacgcatgcgagcacgacggagacgcgaancgacgcacagcgaagaaccacgacacagaanagacagtagcacnacccgaccaacgacgcacacgcgtcgagcagaacgcnacacgacgacgcagcgaggacagcacacgacacgaggacgcaccagacgcccacaccgaccatcgacagcacagcgcaagcgcgagcgactgggtagcagtacgcggagttcagagccgcacccgtcggcacacgacgacagaagacgggagaagacgagcagaggagagcgaggaaataggagtagtgcgacgaggagtcgnagagacgcgcgaacacggagagagcancagncagaagcgcgtcgcagacgccgcgacgaggatcgacagacgagatcacgcacgaggntacagcggcgagacancacgaagtgaggcagcgacgacgagcgcgcacgccgaactgacagagaagcctacacacatgagagacgngaacaccacacgctgcacncgncgagcgaggcagacagcatcagagtagaggagcgtatgcacgtaggagggnagtatgtgacggactaccnatagcacgcgaagacgcancaggagactagctcgcaggaagacgtgtcacgcgcgcgcgatgaagggacaatagacggcaagcacagcgcncacgccacaagacgctgcagcgccgcngagcagggngagaggaagacagagaagcacacacgagagcgcggcgcangatcgcagcgagtagacgngcggcgcgcgcgcgggcggagcgcgcagtgcgcatcgcacgtgcaagcatgcgtgagcgatcgcancgccgcgacacgtgcgcacacgcgccgacctacgcgacacagtgagacagnaggacagacancatancgacagcagcgcgagcggtgccacgagagacgagcgatacatacaaagagtgcagagcgagtccancagaacgngacacagactgagcgacgagacntcgcaaacgcgncgacgggcgnncngagangnagcgtacatgaacgacagcgacggagatctgcgccacgccgcagcagcgcaagcgnacgagcgacgcgactcnacgnantggcagaagcnacagcagacncagagtcgtgacaggacgaacagcagagntcangancgtacacgcagccaccatctcnagcacgtatcncgaccactaggacgcaactacacgctgccacgacagacaactggcacngncacgcnnacacacgacnngcagnagcggacantacgacnagt

SEQ ID NO: 12466 - DNA, 890 bp, Homo sapiens
cagaactactcagaatgaattttccacatcagccacaagaatgaccttccggcatacaagacacttcttaccatgtaatgcaagggaaaaaaaagttcaggtacttcaataggatgttggaaaagaagacttccactctaataggatgaaaaaatgatcatttatttacatcattctgatttcttttaattgcttcacaatccactataaagaagattcgctctgaccctaaattttctactttttttcccacttttctctcacataaattaggtgtttcattctttttcctccttattattttatttacaccattctgtgttgagcacagaaaggtggaagtatatagccctgttctctgtttttaatgctctgtatatttttgtttccttttctgtggaatcagtttttcattacccttataaggagatgccatttttctcaatctttccttacaatctaactaacttctttactaagtcatttctgctccttatagaatagtgaatgtgactgttcttagtgtatcgactggtccctttacatagcattgcacttttaggcattagctaactttcatatgactgccattcatatatcattgggaacatatctcttccaaaaatacataccattcgaccctaaaaaaaaacaaactggccccgttggcctcacccgccgacctctgcggaccgctccctttacggagcggaagctctaatcctccctcctgccttccccgccctgtcctttcttcccgccaccactacctctcccccaagcgcgcaattcttcgttgccgcagctatggccacgaccgacaccactctgctcaacgcctcatccgcccgaaccgcaacagccctgatttgccgattcctaacctcccc

SEQ ID NO: 12467 - DNA, 796 bp, Homo sapiens
cctaggccgactcctactctcccgctatcctgctctgtgccggtggaggctgacctgtgtggctgctccagtggattcctttgccatcccacttccacaggaagctgcagcatcatttgctttgtgagatcaatgagaggatgggaagacgtgaaggtggaaggagagtgaagttgagcaatttacctccgtagctcttccctgctgactcattaaagcctgattacatccctctcgtacgggctgagacctcatcactgcgccaacacctgctcatgatagggactggactggggctggggaggcctgcgacacacttccccctacagatgacagcctcacacccaccttgctcttgaacctgaatggacccaacgcatctgctcctctttcacagtaagccttgcaccttcttaccatcaacccagctccaccccttccactcttggatattccctgccaacccccctcacgcacttatatttctttctttcttgcccaacctgtccttccccttcccatttttacccactaatcttcggatttctttcccccaacccatcctccaactctctccattctccctgggttcctggctctccccttcttaccctcctttcaccgaccgtgtttctctaccgtttcctgcatcttttctcccccccctccctccatctttccgcacgtcaccccgctgtcttcatccacgcctcctccttctctcgcccaccctcgccctatctagtgcgctcccacctctccctccccaccgtccacacctctccctcccagcttg

SEQ ID NO: 12468 - DNA, 736 bp, Homo sapiens
ctcctgtgccatatgaaacttgtattaactaaattttcatgcttttctcctgttgatctgtcttatgtcaatttaatttcaggtctaggaaaaaaataacaaacttaaaagagtaaaagtaaaattttacctcccctacagcacccaataatcatgaaatatggacaatgcaatgaaaagccaaaaaatatataaataaaaaggaaaatgtagtgttggacctaaactaactgatgatctttctaaaatttgggctggcatatatttctttatatagagaagtctgtccctcaccatgtgaatatcacctctcctactcttccaatctactgtgattagaaaggaaagcaatgcaacataattttaatggctttcacattgcatgagtttggtttgacttcaggcatgtatatttaatgcccatatattttgttgctaaatctctatgcagccctagtattaaaatgcattatgcatgaaaagttcaaatgaaagaaaaataagacagagggatctggatagagagtatccaaggttcataaaagagtaaactcaaaatacattataagaaaaagcataacctctgtgattttaatataaaactagcaatgtcttcaagaaggacaatgcctttgttcctgaagtcctgcttttgtattgcataactgtaagataaaatttgatctcacaactgcaaataaagttttgatttgaaagtttaaaaaaaaaaaaaaaa

SEQ ID NO: 12469 - DNA, 992 bp, Homo sapiens
  misc_feature (1)...(992): n = A,T,C or G
aaataggtaaactattatcttagggtaaaggaaaannnttcgtatgttngactaggnacaanggcttttgagggntantacgcctacagacaatactcttcattttgtccatccattttactttcaattattataggtgtttatatctgtaaagtgaccaatacccttggtcaaagaagcgaccaaaaagtcatctacgtttcacaacctcctactactactaacactaagcatacaatagagccggcacacctcaactgctgacatcgaggacctctcctctgaaaaaaaaaaacggcaccaacaagcgcgaagtcgggcaccacaaaccgccgcaacacgcgccccccacataagctcgagacacggcgaaggggcaggacnaacgcagaccccaccagagcaccgagagcccgagccgacccaccgcagcacacccacataccacgacgccagcgggcagccggcgcaacgacaaacggacaggaggcgcaacaccgaggccgaaccgaggacaggagcccacccaaggacgcgacaagccgccagcaaagcagcaacacaaaacacgcggcccggacacacacccgcaaccacacaaaacgcgcaccaacacaacccgaccaaggcgcagatgcaacaacgccgcgacaaacagacaacccaaccaacagacgcaacaccacgcacgaagccagagaagcagacagcgccaagagaccgaaacagaccgaccacgcaaaacgcaaagcaaacgaagaagacgcgnaacaccagcaagcccaacgcacgacaaagacccacaacgaggacgcaccgaagccgacgcgagggacaacacaaggagtctcgtgaaatccgagagtcgcggcgccagtatgagagtgaccacgcaaggtccagaatgaaccaacccatagaagaaacaaacattccaacagacaacaaagcagtaaacgagttaagaatagtatgtacatgaaaagaacgcg

SEQ ID NO: 12470 - DNA, 1393 bp, Homo sapiens
  misc_feature (1)...(1393): n = A,T,C or G
tacccccgattctccgcagtcgcctgcatcatctctcagcgtgttcacgcaccatcacataattacacttcttgccagcgagaaccaccataaggttaacaagcttgtcagcagcgcagccgcctccgcctcaacagactaatctcgttagtacgatgtatctagtacatttgtactaagatagacgtncacaaccacaccaccctcgagcgctccgtgttgtaggattgtaggaagccaatctcacctacacctaactgctgccactcgaccggtatgtcgtnagcgagttcctctctcagaccctgccgtctcgcgtcatcctgccgttgcataaatgtccatcgcactatccgccaccccacgcacccaccacacaccgtattgtcatgcgaccttagacaccccacgctacaatccccactctgatctctcctctcccgccgctaccgtcagcggctgcccgtgtcgtacgacatccggtccgcacgccgacactacgcactaacgagtactcttcgtcgacgtcatatcttgtaactcactctctatttatgcgtgtcgtcgttagacacaggtatgcgactcgtgaccgatgtctcgctagaccgtcccttatactagatacgttacctctacaactcaccctctcaaccagctctcttaacgccgtctccttacggttagtcgactattctacattaattatgaccatcctcactcactcctatcgagctatatacatatgacaatagatgacttactcntcccaccacttcctactacatatctctgcatacatggacgacgaacagagatagatngctcccgtgattctctggtcacactctgcgcgtgatctatgtttctctgatcagatctactaatcngccatcacgcaacacctgtcgagcgccgtctcactgtgcgcactcacacgcgtcaccgagcgcatcctcgcntggtgtatgtgatctctctacttcgatacgtttacgtcgccccgtcctcctctcgacgatacccatcctagtgtggcacatctacacatcgtgtgtcttagctactgctgctcacttctgcggtcagcatccctgttctctactgcggcgcgccgtgtgcccgcaccccgagtgtctctcactgtcancatgtatgcaacgtaccacgccttccgcgctctatccatgtccctctgagtgctgcagcattattctgcgcctctaccccgcaatatcagttatcacgtccatcacgtactccttggttttacacgtaccgtcatcgcaccgtctaacatgtcttcgctctcaccccactcggttcttgtacgcagacacttcctccttattcttggctcgtctaccatccaactctatcacatcatcctgtt

SEQ ID NO: 12471 - DNA, 1202 bp, Homo sapiens
  misc_feature (1)...(1202): n = A,T,C or G
gatagtgaataagaaatgaaaaaagccaagaaaaaagaaacgcgtgctgtggagggacaanacngcaaaggaaaccctctngagaganaggaagcanctacacctgaacaggcaacttgcagcacagaactaggaatcgattttanagctgcacacagagacacagatggtctggggcagcaccagaataccaataaacaacaaaacatctagttgacataaggctgcagaggtttagtagggcaaggtagcgctagagtgctctatgaacgagagtgcacgtccactctagattctcaattgttagaccaggggcaggtaggcagagcatgttgacattttttttttgtctccgagtcggtccgtctggtcggtccggaggcaagcgcgtccgccctgagcagctactcagacgtcctgcagatctcgcggatgccacacatcgtgtccgctgcgcctgatgagccccgttggtcttgcagagctagtgttttctggatgtgggagttacttacgctttgaggattatgaatggagcgatattttcatcattgtatattgcgtacccaccacgtatccacgcaaatgagatacacactggacataacgagatataagcaagagagcgatagaagtagatcagttcccgcagcaccgaacgtagagagataataggggtacacacacaatacatgagacatccccacactcataagactgttccgcactgtcaactatgcaccctagtgtccgctgtgctcttctatctatttagcgagttcgatgctgcctcctagctcgagcgtacgcaccacctctgtcttatggtctaccaggtgataggagcacgtggagagcacacttgtggtcatctcaaagttcttccgctggtagcttacattatgtcncccgagaactactgatatatatcacgtgattatcaggacggagatcccgcggctacagcaaggtaggtgcgtgaatatactcaacgcaatatagtagtacgattacttatcgattgcctttataatccccgtcaagcacgtaccccgagagtagtgaggacgcgcatggctcgccgtgcgaggcgacggatttgtggtatgtcggctactatcgtgctgtgttggtttggagcgacgtcccaccgacgtacttacctgggtatctcatctgacgttcttaacgcatatcggggc

SEQ ID NO: 12472 - DNA, 1650 bp, Homo sapiens
  misc_feature (1)...(1650): n = A,T,C or G
gatcttatagtatatggatttgtgagttgggcattgagtccagagatttgccggtattactttgtcggcggagcgaccacagcgcagcgcgcgcgcaggtcctctctctcctcagctganctcatcccgtggccgatctctactccncagtcatgtacgactccgacgtacatatatacatacataacgaatagtaaacagaccagcgttctctcatcgatctctttctcgcctgtgtctacattctgtagcgtatatgagtgttgtgatacagtagtacgaaagtcacgcgtcgcacacgtgatcgtgataccgtagacgcacatacacattgcactacgtctgctagtctnccgttcatacaccgtcgncacaccactatcgactagatcacagctcacgacgacgtgtgctcagttgacgaatttacgcacgacgaccacacctgcttatgcattgcgtacactgattnatatattcgctgactgtcggtctgtaatanacgcagacgtttagtacatgatgcntctcagtcgcaagaatgcgtatgctctcngataatgtgagattatantgatacatactaccgactagcatagcatcatattgtatnatctcagcttgttctagtgcgacggcatcntagctcggtgatgacgtaattataagattctccctatgcttccgctccgcctgtatggattaccatatagtaggaatgtatacgaacgatagtcagtgtacaccaagtaacgcatgaacatacatagtacgttcgcnctattgcgaaagttcaatgagatgatcgagtgagtgttgtgcttcacgagtgtgtgctcatgtatcgacgttggttccgcagcagatacggatgctaaggacggatagttataactcgccgcgatccgagacgaactatgagcgacatcatctcaacgtacgacagntacgtagagaggaggtgtgtaagtnacgtcttatatcgattcgtgtgtcgtcatctatagtcaactgtatacgngtgttcacacgatgctgatactaactgtcgtggtgttcgagcgcatcgatactcgatagagtcgactgacgcatgtgagggagtgctctatatactactctcgagctcgatagtctacaccacagntcntcagtaacacgtgatggagcatcctggtgtagtagttcgntcgcagatgcggagtgagatactcgcttatgtntgtgtactcgacgagtgttatagatcatttacntcctatacatacagnagtcttaccgtctgtcgattccactgtcggtatgtgcttcacaatgcgctcatcactatactcacactttagtnctagaacacgttcatactacactcgtagagtgagacgcgcagtgtaccccgagncatagctctatagcgcgcgctgttncgtctcacagacgtcgtgagctntactcgctcgtagtatcanaatactaacactaacggtgatgagtcgtctaactctacgcgtgactacactcgtgcgtcacgactgtancgcactgctcgtccgtctctaactcgagagatntcaactnctacgcacttcagtgctcagnanacgagagtaactcacgtacagtgtgtctcgtccactgagtgagagtatgtcg

SEQ ID NO: 12473 - DNA, 1882 bp, Homo sapiens
  misc_feature (1)...(1882): n = A,T,C or G
ggactaaatggcaatagatanatatgcgtgacacgagaganagagtaggacatagtccctcaatgatgatgaaaacagcgcgtacgcatgcgntacattctcaganccaacacaacagacaaccgacnactgaatatacgtcgtgctcagcgagaggtctcatccctgagtnancgacgaccatcgctcgatacttctatcatgactgcgagacgcctgccctcctcacgtcagttgcacacttacgctcagtagttagatctgacactgctacaggtatactcagcgttatcatcttgtgtttctgtatcgtcggttccgctgatgcctgtcgcttgtggcgcgcatcgtcgcttataggacgtgcggtcantccgtgcaatgctatcantaacgtagtacggcgcatcgtaatgtagtagattgtntanttgtnatgctggcgatctgtctcgtgatgtctacgtctcgcgcngagagcgcgtagtaaccgtagtaccntcagtgtccctgtgcatacctcgctctcactatcgggagtagagatgaggtactcatcatgtacgacacggtgtgagagtgcgcacncgtatgagaaggtgtgtcgagtgtgcgagtgactattcaatactgactgtgacgtgntatanctctacatatgaatgtcganttaanctctgtgtcagctctanctntagagcgctgtgcgcgtactgagatncncatnagcgagacatgctccgtactcgcgtcgnanagntgcgtcacagacggcgcagctcgtactactcganctcgatcagagcgcgtagcacangctgagcatagcgatatgactgacagagtatatcatatattatactgcttgtgcaaacncantcatacaagtggacctctgtcgagctgcgcttctatccattagatacacttcaacgctgantgacgtatacaccgatcnatcgatcagatcacgatagatgacaatatgagtgcacnacgctcatagagtagatanagttacatatgtagagtcgagattaatcgacgcgcanacgntgtcgacagtggtgtacgtacacacgatacgctctcngnctgtgagtgtcgtcatatgtactgagacactgtagatgagagagtgcantcgagatancagagtcncntaaagtgtcanactgagcgngctgcgccagatgcgatcagcgnantnacgctgtgaatgatcatctaacatctgagtgtgtgtncactantcgnatgtctgtgattctgtntgcgtgtangtctgcggggtagngtcacgcgcgctagtagatgtatnccntancatatctggacagtactgcnttatcaggatattatnacncgcataacgacgatgatcgtagtcgcaccagatctactgcnctaccgatatgagttgatagcgcgtgattatcactcnattactattgagttagtagatcgtcgcggagcactgccgcgtgcgnggctatagcgcactgtgtcgccgcactagcgaggcgtccgcgagtgatgacgcaacaatagtctgntcncgcgcgaactgtagatcgccacaacgtcgtgatacgactgcgcgcacatgncctcattcgtatatcanatatcgcacacataagctgtgcncnctaactagagagatgttcgtgctatcacgtccgatgcgcagtgagtgtncgagcactcanacatgtacgtcacgctggtctcgatgtanagacncgcagcgcagacgccgacgacgttagacgagcgaaccgcgatgtgatgatcgcgcgcactctatgcgctgagtntgtacacagatatgagagtgatagctgtgtgttgtntagagagcgtatagcgatgagacang

SEQ ID NO: 12474 - DNA, 2064 bp, Homo sapiens
  misc_feature (1)...(2064): n = A,T,C or G
ggtcctatagagagcgcagacgcacggttagttgagtagntacacagagacagtnncacagagnagtaacaacagacatntncgctgcanagtgnngnagagagagacagananagagcaagnangcnncaacagcatggtanaacgcanagagagaatacagaacgccccncacacacgcatcagtggnanatatcgatgcagtcttnacactaccgctggctacgcatacgtgtcattatgctgcgtgacgtacactctgctgcncagagtggtcggtctacacgatcgagtatgtctnctctcttatgtagtcactgtctgatgagtgtntattatgtcgtacgcaccaggcagctgnctcacattgagtcacgtgccaccnaccatctgtcaccgtatgtggancnttattgtgcgccantctgctacgcatgcacgctcgcgcnctctcagcgcatcacgctctaccactcagtgcactgacggtgattagagttcgactgtatggtgcnnncacgccngcgctccancgacgangatatcagcagactgncatactggtacgtncanatgacgcnanccgtgatcgagtctntcgttgatgttcatcgcgtgancgtgcngaaccgccncccntacatgatatcacgtgngtactatctncgtcncatcatgcgacattgttcacagcgcagcgtccactcacatacagtcnacgctacctgtacactgtcgtacgctcacactatgtacaacgcacgatgcagactcnatccgcatctcnctacactcgctgcntcgaccgtacgtgtcatgcacagcgntcgtgnntatcgcgcgacgatcgtagtgtanatctagcgactctncntctnatnacatcatatgcatnatctcagatactgagcatagtagacnactatcgcagactcagncgtgctgcacntacgacgctcntagagtgtncncatcatctgcgtaggagctactacacacacacacagcatcggatctanagcatacgcactctctcgcatgcatatcatagtagctactgtacgtgtacgtgatcgnagtgctctacgataccgtacangacntccgcntcnnactatcatcgacagcgcatanactatgagaaacctcgnangagtatgtncaagcagtcgcnacntcgcgagtcgtaaacgtgacactccagcacatcgcacncacatacagtctgagtgtcactatacgctaagntnnanacatcatactctatagtagatagcaatcgcatacanancatctcgtgcagatcatacatcgcgtgcatcacacgtctatcatcgtgcnntcactctctctcgctcgctncacnaccgtagcatgccccnctgacgctgcacgagtctcgcacctacacncanncgctgcactcgacgtcgcccagcgacagaggatgatgcncnctcaggtgcgatatgattgcncnacgagaagagtgatcangagncntactacagaatacgtaagagctgatcntacncnagtgtantgatcactcatagactagcagacanctcnntgacgactagttgtgatgcgtnnctctactacacacatctntagcttcctatagtacatgtcncnacgcacgagagtgtgtgtgagcgtgaatgagacgagtannacagtagangaacgncnccntctantccgaggcgcncacatcgtcgagagtggcntcctactccatcgacctactcatntcactatcgactcgatngatacactcgtatacagcgcanctgctccgtatcgtgtgtgtctcatcctcgcacctgacgctaacntacgtatacacgcgtgacgtgcgnntcagcgcatcgctacnactcatcgcgacntatgtgcacatggtcgancgtcttctctactncggccnncatgtatcatatacgtcgtctncgtgaagcgaacccgctatcaagngaacanccntacagcagagctgtagaatcacactgactcgtcagccagtgtagtgtgtncacgcactctctctgtacgtacccc

SEQ ID NO: 12475 - DNA, 167 bp, Homo sapiens
tcagtttgataactggagagcccgtggtgagatggaacgaactacaagatgaaagcagcctgaatctctggttcaactgatagcagagagcctatgccaacccatgtctgtttttttcatgtgcaaaataaataaatatttattgttataagccaaaaaaaaaaaaa

SEQ ID NO: 12476 - DNA, 956 bp, Homo sapiens
  misc_feature (1)...(956): n = A,T,C or G
ctagnttatctcttctagactacatcaattccacctcgaagatgatgcttgcagaatgcttccaacctgtcctgttttctgatgcagagggggaaaacattctgccattgggttccttagattaggtatccagaaatttttactcttccaatgccgggcagggcctatgcccagaaactcagcaagaagcagctacagaagatggacctccacctttctgcaccccccttaagattaagaagggggatctaatctctgagtagggaatgcagtacgataactggcaagacttgctttctggtcacaaccttgctgacaaaacaagacctggtccagatggggtgacatgaagaaactggcacgaacctgcagatgggaaagaaagggatccctacctaccctgattgctcattacgataagatacctccacccagctgcatgacaagctaacaggagggcatgaagtgacctaggagcgtctacgcgctcacgcatgcgagccacctgaaagggactcgcggctgccctgagacgtgatagcgcccccgcgccgaggccgcgtcatgggggcccccaccgccgcccgcgggggacccggcgggtcctggcgaataggcccccgagagccgagcggggccagccgccgcccctcgccgccgcccccccgcggcgcggcccccagcgtcagcaggggccgccggggtgcgatacgggaggggtgtggcgcgcgcacgcaacgggggcgacccggggcgggccaggcgggcggcgcccgccgcgagggtccgtcgcggaagctcccggccgctccgcggtggcgaccgggggcacaggataccgcgctcacgcgcgcagcccgcggacgccgtggcggctacgacgacgagcgcggccggcggggggctgcgcccacgcgcccgcgcaacccgcccgctcaccccgaccggggcgtcgg

SEQ ID NO: 12477 - DNA, 201 bp, Homo sapiens
ttccgccccaccccgcccaccacacaaaaccctcaggctgacatgcagtggcactccacgggacctcctggaatcaagcaatactctcatctcagcctcctgagtagctgggaccatagcacaagccctgtaagaatgtgagagcgctcaaggatgttggctactgggaataaacatttgtgactacaacccacaaaacaa

SEQ ID NO: 12478 - DNA, 910 bp, Homo sapiens
  misc_feature (1)...(910): n = A,T,C or G
gtaaacccccgacggcctaacttcccccgccacttccagggcactacggcatttggtatcagaatgaaaagactgttaagaagcttccttctgctctaattgaaaatgccccccaggtctgactctcactacgaggagagccatgctgctgtcaaaaaagcgaagcagaaaatggaacccctctgtggacacgtcactggataccctaccccgcacgaccgaagaactgagctactcctgagaacccccgctcttanttactgaatctgagcgcaggctgtattacccaagattccccggtgatgtgtgtggcccaagagccgaccgggctactccgcctccacccctacccctctccttaagtcaacggatgacggctctccaagcgtaggtatcacacagcagcgtggtcccacggcacagaatccaacccaccccggctcttaaacactaagcctcacacccactcttaccgagtagcgccggtcagacaaaacatgaccactacgcccgcctgtagcagaacctcacatccacagtagccccaccagccccatcgtccccttcactgctagtcgcctctgcccccccgcggtcacccgctatgccccgccaccccaccccgcgcccgcccgccgagccccccccccagcgcagaagagaccaggacggcccacccactccgtccatccatagacctacgaggccgcgccccacgcgccccgcggcgccccgctgcgaccgtgacggcgcctccggaggctccggaggtgcnactcatctcatggtggcccccggggggattccgaaggctccacacacggacggcccagcgagcgggccctccgcgcacccccccaccccaagagatgacggagccgccccgcgagtaccacggcaagcctcggcg

SEQ ID NO: 12479 - DNA, 937 bp, Homo sapiens
cttcagtgaccacgatagtgcctcatgcaaaggagacattctacaaatgtgttgggaatggaaagcagataaagatgtgatcgagatgagagagaaaaatggcatttggaattctcccttcagagatcaaagttaacagtatggtgatacggcatccaaggaagacagaaataactgatttcaggacagcgaaatttctataatttaccagttatttaaaagctagcaaacaaacaacggcatgctcaccttcatctgttgggggaaaattattttttgtcattgctcacttcaacatgggagcaatgagagataagagacactaagaaatgagtgtagaaatgaatatttttgctcattctgctagaaaatataatacttagtagaaacagattcctgaattgctacactttaaacatgcaatcacattgtactaatatatgctatacacatactctaaatggtggaaagtttaatatttcagattggataacacattttgaggcatgttattgtacataccaataaacataaagtaggggtaccatccttatcccaagggttacttagaaaaaaaaccaattcttttttttgactattattaacgacattggatttgcaacaacataatttcttatccacactggttttactataaacatttgtttttaaataaactaaatggctgttccctcttttcgttgtttttttaatgttcggaaaagtaaacggctgctttttcgtcattcttctacaaagagtacaaacggcctgctgcccccccggtgggcccttacgcccttctctttataggggtgactatcgcgcctgctccttgatgatcccctcgcacatgtaggaacgaaggacatcccgaccatagcgggcatcgacctcacgagccccgcgagacgcgccacagcgcgaggcccgtgac

SEQ ID NO: 12480 - DNA, 748 bp, Homo sapiens
  misc_feature (1)...(748): n = A,T,C or G
cagtacctcgaagcaatacagaaggagtacttaatgttcaaataaagtcattgaccaaagtatggaacagcaaatataaatgcgtatgggtaaagcaaacatttcatctcctaaagacaagataagacatggaatgagaaggagaagtaaattaatcccaccatccaacagtgaaagaaaaaacacagaacatgaggaggaccagaaagcaatgtgaaaaagagttgaaaggagtcactgctgagctattttagattctacaccctctatccagccatgaacctatcagcgatcatgcctaactattgcataccccattagacaacctaatgtgaatgtaggaagcctattcatctaaaggacatggaaccgagtagatgtaactgatacttcactattgacctatagcctattaagatctaccatgagtcatatacatttgacaccgtggttttcatttcataatacatatcttcactaattttgtctatcattttgtcaaagggctaaaactatagtaatgagtacattcttaatgagtttttctttaactaccacaatntgtatctaaatcttggctcattttatgttctaaaattggcacagcaaagtgatccaaggaagctagagattttacatatgttcttcttcataaaagggctggatctcttctatatcaagtaaataaatccttgatccatgaaggagtaatggttcactaaacaactaaatttgaaaaaaaaaaaaa

SEQ ID NO: 12481 - DNA, 946 bp, Homo sapiens
  misc_feature (1)...(946): n = A,T,C or G
gcacgcccccccgggcgcggggcccgccgcnaccctccaggtgactcacatcagggatgttgtgaaaagaagactcccactctaataggatgaaaaaatgatcatttatttacatcattctggggtgctgttaattgcttcacaatccactataaagaagattcgctctgaccctaagtgtgtactttgtttgccactttgctctcagataaaggaggaggggcatcctctccgctgcttaccggcgggccgggcacccgcccctgggggcccccgcacagcggaggcgcgccgccggggccgccgggggaggccgccggggcgcgggacggggccctgcggcgggccgcgctcgccggcccgggcgcgggggaggtggcggggagccgagcgggcggcgacaaatgagcggggggagcggatagggggaggaacgagcccgcgggccgctccggcgcagcgcccggcgaggcgggagacggggacgcgagggggcgcggtcggggggcgagggcccgccccaggcgtcctcgggccccgtgccccaccggggaccgccggggtcccaggcgcgcgcgcgccccggccgcgggcgccgcgccccgcccgcccggcgggggcgcgagggggccccggtgcgcaggcggggcgcggccgcgagcgccgcgagcaagtcccgccagggccggcgaagtggcgagcctccgggggcggcgggcggcgctggccgcgggcccgccgccggccccccgcgccccggagcgccgcggccaggtgggcgcggcggcccccgggcgcccggggggggcgcgggggggccgggtgcggcgccgaggaccgcggcgccgcgcccgcggcggcgcgccacggcccggggccgcgcggcgccggccccgagccgtgcgagcgcgccgcctgccccggcggggccggcgggggcggggcc

SEQ ID NO: 12482 - DNA, 1331 bp, Homo sapiens
  misc_feature (1)...(1331): n = A,T,C or G
gagacggcgcgcgaccacgaaggaagaaaagaaaaacangcctcataagaggtaaccggcggtgcacactcgtcgtcgaaacacacgagctaacgactctcngaaccctcctggacgctcacaaaacaattncctcttcttncgctctngccaccttcccgcaaaggtnacgtgggggaatntatcaacaacataaaaanccacnnncacaccccanncacccttacaacggcgcacgatctgtgaatgcgcactggtgacgatntgcaacggcggtactgtactctgcggctcatgatgtgtcgcatcatgaactaccaagatgacctgtaggtggatgtcgtttaaacagttgactttctgaatgactgtggcgagaagtatgactctgtctgtcttatctgcggggggcgagtgggggacagtccacggcatccgtgagagggaacgcttctccacaaaagacaaacagtccagccatcagagtatgngtcctctctcccgaggcgccgtctcgagcacagtaacggcgcacggaggcgctccgctctcggcctgcgtncggctgcacnggcgacggncatgcagcgtatccggccgcccgcggaccagcgcgcccgcgagtcgccagcatgcctcggaccgccagagcaccgcgtgaccgctgcgcaaggctgcccgccactgagaagtcgcctggacgaggaggaggcgtggaggaagggcgagcgcgcggtggacgcagggcgtgcactcgcgctaccaccggaacagcacgagcgcgcgcacgcagcagaccagccggacccgcaccgtcggccgcgcgcgccgtcagtcgcgcgcgctgcaccaccgcggaccgcgcagacgcgaccgacgcacagctcatcaatccgcgccacgccgcgcgggcgtcgctccgacggtgggctccgcggaggtcgactgcgtagccggctccgcgctgagcaggacaagggnaccgcgcaacggcacgcgagcggacaccgtcggagggcgcggtaggacagcgaagtgacggcgtgcggtgggccgggcggatcgccgcnaagtacgcgagccgcgcgagcaccgccgcccgccgggaccgcgggcggcgacggagcctccgcagcccagcgcggacgcccgggcaccaccagcgaacgagggcagggcgccgtggccgcggacgccacangaaagggatgcggctgcgagcagcgacaaaggagtgggcgccgctcacgccacggcacaagacggacagcagccggtcgacaacagcgcgcctggaagcgaccggctcggcccgcacgcggaggagcgcg

SEQ ID NO: 12483 - DNA, 370 bp, Homo sapiens
tgaggccaacgaggccatttttttttttttttttttatgtagagagtgtttttgtttgtttgtttatttcttttcatttcaaaatgttgaactttgggcatttaacagaaatttaacagatatttctacaaagcagattttttcctcatctgctgagtaaaaccatctaacataagtaaaggttaaaggaagtaaatatttatctcagtggttacaaactgcattttaacaagttaggagccgactcctctggctcactgtgttggctccagatagatggtccagggtccccaggcatgggagcagggctcacccggcagggctcctgcgggtagagtgtgagctgtggccctaaaggtagtctccaaga

SEQ ID NO: 12484 - DNA, 905 bp, Homo sapiens
  misc_feature (1)...(905): n = A,T,C or G
cgtgctccgcccgccgcgaaagaaaaaaaaacaacnccctccagatgcggcaaggtgaagtgagtgcatgaccacgtgtatgtgactaagtttacaaagcccgtcttgtgaagagacttgctcttctttgctagcttgaaagaagcctgctgccagttgtgagctaccatccagagaaggccacatgacaaagagctgagggcagcctccagctgacaggtaacaaaaacaaaacaaaacaactgaaggctttaattcagtagcctgcaaggaactgagtgccgccaagaaacacatgagcctagaagaagatccttccccagtttaacctcacaggacactggagacccagatgacacctctattgtacgctcgagagaccctgacgacacaacacacactactgcgctcaaactcttgacccacagcaccttgtcgataaacaatgccccgtgccgtcaacaactctccctcccgctgatgttctcaacctcgggagcgattattgcacgccgccctaacgcgcccgcctcacatctgcaaccttacccgcctcgcctcggcacgctctcccgccatcgcctctagcctaagaccagcgaacgcctcaccctagttccacgccccttccccgcctccccctccacggtcgcccgcgcggctgtgcgctgcgcgaccgtccgtccccaccccgccgcgcgccgctcgccctcatcgcttcctccgacatataccttctttcccccgcctcaggctctccactcccctcccccgcgcccgccccacccccctatccctcaaccattcccgcgatattctataccgccccccaccggcgccctaccctcccccgacgtcccgacgctcacacgtgcacgactgcgctggcatacagaacccgtctc

SEQ ID NO: 12485 - DNA, 1151 bp, Homo sapiens
  misc_feature (1)...(1151): n = A,T,C or G
ttcaaccgcccacccacgcacnccgccgccccctaaggtagacaagaaaaaatgaggtaatgctcgtgaccaactcaatagaacgtcttcagcaagcacgaacagagtcgatgagcgagtgagtgacacctttgcgttccctgctagctacctcactgcactcgcctcggccagaacctcaccatcccaccatgatgcgcattgaaccctcaccatacactgcggctaccaagcacccaccactcaccccgatgccactccacgacgcccctcctcacccgtcaccacaccacaccaacaacaaactcttctccagaaccaacgtcgccttacacaccaaccaatgacagtcaagcaactacgcttctcggcgacccgaacaagccccacaccacagcacctccgatcccaccccccgccggtccggaagtcacaaatccaaccctcgacatcaccagccagcactagaccccgcgagcccgtccaccacacgctcctcaaccacacccgtgccaccacatacggcatccaccaacgctcgaaccgatgaaagtcatacaagacgaccgaaagaacacgtagaaaatatatcatctgccccccccgacgaccaccgcgcccaccgtacaccccgccccgcagcacactgactacgcccaacactcgagcaccaaccgccactaacaccgagataacgcaccgcactacccagcacgctgaaccgagaccccgcgaccttctctcagcacatcacatcccacatccacgttgatcaccgcgggcgacttagtgctaacatccctccgcctacagtgcaaagtcctcctctacaatacactccgctacgcaccaaccccacacccccgaccgccatgaactcactcatacaaagacgctcccacactcagcacacccccatgcggccgtccaatcgcctataganaaccctaatctcttctgccctaagcggaccagtgcatggaacacccgagaccctccagtcgacacatcttctacactaagcttagtatgtcatcactcgcgcttaacccgcgataacatcacacgagagcatgcacaacgcacacccgcacgcgaccactaatccagacactcgacacgatctagtcacagaccagcaaacacctaat

SEQ ID NO: 12486 - DNA, 916 bp, Homo sapiens
  misc_feature (1)...(916): n = A,T,C or G
ttgatttcgcacagataaaacaaaaaaaanacctctggtgacggcaagtgagttgagtgcataaccacgtgtatgtgactaagtttacaaagcccgtcttgtgaagagacttcctcttctttgctagcttgaaagaagcctgctgccagttcgtgagctaccatccagagaaggccacatgacaaagagctgagggcagcctccagctgacagctaacaaaaacaaaacaaaacaactgaaggctttaattcagcagcctttatggaactgaatgccgccaagaaacacatgagcctagaagaagatccttccccagtttagcctcagaggagactgcagccccagatgacacctctattgtagccttgtgagaccctgagcagagaacccagataaactgtgctcaaactcttgacccacagaaactttaagataaagaatgcctgttgttttaagcagccatatttgtgataatattgccacgcaccgattagatatattaatatgggggcctaaaggaaccttctagaagatggaatcttaatggctttctttccaaactttagcattctgctttacctttcacagaaagactactctatccttaagggtgattccttttctctggtttttcgaaacagcccacgttatatgtcgcttttccattctctaaataaagggatttcttcttggacaataaaaaaaaaatcggctcgttcgtctaatagagaaaacatgatgacgctcccttaatggaggacaatcaaattctgcatactagcccgttgagttgctctttcgtccgggcaacggcttcttctctccaaagctgattgcggcttctctcaatcctgttcttcgccgaataacattttcttaggctagcaggccttacccttacaggccgttttgcgt

SEQ ID NO: 12487 - DNA, 941 bp, Homo sapiens
  misc_feature (1)...(941): n = A,T,C or G
ctacaagtttactccctgcccctgctcggagtgcaaccgcgccatctcanctcactcgaacctccccctcccccngtcaaacgattctgcgggctcacnctaccaaancactgggattaccggggggagccactgggccctgggcccttaaaaacatttcgaaaagtatagtgtgtgataaactcttataaaagactngaaaaaaagatgggtaatttttagttattattggacatctttagaggggggaatcagcttttctgtggttnctaaaaaacaatatataaagatttctttatgggttccacaacatttattttattttctccatttcaagaaaaccactatcgtcggaccataaagattctcatcggaccgggggtcaattggtacgaataactcgacacacctaaagcgaaggggattgggggtaaactttcagcctctccccctccaaacgggacctccgggggacccgacactccacaacctagtaacctgggcgtatcccccacacagcgcgtacgccccacacccccctgccccccccccaccgccacgggaaccagggcgctcgagagcaccagccttgcgcgcgagggaggtctgcagcgccaacaaaacagacggcggccctcgcggacccccaacgacacgcctcccccacgccccccccctccgcgaagggaacctccacgaccctggccccctggcggcgcgggcccggacgacccgccgaggcggcaccggaccgccagcacgggcgcccgccggggacaccgagcgcgacagccacgcacacccgccccgcagcccccccccacccccgcgccnacaccggccgcggcagcccgccgaccggccctccgccgccgccccgcccgcgcgccgcccccgccgcaccgggacccgcgcaccgcgcgcgggcccccggcgcgccc

SEQ ID NO: 12488 - DNA, 1216 bp, Homo sapiens
  misc_feature (1)...(1216): n = A,T,C or G
cttcttctgcttcgcttgctgcgcgcctgctcttgctcagcggccccgtctctcctcggcgccgctcgcggcnttcgccgctttccgagctcccgctccgctcagtccgttccctctctctgtctcctcccggttgtttctgtggcctgcgtctcgcctgcccttgtctcttgcccctcctcctctggtggtgcctcccgctcttctcgcncgtcgtccgcccgccccgttcgcgttgcgtctcgctcggtgctgtgctgcgctgcgctcgcgtttctcgtcgcgcgcttctgcgtggcgtgagtgtgtgacgttctggtctgctgcgcgccggtcgcgctgcgtccggcgtgcggcgtcgacctcctacccccttctgcgcgctcgtgccctcttctctcgtcgctgtcctgcgcgtctcctcgtccccctccttggtctctggcggtcgtgcgggacgtccctggtttgcttttcgccctctcccccggcgttcccgctgttgctgcgtcctgcgcgcggcggccggcctgtgcgctgtgtgctcccggcagcgctgtgtgtctgttttgtgttgcgtttcggtccttgcttggtcgcgcctctctgccgcggctcccgtgcctcccgcgccgttccttgcccgccccctcacttgcccgcggcgacgtgtttgtcgtgttgtgcggtcgcgcgggcttgcgctcgcgcgttgtggtgtgtgtgctttgttgctggttttcgcggcggagcgggcggtgttatcgctgcgggttgngnggcggtttgaaaaaaagagttctgtttcggngtggggtcgtggcgcgcggggcggcccgctctgtgtgccgtccggtggtntgttgtttgttttcttggttttcgcttgtgcggtttgctgcgccgcctcccgcccccggcgcgcgccttctgtcgcgtctttccgtggttgtcgtcttctctcgtggtgcccgnttgttggctntnctcgncttgtctctggtggggtttttgcgggcggccgcgcggcgcaacanggggttgctttgcgtttctccggcgggtcgcggcgggggtgtcggcggcgcttttnaaccccnncngaggtttttggccccccanaagttnctcccgccccagggntnccccttcttttcttctttcccccttccttctccccccccnntnnnncctttcttcnntttttttctcttct

SEQ ID NO: 12489 - DNA, 946 bp, Homo sapiens
  misc_feature (1)...(946): n = A,T,C or G
gcgggacagcggccacggagccccgcaacgcggccggtccagggactctcaataggatgttttcagagnaagacttccactctaataggatgaaaaagtgatcatttatttacatcattctgaggggctgtgaattgcttcacaatccactataaagaagattcgctctnaccctagattgtctacttttttttgccacttcggtctcacataaactaccgcggcccattctttgtcctccttattatctcatttacaccattctggggtgagcacagaaagggggggggagatacgccctggcctctggtcataatgctcataatatttggtgcgtgctttggtggggagggggggggtgctgctggcgatnntgagatgacggatgggcggatcctctgcttaagncctgatggcctggctccgtcaggcggttctgggcccgtcgtgcgaggcggacgggcggcccggttgccggctagaggggggccctggccgccacactgtgcgccgcgccggccgcagtgganccggccgtgggtggggttggtatctcggagcggcacgctggggtgccccgggccacggtncagtgtaaccccccggacgggggggcgggggggtnnncggagcgggggcgnccggctaggtgtcgggacggggngcgggggcttgttcctcgggttggctggggcnagcgtggtaccgcgccctggcgtccccgctcgcgcttgggttcgtgggctccgcctcggtgggcgtgccacggttacgcgggtnccggctcggccgcgacggagtgggccaccacgcgagcggggggtggttccgggcttgggccctccctgcgtgtcctcggcgtgagcgctcgtggtgtnntagctacgtgctgtccgctggcggcgcgtgcctcggtgctcgcgcgtgncaccgggcgggtnnntcg

SEQ ID NO: 12490 - DNA, 183 bp, Homo sapiens
  misc_feature (1)...(183): n = A,T,C or G
ttccttaggtaacaacccccaagctgctgcagaanaaaacatcgaaaaactaaaatcttcctcaagcaaatattatattaattgtaggatcgggccatgctcttttcctcggtataaatatgctacaaaacattcttactgtgattttaataaaggatttctctatgggtaaaaaaaaaaaaa

SEQ ID NO: 12491 - DNA, 875 bp, Homo sapiens
tcctgggaacatgctccacccgctagaggttagaaccccactagtctagattcaaaccatgggcaaccctgcgtctccacaacctaagacatagggagggctcaatgttcagaagcacaatgctctacctcccctcccaggatgggaaaggaaaagctttcatttgcaagacagggtcaggggtgttgggagagaagaacagaaagaaatgggtattcatattaaaatacgtactccttggccatgctacctctgggagaccctgatattaaactgatctaggcaagatgagagcaaaactccatctacccaaagcctgcatacaactttgtgctcccataacctatttggctgctctgccacagtgtttattacgctgcattatgtaagcctgtctccccattagactgcacaggaactagagcaaaatggacactcaataaatgtgaagtaaacgaagaactgtgcacatctcggtgggtgcggtagctcacacctgtaatcccagcactttcgggaggtccacgtttggcggatcacccgcatcaggagatcaagaccatcctggcccacattggcgaaaccctgtttatactatattaacaacttaaccacgcgtcgatggtctccccctgtactccactttccccgagcctctagtccggcatctgctccaccctgtgactaaggctcgggaacccaacaccccccccgctcatcaccctcggcccacaccttttcttctctactaacaataacaatcctgcttctgtcctatagttggattctctcgtccgttctttcatccgcctatgcatccctcctcctccgttctttactcttgctttcccacctcatgcattctacattacagt

SEQ ID NO: 12492 - DNA, 428 bp, Homo sapiens
tcgtgtgtcaactagggatacctcctgatgcgatttgacttcttaggagatgtccgctgcggctccaaccatcaagttttggactcaggcaggaagaagaggaaaggtagggggcaaacccgcaaggaccacaagcgtcttttaaggaggttaccttgaggtccatccacctggccgctgctgcttacctctcatctgccagaactgtggcacagctctgcagggagagccggtaattgtagcggttgctttttcagctgggcacatagtcctttcttcctcccattactctaaatatggttctgcaaagtatattcagagaagtggagcttctcatgtcccattcatggcattttgtaaaatagaattttatgactttactaccctctaaaaaataattggagcatattggaccaaaaaaacacaaa

SEQ ID NO: 12493 - DNA, 948 bp, Homo sapiens
  misc_feature (1)...(948): n = A,T,C or G
agggccacaggaacgacaaacaaaaaaaccctcatggtcacccgcagccaggnctgacgaggagaacaacatcaaatggcacgagagcttccagcagcagttgaaatgcaagcccacaagtgcaagcaaagccttgccctttttgtcaaaaatggactataatctggagaacgaatcggaaatacatcataaccaagctggtctaatgactgagtttaatattctacgtaatacgacatacgtctccgaaagcagcacagttgtctttaaacagaacgcccaaacagcgagaagcggcaaatacaccccatcagcgcagtaccagggcgcgagccgcgcccgcattaacaagaccccccgcgacgnccaagaaaagcgacaagggcccgacagggggaggncgaggaggcacatgtctcgacccggcgagccacgctcgtacacgaggcgccccccgcgacctccaacgccacccgccccacgtcccccccgcgacccacggtgccaagcaaacttccaccaagccntcgggcgggcggagtgacgaccaccgcgcaccccctcctgggcagtcgaggcgcccagcggctcggttaacactcccctactccggagcgcaggtacacnnacctgacaagcgcccccccaccaacgcggccacaagcaccgcccccgcgcctacccgcgatgcccggganagcccggcgacggcgntcggggccgccgagcgcggccgcggtcgggaggtatgccacaaccatacagccagagtccgacgttccagacggagagccggagaggggggctttgacgaacctcgcgggagggaccaggcgccgcgactaccaagcacggacccagatacgcagtccncggcccgcccccgctacgcgccacgccccgctcgcggggcacggtggactcagcaactcagacggtgggnnnnng

SEQ ID NO: 12494 - DNA, 368 bp, Homo sapiens
  misc_feature (1)...(368): n = A,T,C or G
cttcaggaagccagtggtctgcaacctggnaagaagatcctcactagaacctgcatctgctggcactctgatcttgaacttccagtggccagaactgagaaagaaacatctgttgtttataagtcattcagctgatggcattttgttatagtagcttgagtggctaagacaacacccatgccacaaatgcaatggactcatttactcagtctgcagaaacatgaactgaaatgctcaaggaatgtgggtgttctaattggttcaacagtctgcttaaatgtgagccaaacctttcactttttaaacttatatcattaataattttccaaaagatacttttcctaaatatagttttatgtccttgttat

SEQ ID NO: 12495 - DNA, 898 bp, Homo sapiens
  misc_feature (1)...(898): n = A,T,C or G
cttagggaggaggctccatgatcttaccttcccaattatgaatttcttaaaatgtggggccgggcgcagtgnctcatccctggaatcggggccttaaagaaactnangtgnttggatcacctgaggaaaggagttcgcaatcagcctggccaacatgatgaaactccgtctgtactaaaaaaatacaaaaacttaactgggcatggtggtgggagtctgtaatctcagctactcgggaggcgggggcanganaattgcctaaacccangaggcaaaggttgcggtgagcggagattgcgctactgcactgcaacctgggaaacgagagcgaaactccatctcaaaaaaatgtggtccatctagaaaatttgcactgatattggttatgtctgcaataattcgctttcatttctttgcagcagttggtttctattggttcccacaacaccaagtgaagagaatatagccacttttctgtaggggcaaaaaatattcaggctttccctcaaaaatacaaaggtaagctcatttcttaatttccttcagggggtgggtaaacagtcacttatagacacacacatgcacagagacacatacacatataaaatgcgtaagatggcacatattataaatatttatacctatatacttcctatgtgtataattctggggatcaaagaggagactttctgtgggaaacatctataatggaaggaggggtatgctataatgaattctaaatgcttccactttggtacaaggacttataactgtaaaaaatattttaaaatggttaataatcatggggagcatattcccaagtggtacaagggctatgataatggtttaattaaagagccaaatgggctgggggagggggtcacccctggattccaac

SEQ ID NO: 12496 - DNA, 833 bp, Homo sapiens
aacacaataactacaatatttatttcgtcatattaggagacgaaaaaaaaagttagataccttccttttccttgttcttcaggaggttgattatcaaattctttgaaggagacttctctgtgttaaatgtgctttgtgtagaaattagactgacacctatgaccatctaatcttcaacaaaactgacaaaagcaagcaatggggaaaagattccctatgcaataaatcctattgggacaactggctagcaatatgcagaagatttaaaatggaccccttccttacactataaacaaaaatcaactcaagatggattaaagatttaaatattaaactcaaaactataaaaactctggaagacaacctaggtgataccatcctggacacaggcaggaaaagatgtcctgacaaagatatcaaaagcaattgcaacaaaagcatacattgacaagtggaatctaattaaacgtaagagcttctgcccagcaaagaacctaacaacagagtaaatagacaccctacagaatggaagaaaatattcgcaaactatgcatctgaggaagatctaatattcagcatctataaggcactaaaacaaatttacaagcataaaaacaaaccaccccatctaaaagtgagcaaacaacatgaacggcctataagttcgaggctgccatgaactatggaatgccacttgctttcagactgggacatggagtcaaactgtttcacacaaacaaaggacatttttccttctctgcacaacggagaagacgcgggattttaaattacgtaactggccccacctttacagagattttcttggcacagct

SEQ ID NO: 12497 - DNA, 581 bp, Homo sapiens
actctcgctaccacgtgactcagcttccacacctacgaaccggagaggaaaataagcaccttgagcacttgttcctggaccttctctgggcctcagtttcagtatttatacatttctaaaatctgtcctactataactaatttataatatgaatttttctaaagatggatggtccggctatggaagaagatataagccataatttcaatggcaaaaataaaagcatttaaaaataagaaggtcctttaaaagttattcatcaaaggcccaaacctattagggtctgattacacaatcttacaaattagcactgaatgaacaggggaaatgatacacaataaaccattagttacaagaagcagaatgcatcaaactttacatagtaccatatacacaggtgcataccagacaatggattaacctgcttttccactgcattcctctaaatgttttcatacgaatcttttctggcatccaagtgtctttcttttatgtcctgactctcctccataagctctctgtcccctaaaagaggctgattaaggccccaggtcgcctggtcccaagctgccgggagtgag

SEQ ID NO: 12498 - DNA, 356 bp, Homo sapiens
ctgttgaacatcaaggacgttgtgcggataacagctgcaacatgaatgaaccttgaagacattaaggtaaagagggccagacacaccagaccacatccttactgtatgattccatttatacaaaatatccatgaaagataaatccatagagatagaaagttgatccgtagttgccatggactgaggtatgcatggtgactgctaatgggtatgggatttcttttgtttttaattgaaagtgttctgaaatttggtagccttgattgttttttttactgtgaatgtacaaaaagccactgaattgtaaaggttatgacatgtcatttttaccataataaaaaaatagaacgaaaaaa

SEQ ID NO: 12499 - DNA, 620 bp, Homo sapiens
  misc_feature (1)...(620): n = A,T,C or G
taaacatttaaactaaaaaatagtttgatatagaatgaaaataaacttgngggctaccccactgaacactttctacgtgaaaccttccctccgttaaagagaaaagacagcctacctataggaaaagacatatgcaaatcatatatccaataagtgatgcgaattgggtcattcttgtcacacccaactaaaacagagtcaagaagccattaggagaagcactcagggaatgtaacagcactttgagaatgtaattttctgcaagcctggattttttaaattgcctgctgtaacctgaaaccagttatatctcacgtttgttgaaacaacctgctgcaattctaagactggttttactgccataactcaccaatgagagcttgccacctccccaaaatttgactaatgccaaagaactttctggaaaaacaatacataacacttttcttttttataaactcccagtcttctcttcattctttggatatactgaagaccatactatgtgtatgtatgttcctcattcgcattcttgtatcccaaataaaatgttaaattcacaaccacaacatataacaatggccctcgctggcctcagactgtcgatcttctgaagacgt

SEQ ID NO: 12500 - DNA, 422 bp, Homo sapiens
aatcttatattatataaatgaatttcaaaaatttaactcgtattaccacaaaggacggtagtgctgatataagctgcaacatgaatgaaccttgaagacattaattgaaagaagccagacacaaaagaccacatccttactgtatgattccatttatacaaaatatccatgaaagataaatccatagagatagaaagttgatccgtagttgccatggactgaggtatgcatggtgactgctaatgggtatgggatttcttttgggggcaattgaaagtgttctgaaatttggtagccttgattgtgcataacactgtgaatgtacaaaaagccactgaattgtaaaggttatgacatgtcatttttaccataataaaaaaatagaacgaataaaaaaaaacgaaatggccttgttggcctca

SEQ ID NO: 12501 - DNA, 807 bp, Homo sapiens
  misc_feature (1)...(807): n = A,T,C or G
cctaggcctctcccagcaagaagtgggctgcaaaagctggagagttctgtaatgcccaatatggccacagattgaggaagaacttcctaaaggactgaatcagaagtcacagaaaacaatggtcaaatcatctctttccgaaaaccaaaactagtgcctgataaagaaatttatttcactgtaaaagtggatttttgtaattcttgttctgaaggatttcatcattgataacaccttgtaactgtcatgtcttccatttttccgtttctcaaatggaaagttgtttttgcatttatcatgtacttctctcccttggtgagcgtgatttcatgggaaaagagtgagcaagacagctttatgaccaaaaggaacagaaagtggaaactgccaaccatccttcaggacgcattttcctcccactcatcctcttagtaattatttgtccccacttagtgttaggtgagcatatatctactcatctagagactatatttcccagactcccatcaagctaggtgtcaagtgactaagttcaggaaaaaaggatatgaaaggaagtgatgcgttcaatttccaggtcatttattttaaagataaagcttactgtcctaggatttcttctattcccttcctgtgggctggaaaaattaacatgaccttagtgaacttccctttattatntgggattaatctgccatcacactgctataaagatactacttgagactgggttattcataaacaaaggagggttaattaacttacagttcctagtggctgggggaggcctaagaaattacattattg

SEQ ID NO: 12502 - DNA, 741 bp, Homo sapiens
aaaaccatgtaaaaaagaaggttttcaggtaacacagatggaggtgatgatctttctcattttgtggaaaatattaattctcattttttattcactgccaattagtaaaattccttactctacctaatatgtagacctctgaactatgtaagtaaaactttatagtaactgaaaagtttgggtattgtatcttcttggagaaaatgttagcttccctctgttacttttaaatgttaaacttttaatgaatttcatcaatgtataataatgggcataatgatccactctgaaatatttactgtcattttgaatttattcttgagtcatcacaaacgtgtacatctcttataccttcatggatgttattggtgagatgatctcttgttgtcaacaccctgaggatagggacttattcaggctcgcctctagcaagtgctaagtgcccgggaacacataataaatatttcatgataggaggatgttagaataagaggaaaaaccagattcttacccaaataaataatatttattatattcttatttgtatatcattgtaactgtaaaaaaaagttgcccagggatttatttgttttatttgtacaaatacttgttttttgtatgtaagagtgccaaatataaaactgcataacatttagaaattacagaaagtgtgtatatatttatatagagacaagaaaaataaaattttcattctatcataacaaaaaaaaaaaaaaaaaa

SEQ ID NO: 12503 - DNA, 526 bp, Homo sapiens
gctaggagcacccccatgtcactgtctacatgaagcagttccctccgttaaagtgaaaagacatcctacactttaggaaaagacatttgcaaatcatatatccaataagtgatgtgaattgggtcattcttgtcacacccaactaaaacagagtcaagaagccattaggagaagcactcagagaatgtaacagcactttgagaatgtaattttctgcaagcctggatgctgaaattgcctgctgtaacctgaaaccagttttatctcacggctgctgaaacaacctgctgcaattctaagactggttttactgccataactcaccaatgagagcttgccacctccccaaaatttgactaatgccaaagaactttctggaaaaacaatacataacatttctcttttttataaactcccagtcttctcttcattcttcggatatactgaagaccatcctatctgtatgtatgtccctcattgcaattcttgtatcccaaataaaatgttaaattcaaaaaaaaaaaaa

SEQ ID NO: 12504 - DNA, 1215 bp, Homo sapiens
  misc_feature (1)...(1215): n = A,T,C or G
agggtggtgaggcggcgcggnaatacatattgnacctctctacatcgtcaataataganacaatcataacatcggctanccacacgtaaggaacacctgaaccacatctttgaataatttacaatctaagatctgacacctagnnccaccgtgaacatacaacatggaancgcaaactcacctcacgctaagaacgancancactcagtatattcacgcgacttgtgtatatatagacgcatatgtgtactatgtttgantacatanaactagtnaacaatanaaatgacggagcgagganaganacacgctgtcgactncggtanannanttatttaataatcacatcaaanaggtaagaaacctcggacgcacaagtatgangangctattatacatatnaacctcaacacttcggctacagtaatacaaacagatacgttacactgagatatcacgatgttatagacgtatgaagngacgataccggaaacgacaggcagcgnatacgacacatcatagaaatgtatcagtggatagacagggtcgcttagagttgaagaatgtagaagtaggtgacgcggcgttcggggaagtttgggggcccggggtggcgactacggcatctgagactatngatcacgttgatggaacatcgaaagctatagnnacaacctactcaccatacaaacgctaggacatcaaatataatantacatnaacaacaatccaatgaggaaagacaggaccgacaatgcgcgactaaaacacacttaatgnnggcctacatcttcatcaaatgggcaagccttacatactntnaaattatatatctttccaataatcacaaatactcgactatnactaaagagacncccatacagcaatttccacttcttactatgnaacgactttgncacatcgagtacacaattncacaggtgatcacactaanaattacaacacngcataaaactccccaattgcatacttactttttctctctttcttctnncctcgtncattttccttgncactctctccactaaatcccactnccnagcatcctnaannaaataaaataancaatgctcctacgtcgctccccttatnnngnnnnacnccccnncccctcccggnnncnncnnnnnncnnnctctnccacnncnnnncnnnnncccnnnncnncctcctttnnnnnnnnnnccccttccc

SEQ ID NO: 12505 - DNA, 527 bp, Homo sapiens
cctaggagctatcccacatgtcaccttctacatgaagagttccctccgttaaagtgaaaagacagcctacactataggaaaagacatttgcaaatcatatatccaataagtgatgtgaattgggtcattcttgtcacacccaactaaaacagagtcaagaagccattaggagaagcactcagggaatgtaacagcactttgagaatgtaattttctgcaagcctggatgctgaaattgcctgctgtaacctgaaaccagttttatctcacggctgctgaaacaacctgctgcaattctaagactggttttactgccataactcaccaatgagagcttgccacctccccaaaatttgactaatgccaaagaactttctggaaaaacaatacataacatttctcttttttataaactcccagtcttctcttcattcttcggatatactgaagaccatcctatctgtgtgtatgtccctcattgcaattcttgtatcccaaataaaatgttaaattcaaaaaaaaaaaaa

SEQ ID NO: 12506 - DNA, 712 bp, Homo sapiens
cggttactcttttaacattaattcatactaattcgcagcgcttctttacacttgttcacttatctctcgacgttatcctcatgtatctttcctctacctttattgaaatagcttctttctgcgctctcagaacaagcattgtgtgacaacggaggtctggtttctatacaggccaatacatctagcctttagacaggtcatctattgaaataatcaaatcaaaatgcctatgttttctgcgtttttcatgcatcatctgcctcataaacataaattcaataaagtggatgtgctccatactgacctttcaatataaatgtgttcaaatgtataaattaggtcacttttgtgtaaataaatatatatgtgggtgcgtgtgtgtgtgtgtatgtgtgtgtgtatatatctatatgtgtgtgcgtgtgtatatattttgatgcagtttgtcttgttatcccaattaattgtctctgcttctaaaaataatttattgcgacgatattttcttatttaatcattaattttcagtcatgttataatgttagtaaaactgtttttcttaatattttctcccataatttgcatattgtatctctaatgttctccttttgctgttattgtgtctacataaatgttctcatgatgtatttataaactccctggggtttagggaaataaattttacttgttcattttaaaaaaaaaaaaaaaa

SEQ ID NO: 12507 - DNA, 657 bp, Homo sapiens
gggtagtggtaggatgtataaatctgacctgtgttccctgagggaagtgcttgggcgcccctttttttggaaagatttgcggaacacccataagcatggatcccacactgtttcagagaatggggagaagtttggcagagctgaaccagacgaccttgaacccaggccttctaatggcaggcacaggcaccacccttgtcaggacaggacaaggcactcctcagggtgcccagctccaccagtggctagatcctactccacactcaatcctcacaactacttggggcaacccatccctgcgtaaaagtcccatttccataatggcctcctacgcatccctaacagccaggaccaatgctgctactcttcacgaccattgcacatttggcctcagcacttggtttaagaatggattccccaggtttgtaaaaggggcatgacaaacttcccgaagcaacgcccttcttaaggccttccgcctggtttcgcatgataccctcacggtcttggtaggcttcatgtctcttcctcgttgcttaactttgaaccaattccttcttctggtactcgacttccacttgctcacctccctttcctctctccagtactgagactcttaaccaaatcttcggctgcttatgctacttaagtttccct

SEQ ID NO: 12508 - DNA, 1542 bp, Homo sapiens
  misc_feature (1)...(1542): n = A,T,C or G
ctgtgtctgtgtacgtccctgatctctntgtgactagctctcngactcggactgcngcgtgacggagcagcgagaagcancnacgaagtgcacgaagnanaccacgcgacagcngaaacgtgacgagtntcngcgtagcatggcgacgagagagcgcncggatggangggancgcggcctgntcgagagcgatacgagcgctgagngnatcggtcgcgtcgactgcggttctgatgcacgnccgtcgatctacgcagtgctgnccgnanctagcagnantagcataccactagcgactcagtacggnagtgacacacagcgngcnacgacgcggantacgagatatcagctagctactactgacgcncancatgacagagagactgngtagantacgagcgncganagngcgggcgagtcacagtcacgagcagacagacgggngncncaacacagcgctgagtngtnacanaacgtccgatagagntgncgaggccgggnacacgaccgcancagagagacgtacaccagacnaganancaactggcacgtcacacacgntaacactacatnctacaaccagccgnacacaccacgacagagacnacgataaaacaaatacaatacgaacgcgcgcgcaccgaacgtgganagcagagcgagaatgancanaacgncntactacaccgccanacacaaatcacacagagtatacattctgacagangaaactaacgacggnccatncacagcgggggctggcttcaacgcgcgacgcgcgcggcggggcgccgcgngcggctgctcgcgctgcgtctnggcgcncgtatgcgctcgcgtggcgcggcggcgctgcggctgcgncgcntaggggcgcgcggggtcggcgtcgcgnggcggcgngngcgcgcgggcggtntgtggcgggcgcgcgtnggtcgcgggcggtggcgcncgcngcgcgcggcngcntgcgggcgcgcgncngcgcgtgcgcgcggcggcggcgccgcgccgcgccngcnccgcgcgcctcgngcgcgncccctgcgtgccggggcggcgcctgcgcgcgcgcgcgcnggccgccncccgccgcgcccccgccncccgccaaacgaaagaagatatttttgtttttctgnctgtttcttctttgtctcccttgnccggcgctgcgtggcgcgcggccgggtgtgcggntgttgtgtggcggcccgtcgcgtggcgcgncgtcgcgcgccccgccgcgcggtngcggtgtttgcctggggcgngcccctcgtngttcngcccggcccgttcccgcgcggcgtcggcgcggcgcggtgccgcgcgcgtcngccccnncntccggggggcgtgcnctcgcggcggcgcctgcgttcgaaagctgcttcgttgggggcggtgcttgtgctgtncgngcnggngcgtngngctgcgcggttttnntcngcgcnctnncaggnttttgtgtctgtcgnnngtnncncngnagcaaggnnnccctcttcttttttttcttttttcttaatctcg

SEQ ID NO: 12509 - DNA, 505 bp, Homo sapiens
  misc_feature (1)...(505): n = A,T,C or G
tcttagggtatcncgctctgncctccaggcnntaccggctcactgcaacctccaccttccaggttcaagctattctctcacctcaacctcctgagtagctgggactacaggagcctaccaccacgcttggctaattttcattttttttgttgttgtttttattttgcacagatggggttccaccatgttgaccaggctggcctaaaacccctgatctcaagtacttccctcctcctcggccttcaaagagctggaattacaggcgtaagccactgtgccacgcccatttcatgctattctttaaacttacttcccttcgaaaccaagacactattaatcagcttacttttaatgcgcccaacacaaactaactgctcactatccattgcacgctcaattactttcacctttgcctcacccctacctgctcttacccaacttttcacaactactttctgccacctcgcatcttcactttcccacccatcctccaactctcaaagca

SEQ ID NO: 12510 - DNA, 760 bp, Homo sapiens
  misc_feature (1)...(760): n = A,T,C or G
ccctaggnccgtccgagcttctcgcctctccctcttcactcgagcctctgccaaaagacctactcgccccctggcccgcccgnatccctatgacattcagccacctcgtccaccaactctcccttaagctgctgcgtgcccgctagctgaccccgccccacctcattccccctttctctctccctctgctgcctgccccttccgttgacaccactaggaaaaacctcccgacgctacgaccctcggcatgcacccgactctctggtggccacccgatggctctacagcctcaaatcctgcgtgagatagccgggcaaggaacaaacaaataaaagaaaaatgaaccttcaacccaccggtaaccccatctagattcaggcatcagagccccccgccaactgggcgggggggcagatgagtgtggcacgagagcctcttcattgtctcttacgtaatagtgcactttttcttgtccctccgaacaccggctaacctcttctctacatagcgtttctaaatttactattccttacccatctccacacaanaaacaaaaacacaactttggttgtagtgttggcacatataatgcgaacactcctattcaaatatcagtattctggaaatacatatccgccctaacatcttttaagatgcagattccgagtttccttatttaaatgacacttcaccaattgagggctggtatcattttctctgttttgtttgggctcataaacacatttttgtgttaaaagga

SEQ ID NO: 12511 - DNA, 771 bp, Homo sapiens
  misc_feature (1)...(771): n = A,T,C or G
tnaaacnaatttntatntgnncaataaacccccngnggtgatttcacccngtntttaanattttgacnncnattaaaanccntgggccctgccntngaaagganaanttcaaccnnctcccccntggaaanaaatttccaaccanaaaantttntattncaagcnaangangttttcccgtatcnctnaaaaaatgncannnagncccnnccacccccaaaangattaaacccngntttttncatttaanaaaggntnatttntggncagaccaatnnttnttttatcaggcncnccaaccaggcnaatattnctttanatgnccatctaanagggcntttccannttctatcnncctgttgtttggttgaatatgttaacaaaataataatccccctnnngatctttcaaatgaattccaattggaagaaaactgcntgggtatanagctttgagtcaaaaatatttttttgtcagtactcttgtacatcatggcactgcttttcaacctgcggttactctgttnaagaaaactgaagccaacttgaatgntgttcatttattagaaatcttttatgattgggttttgtantgttganatctgggaggcttttnatttctaaatttagtaaatttataaatgtccacaagatattttaagtcagtgattttntaatagctttgcnctatgnacattttgtttacaacatgnattttcgaaaaggactgatgtgtaaaagaagttaaagccaaaaccagtgtgcctgaaat

SEQ ID NO: 12512 - DNA, 798 bp, Homo sapiens
  misc_feature (1)...(798): n = A,T,C or G
ggtnagaataatattatttannatntaaaagggttctaancanaantttctngaatnnattaanaaccattcnnntgagtaaatanngnagtagacccaaatntatanngntttcaaattgngacnattntaatntnttntaaaggggnntntccacactanngggccccacnactngangganaatatannggcccncncnggggnaaaatgtgnnnngngattncgntgnnaaanactatnagccggncnaaaaaaanggtaccccnagnnncaaatannaggggaataannatgcaaanaagacnntgtcacnntgncnaaaacgnagcaaagnggtagtcaatccangcatngttgatatnttatgagaaaatatcaaaattttgtaatnntgtgnaaccntaantaatgctcagccanntgngtaggaaattgcaagcnagggtataaagaannttctnagcnacanattataaagccctgntggaagcttntggagnaagtgctccancaaaacaaggaannaacagtaaaaggatacatggattgttttanagaaacaggaaattggaaacgaataagcaaaggcaaatttctgatgcagcagagcagcaagcaaggagtttaatcccatcaaataggtgcagggtgatggagttatccaggacttatgtctccaaggaaaacatgaggcanatggattgctgaatatatttgatcctgttgaagngactaagttttcctttagagaacctgagaatgtataactccagggaaatcaataagttgtanaat

SEQ ID NO: 12513 - DNA, 676 bp, Homo sapiens
  misc_feature (1)...(676): n = A,T,C or G
ttctatattaattgtgtataanctgctgacttaaaataattttgtcattatataaacttataatgagatctttatggttattcgtatcattattataatttttaattattgttcttactactattaattttattttataccctataatttctcttaatacattaatataacaaatctcatacatatctaatattttatctatttaataattatttctttgtttatattattttatttctcttttttattttctaccatactactacatataaacgactacatcaacaatacttccgatactttcttatgatattacaatatttttttcatttattagtttgttcttctgttatattttatatattcttccattttttattgtcactgtgattatattaattcnccaatatacgagtgctccacaataccatcgctacattatctattataataatattttattaatatncctgtaacgttttgcgtagttattatataatgtattatttataatttaggttcatagatatctttacgttaacttatcattctgttctaatttctncncttcttctcctatgtattttgtattttctactatattacattaaatacagtcgtttattaatcagctcttaattaagatatntagagaataatatattatttctatact

SEQ ID NO: 12514 - DNA, 1586 bp, Homo sapiens
  misc_feature (1)...(1586): n = A,T,C or G
acattctctgaactgttccagagcgcgcgtttacagacatcgcatagacaataatatttaatcagccacacaggacaatttactgaagcaaagaccgtaggccataagtaactcgcttcgtcatacgagcgttgcgcatatgttgcgctagacaatcagcgccgcggcctcacagacgagacgccatgagatatgtaccaaatcgcctccagcgtatcatggtcgtcacgtcctctgagtacattcgttatctagacgatcagtctcgtcagattcacgtctgtcgtantcatctgcacagacgtttagtggctcggtacatggcgacacgcggctagtttctatgatcactgtgatacgacagccngcgcacgcacggtagctacagtcagacacgtagggctagacgagagagtgacgccgacgcgtgagaatagacgcaccgacgcacntcctgagtagtgatcgcgcgtgcacagactcgtcacatatgtccttacactgactcgatcatgtgctgacccgcattnacatgagaccgtcgcgcgcgtctgnattactggtgcgtatgcctagagatacgctccgcgcgcgatatcgtctgcaagagatgacatcatacgactaggtaagatgcttataccncaagataccttctcgtcataacgactcagtacactacgacagatcgcgcggacgacgtccgaatgccantgagcaagcgcgacgcacactntcatgcgatctacgtangcgtctcacgctgacgcgacgcaatctcaatcctcctgttattcagtccaatcacgcagcatagaccgcaacgacataacatagagtgcgacgcatagcacgaataataatatgtagatctgagaacagttacgtcggtagataggaggtatagagagtgacctcntctcttcagcacgcaacgtcacaatatacgacgacacatctatcaaccgactgatagtttataagaagtaaaggcgttgaagcgccttatcgccgcggccccgcttgagagggtactggatatcttttggcgtgtgcctctgcctcatgcactgcactggactgacggatggtgagtccaagacgctgagctgtcancgtatcaacattatcgtgtatgcagcgtggctcgtcatgcacaataaggaggcgagacacatattataactacataactaatgcgagagtgtgatgctagatcatcagctcatactcgtctttctacacgatgacgggagcggtaagcagtgtagagacgagtaaacgactatctcctccacctcatctccgctcatagtagcatgccgcccgnactcactcacacacgactaccacagttacgtctctgccgttccgtcgaacgcgatactactcatgtacggcacgtcgagcatgatccaattatagctacataatattaacgcgagaatatgcaaatagtgacaatactcagcacacactacacatacgntacgatgtatcatgcatcgtagactgttatacatccgcgcgtgtgtgctatntcggatctcgcagaagctgtggagagtggatactaagggcagccg

SEQ ID NO: 12515 - DNA, 887 bp, Homo sapiens
  misc_feature (1)...(887): n = A,T,C or G
antcaaaacaanatttcctggggtttgtnnnccccncncccccnccccngggggaaaaaaagggacctccccccccnaatnaaaccnggtttcaaaaggggggacnctttttaaaccttttntccnagggggggttcccccccccccccnaagnngggccccccccncccccngggggngcccaaaaattttncangngngccccccncccccggggggganccaaantgtccccnccnanagggaatccccncggtttntggnagccnttttcaaangctttngtcccaaaganaaaaaaggggtttcccccccngggttntccccaatttccnggggggngggtttaaaganagccccangaaaggcccctttntgttccccccctngnccaaaaaccnagccaaggggggaggtccaatccaggcctgggtggaatattttttgagaaaatttcnaaggtttttgntantncttgnggaanccnaaataatgcncgcccagctgggtagaatttgccagccagggnttattgagaaacttcttgagcaccagatcttaaagccntggtgnaagctactggaggaagtggctccncccaaacaagggaaccaaccagtaaaaggaatncatggattgttttaaagancaggaaattggaacgaanagcaaggcaatttacgatgtccaccagagccagcaacaaggaggtttattcccgtcaaattaggngccaggttanngagttatcccagggcttttgtttcccanggaaacnngaggccagangggtttgctgaatatatttgttcctgttgaagtgantaagttttcctttagagaacctgagaatgtataactccagggaaatcaataagttgtaaaat

SEQ ID NO: 12516 - DNA, 924 bp, Homo sapiens
  misc_feature (1)...(924): n = A,T,C or G
tgggnganantttttnaccntttttnccaaggggttntcnccncaccaagtngngcccnccnagnngtgggngaaanatttanatnngcnnnccnagggggataaanantcccnncagagagtncnccnatttntagagcnntntnaattttnccaaaaaaaangngttccccncggatntnaaatnntgngggggngaanaaaagcnanaanaagcccttttttcacntatggngnaanacncancaagggnggnnccaanacnggctngtttanatattttntnnangaaaattcccaagatttttgttaatactttgggggaaccccaanaattaaatggcccnccnccccccaggtngggttanaaaaaatattngacaaagcccaaggggnatntatntngangaaaaatntttttttgaagccnaaacccaggatttntttaaaaagccccccttngngggggttcctccaaagtggtggaaagatttcaaaaaaataagcccnttggcnttggaacggaatggtttgtttttaaaattccangaccaccccnaccccccntaatggttatttttggattgaanangaccaccntaccntgtantattcttncagagcaaaatgatccccagatncggtcatgattccaagttttttgtntgttttcattgtctccctaactggaaaatccatacgcgcccatttcagttcatatttatcttcaacctgttgggcctaacatcgttcntgatatatagtgggtgttctataaatatttactgaatgaataagttggttaatgagtagaatataggttttttccctttataagctctctaatattttctgatttctataatcctattaatttagggctgtagaaatcaattatgtttatctgattgctactcatataat

SEQ ID NO: 12517 - DNA, 324 bp, Homo sapiens
ctccaccaccacaatgcaacaggaacgacagcagccagcttcaccaggggtggcacaatagagcaggatgtgggagcaagaaatgagagagaagcctgtctgatacaaatcttccagaaggacacagagatgcttagcaagcgccctgcagaagaaattatttagctgggaggggtcagtgaattctctatttatggataagcacaagctggctatccaatttcccactactgtttatcttcctaattacatgataaggaggattattttattctaattttggtcttaaataaattagaatggccactgagaaaaaaaaaaaaa

SEQ ID NO: 12518 - DNA, 198 bp, Homo sapiens
accaccccgacaaactaaacaataaaaaaacacccaagcgctatgaggtacagaagctgctttattgtgctaacaacttatcaagacatcctgacatgggctggatataaggcgcctcagggcaaccttgaagcggagtgaaggttattgtggctaaatgaataaagctagacagaaaaactgtcaaaaaaaaaaaaa

SEQ ID NO: 12519 - DNA, 353 bp, Homo sapiens
ttcttaacgatactactctggacttttcaggagacaaccatgtcacatgactccctctgaaaaatctttgtacttccatttgtcatctcttaatacctcactgtcaaccttggaaagttcatagttacaactaaagatctcccacctcaggaacaacagatacccaggtctcactctgttacccagactggaatgaagtggtgtgatcacagctcactgcagccttgactttccaggctcaaacaaccctcctgcctcagcctctggagtagctgggaatacaggtgcgagccaccatgcccagctaattttttaattttctgtagagacatagtctcggaaaaaaaaaaaaa

SEQ ID NO: 12520 - DNA, 1130 bp, Homo sapiens
  misc_feature (1)...(1130): n = A,T,C or G
cgccgcacagaaggaaacgagcccagcaaaacgacccaccgcgacagaacacccacacaccaccaagagaggcgagggggcataaaaagcgagcgaacagcgagagcaaggtctaagcaagagaacaaagccgccggcggcggagcgggcacgggcccaacggcgcacgggcaggtttacgagcgcggagcaccagcaaccacagacacaaccacgacacaaacaaagcaccaacaagacaaccaaggcccgcccgcccggccgcgctggaaggggacgggagcgccgcggcacggcccgcagggcgcgccccgagccgcggcgcaccagagaggaaacagccagagagagaaagagaaagaagagaagggcgggggggggaggcgagcaaagagggatgaagaggagacncgcggcgcgcccggggcgccagacacacaatcaacagccaagcgacacgcgagacaccccagaacaggcacgggcgcccnaccngagcagcacacagcaagcgaggacggcgcaacagcgcgcgacgaagaaaggaggcggcggaacgggcgcaggcacgccacgcgatccacgcacccgccggcaggagcgcgccccagcggcaggcaaggacgcacagagaaggagggaggaagcgaagaaacaaaacaaaacaacgcacgagngtgcagagggggaggaaaggagccagcgcagcgagggcgcgccacagcagagacgaaccacaaagcagacaagccgaccgaccgccccacgccaaaaagggcgcgcgccagcgagcgggcccgagggcgacaggacgagaacgagagacgacacaaaacgcgaggagacccgcgccacggcccggcggacacgcgaacgcacgcggaacccagcgcgacgagcgggcacgcgaggggcgccagccagcgccgcgcggggccccaaatgaagacgagcgagcggaggaacaagaacacacacggcgcgcgggggagaggaggagaatgacaagagagagagagaagggagcaaggaccgcgccggcgcagcgcgacaaccaaagaacaacaagccacgacccagaaacggccccgcccgaaagcgacgcagcggcagggagcgcacagcccgat

SEQ ID NO: 12521 - DNA, 733 bp, Homo sapiens
  misc_feature (1)...(733): n = A,T,C or G
taagtgtccaccaatataaataaaggtgcgctcttaattaggtatcccgataaaatccgcagtatactctttttatgaacttttgtactttccatgtaagcctatttagctgtgatatttctcatctaaatataggtaggtctaggtttttcttttaacagaaagcttggtctactccttgaacttaaaccttgatgttatgcatgggaaaaggtattgatncagggcacattccctatcttttcctctggaaaaggagtaaggcagttaggttttttttttattgcaagcaacacaaagttaccttaatcaacctattcaaaacatgttagaacatactggaatctcactcactcgctcctctcaggacactggacaacgtggataggactttgcaagaactaaggcagctccaaaaggataaaaggaggacttcctggataatcctgtagaagatggtgtttgttcagggagcagctgctgaaatgaatgaactctaactctacactctttaagacagtaaccaccagccacatgcagtaattgggcattgaaatatggctagtctgaaaaatattaatacaagtatgtatgcatgtgtgtatgtatgctattatgttatacatatactatctcataaattgtttttataatgattacatgttgaaatgatattttggatacattgggttaagtaaaagtatataatttaaattaaaaaaaaaaaaaaaaa

SEQ ID NO: 12522 - DNA, 254 bp, Homo sapiens
  misc_feature (1)...(254): n = A,T,C or G
cctgacggactgctccacgagagtagagaccatcatctctgtgctcaccgttgtatgaccagtatcctgatgagtgngctggggggtaggtacatcaggcactcaataaaaatttgatgaataaacactggattttaagcaccgtgttccccaggagctcctgaatgaaggacatcactcagctgtgttaagtatctgggacaataaatatactagtttcaaaaaaatttataaaaatgggggggttggcctca

SEQ ID NO: 12523 - DNA, 724 bp, Homo sapiens
atttgggcactaagaaccgagccacgcccccatggcacgttctgagagggggacaagggaacttttcttgttcacaaccagtattaaccataaggcacgttcactcgtagtgttctttatgtagcccactgttggggtctttgtctacaacattaatcatatctgaccgtttttcccccgtacatataaattctgcatacacaatttttaacaggtgtataatttatggtgtggctgtggcataatttatttaaccagtcatccatacttagtcattttgtatttttgacttcatacataattctatgagaaatatcttctcctataaatctttgtccacttctctgtcgggtggatttcatggtgtgggatgactgggttagtggttattgatcctttatattacattgatctattttgccaaagtgtccttcaagaagactgtgctgattttcagctacatcagcagtgggatggtgtgcctgtttctcaatactcaggataagattataaattaaatttcttaaaaattgagaccaaatataacaagaccttgtttaaacattgattacttttattcctattagctaatctagttttagaaaaacgtgcagcctcaacctattaggaaaaccaatagttgaaaacattgtagtaaatctttattgtaattgtaatagcacatggataaattttgatataacttccaaaaaaaaaaaaaaaa

SEQ ID NO: 12524 - DNA, 1010 bp, Homo sapiens
  misc_feature (1)...(1010): n = A,T,C or G
cttgttatatttctctgttacggtgctgctgttcttgtttctgttgtctctgggaggccttctgcggcgctgccaccccgtggtgtcctgttgggcgtccgcttgaggtcctttcttcctacgcttggtccctgttctcttctctgcccggtggctttgngttcccttccttctcctgttttgacggcgctcctgccctcttagcgctgtgactgtcgctgggcttttccggcctttaaggtgcctcgtttcgccgtgttgtcgcgccgtcgcctgtgcgttcncctctgtgcctctgacgtttgttatttccttatccttctctcgtgttgcttggctcctcggctcctctttgtcncgntcgtctcgcctgcgctcttcgtggctggcctcgtccgtcgctcgtcctctctgccttgctctctccgtacgtcgctgttcgaggcacttgttctggccttgcttggctncctggtctgtgggtgtgttttctcgtagtttgttcatctgtatgcgctcctggctggatcttccctctttcgtctcccttngccgccttagngtctgtcgtcgcgggctggtgtngcgtgggcgcgggtgcggtagngcggctangggtcgtgtcttcctgtcctgagctccctcttctcgtgttgccctggcgttggccttgtgctttcttctgttgtntcttcccttcttcttcctcttcttgtnncttttgctccgtttgcttgggtcgtgtgtcttttgatctctcccttcgtctcttatctctctgtcctctttctttttgtctttcgtggtgtctgtgtcttttatggtgtcttcctatcttcctttctttgttctttttctctctctatatntctattagctcttctctttcctggccgtaagagctgtgcatgtcggacgtctaaattcaacataaaatataaaataaataaaattaaaattaacaataaaaacaaatggataagtataataaaataaagaataaaaaaaat

SEQ ID NO: 12525 - DNA, 232 bp, Homo sapiens
tctttgaagacataaagcaccagactttagttttccttctgaaaatttgctgttagagacgttgctgcacatctacctggtgaaggcataattttatcactcttataattaattgctttaaaggatgaattgacctcttcagtttttgtaaaaatgatgcatttatatgttttatcacagcaaaaaaaaaatcaaaataacatgatgtactgaaaaagcaaaaaaaaaaaaa

SEQ ID NO: 12526 - DNA, 273 bp, Homo sapiens
ctcagttgcttgttgcatgccttctaaacagcctaccctgccaagtgccatgattactgtgaccacatcttcagaaccagaaaacaggatacctggccctaagcatgcactcatggagcagaagagttttaaatctggaatgccacagaagacagaagataacatgcttactacacttgtaaagcaacatgcagccagccatttccagtgcaaattatctcattgcatagtgtgacaactaaaggtcataaccataatgcaaaaaaaaaaaaa

SEQ ID NO: 12527 - DNA, 410 bp, Homo sapiens
  misc_feature (1)...(410): n = A,T,C or G
gctanggaggacacttgaaacagtctggaattcagctctcatatatcagagaagaaataaatttcaagagagccagcattctaccttcgggcaagaagattttattcccatttggcagatggaatagctgaggtccaggaaagttaaatatcttggtgtcaatgtctccagtcatgtaaatggtggaagctttttttaaattcagtactatcacatataacataccacatggcttgtatcagtcagactagccccaaacttcaatgtcttacatcagtgaaggttttctatttgtagcccatgctacctcatccagggctgtgcgtttggtttagatgtttttattcacaggtgcagactgattgagatacatctattactagttccattgcagaagaaaaaaaaaaaaa

SEQ ID NO: 12528 - DNA, 898 bp, Homo sapiens
  misc_feature (1)...(898): n = A,T,C or G
gctcagtgggacgcctcatcttgtctgcttggcttaacttgctagcactggctacttaggattctgatctatctggcttggtgttggaaccctctgccttactccaccccatggggtaaccaggaagctataaactggaattccaatgacagtcccatcctctctatccagcctcccaaagacaaggccagtaaaggacttcaagggaaactttggatatctaagtctcgttattaagtacaagtacgtactaacataaagggaagtcagagactcaaagtacacaggggagttaatgcatgagaggttctccattgccagtttgaagatagaggagaccacaggacaaggcatgcaggcagcttctaggaactgtgaacagcctctgacaggaaacccaggtggaaaacaggaacctcggtgatgcaaatcaaaggaactgaattcagccaagaatgaccttggaaatgaactctttcccaaagcctccagacaagaacatagcacaactgacgcctggattttacccttgtgaaaccctgagcagagaaagaacccagccacattntgttggacttctgacctacagaattgtgagctaataaatgggtggtattttaagctgctaagtttgaggtaatttggtaaatggcaataaaaactaatatggtggngatatcttattggtgtattatacccccaatgccaagtgaatcctttgatgtgaaagtatatatgggcattaacttcaaggcataaaatatttggatatattttcagtagaataaaagccaataaggggatagaataaaaaaaaaaaaggcctcgtgcctaacggtggacttgcgccgttcctttagaggtaatatatcccctactgctcctggctcgcgtcgga

SEQ ID NO: 12529 - DNA, 291 bp, Homo sapiens
  misc_feature (1)...(291): n = A,T,C or G
taatatgatataaatattaaattaatatatataaaggagaagggggggagggngtgggggcngacttcactctaccgtgcgactgaggaacgcgagctatggttgcccaccactttagatagacaactcatcttgtaaacagaagacatacacttacagtatgaataaatacagtagagtactttaaatgtattttctcttatgattttcttaataacattttcttttctctagcttgctttactgtaagaatatagtatataatagatgtaatatacaaaaaaaaaaaaa

SEQ ID NO: 12530 - DNA, 533 bp, Homo sapiens
  misc_feature (1)...(533): n = A,T,C or G
ccttggaganactggagaaaggacattctggggattgcatatcatctttcttaattcccacgactaaagaagcaggcttatgtggagatggcagaattatttgcatagaggcaacaatagcagttggtaaatgtgtttcagtagaacccatggtgtccccacctccagggtgttcctcagccaagtgtgtcccccaacaattcatatgttgaagccctatcccccacccagtatgtcagaatatgactgtatttggaaatgggctctttgagatgtgattaaattgagactgttgaggtgggccctattacaatctgactggtgtcttccgaagaagaggaaatttgaacacacaaaagacatcaggaatgtgggcgcaacagaggaaaccccatgtgaggacacagcgagaatacagccatctgcaagccaaggagagaggactggcagaaaccaaacattgatctcggactcctagcctccagaactgtggaaaaaataaacttctgttgtttaagccaaaaaaaaaaaaa

SEQ ID NO: 12531 - DNA, 253 bp, Homo sapiens
gctggattatcaaatgatattcctctgtctacgacctacaatgtttctaaagagaagaaagtggttaattgcaccgcttccatgttctcataattctatttttccccttttctgttttcaaaatttgtctttgtttttggatgtcagaagctcatgatgtgtctaggtgtagttcttttactatattctattttttttcacctctttggatctaagtattaaagtttctcatcaaatctgaaaaaaaaaaaaa

SEQ ID NO: 12532 - DNA, 125 bp, Homo sapiens
caggtacccagctcaccaccaagaccaagtgaagaaaacaaatgtgtctgccgttcctcacgccccctgctccagtctcccatcctcctgctaaggaaaagtacagaaccataaaaaaaaaaaaa

SEQ ID NO: 12533 - DNA, 780 bp, Homo sapiens
cctagggccctcggatccactttgatgggacatccatggaaaccaaagagataagactgtgcctcgtcaataaaaaccccacatctctgggactctgccacctggggcattgttgccctgaaggaagaagctgaaggggagatttagttcatttgattatcagccagagaggagccatccttcaaggcctcccagcctctggctgcagcagtaactgtaacactttcagcaagtctgtacctaggccttgatctgtgtgtaactttggaggtagttgagccgttatttgaaagaatattattttgagcaaaggaaggagcagtaagagctttggctctccaatggggaaaaatgtattcatcctttcaaacctctcagttagacttaggcaaaatgcccaatctgcagaaaacaattggagatccctctgaggtcctacttggtggatcttctctcttagaagtgaatagacacaggagcacaggggtcttatgcaatgggtaaaagttcctgcctctggacacacagctcaacctccagtctctgatagagggaggacctatgcctttccatgtgtgcgcataactcaccagcattttcccttgcctgcaaagatcagtttctactgctccttccttgactcaaatttttatttgtttgaataatgggttaactacctacatacctggtactaagaatgcctggaagggactgggactggctcactgtaaaaccagaggggtcacttttggagcttggctaatagtatgattcaataca

SEQ ID NO: 12534 - DNA, 787 bp, Homo sapiens
ctaggaaacacgacctgtatcaagtatttccatttctgtcatgcctgctctggacaaagggccatcatctgagcttgtcacatgaaatccagccaattccatcatactttgcaagagtccagatctctctcactgccgatgcctttggagccacaaagtgacagtcagcccggctgttatggatgcccaacacatggcaaacctgaaaataaatgttacgaaaaaggccacagggccataatagagttgttattagagccgagatgagtgctgcaaaatgactgaacgtccactatctagagaggaacagaaatttcagagactgggggtagatgactggtggagttggctagttccaacttccatttcggcaactgacacacagatgcagaaaaagctgaatgtattctaatgcctttaaaaaaaaaaagaaaatccaaacaaaccatgagtggggctagtttacagtcatcaaatggtgactttcatttgatttggaatgatttggaatgcttttctgatgtgttctatctttcctataaggaattgtgagcttattatactcagacatctgagagccagataaaagagagatcttgcctcaacttctctgacaaggagataggaaggaatagtgtacggccaaaacttagggctcaaatcctggaaaaagtccttactcttcatctattcaacttcctgtctttataagtattaattttgaaacaaatggcgtaaagtgaacctttttttaagaatgactatactttgtcaaatgatggaaaat

SEQ ID NO: 12535 - DNA, 400 bp, Homo sapiens
taggagactgagcttcaattctctgaggggaaaccaaaaaaaggagagaagaaaaggaactattatctgctcagcagtaaactatgttctgggaagatataccttaggagggagagagaatcataaacatacataaaaactaataaacacctacttctctaaagcagatgtaacaataaatagtatttggaggttactaattggtgcttggccactccaagaaaatagtggtcacacagtgcttttatttcacataaaccaagaattagcagctaatgtaatagtcaaaatctctttgctcaagaagttagaagatgattatttattctactgaggatatttatcaatgaggatttatctttaataaaatttgttggggaggattggaaaaaaaaaaaaa

SEQ ID NO: 12536 - DNA, 124 bp, Homo sapiens
  misc_feature (1)...(124): n = A,T,C or G
cctaggtcatgcgaggaggcaaacanaggtcaaagatggcaagacacccagctagtaagtttcagagctgcctccagaattcatgcctgctaattcatactaaattgatttgtttcaaaaaaag

SEQ ID NO: 12537 - DNA, 313 bp, Homo sapiens
  misc_feature (1)...(313): n = A,T,C or G
gtcttgcccgaantatatcaagcctgttagccattttgactgaaacaggaccacaccaaaggcaaaggctggttgtttcagtccagaggtgtgcctccatagaagaattactttgaacaaatcttaatagattttaggaaaataatttaaaatcaactgttggagaatttaactattttcagatgaacagtttattgcttgattgtttttcccttcttattcttccatgtggttttatgcagaagtgatctggttgtaaaatatgaagagatggcaataaactcatttggcaatatttggaaaaaaaaaaaaa

SEQ ID NO: 12538 - DNA, 183 bp, Homo sapiens
aacttaaggcagtaggggccattcccggcatttcagaatgcctgttatcgaagtttgtttgcctgtgatctaatagaggcttaggtttgaaagcccatctgcaatgccaactcctggaatgggacacagctatttaactgaactgatctattctcagaactaaaagactgatttaaaaagaaa

SEQ ID NO: 12539 - DNA, 1091 bp, Homo sapiens
  misc_feature (1)...(1091): n = A,T,C or G
tcttcgtgtgtcgggtgtgtgccgcgagaggtcttcgctgcgtgccgcggcgtcccggtgcggccggcgcctcgtcagtgcgtttcagcgccgcgcgcgcgcgcgcggtggcccgctgtcgccgctctgcctctccgcgcgtcccgcgtgtgtgtgcggcgtcccacggccctgcgtttcggctgtcgcggcggctctcctcgccgcgtgggttgtgtgcccgcgccctcgcttccgctgctctcacgcgcgcgggccgcgtgcctggccggtgctctgttcgcgctgttcgccgcggtgttcggcgctcagggcgcgatcggcggcgcgcgtcggtcgcgccgcgggtgccgctcgttccgctctttggtgtgctgtgcagcggtgctcgctgttttggcgctgcgctctggctccggctcggtggctcgtcgcgcgcggcgtggagtgcgggtcgacgcgctcctctctgtttctcattgtcgtgcgtcgtgcgccgccgccgcggcgtcggccgcgcgccgtcggtgtcgctgctctccctccgctgttcctcgtggtcatctcctgtcgctccgtcgcgtnggcgtggttgctttctgtcttggggcgcccctctggccgtccggtggctttcgcgtggttctgccgcaccccgctcggggtgcccgccggccgtcgtcgtccgtgcgctcctttcggggtccgcgtcgcggcgccgccgggcgcgccggcgctcccttctcccgcgcgtgcttgtgcgctctgggggggttgtggccttccgtcttgacaaaagaagggcctgttttgttcttcgcgccggcggtccgcgttttgcggtgtgcgtngtgcgtgccgcgttcttgtcgtcgggcccccgtcgctgtgtgcgctgcgccgnccgcattcggaggccgttcctctgtctgtacgtcgctttcgcctccgggcggcctgtctccgttgttctaactctggcgtgcgtacggaacgtaacagagcggctacaaaacataaataaaaaagataaaaaacaaataaaaaacaagaaaaaaataanatgttcctcgctggccacngcggggagc

SEQ ID NO: 12540 - DNA, 746 bp, Homo sapiens
  misc_feature (1)...(746): n = A,T,C or G
gaaagggcattcctttttcaaaaagcttcttgtttcaaacatctccttttgggaaagtattggtactattcaaagtgaactggctagacaaaccactgcacgtgcatgcaaagacacccnccaaagacacaccccacacacagttcaattcaatcgaatggtaggtgtttcccctacgtgtctccagacaattcgtacttttacacacatttgaaagttttaacattattttttggtccacaagaggttttttttttttttttccttttgaacacaagtagcctggcagcaaatatctaaaaattatgcaacggacatagtttttattccatgtgtggagtatctgccagaaactccagagcaggaggaggggtgatgctttgtgtttcatctcaagaagcaggagccgccttccagttttgggtaacccctggcccagcatggtggtggggatgaaaagctggggaagtgaagctctagcactgaccagagcaaggaaggggaaaattcacacacgaaatcttttgaaaatgctgttgttgaaaatgttactattgttttgtattccactatgtgatcctaggttatgagtaaaacaatggataactcatggcccccaactcccatgaattagtgaaaaacgttgatatctttttcaacctaaaattcaagatgcagcatattatatgaacattgctctactaataaagataaaaattgctaaaataataaaaaaaaaaaaaaaa

SEQ ID NO: 12541 - DNA, 257 bp, Homo sapiens
cttcaggattttcaaaatgatattcctactgtctacgacctacaatgtttctaaagagaagaaagtggttaattgcaccgcttccatgttctcataattctatttttccccttttctgttttcaaaatttgtctttgtttttggatgtcagaagctcatgatgtgtctaggtgtagttcttttactatattctattttttttcacctctttggatctaagtattaaagtttctcatcaaatctgaaaaaaaaaaaaa

SEQ ID NO: 12542 - DNA, 139 bp, Homo sapiens
agccagctctagagcctgggtctcaggacggtgaaggcacaggaaactgacataggaaacagaactgcaatggatccaaaactaacctgctattgtgagcaaagaataaacacgttattgaaagccaaaaaaaaaaaaa

SEQ ID NO: 12543 - DNA, 1080 bp, Homo sapiens
  misc_feature (1)...(1080): n = A,T,C or G
aagaaaagagtataatctttaaacgagaaacttcagcaccttgtaccctcaaatttcatcggggactggccattttgtcttactatatcaccctttaaagaatgtctcggccggggaggccaacacaaaatattgctttgtttactttccatctcccacaaggtcattcaattctcactacttctatcctactttacatccactaccacgcttataatttgactacagaacaaaaaaacacggccctgtgtctgccgcaacgggcgttttctcttcactccgggggcggcttccacgagcagttaaccaatgagcccgcgctcgttcaccttcatctccagtagggtctctccaccaactcggaaacaccaaagacgcacaacaaccacctcgcgccccgcctcccacaccgcgaggcccgtggcacccggcgctccgccgtgcgcgtgctccccttctccgccaaatcgactcccttaactcggcacggtgcctaccatggttaggactatctagccacggttcgatgccgcgctcccccacccgcgcactgtatgccagcgtctcctccttcggagcgtaagctggctacggcactccatcgagagtacgaaccccctgcatgctcttcactccccccccacccatacacaggcccgcctctctatccgtctatgcgtcactcactctacgtttctccaccccctaccggccacgtcgccatgtacctctctcgaaccatgagtgagtgagtcttcgcccaattgctgcggtgcgaccagagccgtctcgcacgcgtaacacgttatgtgctccgatatcctccattacctcccctgtttcgtgtagcgccngcatagtactgacagaccgagcgtatacagtagtgcgcgttcgcgccagtcacctacgctgagtcacgacacacgacacaattggtgcatatgtcgactatatgcaagtcctgccgctcgctgtttcgccccgcgctcaccgcaacccgactcactgcctcgcctcttcactcctcctcnttcctctgtgacatcatactgtcatgtcacagtggcacctcgccag

SEQ ID NO: 12544 - DNA, 1423 bp, Homo sapiens
  misc_feature (1)...(1423): n = A,T,C or G
aanttcgatcgagtagacgcattatttacgacacgatagacgtagtgantctanaagatcgagactctcgacacaacggatcgactagtcganagacntcgatctctcgcgcgctaaacgatcgatgtacgcgtagatcagcgcccgcgngcgacagtgtntanagctaagagagtatagatatctcttgnttgtgtgtatcgngtgacatgatgtggtgtgctatctgctgtgttatnttctcctgtctgttcactnagagtgcgcgacgcacggcggcgcacggtgttgaggtctgcgactaggagcaaatacaccgacatacctcaacattgtcgctgaagcacgtngcatcagagttatacgtcagtcgaccgtattcacgttatgacatgttgtcgcgtttgtgcgcgtgcataggcatcgntgtgcgtgacagttatgaatcacatnagatcttatagcatgatcgtaataatgtagcgtctgntactgtgcatgtgtctgatgctgaagacatgctgctatcatgccagctcatcgagtcttatcggtaacattacgtgtcgcgtaccgttggaggtcacgcaccnccgtcgcacgtcgtgtacgctaacgcgcagctggctgcgcgagtatcgttgtttggtagcagtgctcgacggcgcgttgctctaacagaaatgctgtcatattcacactgtcgcactaactagacccgatcatggacgaatgaatgtatgttaatcaacatctagggatcgtaatagcgcgacagtgagtatcgcggatgtgtgctcgcgccatatacggcacgctgtgcagtgtatgatatatgcacaaccgtcgctctccgcgatacgcgatctagctacagtctagacggatatcgatcgtgtgatgagcgtggtggtgagatcgtgcacagtgatgctggtagtaccaactgggtgagacgtgatcacgttgtgttacatgaatcgtagacgcgccgcacgtatgttccagccgtgtaagggtgtgataagtctatagcgctccgtactcctgatccgcatctgtaatcgcgagtaagcgtagcgtcagccgatatatattatcgagatcgcggaaagtcgcggactggcactgtagttctttgatgacatgcgtcaatcgttggtcttattcgagagtcgtcttgtactatggaacgttgggtatttatatcataatcgaacgtgcagataacgtacttaagacgatcntctgagtcccatcgtagacgtacgcgtgtgtttagacggtatacgcgtggcgttgtcttagcataccgttgtgctatcgcgcgatctaccacccttatctgaaggtagctcattaatactacctgaccgatgctgcggtggagagttgagtatttgcggggctccgcctccaggcc

SEQ ID NO: 12545 - DNA, 513 bp, Homo sapiens
atggaagaattgtctgaagaggatgagtgatcaccttccaggtggagggaaggggtctcattatgttgcccaggctggactcagtgactcaaatgtctgtgctcaagggatcctcctgcctcagcatctcaagaagctatgactacaggtgcatgtcacccatccagctcaatcacacatcagaccgctaaaaataaggatactagtctcaaagctaaattttattgttgtcaaaattttcaacatcagtactaaaaacctagaggaatatagatgagcatttaaaaaattctgtccagctaattctctccagtgttcatttaaatatcatgcaaaaaagctagttttataaaaataaaatctgcattcacggtgggggggaatgcaagcttaatggaaaaaaaaacccaaaatgaaggaaattatgtgctacgagattgaagaaacaatggatctcacccagcagggctttgaagataaatgttgagatcacattttaaaaaaaaaaaaaaa

SEQ ID NO: 12546 - DNA, 348 bp, Homo sapiens
aacagcatctctgacattagaaccagaagatttttgtttaaggatcacttaagatgtttttcagactctgaattccagcaaccagtttggagaccccaacagaggaacaggatcagcctgagaatacagcttcttcgtcttcctgtccctgcactctttgaccctgcactctttgaccctgcactctttgaccaatcaatgatttgcatactttggcccacaccaaaacccttaaaaattctaaacccaactttgtggaggagatggatttgaggtctcctcccataacctcgttaggtgactgtatgattaaactcctttctctgctgcaaaaaaaaaaaaaaaaaa

SEQ ID NO: 12547 - DNA, 1553 bp, Homo sapiens
  misc_feature (1)...(1553): n = A,T,C or G
gtgtagtctgcagnatatcgttaagatgctcgcgagtcgtgcccgagtttgcacgtgctcatatgcatgtcacaagcaaggaagaaatgaaatgcgcgaattaataacgtgttggatcggatggggtgcgctggtctggcgcgagtagtggttcgtggcgcacagatctgacacnattcgtctacacttacctctgcttgcggtaatgtaagtgagatcgtaacggacaccagcgcacaagagtgtgaggatatgactatgctcggtgccgctgcggcccgtgtgtcggtaccacgtcgacgcgtactgcccggacgcaactatcgatcgccgagttagcatatcactccaccaccacaatctacattaaccgcgctacagaacagtatctatagtaaactctcgcagcagctctatgacatgacaacgtgangtgtcgcgccacgtgcacacgcgagacggacctgtcaacacgacacactcctcggacaatagtactgtatgtcgtcacgtctgtntcggtgttggcggatgtggatgnacgagatagtaatacgtacagataatcaccgacgcgctccgttacgtcgagctcgttccggaacccgctccgagtatgactagtcggcagtgcgggctagggtacgtcaggagtgacatatcatgccatgccgctattgtcgctcgcgtccaaagtatgtacctctacgctatgaagtatctccgagcgactccgagtcgccagtccagtgtaccangatctctacagtgtgtattgtccgtgaagccgtcgatgtngagccacacgccacgctctcgcgcgtgttgtaatgtggcgcgagntcctatagagagtcgatcatagtatatagcgtttatcttctgatantacagtacgcgcgacagcgtcgtcgatcgantncacgtagcgatagtcatgcgtatcacgtgtntaagacatatgtgtacgagatatagtcngtacgatagtgtgtgtctctcgcgangacgacgcatagcattgacgccgcgcgagtgtganactgttgactactagtctaccaatacagctgcgcgcatgcgtcgttctgccgtccacatgatagcgcgtgtattagaggctcgcaacagacgctcatgtctactgtttgttgtacgactccagcgccgactntctacatanactatacantgtngtgtgatcggcggtgcggcccgctacgcgtcagcnagtcgtacgtcagacacgcaatagtgctagcgactctctgtgtcgtcccgcgtatgtcgctgagagacangcgagaagcgcgngcgtgtgcgcgcctattggtatattactctacntatcaagtacacagacgactcgtgtttatcgtatatcccgtcagtggtttgagttatcggtgctccaagacgagagcagcgtagagtcgatgaggatcatagaccacgatcttgngtgtagcgcgatacagacanttacacacgcgcgngngatctagaggagagagatctgtctacgcgtgctatacactatagatacntagtcg

SEQ ID NO: 12548 - DNA, 300 bp, Homo sapiens
ttgtagccatctctcgaatgttggctgcagctactgagaagcgagaaaattaagttcaagatcttctgatgaagtgccttccccaattttcaacttcaagcattggcagaattcatcaactgttatgtggcacgctgcctattcaatgaagacttgcacatatctttcttgccccttacaatttactacatcttccgcgacaatatatccttaacaaaaaatcgtgcgtcaacgcttcccccaaacgctctcaaaattccgggcattccctcgcactctcagatatcacacagccaaccc

SEQ ID NO: 12549 - DNA, 762 bp, Homo sapiens
  misc_feature (1)...(762): n = A,T,C or G
cctgctttcctaggggacgcgccctgccctctaccagcccacctcatgaacagaggcagaagtgtttctgctgtacggtaaaatcctgtggtgtgtgcaatgcagggatcttctcaaagtcactgtccccctggaaactgcaaatcagtcactccatcccttacagggcatggacagaaagcaagttctctaacgccaggcaaagcagaaagctctagaaacagaccaggagacaagacgcctagataaacctgctactcaggtcgctggctaagagggtcactgctagtaggaaaagggaatcgtcgtctctatgtcgctaagggctcatcttcatgatctccaaacctcccctattcaaattcacagggagacagaagcaggtttgtaggcacagtttcaagctctctggtccagacatagctctaaggcctacccaggacagtgtgtgcagaagatgtcctggtggcaaagccgcagcacacagggaagtgcccctgtgatgaagacactgctagagcacaacccacagccatgggtgccagagccactgaaaacagcacacctgctgccagcgggggagctgacgcctcagtggataaggagaagacgcatttcagttttacactgattactatctcacgctgactgtgaaaggctttccgtgccatagagagcatncccactgcccgcaggcttgggagagatgtcaggggcttcaccaaacagtgcctggcaagcaggtgatgatgactcccttgg

SEQ ID NO: 12550 - DNA, 1489 bp, Homo sapiens
  misc_feature (1)...(1489): n = A,T,C or G
atagggtaaggattnattgatnnntgntnnnnatttntngatgataatcnatganttagtggannnnnangnttnactacgaanntatantanattctctccttatnnanncacntnanntacannnnactctactctcctctccccgtgcaatatatactctactntctccctgcgtatatacactggaatntcaatcgtaccactgcgctcaagtatcgtgcaccgctcgtactatacctctactctcaccatctacgcacatgtnccnnctcgacgcaatactctcgttgcgcttgacagtagcgatcgaganagacagctgctctgatcgcgacacncnctcatcagtacagcngcgatactatcgtgcgcatcatctctactacatcgcgagtacagcgtctacatccaacgacgagtcgtngctctagtatacatctatcnctacatcctgtctagcaacctctctctcgcactacgctcacgcntcacagactccaagagtctctacntancccctaatgtctatgaaggatacnataacanagntctangctgaatgacgtctactgacgatctatgtatacattntataggtaccagcaggangntcntcttgacgtcatcanatnttatnaagtacgagaggagcaagngttgttatctgcgacgaagacaccgngcggtcggagctgngtgtgtgtagctcngcgtagcgatgcgccgcgcactcacactctacaantagcgnccgcgcgcgcggctcncgcacacacacacnccctatactncancntccctgcgcgtcgcgggtgtagcttgcgtgtacactactctcattcttcgaatgtcgtagtcaagactacctgtcgccgcgncccgcgcgatatatattcatatctgtctccggccacgcgatgncgacacgcgacgctagtagtcgtgtagagctaatagcgtcggcactcgatcgcgcatacgagacttaagtantacagctctaactctcntgtgtagctatgtaatgcgtaccatctgttatacgagagcgttagacggtatgcagcgtctgtctagtgtgtgcgcagtcatgcacttcatacaagactggtccatcgctgcggcgccttntgtgccaggcgagangacgacgacaccacgtcgctgagcatcgctgtacatcgatctctgtctactgaccctgcgcgcagctgcgcctacgtgtgtgcgctctcagctcccgtgtgcggatcaactccgctctctgccgcgcgtcgcagcggtgtgatgtctacccgaacgtgtgtgtcgcggtggtgtgtaggacgcccttgttgaattcgttctgtccaactgcgcgcacatggggtagcatgggccggcgtgcgaggttgcgtcgtgtctcgatcgcgtgatcggctgtttacgatggtgtcggatcgtcatgctgctctgccgatgtatntgcgtagtatgagtcggtgag

SEQ ID NO: 12551 - DNA, 784 bp, Homo sapiens
  misc_feature (1)...(784): n = A,T,C or G
atgacaaagcctcactctgtcacctggactgcagtgctgtggtgcaatcaggactcgcagcagcctcaacctcccagattcaagcgatcctcccaactcagcacccctcacgttctccccacccccaactagctgggactacaggcatgcaccaccatgcccagccaattttttctagaattttagtagagatgagatctctctttgctgcccaggctggtcttgaactcctgggctcaagtgatccccccacctcggcctcccaaagtgctaggattacagctgtgagccaccgtgcctggctatgataatcatttcacaatgtatccatctatcaagtcatcacagtgtacaccttgaatacatacaatttttaatctgtccattatatctcagtaaagctggaacactacaataagattccttcagcccaggactggaaataaagaagctcttagaatggtgatcattaaaaagtcaagaaacaacaggtgctggagaggatgtggagaaataggaacagttttacaccgttggtgggactgcaaactagttcaaccattgtggaagacagtgtggcgattcctcaaggatctagaactagaaataccatttgacccagccatcccattactgggtatatacccaaaggattataaatcattctacaataaagacacatgcacacatatgtttattgaagcactattcacaatagcaaagacttggaaccaacccaaatgtncaacaatgatagactggattaagaaaatgtggcacatat

SEQ ID NO: 12552 - DNA, 1036 bp, Homo sapiens
  misc_feature (1)...(1036): n = A,T,C or G
cccacacgatcatcctttctcctatctatcgaaaagaaaaccgaaaaccttagggcaacaccgcagngctggtgtaccatgcacaccattgtgtaggctgaaaagaaagtggaaatagcattgaggttctgttcgagtcctgaagaatttggcatacaaagcatcggaccagttaagcataacacgagttataggaggtacggcttgaaactgagagacagagcaccttaggtcatcgcctgccctatgacatctttacacaagcacactctagggttatgacgttatgtttctttgaccatatacatagcttgtgtcttataaaccccttcgtgctagttctacagaaccagcgaggggcataccgatccataataatttttcattcggtccctcgttttacagagacactatataactcatagccgccatagtaaggtcggccgacatatttcccgccaacacatgtaagcgaaacgatctccactcttctctcgagatcgaccgccacttcctccaaccttatccttacttttcactactgtagaacacctcccgccactcatacaccgtctctacactcctaattggtgttaattacatagcgggacgccccacatcttaattacaatactcgcaccccggatcttttttacgatgtacacgcgtgcgcatcaagtgtcaatagtgtgtgcgtaagcaaaccacctgcacaggaaggtgtatctgaccatcactcctgcaaagaaactgtcctctgtgacttcgcacacataatcgaccggcgtcacaagcctctggcgctacacattcctatcatgtgctcaatatttcgcaatgcaccgctcgcgtcttctcataccgtctaagcgatatgagacagccgcgcgcgccgctgaacacgacgtcgggaccggcggcggctgacgcgatgcgggacacaaatgctcggtaacactcgcgatatatcattacatcatttgttcgcctgtcatctcgacaaaagcgcagtctctaccccgcacccccgctcccg

SEQ ID NO: 12553 - DNA, 1598 bp, Homo sapiens
  misc_feature (1)...(1598): n = A,T,C or G
ctctcactatcgcgtgacacgatcgancntcttctcagatgancagagacaatcgtctatatcaagcgttcgaagactagagtgtggagttatagatcagacgagtcgagcatctgacggcgcttgttgcggcgagtcacactctacacgatgatcagtgcatctcgccactcgacgcctctgcgcggatctgttgcacgtacagtgatctcgcttctcgtgntactgtcctacgcgtagacatcgagcgcttcgcactacgaacgatcacangaagcgcgcacaccactcgcgtatacgcatnactcacgtngtctgacgngtcgtctgcgctgtgcncntgtagtngcacgcgcgcttgtgtcccctgcactgccgcctcatcgatgtacgccggcgcagacgtcgcgtgngcgcgctcgtgccgccgcgacgcgtgtcttcttcgctatccacgtaacncggatcactacacgtgccacaccgccacactcactatagcnatcnttcactgctcggtgcgaccacngcacacacacatntctcacacacatcactcctcacctctactctgatacacgcctacatctgccatctcctctcctcctcgtcttccacgctacatcctacgtcttactatccatatcctctatcctcatatnactactcactactgcacacagacataccacctcatacactactctctcgcatatcaacactatatcacaatntacatcncacttcatancancttctgnacgtctcatntgtgttacgtcctcgtatggcttcgtacctccgtcactcgcgcgtgacacctcacgcgatgtcatngactgtacgtccgctctctgtcagctagtccattaggnctctcaccgacgctcagcgtcatgctcgtgccgccgctgacacgtcctcagtactnataggantagctcctccancccgtctcactctntntncgcctgctcttgnttgttcgtcagaacncagggcgggcatctgatcagaggcatnggtnaataaganagtcctaccctgcctgtccgccggcaagncccaacactccacagaagctgtcggttcacgccanattctacatatcaanatacaatcnccacactatccgncctactatcttttacactgttttcacgcctaccactctatcnactcttctcatacaannactcctcctccnaccactatacagtnaaacatcactagcncangaatactaccgntgctcctctctattttattgtactctaacacaaaacataccattctntctccgccgcaagacacacggctttcattaatactgtactaatctaacttgtataatatatggtaatcttctcttnnnatcacaacctaggctttctcttatnnaacacttatcacctctannattactctctatntacatcanttctactacctnccactcctnnatttacactcttangggggtttannaactcctntanaaacacttnannnnacntnnnncatgtttcncnnnnnataagaaattnnnnnnnnnnnnnnnnnnntttnnaaannttttnncccnnnnnccccncccc

SEQ ID NO: 12554 - DNA, 872 bp, Homo sapiens
  misc_feature (1)...(872): n = A,T,C or G
caacccccactataaatcagccaagaaatatagaagaaaaaaaaaaaaaaaacgcttagagttgacttacaagcaaactttgacggatttaaccaccacacctaaaagaaaagaagtggnggcgaatataattgtagactctcccaactcatcatgtagatatattatacaagcaaattactagcagtcttggagaatattcaatgaatgcctttacatgttagcaagcaaatataaattgtatcagaatgttgagagattgaaatcagtggaaataactagctgttttttaattctaaacaacgcgagcacaaagaacgaaccaaaaaaaaatcaaccccaaaatccagaaaaagaatcaaaaaccaagtgaactatcatgacaaaaagcgcataaaaaacataacgacaccgaaaaacgacaaattaccaccataagaacaaacacaatattaacaaactaaacccacacaagatgggcgttttacgaagttataaaataattccacacccccatccctgactctattaaacgaccatatcgatataccgcaataccacacaatgcgatacancacagcgccccatttcccccccgctcctcgtttgatacacgccacgtaatggaccatacatagaaataaattaatacacaccccaaatccccaagtatataacaaaagttataacttcattatttcgacacaaccacgcaaatccgataccaccaaccgtataaaatcccctcccacacaatctctaccaacccctccgactacgtctccgttaacaccaatacacttcatacaccaatattaacaacaatatatcacacacaaccccaaaatagaataacacgcctccccccgccc

SEQ ID NO: 12555 - DNA, 808 bp, Homo sapiens
  misc_feature (1)...(808): n = A,T,C or G
cctgtcttctcttctctttccgctgtctggagtctctttgttcgtgtttctcgctgcgcttcgcggcttcttgttgtgctttggtgcctcggcttgctgtttgctcttctttctctccccggtccttcctggtctccttgtctatcccccttgcattttttgccttgcgccttctccccctctccttcgcgtctcgctccttgtgttcctgcgctcttcgctcccgcttttctcccgttcttttcttgtgtgttcgttgctcttcgcgccttctctctttctctttcttttctccttctctcttgctccccttctcttctctctcctcctgctgctttctgccttcccttgtgtgcggcgcctttttcctctcttcttgtgtctccctcccgctcgttccctctcgcctctgtcctcctttgtttgtttcttgctccctggggcgccgtggctccggatccgttgtgcccgttctcttgttctgtgttctgtgctttcgctgcgtttgtccttgcccgttggggccgccttcctcttctctcttgggttccttggcccttgtgcttctttttcttctttctccctcccctcctctgccttcgcccttcctttttttcttctccctctctcctctctctcttccctcctatcttttgtcttttttctttcctcttttcttctctctttgtgtttgcttcctttctccctgccgctgcctgctcgcggtgtttggtgcccctncgttctggtttcgttttcttaaactttcctncttgccggggcttttggttttggttttttgtgaaac

SEQ ID NO: 12556 - DNA, 847 bp, Homo sapiens
  misc_feature (1)...(847): n = A,T,C or G
acgacatctaccaaggtcagtaagatataaaaaaannnnnnnctcagacaaacgtaaatacatttgctctatctagatggaacttcttcccaactactttgtgaaattatgtaaaatctaatctggggccagcatcaaagaaatcagatacatcaaaacactcctgcaacaattaaggaagatgtggttacataccttgaagagctaagagctactggctagagctaagttttctgtgtgcaaaagcaaaaaaggacacatgatactttatttacattgattttatttttaacttaaattcaaagtttatataatggatgtttatttttaactagtgaggtgtgacttggtattctcaaataaatatctctttgtgcccctataaataaaacaaaaaaataatccaacaacaaaataaaagaaaacgaataaaaacataaaatttgacaaactgaatgtattacccaaggaagaatggagtgtgccttaatctaaccaaggcggagtagataaataatcccgcccttcataaatatagctatggcgggagataacaaacgtataagaccctcggaagtggctagtaatccatatcttaggggtccttgaatgtgccactagattttgcatagagcaaaactctaaaaaagacacctgtaaaaatatacaaaatatctgtcgatttgtaattccccccgcctatcctgtgctgttttcactcatgaaatgtctcaaccacgtttctatatccacattgggaatatgactacataatattacaacaaataaacattcattctcaatataaaaaaataataacatatacatccctaaccccccgcccccg

SEQ ID NO: 12557 - DNA, 1401 bp, Homo sapiens
  misc_feature (1)...(1401): n = A,T,C or G
atggaatattantgagaaatgttaatgtntatagtgagaggaganatagatgatgcgagaggagcgagggttttttatgtaggtannaatggngnagagaatataagataggaagaacgttttttttagtataantatagacgagaaacagctgacgagccggctgtcgtgacgttgtgagaatctagctgacatngatgtagaccgcgacatctgcgtcgctagcgtagctgtagcagtggcggagtgagctcggcacgacgccagcgacacctgctgattgacgctcggagtgagcccatgccgactgtcgctatggttccgcggatcgggtgtgaggatgtgcttggttcctgtcgtttcagactcgcgcctccatggcagggtacgaggcctactacgccgcgcctcatgacgcatcgctggagaaaacaacacacgaccggcctgtagcggcgcgcgccgtcccgtgtcgccgtcgtggtaatcgcacttgcggtgagtcggacgcctaaatatactctatatacttcgattttatttacaacttattatatttcttcctagcccataacccccctaggcgcgccgcgcccacgacctcacgcatcacgaacgctcaaacatctgccgtctccgcctcacgtgcacctgcgcctgccctctgcccgcgctcctctctcgctgccgctcgctttgcacccgcgcaccacgtgccggaagacatcccgtactagctattactcatttcgtcactgcgccccaccgaatgcgcttctagagacactcccattcctcttcgcgtttcctcctattccgttcccgcgcttcccccccacccacgtcgtcttcccgttcccgcctttccatctcgcccgccgtccgacgtttattagacccatctgcaagaccccgagggcccttttatattcacattacccgtacccctctatagtcgcccacgcccgtccccgccgttcgcccccgcactcccccccgtccccgcgcccccatcccctttattcactaggcagccagacaatacacctttgcgggcgtcgccccactctccccccctcggttatcggtggatgttaagccaccacaagcgcatgcaccgctacccccggcccccctataggcgcccgtgccccttgtccctgctgccggcctctgatctttacccccatttcccttctacctcccaatacgcgattcgcataccaattccgctaccgctgttatcccctgccgacattctctgcgcttacccccccgccttaatcccccctgccggggttccgccttcgcccgtccttattgtagcctttaccactcccgtatccccggcgtaacatatcgcgcacgcagagtatgcgctatgctcacgagcgtataatt

SEQ ID NO: 12558 - DNA, 419 bp, Homo sapiens
  misc_feature (1)...(419): n = A,T,C or G
gtagcaggtgtactatcatataacagtaaatgatataaaaaaaaaanctcatacgcaacagctgtgggactttctctgggaaggcagcagcaccctgtttctctggaacatggatttgtgtgagaaaggcagatgtttactgaataagccagctggctccaccaaccctcactctactaaccttgatggcaccacaacatgaaattcacagaacaagccagttcacgcgaccagcaagttcagaagatggcaggacgggtctgacatgaagcatagttacacattcacctcattccagtgctgctttcaaaagttctcagacaggaggctttccaagggttgtgagtccaattttccactttgacacattaaaaattatcatgagtgatactgaaaattattccacaaaaaaaaaaaaa

SEQ ID NO: 12559 - DNA, 832 bp, Homo sapiens
ggaaacgggcgaagataaccaaaacagaaaaaaaaaaaagctgaggggacaagagccactttagccggccacgggtcagaaaacaaggcaaccgctggggaggggcaagggcaacgaagaaccaaacagaaaccagagcgcagacaagaagagaagcccaacccccgcacgaggcacgaaaaaaacagaaaagacaacagtaccaaggagaccgaaaaccaccggaaggcagacgaacgccaccacgaagaccgatcatcagcgaaaagcgggaccagtacagccaaagagtcaatgacaaacgagagagccccgcaaagcacgggcaggcaccccgggagaaaaaaacgctgacgccgcacataagtgcgacgacccaccgaaggaaaacagcgcaagcctgcaaagcaagaaaagaacaaccagagacgaacaacacaagaaaaacgcaagcgaagaagccgagaaaacgcccaaggaggcgacacaaaaacgagacacacacacaaaagaaaaccgcacacaacaagagcgacacgaagaaccaaagaaagagcaaaaacaccacccaaatcccacacaaacacggagatcgccacacgaacaccggccaacaggcggcggacagaaacaaacgaaccgcaccggaacaaaaccctaaaaactccaccaacgacgacagaccggggagaacgagagaaaccgccaacggcgcaaaagccaagatcggacgaacgaccaaaaaccacccacaacgcaaaccgaaaagagagaacacgaagcacgcaacccagatcacggaaaggccgcggcaaaaccacagaaaaaagag

SEQ ID NO: 12560 - DNA, 818 bp, Homo sapiens
aaacggggcctttttttttttgacttgtccgaggagaggcggcttaattaataaacccacacgcatcggcgcttttaaagggctaggacgccaataggcacgcactgatggtaacaagaagttatttcgcgaggtccaccactgtatagggagggaaacaatagtaacccccctcaaaagaaaaaaaaaacacaatccacacgacctgaataactccggcacctaagaagaaattaaaggaagagcatcaaataataccctccctcaaaaaagagagggggcggcggagaactcccccataaagaaaaaaagaagccaagaagttgtagagatgggatctgtctccacctttaatcttttctttatatattttttttattatttatatttttttattttttatttttatttacttttaacttttcaatttattttaactttttcattctttggtaataagatgtaaaacacaaacacattgtacagttatacataatattttttctttatatctttctataagcctttttctatttttaaaacattttattttattttttactttttcaactttttttgttaaaaactaagacacagacacacgctttagcctaggcctactcagggtcaggatcatccgcatcactgtcttcaagctctcccgcatcttgtccctctggaaggtcttcaggggcaatgccacacatggagctgtcatctcctatgatcacaatgccttcttctaaatacctcctgaagggtctgcctgaggctgttcacagttaacttttttaaataagtagaagaagtacacccag

SEQ ID NO: 12561 - DNA, 283 bp, Homo sapiens
  misc_feature (1)...(283): n = A,T,C or G
ctcttgaggaactntggacacagagnctgnatgcacacaacggggaagacaatgtgaagacacgcagggagaacatcacgtgaagacagaggatgggaatgacgcttcaacaagccatggaacactaaagatgactggcaaccaacagtagctaggagaaggcaaggaaggattcccccatgggttttagagggaacacagcctcgtcaacaccttgatttcacacttctggctcttcaaaactgggagataataaatttctgttgttttaaaaaaaaaaaaa

SEQ ID NO: 12562 - DNA, 300 bp, Homo sapiens
cttagatctttcagccttgtgtgtttctgcaaatctgaaccaagaaacaggcattctctttagaagaaaaatgtataggaagcctgctcagaggaagcgaggtgctccagatgacctctggaagtccctgccaggcttatgttttgaattttctgtaacattttattatgtaaaacagacccattagctatgtttactcaggcacatggaagaagattgagacaattacctaaaaattcactgtgacttttcagtaaatgttattaaagaaaaagtgggaaatgggcaaaaaaaaaaaaa

SEQ ID NO: 12563 - DNA, 1247 bp, Homo sapiens
  misc_feature (1)...(1247): n = A,T,C or G
cgagaagcgtactgtcaataatgtgaaccgataactaccacacaataaaatggtcagggggaaaccaggaacacaggagtctaaaatgcacacgaacgaggtaagtaaaatgctgtaaaacactgcatggtgagtgacactcaccgtcgaaggacagtagtgatcgtggatacgactgctgtcaactaagaccagaggtatacactaagagtattgacgtggcgaactcaaacnagcgacgcataagagagaaatggtcatagcgcaatgggattactcccatcataggagattgttaagtaggcgaagcaccagactcccgctaatacacactatgaatatacacaccttctagagcctcacgcaaacatgtggatgattaatataatagtgctgcgtgataatcaaaacgaaaacaacaaaaaaaaatggcgctgacgtaaggcccttacgacggtagagaactactaggggagcgtctttacttatacagaagagaaggtcaagtgtaatatatacctccgcaaccaaacgaaatgcaattagatgctacagagacagtaaggaacaaacaagtatagacagatcggtcacgcgaaaacatacacgggagtactcccaaaaccacacatcttcacaaaaacttttcggggtgtatcggcaggtagtgatagcgaaatatctatacaacattaaagagaccatgctgaaagacgtatatggagaacaangaatagtaacgacctcaaggagaatgaacggtatacagatatgcgcatattataatgaccaaacacagtactgcaaaagacatattaacaacacacactatcggaccggatatagaggtacacgtcggaccgaataaatcngctcgtgaacaaataaacacacttaacatgacctactcgcacgcgcgataaagacatattcgcgatatnattattcgagtncgctgagatatacgncgacgccacatatgtgngagtaacgtgcgtgagcgagtatggtatatgtggacgagactgtgttcgtaacgaatntatatagataagataatacacgaagtatctaatagatgcgtatatattattctatctgcgcgatttataccgcgnatgcagcgaatgatataaatanacatgtnacacgcgagaaagcacgacgtgtcgtgccngcgtatgtcgacgtgaatgacgtgagagtctcgacgcagacgatcgctcgagattcacgcgatatgtgnt

SEQ ID NO: 12564 - DNA, 290 bp, Homo sapiens
  misc_feature (1)...(290): n = A,T,C or G
gaggcaacaggccagctcagcggatacgagcatcaagaaaaagcttgtgganaacggaacccaccttgnacgnagnacatcnccagagaggncgncggactacgacaatcaaaaccacccgggaaagcgggaaaaaagaaccnnnccgagccgcaaaccaagccgacggcagcggaanaccaggaagacgaaggcccggaancagaagacccacaagcaccccaggagagaaaaanaaaaagcaaagccagagacccacaaaaaaaatttttttggcctcggtggcccca

SEQ ID NO: 12565 - DNA, 292 bp, Homo sapiens
tgtgaggatgatcgaattgtgaaagatgagtcggaggtgtgggtgtgtttaggtacaaccaccatgaaagtatacccagctagccacatgggagaagaaaagaggaaaagatcactccctctcaaccttccccactggggaactagacatgtgaacaaagccatctgattacaacctcacaggagaccccaactgaaaccaaccaaagaacagccagcagagccccagccaaccaaagaatcatgaacaaataaagtggttactgttttaagcaaaaagaaaaaaaaaaaaa

SEQ ID NO: 12566 - DNA, 867 bp, Homo sapiens
cagtaacgcctccgctctagaatgcataagcaccaaaaaaaaccttatagccaacatcactcgggttatcagacaacttagtcacatgagggtttcttctgctggtatctgagacgtacaaggcacatctggtcagaggaggcttctgtctctccacagttatcctacctgtgccagcatctactgggacgtctgatcttccaagtctgtggtcctcgtcatgggtttaattgtgctctctcaaaattcatatgttgaagtcctgattccttttgactcagaatatgactgtacttaaagatggcgtctttaaacaggagactacattagaactaaggccttgcgggtgggccctgattcaatattgaacagggcgtattgggacatacaaagaaagatcacgcaaggagagggcgcacctcctgcacatcacagagcgatgccttgggataaaccgaacccgccgacatccgttttgcacttccttcattccagcctgacacaataaactcctgtgtgctcataaaataatatcttaccgttaaatagcgcgaagacaaacacattcgcgtctgcctacttcgctggtaatatcgaactagttatgcaaagctctcgcttagcgggtccgtgctattttcccgtgagtacctatccaatcctccgccctcagaatagggttattacggcgtattttgccccttccgcgtagtgaccgcataatttatcgcgaatccggtgatctatcacgtaccgcccgtatcgggcgtatcttcgccctctttgcttcccctgtttcgtgtcttaggcggaagtacacaccagaatccaggagcggccccccgactaatcgccctgcactacttg

SEQ ID NO: 12567 - DNA, 835 bp, Homo sapiens
  misc_feature (1)...(835): n = A,T,C or G
cgcgggcggatccccgcacaagaggttagcaaggtattggggaactaaaaaaaaaactttgagggcnaactgagcaaactgtttgncctatccacccaggagcaagcggacgacactgatatcctgaccactaaccatncagcaccacttaaagaggtcccaaaacccccggctgtctaccaatacccatctgtgacctcttaggaaccgagcttcacagcaggaggtgaatggtggacaagcgagcattatcgcctcagctccacctcctgtcagttttaaaatttttttagaaaggaagaagaggctgaaacctaaatgccatatggagaagacagctaattgccacactctcctctttggtctttcctggtacgcagcatacaagcccacagatagaggactctgcacttgctgttctctttgcctggagctctatggctacagatagactcctgacaactccttcgacttgaacaagatacacttattaaatgtcacattaaatgtgggcctactttgtgccctacctagaattgtaagcacctctcaccactgagcgcccattctggttaacataagccgctgatattccaataaaaaagcgacatagtgcgtacttatatcctactaatccgccttgataatatatcatacatccccctccgtatggtacttatgtgatgtaaacgccgacagggtcgaaacccactgaacaacgtgagcttatatggtataggccccgaattactcaatatgggcgggaccgggccgacaaataggaaaacaaaaaaaagagcggcgtgataagggatgacagcaatgaggcgagaaa

SEQ ID NO: 12568 - DNA, 377 bp, Homo sapiens
actggtgtactagagttacattgatgagtgaactgcacgaggcccttgtagcagatccagagctggattttcacctaggctgacctggaggaaaagccctcactccttccacggcatggctcccttgttctgcccacagacaacttattttacggggcaccttcctgactactgacatcccaagccatgagccaacctaaggctgagaggagagagaaaatgtgtttctaactacatgccaaatttaaaaattgttttataatttcacaattgttgtactgaaagcacaatctctgactttcattagaatggccaatcaagagtttcatttctaattcattgaaattaaaattttcatagaaataaaaaaaaaaaaa

SEQ ID NO: 12569 - DNA, 115 bp, Homo sapiens
cctagacacctcgaattgtgtcctgtagatacgtgcaacaatgagacggagaaatttgctgaaaagtcgccaagcaaaaaacaactaacacatccaaccatcaaaaaaaaaaaaa

SEQ ID NO: 12570 - DNA, 261 bp, Homo sapiens
tcgatgtggttaaactctacggagctgttttagaaggctgaacaaggaattaccagctcttcattcattttcatatcttctttaagcgggaaaagttgtttgtcaattggacccaaaaggcatgcatacattcattcagatgctaaacatagacttatagaaggttaatgccttaaatctgtgcaagaatctatgtgtatttacaatggtagtcaaaaatttcagttaaataatgctcctgctttctgaaaaaaaaaaaaa

SEQ ID NO: 12571 - DNA, 860 bp, Homo sapiens
  misc_feature (1)...(860): n = A,T,C or G
gcgagcacaagaccgcgcgttgacactttatggaaactaacacaaaaanccttgntagtnaacggancaggnnaggttcaagcgcncaaacaangagnncancacagacancancacagcacaacaaagacangaaaacaaccgaaagggccancaacagnggaccggacaaagaaacggnggcacacacacaccagggaanaccaagcagccacaaaaaagaacgagagaacggccccggcagcaacaaggacgaagccggacgccaanagccaaaganatctttttcaggaacagaaaaccaaacaccgcgggaacccacacacaaaggggagcgaaacaccgaggacccaaggacacaagaaggaaacaagagacacagggnaaagagcgggaggaggaggaggaggaccaaaaaacaacggaaggagcacgaggcgcaagaccggggggacaaaaaaacacggacaccaaaccccacgacaagcaagagaacgagggaaccgaaccacacacgaaaccacgaaagcaaaacaaacggcaaacaaacaacgaaaacgaagcgcgggacggggaaaaaagccaccagaggaagagaaacaaccgagaggggggccaccacccgcaccgagaccaaagcaacacaacagacaagcaacagcggaacaacgacaccggacgaccccacagcgcccaacacacacaacccgcacaaaacgcaaaagaaagacaagcgagagagcacggaaaggcaaaaaagagcgccaaaacgacgaaaagccaacaccgcccagaggggagcacgccaaaacaaacacagccaaaccacgcaccccccacccacaaaaagaaacaagcaa

SEQ ID NO: 12572 - DNA, 1120 bp, Homo sapiens
  misc_feature (1)...(1120): n = A,T,C or G
cttatctggtggagctttctcttactataaggtactttatactgagagaatctctctacgtgtatgttccctcactgacgattcgcacgcagggatactgtcagcatgtggacagtgcaaataggtgcggacggtgcggaatgtgatgatcgagatggacggacacgtgtggtagcgtcaagagtcacgtccgagttcactttgataactnactaattgatatcgaagtacttagagctcccaggcatattggtagatgcaggatcgcaattgtggtggaagaggtgactcggacctcttaatatataacatttccacatagtcattgcgcaatgctacgatgtaacaaaaccacacgtcctttccctactttgctcaatttttttatacggttgttagtactatagctatctataagacctattctcctacatttttctaaactcactgtatcatatttctgcctttactacgtttcaattaagtaaaatatgatactggagtaagaatgaaacctctttcagtgaacgatcaacaatatgcaagtggaaaataagttagatagagccatctgtgactttggtatatgtcggttagctatgtgggtttgactcaccgcctcttaatagacactatataagtacgatacgctgtgcgtagacttgaattcaagtatctcnatactgtcatcagactcacgaaaccctcatactcggcaccctatgagaccnacattgtttattctattatttattaaatatttgttctctntatacaacttgttatctactttctcattattattcttctcatctctatctttctgcttcctgctatttggtcttaaaataaccgaaaaaactactttctgaataacgtgaacaacaccactcacttaaacataatgccacccccaacctatattctttacttatctgttgttttcttcatcttttctaaanattattcttattatcctttccactcttatcttttnttgtggtaantactntanaaacttnnnnttnntagggtcctnccncaaaatttttnttactctcttttcccaaatcntnnnttctctcctnnnnnnnntnccccccnncccccccccctttcc

SEQ ID NO: 12573 - DNA, 330 bp, Homo sapiens
ctgtttaggaactgaggaacatcttctaccatctacggaaagactaatcttatctcacagagtcgtaacaccttcagggtagaagatacaacacactttgttctacaaatgaggaaagtgaggcctaggagctgtgtgtgcagccaagcagtgaggaagaccaaactacacctcccatcaaatcagagtcagtcaataatgatttaaaccaaaaagaagtattgtctgtgttaacagaaaaataaaattcactctcagaaatataaatcacaagttgaatgacaaacttttatcaccaataaaagattaagaaaaataaaaaaaaaaaaa

SEQ ID NO: 12574 - DNA, 346 bp, Homo sapiens
taaacagaaagagtcgtaagaggaagtaataaaaagaacttgagataggcggtcttccacctgttgagcctggctggctcgatctcctggactcaagtgatccacctgctttgccctccgaggtgctgggattacatgtgtgagccaccgcacctggccgaatttgcaaaaattttgatgaaaatctgttccttcttaatttctttaagaaaattttctacaagtggaatcgctggtgccaggaatatatacattttaaaatctttgaatattcttgagagaaatgtcatgtaaatgatatacaagcagaacattaaactgcctttcctacgtaaaaaaaaaaaaa

SEQ ID NO: 12575 - DNA, 787 bp, Homo sapiens
ctctgttgtaacccctggaatcctgcttgcatctgcctttgggctggagccagaacttgaactggaggagtggctgggaaagaaaaatcaaatgtgtttgaggggaatcattggaaaaatgattcaatcattttggtccttggggagaatgtagagctcattcttctcacagaaagccatttagactttcttgaagatccttttcctttgagagctagtttatggtctttttctgaaacatggctattctatccatatcaccaacagtactatttctcgaagccccgccatgttctagctcagtcttcaccaacccctaacaattcagaaagaaaggagccatatggaaaacctgtacatttaataagcctaatgcccttcatgacaacatttaatagttataacctatgcataaatgattggtaacaggcaagtaatccaatgtaaagcccttatagtttattttctatgtacagatggcaaaccctattagtgtattactaaaggaaacttaatcatttttaacaagtcctattgccatcttccataaattcttgtgttaaaattactgttttttggcagccatgttattgggtccctgaacggatactaatgtcaagagtctggtgcccagagtgagcaagcaaataaggaagcatctctaaaaagcccaaccagaacctaaccactacggcagagacaagggggtttggtgaactctcagtgacatcactaaaacttgttcgttgtttactatttgacatcctccatcattagatcctaagtg

SEQ ID NO: 12576 - DNA, 876 bp, Homo sapiens
  misc_feature (1)...(876): n = A,T,C or G
cagccaagaaacaggggcaacaaaaaagaaaacaacaaaaaancttatgggaacgaccacgagnctcaagcgcgcacaccaagagnncancacagacancancacancacancaaagacangaaaacaaccgaggacgaccaccaacagcggaccggacaaagaaaccgaggcgcacacacaccaaggaacacgaagcagccagaaaaaagaaagagacaacgcccgaggcagcaacaaggacgaagcgggacgccaccacccaaaggaaacttttacaggaacagaaaaccaaacacggcatgaacccacgtagaaaagggagcaaaacagcgaggacccagggacacaagaaggaaacaagagacacaggggaaagacagggaggaggaggaggacgaccacacaaccaccaaaagaccacgaagccaaaacccgggggggacaaagaaacaggaaaaccaaaccccccgaccggcggcagaacgaaggaaccaaccaacggaggcgacccccacagcgaccccagcgacagaaagacgaacgaagaaagcgcccgagaacgggaaacgaggcagcacacgaaagagaaaccaacagaagagaggagaaaagcacgacacacaggcaccagacgaagccgaacaacacgcacacgagggaaacgagacaaaagacgaacgagaagcccccaaccgacaggaaacgcgacaagacggaaagaggactaacagaacaaagccgccccggaacgcacgacacacgaggcaaagcgcccaacacgaacaaaccgcaaacacacgcgcccaaggcgcaacaaagagaggaaggaaagaccaaaacaccacacacgcggcgcgcccaacaacccaacgag

SEQ ID NO: 12577 - DNA, 266 bp, Homo sapiens
  misc_feature (1)...(266): n = A,T,C or G
ctccggaaaaaaactatatgataccacaaggtacctcncagaaacacattgaagacaccatctccaggtctttttcctgaataactcaaccaagacaaaggtcaatattatgatcttctatatgtttctgttaccagctgtcctaacttcccagtatattatcataaacatccagaaaattatttaaaatactgttatgaacactgaactttggtggaataatgaagaaaacttctcggtgctggggaaaattaaaaaaaaaaaaa

SEQ ID NO: 12578 - DNA, 430 bp, Homo sapiens
tcgtaggcactgaggtccgtggttccctgaataacaatggcatgaagtagagccacaggtgatgtgaggcagactcatcatatggtttgtcttcaccccagtgcctattctctgaatataaagttcttcagaacccaggaatcacgtggtgactatgaccaaagctcatttcccaacaagtggccacagaggacaaggtgtggaggacactggaaggagcccatgatttgttgggcgtgttgcctgatgctacaggagatccattgatcgcatctcaaagcagtttctagagaagcaggaagaatttaaaatgctctggagaaattattttcaccatttgtgcttttaaagaataggacgtattaatttttcataaattcttgttaaccatggcaatacacaatgccattatttcttaaaaaaaaaaaaa

SEQ ID NO: 12579 - DNA, 268 bp, Homo sapiens
ctgattttgcttcagggtgatgttggctttgtagcaatgagttaaacaggaacacttcctcctcaattttttgaatagtttcagtaggattgattccagctcagaggagcttgcaaggcctgcttcaccttccacttctctgccagattacgaggtggcatgaggccctcatcagaaacaggtcagatggggctgcctgatcttgaacttcccagcctctagaaatgtgggccaaaataaattcctttataaattaaaaaaaaaaaaa

SEQ ID NO: 12580 - DNA, 1280 bp, Homo sapiens
  misc_feature (1)...(1280): n = A,T,C or G
tacagaacaaacgcgagatcgaacattaatagaagatcatcatccctacattctgccgttctcttccacgcgagcagacantaatctgctccgccattcccgtcgnaccctccagcacaacggtagcacactcagtatctggcatcgggcagaccctctttactccccgtccttaaaacaaccacccgtctcatcgactaatctacacaccctctgacccttagaaacacaactctctcagcttgccaccaccaaaacaacaaacaataaaataaggagctctaggtctactcccattagctagttcgagtatccactgacgccccctctccccnctacccaccctaacgcgctgtctcctcacagaaccactgcagtactattcctatctatgcctattatgctagcacacacgcgacactaaaccacccctcgcccaataatatacaactagcctatgcaaggagtccgcgttctccctatattcagtcattccacctcctctctacgattttcacanntagacagttaatagtactttatactcatttacaaacggaacggaaacttgatccatattagattacaaacttctatcatttcagccacgcgcggtatttctacacaaaactatccactcaacgcactctcacacgtactatcattatctaccaaacccattaccctgcattacgattccctcctccttacaccgtcaccccctcctcactcacctcttaatcaattcttttctatagctatacatcaattgctatgcctacgcgctccccctctctcgaagtctctaatcctgcatatatcagactcaccacactattccaaacncttcctccatctcatactcatactatacacatatacataccctgtactctacctacacattgcnacagcacgctttctattactgtntccatacgataacgtatacagtgttatcagcactaaagatcgcgtgngcttacgttcgtccgatatcgacactcctacaacaggacactagatacgcgagtatattccatagacctatcactctatctctaactctccttcgtcttatctgatantattaacttactcccnactctctcgcacttcacatatactttcatcatgtccactccnatataagtctcttgtatacactgtgacagtgatcactgacatacgccactcttacgcgctttgtgcacgcgcgctcatgctgcatcgtacgctgtcanacgatgagaacgcgatctcagctatgcagncnactg

SEQ ID NO: 12581 - DNA, 302 bp, Homo sapiens
  misc_feature (1)...(302): n = A,T,C or G
gatggaattttaatggaattctatagtccaannnaagccctctcagtacctcaagggtgcctgcattatcttccccaacccaggactgaccccgaggctccaaatcacctgccttcctccgagcaaactaccgtctcccagctgacctcggctaggcatacggagcaatacactaacacaccaccgctaagcctccctttcaactcttctaagtttttggatttttcaaagagaaaacatgttatcttcccctacccttactccccaaaggaacttaaggcaaaaaaagaaaaaaaaaaaaa

SEQ ID NO: 12582 - DNA, 276 bp, Homo sapiens
gaatgctcgggacttaccatgataagtcatatcttcccggatcaggaatggtcatatagagaaagaggattgcccagcaatcccagctgaaatcttagacaagagtttaaggctattgcaaattattcagtcgagctgtcacagaaccgccccaccaacccaaattgtgagatataatattatcattgttttaggcaactatattctgaggtggcttgttaaactgcaaaattcaatgtattaatacatatcaacaaaatcccaaaaaaaaaaaaa

SEQ ID NO: 12583 - DNA, 216 bp, Homo sapiens
cttcagagcacgcaccatcatctaccagatgtatctgaatttgacttttcaagactccacttataagtgaaatgatgaagtaattctctgtcttttcttttttttgcttatgcatttcttcatttgaaacaaaaaataacatttcacattcttttattctttcatgtttatattcagaataaaagtcaatattagcacccggcaaaaaaaaaaaaa

SEQ ID NO: 12584 - DNA, 156 bp, Homo sapiens
  misc_feature (1)...(156): n = A,T,C or G
ctaggacagcaaagctctcgcatcccgtgacctacagaaaggagccaccagattggatgggagccccatantcccggcctaaaaaccaccctctcatcactaatctcagcccttgcccttgaaataaaccttagctgccccacaaaaaaaaaaaaa

SEQ ID NO: 12585 - DNA, 1411 bp, Homo sapiens
  misc_feature (1)...(1411): n = A,T,C or G
acaacccgaaaatacancaccaaacatacncacacaccatcgagcacaacaagaacanacagaaaganaaaaaggccttgaagcgagcaagaaactngcngacnnaacaacagnccttacnagnnagggangncatagcancgncacaagcgaacgcctggnacgacgataggacgcaggagcacagcacagncgccttgcnatcgngngggagngnacaagcaaaaacccangacgtgcncangacgtgctntncgcgcagcntcgcgcacgcgcaggcctcgcatnaatcactgctcgaccgccgcgctcgcatccttcccgcgatgcactatgcgtagcggagtactcgccaggactagagcgcgatgcgctnaaacgtcgtagctctcctcttgcatagacacctccgctctctcacaaatccctaccgcaacgatcgcccaaaaaccgccctcgtctttttgtatccgccaccgggaccgtgataggcgaccagccccccgccgctagcaccgccactttttcttatttgctaccacacgagnatcgcgancggtcgatatcagcacaccaccccctacacacacaacgctgccgcgcgcccgcacgcgcgcctcgcctcgctgctcgctcgcggcgcgcccgcanaagcagacgaacccgctcttgcggctnctcgactcgcgttcctctctccgcctcgccgnggtcgcgattgctgttgtgtgtggagccgctgtgccgcgcgagctcggctgtccgtggtacgtgcctcgtcctctctctagctctccgtcacctcgcgctcgctcggctgcaggcgcacaanagcgcacccgcgcgcgctcccacccgcaccaccgccacaccgcaatcnacagctaacacantacactaaactgagtcgacaagacagcgcgacgacacgtcacgcgagaagactgaccacatcacgactaactaagatgcgcnactcacntacacgcagtcgcccgacgtcgcgcgtaacgnatcaccgatatctgatgcatcagaatacctgagactncatcgctacgctgcaccgctgagcgcgcgactagctacagcggctcacgtcacacctatgagctccctccgtggcgacagcgaccacgcggaccacgcgcgccagcagcagcgcgttcgtcgccatgacgagcaagcgtaagaacagcagagcaacgccacaccacatctgcacaacgccacagacaccgcgcaccagcgcgagtggccagcggccgcatacaaccacgagacggatagcttataggacggcacaacccgacacaccgtctnccgaccaacacacgagaccgagaggcagccagcatgcacgaccgacaccagacaccacccaacgagcatccagcnaccacgcacgcac

SEQ ID NO: 12586 - DNA, 796 bp, Homo sapiens
cctaggttaatgctgtgacagtgatcaaaagtgctaacaccctggggacgttacctcataggctcaatatttcattctatttctggaccgcggaactcttttgtgaacctgacgcattcatcctgggaagaaggtttggaaaccagccgtgctcttccctagggcacatcactatcagttttcaagttctatcaccaaggattacttaggacttccttgaccagtcctgcaggccagtaaaatctgcattgacaacctggatcaacttattattatttagatcagagttaggaacacattcagaaccataagacagcaagaattcttcaaagaaacgaattgtttgtcctggagacaagactatttgtgtcattgttttcaaatatgtaaataatttttatgtaaaaaaaagaattattattttcaaagaaacgaattatttgtcctggagacaagactatttgtgtcattgttttcaaatatgtaaataatttttatgtaaaaaaaaaagaattattatttttaatgaagtaataagtggcagaattcagacctactaatgaaaaatgcatgcagcagaatttggaacacctggagaaagaactttgtaataaccacagaaaaatactggttgacttgggaaggagtgggggctggtaaaggggctacccttcgacccattgcccacttggtggaaaatgtctcaaaagctttactgacagcaacagggaacacattctccacctaggcggatcgtgctagcatgaagaattagagaaataaaatcaagtactaa

SEQ ID NO: 12587 - DNA, 296 bp, Homo sapiens
  misc_feature (1)...(296): n = A,T,C or G
cctagatgagacactactgtgccngtcctgtggttactgtgtctccacaagtctggcctccaccaagattcctgcaccacctcctgcactcctctccgtatgactctacaagttcagcaccatccaccaaggctgctggctctggggctctctgatgcttttggtgggaacagtgtatcggttatctgttgccacactaatgctgtgtaacaatcattaacacttcagtgttttacaacaataaacattgattttcgcccactaaaaaaaatttttttttggcctcgttggcctca

SEQ ID NO: 12588 - DNA, 1109 bp, Homo sapiens
tacccctcttctcctccttcttcccctttcccccccccccacacacccttaggtagtcgtcttatggtccaggtactggagtatctttgtgaacatcacatttaagtctcggagaagaatgtgtctagtctgcgcgttttaggatgagagtatctgttagaaattttgccaatgcagatcaagatagtttcgatctgagccatgccattccacggcatcctgtcttcctccgactgcttttcctgtctcgcttcactctataccagctcctcgacaacagactgcaactccgtcgccttcccacctcctctcccgcccgaatatcacacctgtcactcgtctctccccactcgcaagccctctctcctgtatcttcgtcgccgcggatcgtcacaccactcactctctctccccactccctcacacccgcgcgtgtgcccccctctcgtctccttcatcccctcccctcccgtccccctcttccaccccctccttcaccttacattctttatttatttcccctcttttctatcctttctctacttaatccgttactcccacctcgctatccgttcacacacaccatccaccacccctcgatcttcctatctctcacaccctactgccccctcacaccctctcacctcactctcccctcctctcccatactcgtccacattccgtcttcattttattactgcccacttcaagcatagcctcgctcatcactcactcccctccctcaccactcccaccccaccgtcccccgcccacccacctcctcatcagacccacccccactcatcaacccctatctttccttacctacacactcttctctgcatccacttctccatacctgcacctccctggctaccacgagctagggacacaccgcccacaacaataacttcaacttcactcgccttctgaccacctctaacacgcacgcctactacccttactcccctccttcctctactctatcctccacccaccgtcataattcaatctgacttaaaccactacgtcctttctccactatccgctcctcttcaccctcctctactacctctccttatcacttcttaacgcaaaccactatcacg

SEQ ID NO: 12589 - DNA, 391 bp, Homo sapiens
actcctgcatagagaatcggctgtctgtagaggacagagatttgagataaagaggcacatctatttctttcttgtggacaatatgcttatagatatgaaatcacacccgactcttgcttagaaagcagcagcgatttgctcaacggagtggcacgtgtttactctcactgatgctgtttgaggtgatccgttttcctggtaacagacagaatgtgttcctttctgtgaattcacagaggctccaacgctgcagttccttgggagcaaactctgctgttaggcactataattttttgattttgcagttcacatgatgtctcagaagagggatatgtcttttctaacaaccatcatttttatacaaaatggaaggtattcaaaaaaaaaaaaa

SEQ ID NO: 12590 - DNA, 353 bp, Homo sapiens
  misc_feature (1)...(353): n = A,T,C or G
cctgccagcaccntggagatgcagttcagctgttacatcagatgtctgtgaccagcaggctttgctcctttgttcaagcaagcacatcaggcttcagaaaatcatcacatcaaggaaaaccatggtcaaaagaagagactatcctgcaccttccacaactatggaagaacccatattcattttttataataacaaagcaaaagttactaatatgcacccaggaattcaagctcaaatttaaaacaaaaaatgattagaaaaatgatttagaaaagaaaaagcatataattaagagacaagcagaaatctgttatttacagataaacaaaagtatatgcctaaaaaaaaaaaaa

SEQ ID NO: 12591 - DNA, 368 bp, Homo sapiens
cctgttgagagcttgccgctgctcccagaaacccagaggagaagtttcagctctatatgcagatcatcaacttttttaaaggccttagctgtgcaaacactcaagtaaagcaggaagcatcctttcccgttgatgaagagatgatcatgttgcagtgcacagagacctttgacgatgaagatttgtaatgcagaagaggagctgcgaggggagggactgaatgaggtgggcagttcccaaggttgaatgctggcagctaaggttgcacctgccttggcctccaggactctttggagtgggttgttccagaagcattttgatgattttagtttctgattattataaagtataagagaaaaaaaaaaaaa

SEQ ID NO: 12592 - DNA, 521 bp, Homo sapiens
ctggctgatctgctatccaccttgcctaagtataccatctggaagaaatctgagattttagggatgagaaactagttgtttatccctgatacagcaacttatctagaaattctttcaaatgctgtctgctcagcttaagagacgagtgaatctctttgatcgcatgactgaccctaggttgtatatagttgtcacatgtcagtagcctatgtgatcccaagcacggctccccagctggctgccagcttgcaatatccctccagttttcctatctaccaggttaattgctccccaatcaaaattaaagatgcactaagttcttgcattgagaaaaggacatcacccaattacatttccctattgtcaattctgtgctatgcataacagacttgaaattgaactgtgctcatggaattgagtacaaaagaggattcaatttaacaaacagttgtcgagtacctattatgtatggcataatgaatacaaataaaatagttttaaaatctccaaaaaaaaaaaaa

SEQ ID NO: 12593 - DNA, 833 bp, Homo sapiens
tctttttctccccacattaaacatatattattaaattaaaaattacacgcacaccccacagggtttttccccttcatgttcagcagttagcaccgaatctccttggcaaggcgctcagtgactgcacaatctcacacctgccagcactttgggaggccaaggatggcggatcacctgaggtcaggggttcaacaccagtctggccaacatggtgaaaccccgtctctactaaaaatacaaaaaattagctgggcatggtggtgggcgcctgtaatcccagctactcaggaggctgaggaaggagaattgcttgaatccgggaggcggaggttgcagtcagccgagatcgcgccactgcactccagcctgggcgacaagagtgaaactccatctcaaaataaatacataaataaaaacaatgactagtcatacctatgcccatgcatggtctctttattcctggacaagagtctggcctatatccagtctttcagttggataatatacgatagaaactagagggaggatgctgggtgcttctcctatgagctccttgagcaccctccaacttccctgcattttttgtacatgctctattaaaactgctcgatgagaaattaactgttctgacatcccaccgaactaatccaatacaggggtgtaggggaaaacaggtatttctctactcgatcccatccccctatgggactccactaacattgccctccttgtccctccaccatttctccctgatattacaaaccttcccccttccgctctaaaaacacaaaaccgccctcatgtatctccatgcgatcctccgattttccttt

SEQ ID NO: 12594 - DNA, 794 bp, Homo sapiens
ctagagtcctgctaattccctgaattaggccactgccatctcatgcctgcgttgcactgaggacctccagtctggaagctcattttccatatctttacaaagcagatctatcactctgaactgttgtctcgacccgagttttgataggtattgtgctgggatctgaccatccaaaatacaatcactggaatctgaagaagtattctgtgggagtgaatggaaatatatatgacttttaaatgggcaaaggtaacgtttttctgtaagaattaaatacctgcagttgtattatttgaaggtgcattttcaggggcgagctgcaaaacatctgtcaggtcccaacatttgtctactggtgtttttttaaatgtggattgccaaaatctttattcatgatggacattatgtaggagtggttaatacttacatagcacttacctgtgtcaggcacactgatcaaaatgaccgacgaagtattattcaacataaagaaaaatctaacttggatgtgaatgatcagagaacttaagttttgatttttaaacctttcagaaattgttaatatagatgtttataacttccaccttttaaattacttcacttattgaacagatattagtgaacttttaggtgctgaggaaaacacaaagagcaaagcaaagtccctggcccccaggaattcgcgttttaacggggaagacaaataagccagtgaaatgcacgactgtgagaagacggaccagggagatgttactattggtttgaagggcggtcacagaatggctgcaaaaaca

SEQ ID NO: 12595 - DNA, 901 bp, Homo sapiens
  misc_feature (1)...(901): n = A,T,C or G
gccaagattcaacgatcaacaaaatnaaaaaaaaaaaaaaaaaacttgttgcgacccacacgggnctttttggtccaacaacagcaaacacagnctgggnggnggntctctaagaccataaaggacccaactggatgctctacatagcacccttgccaaaagggttccggaaatgacttccagcttcccacagtaataaaatggcactcgtttggcacacaaaaaaaaacaacacaacaaccacaaccactacacccacaaagcccatttttttttaaaaaaaaaaaacaaccacncaaagaaccaaccctctctctctttcacaaattccgctgtcctacagcaccacccactcatattcacacgcctctctccctctcaaacacggctccccgccacccccacccccccccatcccacaaccacccccaccacccgtccctctaagataacttacactacacactcccccactcccccgagatatctctcagaatttaatccctatagccacaatcccccacccggccatcactcctccaaaaagtcctactacttccccaaccacgccaaagcataaagatatcctatgtacgatatacagcccacacaatagtttctacatacctcacgcaattcccacttctactcctctcccccacctcactcagcctcgccaacgcatcgacccactcccccctcccagccccaatacccatcccatattaccctaccccaccccccgtcacacactatctcctgtaaaccaaaatgccctcaccctacgccccctcatcaatccctccccagtcgtccacagagatggcgaacgtaagtacaagaacgagaccncaaaaatccccacaatcaacgtctatattccccccctcccacacttatg

SEQ ID NO: 12596 - DNA, 462 bp, Homo sapiens
cctagagggaactagtcgtgctcttaatgggacatctactggtacacctgctgggaaacattgtctgtattcatggaacgctatctgccttatacctgaaggagaatgtctatagaacgtactacacccttgtgaggcggtggattcatatacacctaactactatatacaagaaataaaggatattgatgagaaaatgatttattgatccacgcgtaccatatgttctcaaagatggattacaccgttcgaaagggaacaattcaaattgactgtaatatacacaaagatgccgctacagaagctatcttcaagcatgcaagctaattctatactgacactcatgacttttagtatcaatgcaagtcttcttttagagattaaataatgcactcgggcttatatgcctgatctaccttacttatggaactattaactttatcgaagataaatatatgattt

SEQ ID NO: 12597 - DNA, 510 bp, Homo sapiens
aagagtaacgccctacaatattttttttatttcactgctctagactctaacgctacagtcttagcagagaaggccacagggtctattgtgctgtcattctccctcaaaacattctccctggagatggacagctgcccagggtacctgaagcctgaccactggagagaccatggtcttcttaccagcctttcacctctgataaaagtttcaaacaaagctgggagtttgttgacttgtgaaggccaggtgatctgtggacgatctcaggtcaacagagctgaagaatggcagcagttcagtaaagggacaaaggccaccaaagggagaggggtcggcagacttctataaagggccagcggggaaatattttcagcttttcaagctaaacagtctgttgccacgtctcaaatctgcagttgcagggcaaaagcaaccatagataatatgtaacgaacaaatgtggctgtgttccattaaaacttaattttggggcactgaaaaaaaaaaaaa

SEQ ID NO: 12598 - DNA, 870 bp, Homo sapiens
agtgacacccacaaaaaaaataaataataaaaaatttaaaaattattgaggaggaacaagcacgacaattgtaaagatcttctgtctgaggaaaatgaatccacaggtctatcccaggttctagcccaaccttttactagtcaaagcggactcgtgaatgggaagccgagggtgccgagaccacaaagcgccaggatgtgcgagctgacgagttgtgaactccgtggtttgaaaatgaaagaaatgtaccttatttcactatgaaaactttctttaacttagagaatcgtgcttctatacattgtattctaattatggaaattatcgataatccacagttactgctgcacaattacaaacctaatgacaccttccaaaatctacacacccccaacaattatccacattcctaccttaccacaccactcctacttcaacacaaaaaaacacgaacgatccaacccactaaaactacatttcaactcccagcctactataacgcaaggcaggaaaacagaaatcaagcgtcccacacgcgtccaaattcttcaccattcaccccttattattaaacagtacgaaacgagtaaatatgcaacaatataaactattcacaaaatcaagtacataattcacacccctaccaaccaacccaccccatcgacagcggacaacttaacccattaacctcgactcctcatataggacaataccccacactcgtgcccacacataataatctccaatatatacacaccaccgaaatccaccaatataatcaaacctccactctttccgcaatgaataggcatattaaatagaacagaacgcataaaccagagacgcacactaacagcgataagacggaat

SEQ ID NO: 12599 - DNA, 593 bp, Homo sapiens
  misc_feature (1)...(593): n = A,T,C or G
tagaggagagaactcaggttttataccatcaaatatgattaaggcttttagcagtagaagccctttatcagattcagacagtgtctttcagttcctagttttctcagaagtttagattttgaaggaccagtgaatttcatcaaataatttctgcattggcattaatgtttttcctgcttgtttctattttattttaaatttaaccttaattttttntaaaaagtaagttgcggattcacaggaggttgtgcacacattgacaaattattgaatgctaaactagtcttacattcctgggataagccacacttggttttgatgtattttcatttttatatattaatggcttgattagctagcattgtattaaatattttgtgtgtgtgtgtatatatgttcatgaagattattagtctgtagtttccttataatatttttgactagatttggtattagggtaatgctggcttcataaaatgagttgggaagtcatctctcctcttctgttttctggaaaagatgatatataattatattattttttccttcaatgtttggtagaattcactagagaagatattaggcatgaagag

SEQ ID NO: 12600 - DNA, 228 bp, Homo sapiens
aggatgattacggggctaggaatttcctagaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaaaagaaaaaaaaaaaaa

SEQ ID NO: 12601 - DNA, 490 bp, Homo sapiens
ctaggccccaaactacagtttcaataacaccattaaaatcttgggcaacaaagataatatgtaattacctgataaattcgaagggtgtgatgaacaaataaaaaagatcgtcttgagccagaatacacacgtgtccttccagcgtggagattactgtgaacttgcataccagctttcgtgcagaagggggcgagagaataggtggaaaagaatattgtcaaataattgtgaaatttatctgctaacattttctgaccatctattattgagaaaggaaacagttttttaaagcaatggcatgattgtacagtaaaccctgaagtgaaatatacccaaaaaatgtatttgtcaagcaatcacattttgatatcttacagacatttgcaatttatctttcttttttcctcaaatggggaagaacaaagttaatttaagtgaaatgaaataaaaattaaattaaaaaatgaaaaaaaccttaaaaaaaaaaaaa

SEQ ID NO: 12602 - DNA, 195 bp, Homo sapiens
cgtgaagctgatttctggtctggacccacactgaagaaccattgtacgaggacaaaaaccttagagggcctcgtgaccagtggagaggctgaagaaaaacccaaggtcctccactggctgctggtaaatgtttgttttatatcagcaatagaaataaaccacttacatttgttttgaaactcaaaaaaaaaaaaa

SEQ ID NO: 12603 - DNA, 209 bp, Homo sapiens
ttagatccctcgcacatgctgttccctcatcttgaagtgtccttctgccatttataaggacctgatgattgatttagcatcggtggcatccggccactgctctgcttggccatactgctgccttcaccctcagctgttgcaactcttttggccactttgtgtaactgccctgccaagccctgcttcctggctgtccaaaaaaaaaaaaa

SEQ ID NO: 12604 - DNA, 848 bp, Homo sapiens
  misc_feature (1)...(848): n = A,T,C or G
tgatatatgaagcaaaggatcacccacaaaaataaacacaaaaaaaaaagcttataagccacctcagcaccggtttaggggaaaaacgggtgatacatngggattaatctaagacattctttagtggctccgttctatcgccagtgattgatttccacacagaaactgtcagcgcctcacagtgtccatccagtcttacgtgctgacacacggtcccagctttcgtctctttgcctggtggctttctctagcaaccagagctggctctgtgactgtgttttttgtaggccggaagtgcatcctttgtcaggtttcataatgtcttaatattttatcattgcatatgaagggtaggtgatcccttcataaaagacaaaagtcataattcatcactctcactatcaacatgtgttcaacagtgcacttttcaaaataaatagctgtatatttctccttatgtaaaaagaactttataaaaaaaatacactaacgccataataataccactccttattgttctatttatctcttaattacaaagacaaccactaagaaatagacacaaacatcctcaacatatcatcacttaattccctattcctcttctcctgccgcacatacaagtacttattcattctattctttatattaaaatttaccataacaataaataaattaccagcacaaaaaagcctgacgtcgctgctttcttgcacaggtaatttgtatcaatactaattttgtaaaacacacaacccacaactgttctttttttttagtttttatatcgtatattctatcttataatatccctgtatttaaataatattccccctaacgagatatag

SEQ ID NO: 12605 - DNA, 1421 bp, Homo sapiens
  misc_feature (1)...(1421): n = A,T,C or G
cgtatctcgcgcagtngcactcgcgcttggcagcggtangagcgacgtgtgccgactgtcgtgagtctcacggtcgcacgcgtcttcctgagatgangncacggagtgagcgcgaggcagcgatgngagacgcgcgcggacgaggatancgtacgagacgagtatgcgcatgcgagngtgagtgatgacagccgaccacgtagcnggagtagggcgtatctgtgcgacgaggcgagcgngcagtctagcgagacttgtatgaggtctgagatggtagtgggtgagctgtgcgagtatcgtagtacgcgatcgacgtggggttctgcgtaatgacgcattgttatgtgcgagtacgacgcgcgatgnagcacgggtacgtgaccgacnattacagcgacataccacagaagataagagcgcgtgcgcgcctgcatcacacggtaggtgcaaatgnatatcgatcctgtacaatacgatgtcgtacacttccgagccgcgattactctcagtgncnacaagtcgatcacctatcacntgcatacgacncgcgcatcacgacagccagtcctcactcactcagacggctgtcagcgaagcgctcactctattcagtgtactacacgtcacactcttcatcttgntcacattcactcantcgcacgagtgtcgtccgcctcccacaccgtcactgctacttctcggatacgagtgagctcactgcatagcgtgcaagccatcgcgagagtgcgcacgtgaaatgaatactcgctgtgtatgagtgctcactgtctgtagtacttgcctantgtggcgtgtctcttgctgtcgatctacganggcttgtgcgttcattatgtcgctgtgtagctacgtggcgatgcacctttatcggtattgtcgagtagagaagcgcataggcacttccttcttctttaccaggtgttctgtagtttgagacttgtactgcgtatagtgcgtacgcatctaggtagtgtgcactgtcatagttatactganatctcgatacttcngttggtttgtncnttacgcccgtcttgcagcgatctctgtatattttaccgacgccatactagttgtacacgtataatctgcgcatcttgctgtcgcgtcaacatacagacacaaaactaacttatttgttacgctagatgtatatagataacgtgtcattactctgacccacgccagccacaacctactctctctcctcttttgatttctcttntcnctctctcaaaatttcttcttcttttcttcctttcttttccccccttcnttnttttggttctttctcttttctaaattcttnnntnnnttgttcnnannnaaaanncnnnnnnnnnnntnntcttntttttcnnctctcccttttttcnncntnnnntnnnntctttcccctc

SEQ ID NO: 12606 - DNA, 209 bp, Homo sapiens
  misc_feature (1)...(209): n = A,T,C or G
cctaggttatacctcagcaagtgctgnaaaacactacgaagagggtcggctttatcctcctttgaataccttagagatgtttctatgcaaattgcagaaaaggtaaaaccactcttgttcaagcttcattatttttccttccttttcttgctaaatatgcatttttaaatattaaaaatctgcttccttgaaatgtaaaaaaaaaaaaa

SEQ ID NO: 12607 - DNA, 2100 bp, Homo sapiens
  misc_feature (1)...(2100): n = A,T,C or G
tgggcacatcgcttcgtcnnnacagcggaatggggagagacgaagagcagagggncanntcgacagagaaaacgagatgacgcgatgtggcgacgtcggacgcgngngtgtacatcttactgctcgcgctacgtactgcggacgcgacgaacggacgnacggaacgctgatatgnacgtggtcgcacgcaggatgcgatctaagtntgcgtacgacgcacgatgcgactgatatgatgtcgactgcttccgatttctgacgcaatgtctgttacgagtgtgttcgactcgcctcctgccgctctatcgactcgttcgccacgccgtgtcgctccatgtgtcactggccgacgtcattcaattcacgcttctgtatacgagtatgatatatgcggcgtccgttacgtactgactgactgtctgcactttagatcatctacgcgcactgactcgactagattttatgttgnagataacagactatagtagtagatgtgnagagctcacgacacgtcgccattatcgagtccattcagtaattgnatgnattacgtgagcatnatgaatgcttatgcttatacatggtatacggngctccagttctgttctattnagtnattctgctcattatgaggtatgtacatttgtatgagtaatatcatatattnacatctatacaatgctaattatagatctnagtcgtactgagcgtaccataatgtggatgattagacnatatagtcacgttattacttgagatggttgctatataatcatgtgtatcacgacgaacaccatctataccttgcactctctgataagctcacgtcagtattagacctcatgatatctatatcgttatcttgttacatccgcttctgcactacatttatcatatgcgccgtacatatctataatacacatataattatagcaatagccgcggaatacttgctcagatatcactttatgntatattactctcttctcactatacgatgtnagttttctgactnaatacttattatcgcgatagntatttgactgttagacataatcgcatgtcgtaaacgactgttgtctacgtaatatgtattccatgatctgtgttcgaggnatatatgtctgtattgcttatactatctnttgtctatatcgtatctatccgctcgtcactataatacccagctatctatcctctactctnccatcatcattagacatncagctatgttatcacgacctcgctaacagtagactgntactatctatagactatatgcaactcttgttactatnatcatgttatgtcatcgtaatgcatgnttctctcgctcgtggtgctgccacgatcgatgttcggacctcgcagtcgatgtatacatcaagncatcgagtatgattanccagtgtatagtatgtnatatctctcttnagatgctattctcatatgttgacatatccatatgcttagncatcgtctgcggtaatcatgtgtgcaggtctgtgaagtatagtagtgtnctantccgtggcagtagtagcgatatacatgagtaganatgtaatatcgatnatgatactgtgtattaacgtatnaatatgcttgtcttattgtgtcttgtnatntatgtatatgttataagtagtcattagtatnacgtagtcntacatgacgacatcatntatatgctcgctctgnagtctcttcgactaacgacggagttcttatagatgagttcnctcnncggaagggacgaactntgtgcatggactctntnngcatcgctntatgnatctagnntacgtccgagtcgatcncgntcattgctcganatcgtcacntgattncgcctncatcgacggntgctcacagtacgntagacagtatcangtgattngtcnagagcagtctactgtatcgcatgtntgtattnttacttttagtgagtatgcantgtcataattttacgtntattnttcatgcgtatcngctttatnctatgtnctgtgctcgtgagtccactactatctgagtgcaggagacggacanattgtacgtntcgtnaatngacnacacgcgtgccgatgtacagtatct

SEQ ID NO: 12608 - DNA, 271 bp, Homo sapiens
cctagaatgaaatggtatggaacagtgtaatgagcaatagaaatatggaaccaagaagcaattatatcttcaaaggagcaaaatgagagcaaataaaaggccttgcacaagttagcatacaaacaggcagatcagaacatcatttacagagtccaaatacatgcctgttggttatagccgtaaattatctttcacagacatcatgttatatctctggagactcatttctgggttataataaaaatcagatttctcaagaaaaaaaaaaaaa

SEQ ID NO: 12609 - DNA, 835 bp, Homo sapiens
  misc_feature (1)...(835): n = A,T,C or G
ttaggagctacaagaggaatcgtgatacgggaggcaacatgaaagtggacaaggagcatgaccattgattcacagcaccacaaggaggggtttaggcctccggatgactgtgggcaggcctggataatatccaatctcccacaagaagctggttggtggagcacagtgttccctgactccaagggaagggaggctccctttcacagtctgctaagtaatgggtatttttccaggcaatggtgttacccgccgccaaggacccctcacactgccctcatccgggagggacatacggttcacctctcgccttctcagtcacttctctcatagtgcctcaccacctcgtccatacctggccccttcacttcgatatcttaccactacaccagacactatctttgcccccccgcatatgaaatccaaataacctctctgcgtgggctcccgtttactctactcccggcccctctcctttaccccccaccgattctattgttctttctgtcctcccctcccacccctccgcccgccccccaccccactacgtcaccacttgcctggcccgcgcccccactcctctatgtccntcctccatacgacctccctctggtctacttctctcctccccctgcctcccccgcacgctttagccctatacccgccacccctgcccctgcctccaccaatctattcgacccatccaccccnacacacagatactcctccctacacatctttctacagcaaatcaaagaggaccctacctccctcccggcacccccgccccccaaccgcccgtccctccctatgttcaacaatttgctgaaacaaaaat

SEQ ID NO: 12610 - DNA, 103 bp, Homo sapiens
  misc_feature (1)...(103): n = A,T,C or G
tgtgagtnactgtgcnagactttgctgaccactgnatagtgaactgttatgtgagagcagaatattttgcctttttctttaacgaaaaataaaaaaaaaaaaa

SEQ ID NO: 12611 - DNA, 297 bp, Homo sapiens
ctagggcatgctaacaccctccagtacagcagatttactgagatcctaaatgccgaagacttcacctgatagaggctcaacattcccacctaacttttaaagatacaacaatcaaacttacaactgaattctagctgcaaaacatattgattgacatcattgtccataatatattgaaacggtcagctattgtcttgctcctctccgccagttgcaaagcactctttaaaaatcaattgccttctccctgtgcagaattgccagaagtagatatctgatgcctgaaaaaaaaaaaaa

SEQ ID NO: 12612 - DNA, 788 bp, Homo sapiens
ctaggttccacgaggacttgggtgccccaggtctcgctcaccgaaatccattgacaagatgccacacatttccactacatgcatttaaaaaagaaaaaaagaagaaagatgctgaatctatgttaccacattcacaccagaagtccttaaagttaacatttaatcccataatcctaagtagtgaattcagcaaagcgcatggaaagcacttttcccatggtgataattacatagtgcttttcatcttcaaggtagttggccaacacttactaattaattcttctaataccctggagcaattaaaaataaaaaccacacatttaattcgactagaggagataattaccaatatcagtagacaagaaatcctgcaagggactagagatgaataattaaattgtggtggaaatatttcaaggcatgattcgccttctgctttcattacagcaagaacattacaacttgattaagaaagaacttttatttgcctttcacaggtgaagaaactgatattcacacacgagcctttcgctcaccaaaccctacttacccattgtcgaacgggaggtccacggacattggtccacctgccggcgctcgacataatctgcagcgcctcccgaataagactgaagtaccaccccccatgccacgcgtcccccccgccccctcttcccacccccttctctatccttcctacccctcttttctccgtcaccaagaacgccactccccacctctcaccgcttcaaaactccctgaactacttgtttcttgaaatagcctac

SEQ ID NO: 12613 - DNA, 147 bp, Homo sapiens
ccaggaaaaaaaaatggactggaagactaaggtggagaaaagacgtgtatgtgtcccttatttacaacaatttctctccaggaaaaggtggctgctcaggagtaggaagggaagaataaaacatccttgctttgaaaaaaaaaaaaa

SEQ ID NO: 12614 - DNA, 1241 bp, Homo sapiens
  misc_feature (1)...(1241): n = A,T,C or G
caagtcctataatattatcctgttggggccggcgcacacagcaacaccgagcgacgcgcagccaacattcaactctccttttcccgccgcctctcgacgtcacgcgntggcgtctctttttcgtgcgcaactacctgtaatgtaatactccctccccactccttcgcccaccgattctatcgtacctatttcccacgaatgcggtccacccgcacacacaactccctcctcacgctctgcccgcaccatcctgctcagcctcgctgcggcnctggttctgttggtacgcggcggtcgaccactgcgcgtacgcgtcatgancctcggcgcatctccccgcactaagatcaatagaagaacacactctatattagtcagtgaacgtgcccgtcngtcgcgcacactgcgatagtaacacactcatatcaccgccagacgttggacggtctcacccagcctccgcgatagcgcctatcatcgcgtatctaatcgtttgccacctccaggtgtgagatcttgcgtgatctcggctggtgcaccctccggcacacataccaggttccgctatatatgcactcactacngttgcagctcacgcaactaccgccgcaagtcctcggtagacaactctatgagtgatatggcacgtgtgtgggtagcaatcttgcccggagatgcaccattattatactgactgcaagccgcgaacacacgtcgctcctcccgactcccctacaactagcgccccacgtcgcccgcccattcggcaagccgggacgccaacgatgaatcatgtcgcggggtcgccgccggcgcgttcccccgacgcacntcctgcccaccgtacgactctaagttcgtccctcctctacacacttggtcgtcttcacacaataagttgctcgcagcctgcgtcaccccccccccatggtataaccgcactcatgtctcctcgtgtccagtgctatcactggcgagcccgtctccaccgcgcccgccgggacctcatcatcggtgtcctcagcggcacgtgcgtgttcccgtcgcactctgccaagtctcagcaagccacttgtccgtgcgacccatcgcactccaagcgtcgcatcgacatatcttcttcgtcccacagccacaccctcacgtgttccattatctgtattggtggcgcgcatctccgcaccatccgcacgcaagtgattcgtgcgtgtcgggtggcggcatgtcacggggatcgtgcc

SEQ ID NO: 12615 - DNA, 1606 bp, Homo sapiens
  misc_feature (1)...(1606): n = A,T,C or G
atctgcaacacccgcagagcacatcacactaatgatgagcgccagatacagcacacctatcacatcaccaagacccagagacacacagaacaacgcgctacgtttcccccatcgccatcgcactcaccacaacagcaaacccgtcgcacccgcgccgcggccgcctcaccgcacacatcacaccgctcccgcgaggcgtgcgccgcgcgcgcagcgacagcgtagtccccacatgagcctccggacgcagagtcaccacncaccggcacacgcaccaccgtcgcccgtcaccaccgctagcacacgacacagtnctcccgcgaccctggaccgtcaacactacctcaccagatcgatcatcacacctgacagccatcgcacacttgtcacgcgcacacctctgcacacactcaccgcccgtcgcacagatccggagagcgcgcgcacgcactatagcaggtccgtntcgcatagatctatcacagtatcgtcgatgcgcgacgacgttagatcgcgcgcccacacgcctgacacacgcagccaccacacaacgccaactcatcacacacanagacgtgctcgcccgccacgtcgcagtctatctcgcccgcacnatctgccgcacagtccgcagatcctcgaagtatgcangccctgcgatggctgtgattcactccgtcttgtgtgttcgcggacgatccgctgcggtaccnacaccgancacgacgcatacacagcnatcgcacatcgcatcagcatatatacgacgatatctcacggcgcacgctgtttcaagagtgatcacgcacatactacccgcgccgcagcgctgcgtccgagtacgcggcatccgcgtccgatcgacgcgccagaacccgcactaccgcgcgcntaactctcggcagccgctatctcgctgtgagccgacacacgctnacncacaagctcgcgccttactaacgccatccgccgccgctggccgtgatgacacacgccgcgctcganattagtgacaacacatccgctggcggacgtgcaacctcatacacggatcacacacgacggccgctcgcgncgtcgataatcatccgcgcgacgcgagcgggccgcggatganactaanacgacgaacgtactacgcgcagtacgcgggtgcgcgcgctgtgccgcgtggananatacnatacgcgataacacgtaacgggtgccacagacgccaccgccgtaacccggcggcgcgcgcgantctgcggcgcccncgcggtcgcgaancgcccgtcacgacncgcgtactcgtacagctcagcncggcgggcggccgcaggcgggcgcgcanacgtgagacggcgcgaactcaacaacacgagcgctgcgagcgatactgagttatacatgatcgcgctactcgcgganctctcgccggcggcgtcgcgacagacacatctcgcgcgatcgcgtcgtcacgcatcgcggcgtgtgagatgagtgatngcaaatcgttcgcgagcgcatccatcgcccgttgacacccgacacgcggcgctacgctacccgcgccgtcttcacgcgccgcggtggcaccgtcgggacgagcggcgcgtatcat

SEQ ID NO: 12616 - DNA, 1515 bp, Homo sapiens
  misc_feature (1)...(1515): n = A,T,C or G
cagtcgtggacgtgcagccacgcacgtgcgcacagaggagacggaggcgcggcagagcaccagcnnngacgcgctgngtnggggaggaaccacaagagcgcaactagtgttgctncatgcggcaccactcggacataatagtaacatgcatggaggggagtgtncaggccttatctattgtgagtgatctgctgcacgcacaatacactcgatatctcgttgtagaataacttgcgtggcgtacattattgcaggacatagtcgagcgcatacagtgaatacctcgtgtataaagcgaatatagtcactggtagaactctatgtgatttcgtatatagactcagcacganacgagcgtacgtgagacagagtatactagagtgtgcgccaggtaagtcagtgactcagtgtcatagactcacatatganaccgtaaatgcaacgtccatcatanagactgtagcatacgctaacatgatagagctagtgatagagacacacagacagantgttacactncattcgcaacaactcgcaccagcgntctgggacgactagcaacttatctatgtaggcgtatagcgacgatagtcaactactgtcggaccgcagcttgatgtcntacatgacgcctatcctcntaatatcgcgagccacacacaatgatcgagtccacgngctagcgtaggagagtgcacgtaatcggtacatatcacatttgtaatacattctgcgcgcgtggctcacgctggagaccctctcatgttaggcagggcgcaatctctactgaggatggcgcgcgttgtcgctcgctctgcgactntcgtggngggagagntgttctgatcgtgacagacagcgtagtgcgatcatggacttgaccgttcacgcgaggtgtgtcgcacagcgtnacgtatcgtgtatatcacctcacaaggcacgtatgctcgcgattatattactggccnncacattgatactaagagcgcatggcggcttgtctccgcggagtgtcgtcccnccancaaaatatggtcctagtgtattcatctcggacccctgcaggtgtataccctacncgtgctccagatattcttagctgcgccccctagtgatgtgtcactcgcgcgctctactctgtgagatatacaagcgcatcgcgcccatagatgctgttgtgatgcgcctatatttatctattaacgcgtgcgcgccgccctcgcgcgcctcctcctgatagacgacggtctaagaacacgatctancaacatgtctgtggctctcgcgccggcgtctgtgggagcgtcntgagtcacgttctctcgctgcgtctctcttctatcttcttacgtcaccacactagatcacntctgtcactactctcgcgcgatacncncacataccgcccgctctcnctctctattctctctcgaacggcnagacacatatcggcgcggtctcttcctccgagaagtccactcgatgcatgtatatcatcagtgtattatctgatat

SEQ ID NO: 12617 - DNA, 1049 bp, Homo sapiens
  misc_feature (1)...(1049): n = A,T,C or G
cgaacgtggtgcggacgaccgagcgacgctgcgcgcgcataacgcgttatgccgtgttggatactcttttcatctagaagcttgcgttgttctcctgcagacacgaaccgccgtgtgccaatctcgcctcgccgtcctcctactccgttgcctgccacacttcccacccctgtgattgtgcgccgagccgttctgtcgcccggccctcttccggtttctgctatcagggtcgtatacagacgcgaaggaacctntcaccagcagccgccgcccgtgcgggccgaccgagcatgcccccgcctggcctagccacgcgtagttctgctatgcccgcgcgtcagtacaccgacatcttgtactgagtgtatattgagaacactccctacgctcccgtggcccggtctccgcggttctcgcctcgtcgtgtcttctgtagtcaccagggtcctcctctctcggttcaccgctctccctctgggctcgtgccgtatagacgtcgcggctgaagcgtcggcgcgcgagtgcattgtgtaagcagtgagctggggggtatacttgtatgaggtggggtaaggcgacacgactcgcgacgcatgacccgcggcgcggcacgaccggcagtgtcgcgaggacgtgctcacttatgcccccgttccgacgctccggagcgggtgcggccgttcggctcgtgtctctctgcgctctgctagccccataatcgcccgccctctcgccccttgcgcttctcatcgcgcttgttgcgtctcttcttgtttgtgtatgctcctcttgtngctgcccctcgtgctcgtccctctggcgctccgcgtttccttcgcttttgacccctgcctctttgctgcgtccggtccgtgcgtcggcgcgaggtcccgtctgcggtccatggaccacagaacacgtgaagctgtctttggtgtgctcctctccgcctctcttggtcgtttcttgctcccccccttggtaaactgcatttgtctctcctctccgctccctgcgtgggctcntcgggggtctgnatttttgtaaag

SEQ ID NO: 12618 - DNA, 1568 bp, Homo sapiens
  misc_feature (1)...(1568): n = A,T,C or G
gcgattagtgatatatatntgnctagagacatacaacctgtcgtctgcatgatcacactgctacgatgcncacgcntcagactgacaacgtncgtgaangccnctcnagntcntagngtatagaaccantnaagcgnancgcaanatctgtgttagtctgctatcgctagncncacgtctgtagaatacattgctagacaancctacgnaagntggacgagcttgcggcatcattacnagttgncagtagcntnacctacacacgacttacgcatctcgantacttgtgctatagtaagtaacgctacgattggctaggatctcagtgcgaatacgtaagtctatgtcgcaatacatctgactctaatcgttcgtacatatcgcatatatgcgtatgtgatgagacactgatgtgacgctcgtactatatgcaccatcacaatagctatgctacagacgctagagtatctatatgagtnagccatagtcgtcagagacttcggtctaanantnacatctcagaatncaataccatgcgagtctcttgagtgtcgcatcatagagtagatgtcatgggagtgatcgcagtggccttgccttagtccgttatataatagacacttctataacgtagcacctccataatcgtgtactacctgatcagcnatgttagacgcggttgagatcataatgagccactaacacttaatggtgtgcacaccaattgtattctgcacatgtcgtaatgggagaccgtattgtgcgacgcagatgcttaatcatctataacgctatatagggtgttcaatctctactttgtgagcgcacatccaatctacctcatgagtggccgcggttaactagctgctgatctctgtangagcgcggctagttgatggngaacatgtgttgctcgacaatcggtctatatcatcaataagcgcgttgtctacactcacgtctgctcgatcgcctcccacacactcttctcttgtgctacctcacccacaggagtgagtggatgaaatcaatgggctatattctacaccgtcggcncccctctcacattcgtgaacacnacgtcacgctcttntgcacttatacggcgctcacctattcgtagctggctgcttctgtgtctgtgccattatagcgcttcatcgtggcgctcntatggagtgagtatggtntatcactagaacatgtgtctgtagagcgcatattagtcatgttatgactgagtatgcgactganaatctntgttaacnancatatatcattatataccacacccaccattgtaggctatctatcaccactgtctcagaganagcacgcgtacgctcagaggtgtagcgctagcgntgtngtgatgtcagctgagaccgcacgcacagtgtngtatacgtcatgacttatttatantgtncttcacattatatagctactccgctcncggtccgacgcgatgagagagtcgcgcagcaatatgttagtgcgagttgagtncnatatcngacagatacgatgtatcatatntctcatatagtgtgcgtagngatcgtgct

SEQ ID NO: 12619 - DNA, 172 bp, Homo sapiens
gcattacattgattgacttttgtacattgaaccaaccttgcgttcctgggataaatctcattaggtcctgtataaaccttcttaatgtgtgtaatacttcttatatgctgctggattcagtttagtgtattttattaaagacttttgcaccaacaaaaaaaaaaaaaaaaaa

SEQ ID NO: 12620 - DNA, 1335 bp, Homo sapiens
  misc_feature (1)...(1335): n = A,T,C or G
cttgattctgcggtgtgtgtgcganantcgctcgtgntacgcgtgccgtctcgacatganacgttggtttgccatgatcacgatgtacctcaactaggtcgtcgggtgcacatgcgcacgagtctcttatcttctctaaatcactcataaaccgtacgacgacnctctcctgcgcacgttccaaataacatacacacactcacatatatacacacaatagcgccgacatcagcagatggacctatcgtgtacttagactcgaccacggatgcagctggtgatgatcaagcaagagcgcgaccagcaatatacataacactacctcaagaacttgctagcgtctgcacatcgtactagagcggactgttgatatatagataggtatatcactgcatcttctcttactactccctctagcctcaacactcgacgtacgacctacgtcttcgnccacagctngtcgcgcacgctattgtcgcccgtcatctcgaccctgtnttactactccgtgacgactcatcgtctatcggcagtacacctctcacgtccgcttgtacccgtctttgacgtttctntagcgccctctcgnttcgtataactgtatccactttcggttcncgtactccgnactgtctgactcaattctctatgtcgaccgctctgtgcagacangaagtcgcacgaacatatgagttacgtgaagtgtggcaagatatagatgagaagaatataagatgtgagaagtaacatctcagagagtcagctgcgcatacgcggtcagcgcgctgctgtgctcgtcacatgctacgtgtctactccggtcatatcactacgtcactgttcatgcgatcgcggttaatctctgcgtgcgtgttagaggtacgatctagtccgcttgatgagagcatagtctgttaggcttattgtagactcatgacngttcccccgattcattgttgttatcacctcttgctangctctcntattctgtttcctttcttcctcctattccatctcttatttttccccctcatcctnttctcctcgcacctcgcactcccctccgctatgcccctgcaacccccgacagtcacactaccgaacgcctcgtgcagcagtctagcaaccaaaccctttttattgttattatgtcacaccgtcttcctntccacccctggctccttcccccctcttctaaccttccattctcccctcccctcctntttcctccacttggttcctccttctgaacacccnnnnnnnnggttnanataaaatnnnccnnnncttcgtcccntnctcctnntctctnnnnccccntcnnnnncccccctt

SEQ ID NO: 12621 - DNA, 808 bp, Homo sapiens
cctggctgaacacttaatggaggtattaataagattcaaaatgaattatcatcccttaaagaaactcatattaagttacaagagcattataacaaattatgcaatcaaaaaacgtttgaggaagacaaaaagtttcagaatgttccagaagtaaataatgaaaacagtgaaatgtcaactgaaaaatcagaaaacaccattatacagaaatataatactgagcaagaaatatgggaagagggggtggagaatttttggtcagatactgaatacagagaaaaagaagaaaaaaaaagaaggcttatttatagaggaaataattatcgatgggtaaccttaaaattatattgagcatcttccaattgggatggggatattaacaggaaatattctgtgggaaatttaaggcaaagagaaacctgacagtcgccccaggcggggggtagtggcggttcgcctgggccggcgcccgggggtggccgggcacgcgcgcggcgtggggtacgctatcccgcaccctaatgtttagcgcgtacgagccggggccccgcggtccctctagggcgccttcgtggtcgcgcctaccccgccgaatgtcaatcgcccagcccagaagcacacaccacccgccacgttcgctcgtatatgccccctccccgctcgcaattgttgactccttccgcgtggtgttggagggttgtggtctatggcgccgacgcggccgccgactgggaaccacccggcgtccgcccctaacgcgcgctatactggatagagcaaagacgccgagatacccgcaacccgaagc

SEQ ID NO: 12622 - DNA, 745 bp, Homo sapiens
ccctagtgttgacataaaggaatccctgaagctgtgtcattcataaagaataaaaggttttgctcatgcttatgaatggcctgaaaattcaagattgggcatgtgcttctgctgacatcctcacactgcttcaacttatagtggaaggtgaaggagagatggcatacgcagggatcacatggcaagagcagaagcaagagagagcagtactatctataatagcatgatgtggaaacaacccaactgtccatcctcacattaatggaaaaaatatggtatatacacaacaacaaaatgctatgaaaccttaaataatttctgcaatatgtgacaatgtggatgaaccttgaagacatcatgcgaatatgccagtcactgaaagatgaatgctgcacaatttcatttatatgagatgtatttccgccatcttagcagtggaaataaacggtgaaagcctattgattattgaggaatgataactcagctacacagcagcaccatcttttggcctttgaaggaaaatgatccaaacttatgaatcatgagatactattatcaagtgctgtctgcagacaatttgcaagtagtgcaaattttatgaagactagattttgttaggttggtgtgatgaataagacacatactttgttttagaatatcatttactttattgctacagatgtatttgcagaagttatatataacaaataacccgaatgcaccatcagaaacaaaaaaaaaaaaa

SEQ ID NO: 12623 - DNA, 280 bp, Homo sapiens
cctaggaagatcaaaatgaagctgataaaaaaatatatctcaggagctcaacatggaacacaaaaatccaaagaaataaaagatgttctggagtgtgaatcaaaactttccaccttatctaataccacataaaatttctaattgtaaaatggtaaattgtaaaatctaatttgcaaaatgttctcaataaagtcattcaaaatgaacaacgacaacaaaccacaccaccgcaacccaccgggggggggcacaccccgccccgcccgcaaaaaaaaaaaaa

SEQ ID NO: 12624 - DNA, 863 bp, Homo sapiens
atatatttctcccatcaccaatcaatcccccctcaaccccactctccaccccttgttaacctcaaatcaaaaaaaatttacaaccaacatacaaaagataaaaagcaagaaattaaaatatgccatcagagaaaattgcatctcctgaaaggaagccaggaacaaaggaacgaaggaagagaagagaacaaaactagctacctatcccttgccatatacaaaactaaaatcaaaatggatcaaagacttaaagctaacacctcaaactatgaatctactacccgtaaaccttggagaaaatattcaggaccacagatcgagaaaatatatccctacgaaacctaacaccccacacgcacagggccaccccctcacaaacccacctcatcgcctcaatataatctcacacaccaccccaccacttgctctctttaaccacccccgtgcaaatctcaccacctccttcccttaaaaaacacaatcacacccccggtcgcccccaatctattcgctcgtcttagaaatactcccaccacacaacccccacccatccccagtcgtcacctgcccccacccccccacctgattttttatgtccacccccgtactagattcccccacccaatttccccccacaactaccatcccaaatcacctcgcatcacgttatccgcccccgtcgccacccccatatcccctcctccccccgattctttcctccacacccccctctcttctcccctcctcccccaccgaacacatgtcccttactatccccaccccccccccataccggccccccgtcacgcccgctttctcccaccctacctctctcgtatcccctctctacccgcccgcacccg

SEQ ID NO: 12625 - DNA, 146 bp, Homo sapiens
  misc_feature (1)...(146): n = A,T,C or G
tctgacgcacanaattggctacttctgacaacattacagcggactacaggaatgtcaacaacagtatgacctttttgacaaatgtcagcaaccagaaattcatcttttcctcaataaagttcaagcaaccatcaaaaaaaaaaaaa

SEQ ID NO: 12626 - DNA, 922 bp, Homo sapiens
  misc_feature (1)...(922): n = A,T,C or G
taaattcactacaccccccccaacacacccaaaacaccagnggcgggnctccttaacctctcaattcaaaaaatttatacacccaacatacaaaagataaaaaccaagaaattaaaatattccatcacacaaaaggccctgcgtcctcaaaacaaaacaccaacaaaccaaccaaccaacacaatacaatacaactacccctccctatccccttccccatatnacaaaaaatataaatcacaaattccattcaaaccacttaaaaccctaaccaccctcaccacctatcccaccttacctacaaacaaaaccattgggaggaaaatctctcacacaccttccctcttaaaaaaaatatttctttaattaacttatatcaccacaaacccccatcccccccaaacacaaacccaaaccaatcccctcaaaattcacataaaaaaaaaaaacaaatttctctccttcacccttcacctcttatatctcccccccccctttccctttttaataaaggttaatctcctaaccctctctaacctaactcccccacccttcaaccctccccctaacaaccaacccctatcaactccactcaaactcccctacctccccctcctcccataatcaccccaataccccccaacaacaccacctcttcccaaaacccccccacaaccccccaaatccccccaatatctctcatattcccgtcctttactaccacaccccccccaccccctcacacaattttataacaaccccacccacccatatatactccacccccaccccccctacacccattaaatacctctcactccctttcccctccacacccttccttcctcctcttaccccccccccaccctcccctttatcccaaaccaccgtcccccctccccctttccccaccacccncccg

SEQ ID NO: 12627 - DNA, 272 bp, Homo sapiens
tgaggccaacgaggccattttttttttttttttacttgatttgatgccatttgtttgtttttgctttggttgcctgcgcttgtgggatattaattacttaagaaatatttacccaaacaaatgtcctgaagattttctccaatgttttcttgtagtagcttcatagtttgaggtcttagctttaagtctttaatccattttgattttatttttgtatatggcaagcgatagggagctagttttattctcttctcttcctttttccctttttc

SEQ ID NO: 12628 - DNA, 1538 bp, Homo sapiens
  misc_feature (1)...(1538): n = A,T,C or G
aaaannnnaaaaaaggagaaagannnnagannnnnnnnnnaagaaagtggnnnnaggannaaggnnnnnnngannanaaggtnnanganaggnnnnnannnntttttannnnantgannnnnnnnnnaaatganaagcttttatnnagagagnnnnnnaagtnnnnnaaaaaggagcagtggnnnnaaaaggannnnnnnaagnnaaanaaatagtttaaaaggananannaanatgagaatgannaagaagaaggnnnanagaagagaaagagtggtggngggaaaaaggatgatattnaatacgtaatgagtcagaaggagaatattagcgcatcgacgtgcaacacatgnnaagaggatngatagaacagtattgtnntagagaaaagatnnnanacgcgacaatgaaaanaggatntaagatagataagtnanactaagtnnacaagcgatcggtgtggctgcatgggtacgacggagagtcggtggactntnacatattgatataagagttcnctcctaccanatagcctccactctagctccttcacagcttagacgtgctgtgtcagtccncncgctncagttgttgnngagattgtnatgattggcgaanctgatnntaaggtgangnaagtaattannnnatatgtataaggataggtctgttnnngtctcagtgtcccacgtcaattaactgagagtaacgctcgtaataagtcgtcgtagatagcgactccaacagaaggaatgaacacagcggacagacacntctcacgccaccatcacacgcacaacacagtagtgccaccgcacacatcacactcacacacaacaacaacccacngccgccgcctcagccctgcgaccacncctcccagctaattcataaccaaagactccaattcccatgacacaaccaactctcccccagctcatatcccatcctacacatgacgctcctatggcgtgaagggagagagngcaatacattcacatactgtctattctagtctacatagtanttacccgcagcgaccagagagcggccngtgatatagagagggagagcnctgcggaagtgcagaggtgtactctgtatatgtgtcacggttcccgcagcgtagtcctgcancactgcgatagctgcttctgtaagagtctcccatcgtccatagagagttgaagagagntcaaggcagaggngtgacaggtacgtcgcataccgtactttcccactacaccagctaatacgatacgaagacgtgtggacagagtgacaccttacacactcagtcacatgacaagacgtataggtgctanccacgagatcgacgcatacatgcnatgtncagtncggtgcgcggcagtgcgtgcatgcacagagagtntcaatgtacgcncnnancgagtatgtcggagtgagacatgtatgtccnntgaagattgagtgctggtgtangtgtgagagtatgtnttatcactagatagtncttatagaaagtcacaggtatacncncatcttctttgatgtct

SEQ ID NO: 12629 - DNA, 1164 bp, Homo sapiens
  misc_feature (1)...(1164): n = A,T,C or G
aattgtgttggacagtattaagaggacgaagaaacaccaggaggtgtgaaagagtaaggagaagaagagagtaataggangggaggaagagagacatgcgagtgcgtgtagnagtggatatgtgggatagaaaggggggagagggcaaggtgatgcagacaaggaagaaatatatgtggngaagtcagacttgtataatgagaaaaggncaattgagagtgtggggaatgaggactgagaacgggggaggggaggagagaagaggagagtggagagggngaagacaggtgaagtganaagnacaagcgtaagcaaaaaggttatgaggaagatgaggggagcggtgtggggatgaaaacagaggataagaataagtagtntngaatctgtgaagagtacactaacgagtgncggataaaagagactgaagagagacagaaacatacgaaaggtgacaatgaaggaggatagaaagagaaagggaagcgaagagaactggnagacttggacaaggtaagagagacgatgaatcgctgaacagtagagcgacagtgagcagacggaagagtatagagaagagttacacggacggcacggcgggtagggtgttgttgatgagagggtgtgggatagacaagtggggggagtgtgatagagtaggagtgtgatgagtgngactttacgtggtgtctccgtcgccgttgtgtgtgtcttagtgtgtgaaatacagcatgctggcgagttgtantaacatcttgaggaagcgatggaacattagagtgtatttgatataaaatgcatatttctttgtaacttaccctttctactacctttacaggtcacttagacatcattcantccctatanacctcattaatatataattattcgttggcatatcggcaaggagaataagaaaaggataggtacatatatatgtatcttcatcacantctaatcactttacttcattatcttacctttcacggaatacagcacattttnctactcaatgagctataatttttaatatctaagctttcatatctatctgtgaagttgttntgtaaattttactttncatttaagatncataaaaattctcctnnncactctccctcccatcncncncctcattntcctcacttttcncctccccctttc

SEQ ID NO: 12630 - DNA, 240 bp, Homo sapiens
ctaggtctttaggatgattccctaatccatatgatgtccctgggagaagaagaaatctggacacagacgtacatgagcagagggaagggcatgtaaaaacacagaaaaaaagatggtcatcagaagccaaggagagaggcctcagaataaaccaaccctgctgacacctggattttggacttccactctctagagctgtgagaaaataaatttctgttgtttaagccaaaaaaaaaaaaa

SEQ ID NO: 12631 - DNA, 336 bp, Homo sapiens
  misc_feature (1)...(336): n = A,T,C or G
cctgataattgctgattggtgagctgngagtcagcaggacaggcagaggacaaaggatgaggacatgctgaaacataccaaccagcagagtacctgactggcaatcagaacttgtgcaaatgacttgggtggccttgggaggaaagatagaaccccagtagtgagttaaccagaatatacttcatatagaaacagtgccgaagactaaagtcttgtaccattttaactacacttgtggtatgagggtattaataaggtatccttaaaaggatcttctactccaaataaacctttacaattcaaaataaaatatcttttacagcaaaaaaaaaaaaa

SEQ ID NO: 12632 - DNA, 307 bp, Homo sapiens
  misc_feature (1)...(307): n = A,T,C or G
ctangagttaccagttaccacgtcagcgggaaagcaccttggaaaatgatttcatgtcatatgctgcatcatggataaaccttgaagacattaggctaagtgaaataagccagtcatggaagaacaaatactgtatgattccacttatatgagtgatgcatgctccccttcgccttccaccatgagtggaagctccctgaagccctcaccagaagctgagcagatgtttttgtcatacttcttgtacagcctacagaaccacgagccaaataaagctcttttctttataaattgaaaaaaaaaaaaa

SEQ ID NO: 12633 - DNA, 367 bp, Homo sapiens
  misc_feature (1)...(367): n = A,T,C or G
ttcgtgaggtaactaagtctgtnctgnctgtgctcatcgagaatgagggacccatggaacagagctcaaacttgaggccatcctagaccagccagcccattgctaacctgacaactctctgtaagtcatgagcggctcagagaagagacactgacacacaaggagtacagtcacatgaagatggaggcagagtggagttacaccaccccaagccaaggaacacctggtgctgctgaacctggaagaggcttggaagattctcctagaagattcagagggagcatgaccctgccaagaccatgattttagacttctattctccaaaactgtgatataataaatttggtttaagctaaaaaaaaaaaaa

SEQ ID NO: 12634 - DNA, 1100 bp, Homo sapiens
  misc_feature (1)...(1100): n = A,T,C or G
ggatatatagctcagtgtagataataatgtaggtaggaaaatgttaatagaagnaagncgtgnagggggtaactagnaagnnatgtgtttcatggggcctatacgnnaatggagnannngggggnntgaagagaagccctcagaaatgtctgctagcgtaccagagtgacacgtagtgccccaacagctctgaaggggatgaagaaaatcgaacagactcgacaaacatgtctgatgtatcttgatacgcgaaacgtgggcgagaggaccttngcatagagtgaactgctagttctattctcttcggaccatagcacttataaacctatctatgtgttttacgtaagaatatatttgtttgatctctctctccacctctcaaacaaagcacaaaacaaacgaattggcgctccgtatgtgcactgcacgccggtggcgacgcgtctcgcatggtctgcttcccgcttttatgttgatgtggtataactgtccatcgactcccttcgcgtcaacttgatctcggcctgcagctacgtgaacagctgcggcatagctgagcgagccggggactcatcccttcacgtcgaaatggtcggtcgaatacggcggttgccagccacaactcactgacgacttaccgtctggaaagagaactgttgtgttgccatatagtgttcattgctactgtgcccaggtacctcgctaacataggtccgacgttcgctgagtagtattgtgagcgttaaagacacaacacgcgtatgagcgatnctgttgacgaagtacacgacctcctaaatattcatcggggccggtcaataacgcgcatcaggtagcgtatgcgccaattacgcaagctgtatgtggtccctggcaagattaagttcgcgcaccttctcgcggtaaacataacgatggccgatataggagaaacatccggattcggcatttcatccctctctcaccgtggttaaaatcttattcggctatacgcacgattagagagttgtcatcacgactgtgccaccgactttctctcctagcccccgcgttacgtacccaaaaccaccatctcttaatatagtcacacgcggcacacc

SEQ ID NO: 12635 - DNA, 740 bp, Homo sapiens
agcctagctacaggtgaatcgctgggggtgcagttctgcatcacctgcgtgggcaagagctttgatcttctaccacatcattctcattaacaattgcagaagttgcatatctaaagagttcttctctctgctgaaactaagctccttcaccttcagcactagtaaatccactgcttctaactgcggctccatcatcacacattgtaaggactttgaatggccttctacttgctgtcagtctaatgaaatgtgcgtgagcgaggacaacaagcacccttcacacgccaccgtgtgggttaatgtgagggctttctgaccagtggaaggtgtgaattcataacaagatctggtgtgcgcagctttaacagcttgtcaaatgtgtgagttgaagataatgaattcaagtccagctgggggttttctctggcttgcaggtctatttacagggatgacatggatagaggagccacgtggaaacgcacaagcagggttcgtgggctcgaatggaatggtcttttgtgaaaggccggcatggctgaagagaataacgatggctgagcaacaccttcgccttcccataaaataaggggactgtactggtcctgactccaactggcgcaaaaaacaatctataactagcactttgacgcaccagatgattggatccataaccctacctagtgcttgcgccgggcaacgaccaagcccacgaaggtcgatgaacccctgcacgcgcaaac

SEQ ID NO: 12636 - DNA, 1507 bp, Homo sapiens
  misc_feature (1)...(1507): n = A,T,C or G
ttgatgatagtgataatgttagtttggtgtttgtatgtatgtgagacgtaggtagnggaaggtctctttgtggagagcttctctagcagtagctagctctagcgctcgtgccgtccatgagcggagtggaatattgtcggtactactactattagtagtactactcatgtgtgtataggtagcgatgagctatcggaangcataaatgtactcagtgtatagacaagcaccaccataagcgtactangagtgtgtgtatatgtgttggncatctgtactgtgcaanagacacgctatgtgtacgctgtacgagtntcttatatgtggaataatatctcatgtgacgatcgattgagaactactcttttgtgttgcgtgtagtgtacgtctgcgtcacagcatgcatcaagtagactattatagggaatatatcgacgatntgtgtgtagtggttgtgcttcacagcagcgactgcgcgatgngcataagtctagattagcgtctgctacgctgatctgcggcgagatgtaccatacaagcanaccatcgtcacattnatctagtttctaattnttagacagtatcgagacacatacgattgacatattngttatcgcagaggcttgatatactctagtncatcgcttctgtcactatctcactgactcgattacatctcatattactatgcgacctgtgccgagtctccgtcgtatgggagctttgtgccgcgtggacacatccactcagtnagcatatgatcagagatctcgcattgacgtctcgctctactgcgctctagtgagtatgtgttattgcaccgtgcgtgtgttactcatacgccgctctcgcgagaccatgtaacgtccgacttacgcacatatgatcttgantcaacctcagagagatcatgcgtctttctcattaatcgcaccgtgantgcgcgatcgattcgcttctgcatgtatgttgcatcgntgtctgttgacntatattcagatcagatatcatcgattgtatgtgctngctcagaacccgcgcgnacgcgtcgcgtgacgtctcgaccagacgnattgacgntcagggtcttctgatgatgantcgttcgcgcgattcgtactatantagagatctagcacttgatgtcatatagacttcttgcattcgctgcgctggtatatgtgcagtcctggttgacactactacaatcagtattcaccatctgattttcgcgctgatattacacgacttactccatactaaacattcgaaaagaatgagactatctatatagatatgtgataanccgctcacatcgcccggcgctggtcactgttgtgtcaacaggacatgtaaccgcgtctctnagaacacgattatggttacgacancggacatgaatagcaacgatacttatgttgatgcacgtactcgcncactcatgacagtagccgtactggtacgtcggtaactcgctacgtctatactacaatatgcgctctcgttt

SEQ ID NO: 12637 - DNA, 959 bp, Homo sapiens
  misc_feature (1)...(959): n = A,T,C or G
ttatgtgttttaaatggcatactacaaaaagagattatcaatatcatcatactagttataacgaatcttacatgagaataggcaacattatacataatatgagtangattagtcaatatagatgaatcggaggattaaaaaagaaagaagatagagntaacgataganggaactaatagaacaaacggagatagncgaggaaggacattggatcaatataaaatagagcataaagaaaaaacgaaagatagaagaaagaagagaanngtaaattactnnctcactatctcaccaacaaccatcncaatccccgctncccnacaaccncccaaacacccccacatctncctacgncatcctcactcgagcncaagcncaacaaatttctcagtctcccacnacttatttatacttagctagccataactacataactatatgcctccaatcttaccatatacatataaccaaatttataacaaganaagaaaataaacgcatccgtccgcgtgtncgcccncccctacgccgcccgcaccggcccggtctngtccctcttttctnngctttcgcgctctttgcgnccctttccctttctgcttccngcccgcccgccccccnnccattctcccnnaggnncccctnaaaaaaaaattttttttctcttcttctcctnccctcgtccctcccccncngtcctnccttccccgctcctcccccttgcgcgtcttcccncgggnccttcgcgcgtcgggcggctcttncctccccctncctccctgcccgccgcgtcntcctcctnncctgttttccccngctctcttaaacccccccctcttnctgcgtgtcnncnttncnnctgtntngncncccagccgngcgncttntcntcttataacttttttttttttttttataaaaccccccccccacnnccncncnnnncnnntttttccccc

SEQ ID NO: 12638 - DNA, 689 bp, Homo sapiens
cttgggactccttcagtgttgctttacagccagaaatctctacggccatcgtcatctctgcccaagccttgcttagggcctgctgggctcaccctgcccacttggcccagcaggctgcacttggctcatgcctcggcccgaatactgcacctgccatggctccatgcttagcccacagctggaccaagcatactgctagtgacttctgccttgggcaccagcatctagacaaacagaacgcagtggcatccgaaaacttggagatgacagcaattgcgaaaccccaaggggtgttacagctcttacctgaggagtcccaagaaacttccacttggctaattgaagcttccactgcatctcccacagagcccaagaagtatcagtatgtgactactgaatgatggacaatgaaatatattaataccataaaaaagaaaaaagggcaattaggtatctgttgaagattcttaaatttaagtaggaatatatgccaaaggaatcagttatgtaataccagagttttcagacatatttactatagagtacttggtaaagtgttatgaaggaaaagagtgaaagtggaaaaagaaaaaaatagttttaaaatctttatactcaaataaaataaacatatatggaataaacttgaaattattaataaaaactctttataaagaaaaaaaaaaaaa

SEQ ID NO: 12639 - DNA, 1485 bp, Homo sapiens
  misc_feature (1)...(1485): n = A,T,C or G
agagacgaaaggaccaaggaggagagcaggcggacagaagacagatgagagaaaacagaagananaaaaaaccgcctttaganagangnaacgnngnacgananncgncgctttgnagngaggaggaacaaccannngngnagncnngagnnngngnanagaganngannaaagaggacgacacangacatgaaagacaaaangagcgnagaaacacacaccncangaggaagagagccccgcgcaccagcacgccagacgcaccgcgagaacaacaacacgcgcgccagagccgcgcggaacacgcaacagcagaacacnagacgcacagaagcnggcgacgaggaccacgcacacgccacanagcacagcacgccgcagaggagcacacgcccccgcncgagacaagcagacgcngnaggaacccaaaggcagcccgcgccacgaccagccaccgcgcgctctccncgcacgcaccagcaagaanagagacaccancggcagcgcgcacgcagaacggaccaacgacgagcgacacacggccaccgacacagacacacagagaaaccgnacaccaccggcgcgcgcacggacacaccacgaccaacaaaacgaagcgacgncgcgcgcggagctacgactcacagccacagacagcccgcaggagggcccgacccncgacganccgcagcacacacacacacacacagacgcaccagcgcccacccccacccagaacgcacaccaagagcctcgcagacggccatacgggaccagcaacctcaccaccgctacgacgagccacggcgcacacgcacaacacaccgcgaagaagagcagcacncgccgcacgacgcacgaccaccacaccacgtcacggcgacaagcgccatcgccgcgcgcgacaggcacgccaagcgtgcgcgcncgcagcagccgcgcagcgtgctgcagcaacgcggagacgacacntcgggccggccgacagaacacgcagtatcgcagagacacgcggccacggcacacgcgacgaaaacagagagcgccgcgacgcggcctcaccaaacagaggcacgcccgaacgccgaaacagatacacagccaatagcgaggcgccgcgcaacacgcacgcganaangagacagaggcgcgaccgccaaccgcagcaaaccgcgncccggccgacaccgtccaacgtcacagcggaaacgacacganaacggccggaccaagcacacgggacgagcgaggagcgaggagacnacgaccacacacgcgcaacacccgccgcgtgtgatagagacgacacatcgacaccacgacgcaacgcccgncggccgaacacccaccacaacgcgcgataacgaacacacgcaaacacgacaagactaggcacatcgcgccacgcgcgacaacacgcgcagctcaaagccaccgcgcgacgacagaagatgagcacagcgccgcgagcgcaccacnangcag

SEQ ID NO: 12640 - DNA, 1782 bp, Homo sapiens
  misc_feature (1)...(1782): n = A,T,C or G
ccgtctcgcgtgtnttcgtctgccatagcgcacacattagatagaangactccacactcantntacanagtctnatcgcgtgaccgcanctatcacgatgtgagctaccacctgcggatgccctataggcaagtcctatgcgtatgaacactctttactctctagccctgccaacacacgaccgcgtgacctgcgacgcagatagtgggatcagagagcacatgcactgctgngtcgctcgtcagagcctcatcgatgagaggangtagtgctgtcgtctctatactntcgtgatatacgcggagatgagacgctacgatncgatctgtgtgggtgctgtttgtagcagtcagcatntgtgtctggatactgnagangaatactcacataatagggttgctagctcgatgtgaacgtagatgtcgtggncgctaatcgatacacgctacgtggtntgagcgtgacgtatgcgtagcgctcgtcgactcacgcagatgcggaagattcgcaganggcagtagcgtatgtgatgcacagttngtctgggagcacagctgtgtgccgccacgtgngncgcatcgctatntcacgtcactgcatcatatacacagantatgcgagcatagcatatacgtaaactctgcagtccatctacatacgagagcgcgacagagctctagcacntcgtcctcactatgcgtactctctagactcattactatctactcgtatcacgacgacttcacgcgatatgagtgttagcgtgaataacancgatctacgagnaagaagagtagtagagtagcggagcgtggagnggtagtgtcagtgcacgctcgctgcgtcgacaggcccgtcacgccgcgctcgttagtgtgctcactgtctctgttcgctactactactctctcctcatgctcgtcntgactttctatcgtgatcggggtcgtgctgcaatatctacattantgcctgctacttcacgactntcttattactcngaatcaacattacacaatnagcacntgattcatccatcggtggtgtagatgactgccatttatntnntnaactctacgtttgtacctcttctgatcatgtagtaacagtatctctnagctggccgaagctagcgagtcaacgtgcagcatcgacggacgcgaggtgagcagngcacagaagagtagggatgtgtggtcgagngggaggtgacgggcggtngacactctcttctgtatcatatcctctctactntatgtatcatctntctcatactatcgatatactttgtatcacaatatattcttaaatgctatattatangtgaggnggcgtggcgcgagcggtgagacgacgtgtcgctntatgatatgagtagtgcgcacgtcgctgtcgttcgtcncatanangcggagctgtgnnncgaggtacatnnggngngacnnatgtcntgtgtggctggcgantgttnnngtgtntctcgtgctgtgagatcganttntatntactccntacttcgtgtntcactctcttccgactaacatgagtgttggtanagcacagaccaatctcgcacaatggangangnacacacagaaggncatatataagatnnnnancaattgtttantcataaannnnanaaaaaacatccacnccacananannnnnnannnccnnnttacntnnnnnannnnactnccannnnnnnnnnnnnnnccttnnaannnnnnnnnnnnnnnnnccccnnnnnnnnnnnnnnnnnnnnnnnnnncccccacc

SEQ ID NO: 12641 - DNA, 1012 bp, Homo sapiens
  misc_feature (1)...(1012): n = A,T,C or G
aaagaaaaaaaagaaananaggaanagnagagaaggagaannnnttttgcgtagcactgggacaaactgggcagaaaacttttggtgtcacacacttatctgatggtggtacgaatgacaccactctgaatgcatccacagcgataacctggtctgacatctcctcgacatcacacgctgcatatagttgtcatagcatactgtctaactcttccctgcgatgctgcggacaaagatactcactgcacccatctgaactgtgtgtccctgcagatgacaacgctagacacgaggacgacattagaatgattgaccagcaaattgagctaaagactacatcaaaagaaaaaaaaaatacacatgcgagaagcgatcgtacgtgatcgacagaagtatctccaacgagatccccatcccccgctatctaccctcagagtctttcccatatcgaatagccccttccctacactccgagccattcgcctgtttgcttctctccggctcgtgcctcttgtgcgtcatcgccagcttccccctactcccttccctctctctctccaccttctgctctcttcctcgctcgcagttccgaatataagttatttatcactatccaantttcagtcaagactgntgcacgccactagtacgatcaccgatcgagtacctataatgtataaagcacaacctcaggatgatactcgtgatttttgattgcatccctgctcacacgtcatnctcgacgagtctgtatcatagtccacgcgtctgccccaccctccttcccacctctacccctccatctaccccccgccactccggtccccccgcgactccatagttctattgattcctgtccctaattacatattataactcagactagagactgctcgcaggagaaagctacacatgcccgcccgtcatccccgtcccctgaacagtcagcgttctcatctagttgaacacactaatcactactactgcctataccatcccactcacaacgaac

SEQ ID NO: 12642 - DNA, 189 bp, Homo sapiens
cccccccccccacccccccccacccaactaaagaaaacctcacacactccaaccttttgtatatcttaaacatcatctcgaagaaaattcatcacttttctccttaactctatatcttatgtgatgctgatattacaaaaaaactatcccaaactctacaaaaaacacaaaaaaacaaaaaccccacaa

SEQ ID NO: 12643 - DNA, 1930 bp, Homo sapiens
  misc_feature (1)...(1930): n = A,T,C or G
cagcgagtcgcatcntctctcnttgttggtgtgtgcgctcncctgctgtgcgtgcgtcgctcggcngcgtncngcgcgtgatagtcgtctgctgtgttcntntatctcgcttctcncgttgctgactctttcgtnntcgtgctgctctgtcctgctaacncatatctcatgatgagtnaatagctagtctgctantnatnctagctactangttngtagtcgtagtagttttcnacntcgtactgatngtttcntagtcgtagtctgtcttcncgtactactgtcctacnantnntcanggtanattttgtgatatgctttgantgatgacnngtgcttgcgtttcgcngttgctgctgactanctgatcttcaggtagctgnntatgacgatgcgctgcnatnctactgtgctgnantgtatgtacgtcgtctcgcttcangcatngtcatngtcactgcagtgatgtgntgncgacttgctgcgagngccangattacttngagcatctgctgtcgctgcgtcgggctgatcgtgatgctgtcaggtcntggtgtctgatttgttgcttctctagctgtttgcatntgtttcgtcgtcgttgctacntatcntagtanntangtggtacgtggtgtcgtgtcgacngtcggtgttgttgtgtgctggagcgtgtggctcgcngtcgtcgncggtcgtgtgcgntcgcgtcgcgctcgcgcngggangcncngngcgagcgacggatgtagatgngtagctntgtgctntcgttgtcgtcgtntgtgcggtctgcgtctgctggctcacttctcagacgtcatcgttgtcacatatcacntactatccgatctatcgttgtcatactctntatgancttcatcntactcctgctctctttatcactcgcgtgtcatgcgtancacgttcctatctcatcnacactacttctgncgcgtgtcntngcnctgtgctatgtggtctgtgcatcgcattctgatcangtagtctanctgcgtgtgcgagtcgttgtgtntgctctctgcgtcgtctctcgtcctctctgtcatctttcgctgtatcatctctccgactcantatgtgcgtctccgctagtnctactctctgtacacactcgtntcgtgtcacgtgttgtcgtgttagtgcgtagcagctgtggtactnacagtgatatatcgtgtgtactgtctcgtntgtgtgcgcttgcatgctgtgtcgtatgtggtgtgcacgcttcgtctgaggttgtcgangagcgccgcacgcnccatcgcatatctgtgagcgagtctcnttggtagttcgtcgtgcggttctcgtgtcttttcgttttcttcagcgttcgtggccgcgcgtcgtgtcgtaatgcgtcgtaacacgctctccctcctacgccgctggtgtgtatacctcgtantcttgctttttctttggtcgtggtgngntatgtntcttggctttgcagctgcgcgtgatctgcgtgtcgttgtgtcgttgcgcttcgtggccgtctctgtgcctctatcgtgtgtgtcgcttgctgtctctgtgtctcgttctttgttctcgctntcactctctcgtcaactcctgagtgtacaganatatcacatagagaagatacaatcaacanacataatagataatacatangaganaaatataatatataatatacaccacctccacaaccccacaaatatatataatanaaatatataagataataatataatatataagaaaaaaaaannaaannagagaatgntgctctttcngtttgtgtccttnctagtcngngtggnnagnntttgtttgcggctgctcggaacactcttctcttttctttattgtgtgtctgtgtttcttgtgtggtggtattgtctttgtatttgttctttcttgtctt

SEQ ID NO: 12644 - DNA, 917 bp, Homo sapiens
  misc_feature (1)...(917): n = A,T,C or G
atctaaatattatcccaccgtccttccgncnnaaaangnactactaatttcttcttaaaaaaatcacatgccnccactacttcttgacccctcaccattcctctaggattatttcacaccatgaaaccggcgcacaaanaaactcccaaaccctttcttcctttacatcataaacatatcattataatcctaatttcccttccctaaaaaaaaatctctgccattttctctacatatcatatatgaacatccatttttatcaatttcgccctgtcttgtcgtggagtcccaccctccccatactaacattaaatattctgccccataggaataaaagccataaaccccctacccttttatttcttcaaaaaaacatccctttcaacaaaaaaaagctcacccttctccacttcccctgccaaaataaattaaaacctccattgcccttctttcaaaaaaaaacaacacaccaaacaccccgaacctccccaccccctcccccttccacttaaccctccccaaacacctccccaacctaactacacnttcccctcttcttccacctcaccctattataacctcttaccacccctcacctcttaacacaactctcatttaaaaaaccccctctaataaactcccttacccccccccccttcaacttaacaccaccccctttcctttcccctcaaccccctaataccccctttcccacaccatcacctaatacccccccacacccaaatcttccccccaacacccccccaccccccaacccccccaacacccccccctatctccccccttttcccttaactcccccccccctctccaaatccacaacatcacatcctcactaccacactccacaacccccccccatcttactaattaccacagtcctcacccactttcaa

SEQ ID NO: 12645 - DNA, 1250 bp, Homo sapiens
  misc_feature (1)...(1250): n = A,T,C or G
cactccacttctncacgacttaccatcgtcttccatgaagggacgcctgtgcccacgactcgctcctagtatgttacgtcgctatggctcgatcgctcgcgagacgtctatgcttgcgttctgtacgccatacgcgtgtgtcggactcgtgtctcgcgtcgggtgactcggatctacgagcgcgcgacgtcgcggtgcagtcgcccgcacgcactgcacagcgtcacacgtgtgcctcgtcctgcgctcgactactatagtctacgctggtgggcagcgatgancgggccctggtgccccactcgtgacctcgctctntcgctgcgcgtggcgagcctgctacgctcactgctgccgagcttcgcgcacggcttgtcgttcactcacactgntctcacactctacccaccatnaatctccatcgcnaacccacatgcgcanatcttagtaagctctaaccctcatacaatccttcaattcttcctcactctgaactctcctcacatcatcgtagnagctattgggccacgatatagaagatcctaaattcagtttcgtcccctgtccacactccacaacgcagagtccccactaactcagccccaccccacccccgtcacggctcagtactcgcattgagacccggatagcaataagaaatctgctaccctgcctgtggtggtggctgcggtgggcatcaggcgctgtgtcagatcggacgcgtcgagccgtgagcgtgctttatacacacaggcgcacatacacgaaacagggcatgagacccactcgagatatgcgcctagtcactcacatataatatagnatgaccaatgttatgttgcccgcccctctcacatcgtatttcatttcctctccgatccatacctcgccgcccgacttgccagggtatganaactgttgtncacctcgatcggtaaagctgatatactaaacatactggcatctgtgntcctggggtgtcgtcttggacttgggcccttgcggcgcgtcggtcttcttgacgtatgagagcagacgttgttattctaaatattaaattttctctattttncatctaacactcttgtttcttccccaacctcctatcctgccttcacnattcagttactaatccanacacaaaaccatctactnncatgtcactaaccaaaaacattactccaaaancctcctaaatattactactttatcactttctatnattttcctctttnnnaattttnttcttt

SEQ ID NO: 12646 - DNA, 223 bp, Homo sapiens
cctagttccagcacatattcaagcatagtttggataaccacctgccaaagatctgtattgggtgggaagttggttcatacctgtgttaggtgtgcaagattctattcttcacctagattatctctgtaaatcatgaagtgcttactaaaagtattatatccaaatgaatattcaagtaaaaatataaacaataaaataatagagaatgctaaaaaaaaaaaaa

SEQ ID NO: 12647 - DNA, 195 bp, Homo sapiens
tgatgacgaaactgaggacctttccaggctggaggtggtgagggggtcagcaccaggcccaggcctcctgactttctcgagtgatccttcttctgtaccagacatggacaatggagggcagtcaggcctttcactgtcaccaagagcgaccaatcttttcaatatagatcaaactgcttgacaaaaaaaaaaaaa

SEQ ID NO: 12648 - DNA, 797 bp, Homo sapiens
cctgggctgaccctggctgctcctgagaaaactggacgatggtgtgccatgtcagatcacgaggccacgaagtgcaccagttgccgagggagtatgaaaaaagtgttaccagcaaatggtccccttgtcacctgcgtggagagagcgtcttcccttgagtacattaaagccatcacagttaagtcactgctgcctaaaacacagtggaagaaagcctatactttcgttttgtttttctggactggctgttgtttattgctttctccccacaggaaccagaccatgctttagaggagaaagaaacaagccaaagatctgaaaatgcaaggactgtgggtagagaaaaatgtagctgctcaacattcattgatagcaaaaatcataatcctaatcataattaaacaactaatagagaaggattcaatctcagtaaaatacctatgtcaagcaaagctagcattacattgaaagagaatctataaagactcataaataaacaagaatctctagtggcaggattattactaaatggttttgggaaggtatgggggggcaatgagagggatgacgcctatgggatagacgaaccaaaccaggccccccttttttcagatcgtggagatgctataaagtacagcggagatgagaggaaggctggcctaattattcattaatgagcccttgaggtcgggaccggatagggggttccccaggcctcttcgtataccagccatggttattgggcaaagaactcccgaattggtctccatcgactccaaaacgataacaggagattg

SEQ ID NO: 12649 - DNA, 705 bp, Homo sapiens
gcggcggggtcgcgctcccgcggctcgtttctggggccgcccgtccggcgcctgtgtggggccgggcggggcgctgccgctggggggcaggcgccgcccgggggggtggtggggctggcgtgcggtgggggccgtggttttcgccgcggggtcccgccgcccgggtgcgggggcgcgactccccgcccggtggttctgggggggggggcggggtggggggtcgcgggggcgaggggacagtgtgctcagtcgcgcccgcgcgccctcttggggtgcttttctcccttggggggggggggtgggcctcccgcgtggggggcggcgcgcgggggccgggtggggcggtcggttgtcggggccccttcgcgggccggctttttgcccctctgctggggggggcgggtgtttttttgttgtttttttggggggtggtgggggctgtttggggttttcggctgtgtggcttttgtgtccgcgcggccccccccccgttttcccgtggggggtgcccccggtgctccggccggcgttgggggggggggctcttttttgttttttttttttgtgggttttggtcctctcttttttgttggttctcgcttttctttttttgccgcccccccgtgttggggggttctggcgccgctgtttttttttcctttttcttttgtttgttttttttctttttctttgggggataaatct

SEQ ID NO: 12650 - DNA, 1400 bp, Homo sapiens
  misc_feature (1)...(1400): n = A,T,C or G
ctatgcgagcgttagcgcacgtggacatgacatcgagtntcgtcgtccacgtcgtgtcgtagcntggagtgatattgacaggtggctccgccggcctccgtgacgtgcgcangcacaccgttcacacgatgttaagtcataataagagtcgtgcaacgagtanatatagtctgcatcaatcacgacaacaggcttcacggtcacgtatgtgcaggcagtgagaagcgagcgcgganaggacgagggcgatggatctgtcctaccacgccgcgacgccgtgttcggtagcatactctgcgccataactgcgacgcactaatacttcctccgattggttgataggacgaataataggagttagatgaacagagagataagtccaagatagtgagtagtnttagcaggcacgcatgttccctgtctagaagcggacgcagagtcgcgngtcacgggagggcacgcgttccccgctggtanaagacagggaatgttgtcgggacgcacgtanccgncgcgcgcgcgcacgtagcatctttgctcgcccgtttccatgcgctctatacttccttatcggtcgacaatatttatcagtggttgacagacgcgggcgcagatgcgtccagtatcaagtgcagtggccgacgccatccaacattcctgctagctgctctgctagggcatcacacactccgtcgcccgggacgtgtgcgaccggcggccgtcgtgtagcggaactatgatcggcgtacgacacgnatgacacacgtgttcaacagatcacacacggcacctcgctccctccggtctaccgaccactatgtagacatcaattatgagaattgtggtgacatatcatcacccgtatactcgagacatataacatccagaccgtcgcaactcgtctcatcgctagcggcgcactgcgggcgacagcagcgcagatgatgaaatggtctatcaactccctggcgagtgtgtctggtctcagcagtaatgctctcagctaccatctcagttgtgagcgaccgcggtgcgcatggcggtgagtcacgtaagtacgtccgagcactgtcgagcggctggcggaagacgatgtatggtgtagttgcgtacctcatgacatacagagccgatcacggagcgacgtatggtgttcacgtgtactatacagcgcctatatacacatcaaatacacattcctctcgactgtctaccaaggactaacatatgacgggcagaagcacggagtcgagggcggtcgcgacgcaaccggacgtgaccgctccaccagcctcaagcccaaaacccaggcatcggatcgctcggcgcgcgcgctggcagcacgccgctcgcgcgccggctctgcaacctncaccctcccccctcacctctatgcgcag

SEQ ID NO: 12651 - DNA, 813 bp, Homo sapiens
  misc_feature (1)...(813): n = A,T,C or G
ggagaaaagggtaccgaaatacgacaacgaaaattttggagagacaacccccctctgaggggacatcacatcnccccagcgagaagcaaagagacagctggaccgcatcgtggggggcttcaatccaaggaacattcacagtactgaattcagtgcttagaactgaagttattgagaggacagctttaaaagatgaatgaactcaaaagttcgagttgtgctcttcgcgttggttcgataatggcctttattttttttttacccaatggggtctttacagcaaatattccattctgatttcgtaaattaaacattcatgcctcccttttgtgttgacactgtagctcatactggaaaagtccatcaatgttgtgcagttcattgaaagtaggtctatatataacaatgttataagcatttctttagaaatggttgaaaatgcttctaaaatgtgattatcgaccctgtatgcatgatccttgcaattgtcgacttccttttagaactgggaaaggcacaacttgtgcttatgcaaaaccatcttctgtctcagacagacggacctgcttcataaagctattaccctcaaaacaactccccggtgtgctcccccacccccgctggcgcctccatcgctcttcccgccatttcttcctaccagctactcgccgccgcctctgcccgccccgccttaccccgagagtgtaacacgccggcacgacccccgaataacaaaccaccgtcacccccccctgcccccccgctcgcccggcgccgaccgagaccgcccccccaaccccacgccaagaattc

SEQ ID NO: 12652 - DNA, 2193 bp, Homo sapiens
  misc_feature (1)...(2193): n = A,T,C or G
ttcgtgctgtctcgttccctttgtgctcctcgcnttgcgcgcgtgcttcgtctggtgcgctgtcgcgcgcggtgtgtgcgctgtgtgccgctgncgcgcgcggngtcgcgtgcgcgttctgngtgtgtgccgctgcncncttcgcttcgtctgcgcncgtgcgtcgtgtcgtcctttctcgcttcgtgcgtggtgcgcgcgtgggtgngcgctcgcgtggctcgtgctcctngctgctccctgtgtgtccggcgcgcgctcggtcgtgttggtcgtngcgcggtgctgtttcgcgcgcggtcgcgctgtgcgctctcgtatgctcgcgntgctcgtgntgctgnctgccgtgtcttcgctcgcctgcgtgcngtctctggtcgtcgtgtgcgcgtgcngcgttctctccnctcgctctcgctcgtgtcgtncntgccgcgtgcgcgttcgcgcgctgcgcngcgtntctcntgcgtgtcgtntgtgtgtntgtgtcttgcgtcctgctgcgcgcgtcgtgcgctcggttgcgtnctgngtgcgtgtgctgtgtcgngcgctcgtggcttctgtgtnttctctgcgctgcgctcgtgtncgcgtcgcgctcngtgncgntcgcttgtcgtgcgtcgntcggtncgctgcgtgtcgtcggtgcggcgtctcgctngggtgtgcgtgtggtcgncgngcgctcggtgcgtctncctgtctgntctcgtcctctgcgcttctgctctncgngcttgcgctcggtngcttcgcgntncncctgctcctgtttcgcgccgtgctgtctgttgntcgcgcggtcgtctgtcgctctcgcgtccgctcngcgcngcntctgngttctcgtgcgtgcttgtcgtgctttctcgtngttgttcngctgtggctctcgcgtgctgctgtgctgcgtgcttgtgcntgtgngtcgttggtgggtgcgtcggcctggngncgngcgtgcttngtttgttgtgctgctctgtctctgctgtctgcgccgtgcgtgtcgtccgcgtttgtccgnntntgttgtctgctctcgtggtgtcgtntgtcgtngtttgntcgtttctgctgtgccgccgnctcgtnntctncgnntcgtgtccgcgtgntncgctggctgtcgtctgnctgtgcgtgtgctcgtgctgctgntctcgtcgtnntgncggtgtgcnccgtgtgnntctctcnngttcgttcctcgnggcgnctngctgtccttncttcgncgntctctngccngtcttcctnntgctcnctnctgctgcgctgntcgctccggnctgctgctcctncgcntnnctgtncgtcgtcgtctcgntgatgtagaaaagagaacatatactancttntnctnctnctttcntcngcnctntggtnnntnctnctcntantanttatantanctactnncncttctcatantantcnctnnttctcntacncattcntcnctactctaattnttaataattcttattatcatcnttattcttaacanccnntttactatcntantctctacctantanctccaactacttcctcatnntcnatnctctcntnnctctccctncccatctccatcatnctnctnncctctctnnatnctncnnctnatccaccancacnttnattacnatcacnatnatncttatctantccgtnctnncnctnctcctnntnncnntnncnnanctantccatccttacnatnatcatcatcattattatatnnannannacnannantacatcnctngtacttctttcatccctcctactcatcatcaccacgatcatcatcatcactaacacnaanacnatnatcatnattntcattctcntnntnatnatnanngtcntnnnnntnncnacnancnnnncnncnnnnnannannnnnnnnntnnantnnggggnnncttcnnnnncnngnntcctngncgtncnnnctgaacggncnngnncngnnnngtnngngntnnnngnnnncnagttcnnncngaaccgnnangacnncnnncagccggggcnntcnttttttttcnncnnttcnctcnttcagtggtntnttntctgcgtctcntctagtatctgctnnnnntggcctcncntnntccnctacntctctcctcgtcnnctctttcttatcntatctcacccatattcct

SEQ ID NO: 12653 - DNA, 976 bp, Homo sapiens
  misc_feature (1)...(976): n = A,T,C or G
ctgttattgattcgtgtactgttcgtctgcgcccggtgtctgttgctccgacttgttagttctgggtgtgggtgtggtgttgaatgctccggtgtgtggtattcttctgctctcgtggtgtcgtgccgncgtgcagcggttntcttgtttatcgtgttagggtatgagtgtgcgcgatggttgtgcgcgggcagtgcgtccggttgtggtgccgtatggtttatcgtgtaggtcctgtcgcatgtgcgtgtcgggggtgtcggcgngctcggctgtcctggcgacgatcgtttgnagggttcagtggtgcggtgtcttgctcgtatctggtgtgtaggttgtggtactgttctggtggattgcggtgggtggtgtggtgagtggtggcagggtgggatgcaatctggtccgaggggcgcgcgcggtggcggcgcgagagcgtggccctcttctgcacgggtctttgcgtcgtcgttttgctgcactcgtctgatgtttttgtttttattctttatgtttatttgtgtagttttgattgtgggttttcttattgcttttgtctgtctnctttggtgtttgatgtgctgcttagattggttgtgggtgtcatggttagcgttcctgggttgtgtctgttttgnttttttgtgtctcttctagtctgattgtttcgtttgttgtgtggggttgttgtttgttgttgcatttccttctcgtgaggtgtcgggtgatagtcttatctcttccttgtatttctctcgcttttggttgtttgcgtgtgtgttgtgtgctcggtttntaatcatgttctcccctccccgcttctgtattttgtattgtctcttgtttcttgctttgtgtatttgtttgtgttcatattgtttgtgttgtttattgtgttgttgttgttntttgtggtgtgggtcgtgcggcggtgtcgcgtgtgtttctgtttatttggtttatgtataagttg

SEQ ID NO: 12654 - DNA, 924 bp, Homo sapiens
  misc_feature (1)...(924): n = A,T,C or G
cccgtctntatacacacactaacgctcgaaacctggcagctgtggtcatatcggccaaacttagatcgagcatatacaaatacagaccaaacgttaaagatgatcgcggcctacgctgatgccgcagatcgcctgctatcatcatccctcgtgaatactcatgggacgctcatgcacaccaagaccacgaccgccgtcatcacagagacccactgaaccgaaggcgcaccctgggaccaccactaaacccgcgctagctcctcgaagaatactctgctgtagcgcgtcagactcacgagcgggcacggcgccgctcatccacacgcgcccaacgaagtcccacgtgcacttccctcgaacgccgccgggcaccgggggccactggatcagtgcggctggtggggcacgccacccgaccgagcgcggcgcgccagacgcccaccagccccattacaaacacgagccaactttcacaatcatgttttttacaaggcatcgacgtcctcagtccaacctcgctcttgtctctttcactttccatcgcttgacgaacatctattgtcacacactcgccgaggggctattcttgtgttgatggtgttggtctggtgtaagctcttctgccaccgggacgcgcgcggcctccgcatttgcatacctataacaataagcatatgcacagtaaacccctacagacgccaaacaagcaaacacccaggagcaaccactatccacaaacatggagtaatcccgtctgtacgggtgacgttcttctgccattattgcactgataccgtccatcacacagcgtcaacgatcctatggccctcctcagaaacaaggctacggaacatgtgcgaaaagactataacccgcacgcccaccgaatnaattaacgtttncgccgtaaccgttnttataatg

SEQ ID NO: 12655 - DNA, 888 bp, Homo sapiens
  misc_feature (1)...(888): n = A,T,C or G
agcagggaaagaggggtcagcaaaataaaggagagtagaagaaaanngttagaggacaactagcgccaagncttcaggagaggaaccnaccccggccacaagagcaaccacgaacactgncccttcagggaacgggggggacccagacacacacaaaacccaccagaaccaaaagaagaaaccgaaaccaagcgaacaccggaaagaacaagcagcaacgaggaaaacagccagaaaaaaagctgcnggagaaaaaccaaacagaaacagcccttttttacgagctgggagatacggaatagggtatttaaagatccacggaaagcaagttcatgaccagaaatcagtgcaaacacatcttctgctaaacccattggtatacacagaatatccctgagcccacacttaatggaaatctatagtttgaaccattcatgcactattctactaagcgtaaaactattgagcaatgtctattaaattgagatatagatcttgcatcctatatcatggccatatgtgatatacaagacaacatccgcgagaagttttagcctaagcgtgacagaaccgaagaaacaagagcatctatttttttggggaggggggtacattaccaggcaaaaggaacaacaacactgtaaccgctaaagacccgccccaggaacaaccccaacccgccagtcggccgccccctgggctagccccaccgggcggtgaaagcactggtctaggctgcaccgccatcaaaccgctccagaagcagacaacgataatcgatcaccggaagaggcaggatggacaaaacgacaccccgccctcagaccgatagcccagacgcgcggccacgacccgtccgcgacgaaagaaaaagaaagcacaacaatt

SEQ ID NO: 12656 - DNA, 1210 bp, Homo sapiens
  misc_feature (1)...(1210): n = A,T,C or G
ccacctgtgcgaatcacctcctcgttccttctcgcatgcacgtacgcgtgacactcatccggttagcataaccagcgtacgcttgacgctccacctgagtcactctaatacagtccattctcgctcgctaccactccacgcagcgtccactgtgcacatatcatataacaactactctcccagtgccatccttcttacctctgaagttactatcaatcagcgctcatccactccaattcaatttgcactatagtgctactcactacactccgcggtatctctgtactacacccagtctgactgatcaattcctagctgctaatgggaccacacctccctctgaccatgtcgtagccgctccggtgctcggctgtatatcactcccgttctatnacacagattcaacgcacatagtcacgtggcgcagtccctgtgcgcgcgggcgtatgaccactccatgcccggctctctagcgcaccccccctctcacatcggcacctgagctgcgctcgttcacatcatagcgcaaagtgtcgcgtctcccgcctcgtacccaccctcctagcaccccccaccgcacacatactcttaggtcagtcttaattaaatcttggaagtcggtgcgacacagttcctctaaacaatttcactgatactactctcacctctccgctatcnnntcctatactcacctcgacctataccagactcttattttctcgttctctactttttctcttttttctttcccattccttgactggaaaattatacaaatatagaaggagagcaggataggggtgagaaaacaggtaataacaaatagcaactataacntgttctctaaacatccgatctgcgcacttatttttccatcttaatctcgttatccatcattactactatatgaattagcaagagggagacggcgagaactaacgggcggcaagactagtaagcgatattcacggcccgctacataattctctaatccatctgatcnnactttnttttcataaatctctctcttnctcatctacctcttnccctctttnttctcttgtaattaatttntttnnnnncatgaaaactantnntctantnntatngtnnnnnnnnntcaaagctttttnnnnnntttttnntnnntctnntttttnnctnnctctttcttnttntttnnccccttttnnnnnnnnnnnttttcccc

SEQ ID NO: 12657 - DNA, 816 bp, Homo sapiens
  misc_feature (1)...(816): n = A,T,C or G
ccctaggggctacctcatcacgcccagtgctaggagtgcgagcgtactcactctcacataatatgccactaccgcactactatctctaggggttcgggggggacacttacatacactctaccactacatactagtgaccacactggaaccattctaacatgggtgagagcaggcggctaactcgtaaacagctagaactaaatcaggtggagaaagtcaacagatacagcccttcttcactagctgggggaatcggaattgggtattctaagatccacggtatgcaacttcatgaccancaatctgtgcaaacacactcttctggctgaacccattggtatacacacaatatccctgtgcccacacttaatggcaatctataattgtaaccatctctccacgattctactaagcgtagaattattgaatgatggatatgtagttggtatttatatcttgcatcctatatcatgtcaatatgagatatagaagctagataccgcaattttttagctaatcttgacagattgaaagacgaggtgtcattttttttttggggatggggatatataccatgtaaatgcatgagagacttgcaaatctaagtcgcttgaactgtgccgtcggcgtcacgtcagtgggcccccgttcggtctccctcgctggctgacccacgctgcgggcccggccgagggggtgtcgcgtttcctcggcgtaggcggcgcatcatcactccacatccgggtgtctggagccgtgagcttgtgtgaccgggccagcccggaggtagtcgtgggaccattgccctgacaggag

SEQ ID NO: 12658 - DNA, 1040 bp, Homo sapiens
  misc_feature (1)...(1040): n = A,T,C or G
agatgcttgacagtacaatacatatagtatgaaatcaaacttataatacgtgtcaattgatgtttattagcatcctgaatagcatatactattaaatagagtcctgcacaatagacataaacacaggctatcagataacgcacaacgtattaatgccatcaaaaatcttggtgcgccctacagtcactcgacactctggtcagggactcagacgactcagaactatgcgagtatatatcaatgcctcttctacgggcataaccgcaagtgttctattaattaattaagagaggagataggtcgcaaaaagaaaagtatagattgtaggtcgtagtgataggacgggaatgtcagagcatattacacacagtattgatctagaggttatctttttgatgattagccgccgttagattatatgtgacaggaggtataccccactttcactttaggtcgtaacaccagtgttcagtcttgataactcaggtggatactgtgttgtgtgaaaaggaacgagtccccattcaaaaacagccttcacacagaagtgaggccagggccgcaagggtttaacacagtatggacttacatgaagtcgcgatcttatttagtggacacagaggcttctcaaggcatgacctggactaacaatggattattcatctctttgatccatacaaagggccatcctcggatattgatacacgtggacaggtcccttatcatatagtgatctaaaagattatctgtaacttgaggcggcgactgcacacgtagtatattctctaagtggtaagtatggatgatatgatgatacaccattcatgttcacagtgtcaaggcgtaggtctcgttgcattacgaatgcgtatgtcgcgtgcgcacatcacgtgtttactcatcgacccttcactgctgcgacttgtagctgcttcagtcatattagccctagtctacaacgaaagaacattaccacgctcgtaatcataagannnnnnnnnnnnnnnntttcccttccnnntttnttttttttnnntttt

SEQ ID NO: 12659 - DNA, 277 bp, Homo sapiens
tctctctctaacaccttgaatgcctactcccttcactgagtggtttcttctgttcctggtcaactcagagtacttgagagactggagcattggggatcagattttggtgtgcatctgcatcatctgggatacttttcaaatgcagacccccaggcctcaactaaagtgcttctgatatgaataatttatagatcacacattgaggtatactgctgtgtgctatgggattaatatttgatgtataaaatgaatatgagtagctacaaaaaaaaaaaaa

SEQ ID NO: 12660 - DNA, 166 bp, Homo sapiens
taattgcgatgctctaaacacagagcacaatgcagaaagatcaatatatgactttggaatggaaagatttcttaaataaaactgcaaaaacgtgataattataacgaaaaaaatgataaatttgaccacattaaaattaggaatttctgcgccaaaaaaaaaaaaa

SEQ ID NO: 12661 - DNA, 253 bp, Homo sapiens
tgtgagaggagagaccccactgaaacccactctgttttgtggaattctcactcttctccctggagacctcatgactgtgatatatgaactgagagagggcagtactgtcaaaacatacatggaagagaatttaataaaagagagctctgtgtacctatcatcctgaattcacatatgctaataatttatgatacttgctttgaattattttatttattaaataaataaaatattatagataaaaaaaaaaaaa

SEQ ID NO: 12662 - DNA, 843 bp, Homo sapiens
  misc_feature (1)...(843): n = A,T,C or G
atagaggatttcatataataaccattattgtcctctcccgncccccgttaggggtggactacaatggtgtgttctcagctcactgcaacctccgcctcctgggttcaaccaattcttctgcctcagcctcccgagtagctggaattacaggcacctgttttgtgggtaatttttatgcaagaactatgagcactccaaaggaggttgctatggtttggatatttgtgtctccccaaaattcaagtgcttaacctaatgatcagcgtgatattaagatgtttggcgggagctctgggacatggttagatcatgaaagcaaagccctcatgaatgggatcacgtgtccttataaaagacacccaggatagctgctttcttactccccacaacaaggacacagcaagaaggtgccattgttaaccagagagtggatccttacctaacaccaaatctgccaacaactggatcctgaactccaaatcctccactactgtgccagagaaatcctccgctacttataagccactccccctatgatactccgtgatagtagcctgaatgaaccaagacaggtgcctaatttatgccccgcatggtataggcttgacaaaactcccagctctatgtattcaactttctgtactttttcttcacttgtggacttgtatatccttagttcactctgtccttcactaacttgtccctaattgaacactactttctattttgtccttccgcactattgttaatctcaaccccatgaatcccttatctttactacataactaaccataatttggaccccgcttcccccctatcctgtagatttttggttttaacacc

SEQ ID NO: 12663 - DNA, 838 bp, Homo sapiens
  misc_feature (1)...(838): n = A,T,C or G
aggagcatgaaaatacgtaatcctctatacatgcgaccgcccnccccttacatgtcacaanatatggttttgttgggagtgcatggctgagagaaacagaaaaacctgaaagatcatactggaatcctccaggagctggactccacggtagaaggagagtgggtgccttcacttccaccccctgaagtctagagaccattttgtatcaaattgtacttagcagtcatggaaggaagcttgcacaaacttaatgttcttcaatggctgtgctcactgtaagttaattttattgtagcagttgttgtcttgaaagtttagaataaagagactccaggaggtcttttcataacagataatgatgctggaatgcataaatgttttgcggaatagcttggagggatacattaattaattatttgggctaaaaatgagctggaaagaaatggaaacaatactacacttggaactagaagaccaaggttcaacactacgctgccatactcactatccgcatgaccttgagcaatacagcgaccctctcacagccacattgtcatctgcaaaatgggaataatgctaacatgcgactggccacaaggttgtcatacagcactaataaaatagttgatcattacttcagccgaccggtgaggacactgcgactcaaagggttaaaacgaacttcccaagggcacctattttgtgagtggccaaccccactttaagaaccaacccaatgggcgtgcatgtttcactctttcatggccccttctctgaaatatgccggataatattggccctcggacccccgctaccaacgcccttccgcagcgcaggt

SEQ ID NO: 12664 - DNA, 259 bp, Homo sapiens
ctggcacaaaatattttagcgaatgaatcagtaaaaatcaacttttcctaaattttgactgtggagcacgtgttagtcacagtgtgagggacatgggacagaagatcagaagaaacagaagatccagatactgttactcactatagctgaatttccatttgtgattaaacttcaacatcctaataattgacaacataacatactaggataataggtaataatatttgttgtgcatatctccgggggaaaaaaaaaaaaa

SEQ ID NO: 12665 - DNA, 811 bp, Homo sapiens
  misc_feature (1)...(811): n = A,T,C or G
acaacctggagaaccagcagatcaacatcactcattttcacctaactttgttgcatattttgttcaaaccctgcttctatctacaccttaagtgtgagcttcctgaagacagagtcaagatttaactaagaagaaactaacgacactatgtacctcaaagagaggaaatgtaacatgaaaaatcagttacccaagtgatggagaatgggaagctaagcagcaaatggcaaggcaggaggccactaccaccccacagctggagggataaaagaaggagacacggtctccacagcccaggaagtgggaccacgtagtagacctggaactttggcagccatcctctgcaaggggggctcagcagagacagaagacgtgtgccagaagctagagctacagaagaggagaagtggtcactgacagtgagattgcccaagtcttttgtacagaaatgcatggtgtgcctcaaaagaaaagtaatcactgaggcagaggaaggagaaatacagacaacagaaaggatggatcaatatcaaaccgggggcctcacagctgctttcacacagggcggacctcagcaggaaaagagaatcagaaaaacaagggacaagtgcttgcctttgatgagtttgacacaggggatcgctnggcgattctgnaacctgaatccttttactggggaatgacatcagcattgcctcaaagtttttgtcaggaaattctgcattatccatagcttaaccttgtagaaccatggacatatttttagaggcttttttttggtttcttaaggatatggctttaacctaaaaaa

SEQ ID NO: 12666 - DNA, 749 bp, Homo sapiens
  misc_feature (1)...(749): n = A,T,C or G
tcggggttgtcactactaatggctctccggaggcgtcnataccctccccggcgcgtggggtaaaaaaagagagaccctgtcttccccctccccgtataggggcacccgtggaggtcccggcgaatgggtcggccctctccttagaagggggggggggaaaataaacaaaaaagcttggcccccgcctgcccagatctccggactgggggagggggtcaccgcccccaagagtagacccgagggtttatgtaaagaaacagcagggccgcccaagaaaaaagaagaattttgggggagaaggtggggggaacccatcgctcccgataggggtggtgcgtttcacattggagggccccccgacgtttttttccgggggcggggattttttgcgggtaaagggttcgaaaggcctaggggcgggggggccccgtggaaaatgtaagcccgggggtttgccggggcattttgggaggggggaacccttttgggggggagggccacacgggtttcccgcaaaagttttgtcatggtaattatcgagctatcccacaagttttaccggggtgagacccaggacaatatttttttagggccgttctccccttttttccaagggggttgtgttttccctgcaaaccggaaaaaaaggagtttgtttttcacagaacccccccttttggagcgcctttgggttttcttttcaaacccccgcttttcccatagggtaaggcgggatttcccttgggggg

SEQ ID NO: 12667 - DNA, 1316 bp, Homo sapiens
  misc_feature (1)...(1316): n = A,T,C or G
ggctggcgctcgcggcgccgttgtgtancggtctcttgtngnggtgtgcgtgcgcttattcggtgcgtgggtcgtgtgcggcggcttcgtgctgtgtcctgttcgattcgcgtgtcttgtcttctggtgcgcggcgctgcggccgcgcgcgtgcgctntngngatctcgatgcggtgttggtatctttgtctatcgtcgtgcgcgctgcttgtctcggcgttccggtctggctgtagtcgtggctcgctggtcttcttcctgtctgcgccgctcgggtgcggctcggtgcgctcgtctcgnctgtgctgtcgtcgcgtctcgctagctctcgcttcatgtgcttgtgtggagtgcgttgtgctcgctctcgtcctcgcgcgcgcctgtcgcgcgctcgtctgtggtgttcggctctgtgccctcttccggctttccgctctttgcgttgtgtctcctgtgttggtgcgcggtcgcggcggttcctcggctttgctgtgttnctccgctatttgtcgttcttttgcgtcgcggcgtcggtgtttgcctggcgtgtgtgtgccgcgttttttgtgtccgcgccgcgttcttctgccttgttagtggtntggtaggtcgtattgttgtcgtcttgctcgcgggttctgcatatcgttttgttgtttggccggtcgttgtgtctctcgtccgcgggcgctgtctcttctgcgcaggcgtgtgcgcgttgttgtgtcgtcctgtgctggtcgatgtgtcgttcgccgttgcgtcgaccgcgcattagccctggtctttcctggcgcgtgctgttgcttgcgctctgctttctcggtgttcgcttcgtccgcgcgcgttgcgngggtcgatgtttcgctttctgctcgtctcggtcgctcgccgcgtgtctactgttcctttgtgttgtctgcgtcgcgctgcggcggggcttctgtgttgtttggttgcgtggtgtgttcgcgtgttggggcgttcgtgccgccgtcctcgcgggtcttccnctcgttgtgttcnctctcccgccttggcttgntgcgctcgtcgtcgcgttgccccccccggtctcgccccgctggtgttgggtcggcctccgcgttgcgtgcggncggtgcgccgttccgctgccgtgctgctggtcgggggtctggtggtggctgccggcctcgggnccgttttgcgcgcgttccgtcggttttcctcccctttcaacaatcttnggcgcgtttacgcgcgccgagcnctcttttgttntttttccgtttctccctcgttcccgcctctctttgcggctcgtgtgtct

SEQ ID NO: 12668 - DNA, 933 bp, Homo sapiens
atggtataaaggatggatagtagaaaaagaggggggggagctagctgcggaccactctcttaatctaccaggggtacacagagtggagggctgaaccagccaggaggaccaggatttgctgagccgcataaacccgcagctcaagcgccgttttgccattggctcccaggtgtctagagcacagcatcatcaaggactttaccgatcagaaataccctggagcacgctataacaaaggtgctgtagcttatgctgcggcggggtgagagccagaatagcatgcagggaagggatctgtaccggcacatgcggaagatagcagattcactggagatgtggactatgacgacaccgaaatcgatttagtcgttggctaggctattgaaaaaggagaatggattttctgaataatcacgtgaagtcgtatgacgtactaagggattttcagctagagttacagtgtgggggagactcgagagaaataaagaccatagaggaagacgctcttagcggtctacgggggaaggtggtatgttgcttagaagtgatttataagtgcgtaggagtctcagggaaacataggtaattgtaatatattatgacataatgctcggataggggtcttaatggggggtgggggaggggtgaggggcgcaggaagaaaattatatacaaagtagttataagtagtaagacggctgatttattataggcgtgcagtcagtaggagtgaagagtgggtcgtgaatagttatagttttacgtctcggatgaggaggtataatagctagcacatagtgtttgagtgtatgatatgtattaagtatcgagggcatggaatagagtagaacgcatgaccgtatatgcgtggtgacacaaatggatagaagattatattagaagtatataagtgtgtttaattgagagggaaag

SEQ ID NO: 12669 - DNA, 908 bp, Homo sapiens
cctgcctctgccctccagaataaaagggccctgggagtgaagttggaagagtttcgccaccctttaccccaaatgggcctctggtccatggaatattcctggaggggacatttgtggtggcccgtggaagacagcagaccagtgaacattgtgacaatgaaggaccaaaagacccagattgattttgaatgtagaactggagaacacaggggagcctataacgagaatttcccccaaatgaaccaggaggctaaagggcaagatgcccttttctgagactataaaaacttggaggcgaatcactaatggaatagctacactggatggaggcccatgatctgttgggtgcggcctaccgcattagagaggaggagtaccacgggaacattgatatgttaggtgaatggcggaatgtttttaaagctcgatttgctgttgataatggaataccaagatagagcgaatataactgtgagcccagataaacgagacgcctgatggcgatttcaatacgaagagatgttaggctagaaagcaaacctgggttagttataatcaccgcgaaggaagaagatgagaccgttgtttctaccaaaggaggtcgatatctcattattacttatcacggatgagagcgcaaagtagtgagcttgacaaacttgactagcgggagacgagttcgagtatagtttgagtcgaaggacatcagcagatcgtgtatgtaataatacaagcaatgaacgaaaacagaagataatccagcagatattactgtggcgtgtatgactgtatcattcacaacatttacacaacgccgagtatcacatacgagtatattaaaaatgcaggagtcataaacgaagagagctgggagagacaaaatgggcggagtagggcataagactaag

SEQ ID NO: 12670 - DNA, 1007 bp, Homo sapiens
  misc_feature (1)...(1007): n = A,T,C or G
gaaaagagatcatggggaaggcatatcagggaacggagcccacgcttgaggggcataatgctgggcttaactacagggacctgaccatgaccaccaccacgcgacgacgaactgacaggccgcgaactcacacatcgccaccgaagagagacaacgcgtaaagtcgtacgaccatgacctgcaccagcgagcgaaaaacaacagaccgagagaagcgcgcaagccacaaccagtagacatcacacgaaaggacaagcacttacaaggacacgaacattagtatagtaggacaccttaaaagtcatagataacagcgaccacgcatacggagcggatacagcgagacggcaggtgggagattatcaagatagcagagccagagcacgactcactactgccgatagcggaagtttcgtacgcgcgggctacgtgatagaatagcataacgccgaatagcacactcaatacgacgatggtactgcagttagactcactcaagagggacagccatgcgccaaggatataggtcgatagactgaccaggtcagactgatcacggcgagtagggccaggcagagaaaagaggacatgagaggcgagtccgcacgagatgcaatatatttgaaggaccacgccaaacgcgggaattacgaagtgcaattcatactagaacacggcagacagcgtgaagcaccgagatggtggcggacaaacgtaagtacagacgcagagcagcattgcgcgcagtgtactagtcgtgagaatgtctaattcaacacgcacagaagatgcaaaatcgatagagacgtcactcgtgagatacaggcggcgacggtaantggcgcacagcgggactggtccgggtgcgaaatggtcagacagcgacgggcggcgcagaactgcagcacgagacccactcacgatattgatggagagtaaaggtaaggatatatagtgcgtacgagagtatattaagacggacgcacggatcggagaggcgatgacgg

SEQ ID NO: 12671 - DNA, 405 bp, Homo sapiens
accacagagactgtaaaaatacgtttaaagcactggagaaatgaaacaacaactgtgaagccagaaatctatacccagtgaaaatatccttcaggaatgaaggccaactaaatcagactaaaaggagtcatcaccagcagatgcactacaagaaatgtgaaagaaatttcttctggaagaactgaaataattcccaaaggaaactcagatcttagaaataaaaggactcggaaatggtaaatatttgcataatcataaatgttggttttcctctttcgtatgatatacgctcattttaaagcaaaaatttcagcacagccttgcaaggttcccaatgtatgtggatgtagtacaaatgaaaattataccataaaaaatggtggagagaaggtaaataaaacctga

SEQ ID NO: 12672 - DNA, 837 bp, Homo sapiens
  misc_feature (1)...(837): n = A,T,C or G
actaaaagctgtgaagctaattgcccatcaccatatagatcctgagctgcggaggagaagaccgccgtctgccactattaaagatacacccaacacctgggagttcccgagactcctgacgtcccgatttccttggaagacctggccacctcctaactgattgatgacccctgtgacaaacaaaaaaacaatactattagcgaaaggggaaaattctttgccaggttgtcacgtgacagttaacaaaagagttttctgtttggagtggctcgcgtgacagtggtataggaggacaagatgatcccgcnttggatcctgcatatattgtgaagcctctcttcaatttaatgaagaattccccacattcactgccaacttacccagatgggccagagtccctgggccaactcctatttcaaggccggaaagcatcggacctcagacaagaagtaggctggacagggtttctaagttcgggcttgcctactcccctctcccggggaaatgactctaaactncatgttccttttgtaggagcaatcacatgggataaacccatagacaacttgtggtataccatccccaccttcttctagattctacaaaacagtatgccctctgaaactttaaaaaagaaacctggattgttctctacggccagagacttttttctacacaaccaagaaaagaacgaattcctcacgcaagaccctaggaaaaatgacccctttttggngatttggggtcggttttcttttcttaaacgaaagaaaggcccttctttgctcaatgtacctcggtggcgccgtatcctttnaagggggagccgcttgtctt

SEQ ID NO: 12673 - DNA, 673 bp, Homo sapiens
acatcattcaaattttggtgttaatttgttatagcagctgtcactgtaaccaatattacatccatcatgtgtgggaggatggaagttggagacgtcttcaaaaaaattacttagatgtagtggcctcacacaccaaccataactccacatttcctctctagtttaataaggagaggaacaagaagagaagagaaatgagttgttggctcccactcacagtgtagtgtactatactgtacactattgtatagtagagtagtagagtatatctaaggaggagaaagtgatggtgtccctcacccccaagtcaaggaaattcgagggctctcagtgagtcactgggttagaaattgggactgcatgcaagaaggggggattggcttctttttcctgctggtttgtttttcatttaaggaagttcacaaaccctgaaggcccactgtgggaacccagcctgcattataaccaacaaaaatctggtgggattcatatttctggggtgggcattttcacacctgattagggctctttattggagtactaaaacaggaaaaaggggcaagctgggactatatgactgagggccacaaacctggccgctttgccttgggcttttggtacatatttaggaagagcgcccgtatgggccggggccttaggcgatttactaaag

SEQ ID NO: 12674 - DNA, 846 bp, Homo sapiens
tctctaattaccaccgctacaggagcttgagtagacacggagagtataactacatgtctcagaggacttctggtgggggataacgcactgatgaaataccagaacgtccacccttggagcttttggaaacggaagaattaaacgcaccgaacagcatgcctcagaccagactggaccaatgtatttgaaccttattcatcggcatgctctattgttctatggatggtgggaggctgcatccttaattacctcatctttacgacactggatggtttacagtttgcactgttaggaggtctgattccaattgatgcctcttaaacgctgaataagttatctcctgtaaagcttatggtcgttttacccaaacgcaaaaatggccctgccaaattttacccacagtctccggggtaatgactggcgcccgtaagcaggagattttcaggacacctgtattaattaagatcaacgcggatgggggttgcttccgtttggggaggggcaaattcttgatcctggatcactgactctctccactaagtacaaaaaatagagggcaactggattaactcccctgcgaggcgggaaaacggggtatccacctagatgcgcggaaaacgcgggaaaaagaaagtgggccagcaggccataaaacagatggggaacgcggaacgtggctcgttgtataggcggtttaccaatggctctcgcgcgcttggagagagtggcaaatctcacgctagaggttgatggggaggatcccccggcggactatatggctctccgcggtttgtccatggagaggcacatctggccactaatgtgttacgacgcataggggctaca

SEQ ID NO: 12675 - DNA, 686 bp, Homo sapiens
  misc_feature (1)...(686): n = A,T,C or G
cncccntntttcacagactcaagtttttcnncagngtnnaanggncatnttnttacaananccnagagagtnatttgnngaacccggggngggcnaaaanaaananggaatgngccnananantnganatgaagagnnggcccnaaaagagccnatttcncagacgcaaaaataaataattgngngttttnngngggaanataganacatncnccaggcccagaccnnggggtctnanttttaagaccaacaaatncnaancccngtaaannncnttgtagaggaaagttangtnctanatntaggantnaccctnncagggaggggcaagattttntattctcccnntctggtccctcttncctaaaggncaaaggtngaaacaatcagtcctgcattccacanntggnaantgtgtgctnaggttgncaganagnantncaaagggaggncagattgcncaanccntaaatgtttnagcccntnataataagctcccntcccntgtnnnanaattcctatcgaaccngncaatntgcatagaganatgntttctatcaatgcatctaancaggaaaaanttttctggcttttagcaacagacctatttgtnntgatagacataccttaaagngttaaatacatcatacaanntatgtnattgagcataccagtangtggtnaat

SEQ ID NO: 12676 - DNA, 751 bp, Homo sapiens
  misc_feature (1)...(751): n = A,T,C or G
cacaatagaattaaactagaaaaaaaaagaactaataaaaactctaggcctgatgagaaaaaggtactggacacggatatgtgggctgcactctaatgtactaagatctagattacgctnaaccctcgttgtgctccacgtggtctcacaccactgaatcagattacattgaaagtaaagaacaaacagcatattaaccttaccactcaatggcacacgaacgactaacctcagagggacgtcaccaaccagcatcaaatgagcccggaccgtcacctacgagaaccctggatctacttaatgaatgagataacagttgatcagaatcgacgggcggggagtaaggggggtatatgccacagaggaactaaacccccagcagaccaacataattttttttttgatggagatccgtgggagtctatgggtgggcaacacaaggggttaaaggcaaaatatagtgcgtcccaccctgatcaactaggtatnnccttagcgaattcatcaaatcttcagtgccagtttccctgaagatcagctttcatgcttattcgttaaaaacaacagaagagtgtttatcataagattggaattgcactattttattttaatctgcaaatctgtatccttaagtgaacattccaacccatattcttctctgttcactgaaattaagttgaatttgaatggctgaaagactaaaatatatgttaatacaatctcttacctagagcaaaaaaaaaaaaaaaaa

SEQ ID NO: 12677 - DNA, 163 bp, Homo sapiens
ccttacaacaaagattcactgaagattaataatgaaccatcacctttgatgtaatggctgcctgcactgtcgagatgggagtgtgccaagatcagagattaatgcatattaaagaaggtgaagagaatttcacttctggatgatgtgagcaaaaaaaaaaaaa

SEQ ID NO: 12678 - DNA, 138 bp, Homo sapiens
  misc_feature (1)...(138): n = A,T,C or G
gctttgatggaacanttttattaacatcttcctcgagctcactgatactttccttagtgataaccaccttgttaatatactcatcaaaatcatccttaattttgattaaagggttttttatttctaaaaaaaaaaaaa

SEQ ID NO: 12679 - DNA, 833 bp, Homo sapiens
cttggtgtgacgtcttggaacccatgatgactctccaaagcctacagcaacttgcagtgaaaaaaacttcaaggcttggaagattgtgagtggtaccctctatgaaaggatttgttcttatcagcatctctgagtgttggcagaatggagccataggaaagaacatgggctttgaagctggactgatctttcgttgaatcgtgactctactacttcccagatgcatggctttgtacctccttgagcctcggctttctcatctgtaagcagggttccatgacactcattcatgctgttaaaattgaatgtgactgtttatgtaacaggtacccaatacaaatcctaggctgtttcattccagccccactccctgtatatcaggaagctccttttagactcagtcactccgatgaggcacattgactgttgcaagcctatttaccagaaacagatcagacttatggtcatcttggtgactcagtgcctggcacacagtaggtgcttaatgtgcattgactccaattgacatccaattgagtcaatgaaatttactcaatttctgaggaggggatccacgcagatgccttaggagaatgaaggcacccgaccccggaaagcaatcgcctggctatctctcgcggccttgtgcattggcgcgacatttgattgggccttcgaaactggaacaaggggccccgaaccgccactataagaatgcccctgaggccggcactgaggataatcgaacccctagtgcggtcgacctcgtatcctcctacgagcttcgcccacacccgccagcgggcgaggcgcgccgcgcatcgtcagcaagg

SEQ ID NO: 12680 - DNA, 859 bp, Homo sapiens
  misc_feature (1)...(859): n = A,T,C or G
aacccatgactatttcccgaggtcaatacntggagaggctttacgctcctggataatgttctatactcccccctgattaagccttcgataattgccatttcccccataaacctgtttagctctcacaaaaaacaatggtgcgctaacaactccgcccatatcgctcattgagtctcccggtcccctgactgcccactggaacacagaacctttcaggcaaatcccgttgctcatttggccaatcccctcatattaaacaggagaatcctgaagccagagtcactcaactagccagggcacagctaaggttgggctggacttcccagtacacaccctgcctcagagtgatggactccttcctcatgcagttgcagaacgtgcatgtacctttgcagtcaggaggacttgggttcaaacccaagctttgtcacctgctgggtctgtgactttaggtggattacagatgctcccagccctgcagttcacccatttataaaatgtagattttcacacagtcttccagggttattgcacagaattgagatgacatgaaacatgcccagccagagtctggcacatcacagctgcccaatgctatttgcctttgtccttcactcaaaattctcaccgcaagtcataataatggaaatagctcccctttcctgagtgcttacttagggccaggaatgggtctaagcacctcacatgtattagcttatttattcctctttctctaaagacaaaagtatctttcttgattccctaaagctatccatcctcccaactactggactgcctggcctagtgccccttcaacagagttagctgattttaaacaataaaaaaaaaaaaaaaaaaa

SEQ ID NO: 12681 - DNA, 301 bp, Homo sapiens
catatctctggatgcaaccatgactctctctgctctcctaaggggaggacctaaatgactggacattagcgatgagagggaaatatttcagttaaaaatcttttgtctcctttgaccacaaaaaagagacctaaatagtaggtggatgactgcctggttttactaggtttccaactgcagtgtccctaaagtagttggaggagatgaagaaagccaaagcttgacccatcaatgatctacttccaggaaagctatgtttctctggctcaaaaataatttaaagacatgaaaaaaaaaaaaa

SEQ ID NO: 12682 - DNA, 457 bp, Homo sapiens
atgcctttgcctgctacgtgaccttgggaaagtccctcagtgcctccatttccctgttgacagacagggcatgactgtgccgagcacatggaattgttgtgacagcaaatgaaatcatctctgcgatgtgtgggaggctgagctgagtgctgggcaagtgctcaccgcacattcctggtcattgttgttgttaacgtggcaggaggatttcattgagtttggagcccttcccagggtaacaaagcaaggagtcatttaagattaatgttgctcttttatgatctagataggcccttgggcagagcaagaagaaaccaaagctgcttctcaccagccatgtgggctcactggctaggagagctgattgggctcctttttaaacttggaaaataattcctctttaaatatggttttggacaataaaaatgaaacatatgtacctgcaaaaaaaaaaaaa

SEQ ID NO: 12683 - DNA, 148 bp, Homo sapiens
cgacccacacacacccctaaccacccaccccgcccctttgcagcataaacacaggccctcacagatgctggcatcaagttcctgaactttccagcctccataaccatgagctaaataaacacctgttatttatagaaaaaaaaaaaaa

SEQ ID NO: 12684 - DNA, 136 bp, Homo sapiens
taccttaaggctcttctggccgtttaaacagatgtgtataagagacagtggttgctgtataatcatcttataacagtttttgtgttttaacaaaataaagaggaaaaattctgtgttcatgacaaaaaaaaaaaaa

SEQ ID NO: 12685 - DNA, 396 bp, Homo sapiens
cttggagatcatcttctgcttgatattcttcctggttccaagattaggtttgttctcccagagtactctgagcttcccctaagtagagttccttctcacaggttccaccagccatatggggcttccaggggacatatttggcaccagggctcaaaacttggtcatcagaaccccattttcttgctcatcaggagttccttgtgcaggggcccataggcagcagacttgatgctttaacagttacctgctagctttttcagtttatgtatcgcaccctccaaccaaaccctcaaaggaagaatggctaattgaattgaatcccatgttctttcagtggtttccaataaaatgtgctaattgaataaaccttagtgtatgtatagaaaaaaaaaaaaa

SEQ ID NO: 12686 - DNA, 339 bp, Homo sapiens
  misc_feature (1)...(339): n = A,T,C or G
cttatgaggaacctaaaatgaagagtaatccaagttcccataatcagaaggattgagtccatatcatctgcatataaaagacatgtattttctactataactccgacaaaaactaataatctgttatttttcattttctactacataatacttgaaatatcatcattatcttattttcattttagcatgcttccttaaactcttaggtttttttctttaagtactttctttgtatcaaggatttttagtttaaaatatttctactgaaaaaaacttcacacttcacaatattgtattatattccataaaatcttacagtcttgtanaaaaaaaaaaaaa

SEQ ID NO: 12687 - DNA, 168 bp, Homo sapiens
cttttacagaatagattttactcgtttcagcaatgttcacactggggcccccaaatgaagtccttcagaggtattctttgagattcctatgaccagccagaacaaacaagcacaaacaaaaacaagcagattgctgaataaattcaaatctcactaaaaaaaaaaaaa

SEQ ID NO: 12688 - DNA, 324 bp, Homo sapiens
cttaagttccagggtctaatcttgatgaaaaccagacatggaggcccagctgcaaaatgccagagattacctcaaggctgttagtctacaacccggccatcgttcagatgacatcagatcaccctgacagtcaccagggaaacaagagacacagaccttgaactcagcaccactcctgcatacttcccattccaagttcccctttttaagtccctctccctagcctaaagttgggaatggtcttttaaaggcatgagcctggctattccccaacttctagcatttgaataaagttgctttcctttcaccacaaaaaaaaaaaaa

SEQ ID NO: 12689 - DNA, 434 bp, Homo sapiens
  misc_feature (1)...(434): n = A,T,C or G
cttaccctttacctagaggcacagcttgnttaaagaaaccacatggcccaggatggcaccagagcttcttgagccctgaccagatgccagaggaagataagatgctgagaaactaatgcaaactggaaccacaatccctggttttcttcatatcattaacatacaattataatgctaaaattttgttccctaaaagaaaatctcctccattctgtgtacatgtgatgtatgaagacatgtttatgaaccgtgcttacgcatctggagtcccaccctgcacatgctaacattcttctcctgccccacgccttatccttaaaaaccccatatgccttctgttgtttggggagaaggtgcatctagaatgagtgctccctttctccattatctggccagggaataaaacggtattgctttttctaaaaaaaaaaaaa

SEQ ID NO: 12690 - DNA, 376 bp, Homo sapiens
ccttaaaggctacatctcactggggctcagtggattctgcaatggctttccaagtgttatcagatattttactttagtaaattagaagcatatggaatcataagacaataaaaagagatcctccctaaaccagttgacttcttctccaaccccacagcattgcgcagagaggagcgttcagcttgtgaaagaagaatggcatgaaatatatttgatccatttgactggacctaattgaacgtcactgcatcatacaactagagtgaggggcaaccaacaactttcagaaaataaattttatctataggagataaaagaaaactaacatgagaatctctttaaaaataaataataataacaattaaaaaaaaaaaaa

SEQ ID NO: 12691 - DNA, 861 bp, Homo sapiens
  misc_feature (1)...(861): n = A,T,C or G
atggtggcgtggacaggtgacagactctaacatggagtgggctggttacaaactatgtgaacacaagatagtgtataagtgatatgtgtgaaatagcacgcagtgataattgtgtacggtattcagttcgcgagaaatatatatgtctcattataggaattcatatgctgatacacgtggagattatcgtcggtacgttcttcacgaatatcatgtgttaagtaggagcagaagtaagtgccttggagcccgattagtttattagtgggccagttgaggggttgctctgacgacaaccactaataaaaaggacgtatttattgttcggggcgaggcaggacaagaatatacacggtgcagcagtaaagtggactcggcttgacagtatggatgttctctctatttgggtcatacagtccaggtacacaaggtatacgtccgtagcacaaacgacgcacnagaccggcattcattttctaggtacggttgtaaaataacagtacattgtggaagaggcaacagtgaatctatactgtgaccatttcgtgtgtattgaaataacatgaggtatctatttctaagtatcgtgattataagtaacagacaatgttctaggatattcgggttcacaagtttatgcatgagcagacagtctctgttggatttaaaatagacattggtggcgggtccaggctttcgtagtagtttactgtgagtagagaaatgtgttgcagatttacagtttgatgacaaatttcaagtggggcctttaattggagtcaccaaacgaatttgaggacatagaccaaaacaaaaaaaacaaaaataaacacgttatggaaaagaaaaaaaaaaaaaaaa

SEQ ID NO: 12692 - DNA, 735 bp, Homo sapiens
  misc_feature (1)...(735): n = A,T,C or G
agattcggcgtggctctattatatcacattggtctcttgtaagggaatatcttctcttacaaattgtagtgtccgttaatatttngnanatagagttcttcatgcctcttggttttttctttatcccttcgaattgcggcgccgtgnaccaacatcatgttaaatgccaacgactcctagcggtgggttttgggtgtaaaataatatgatgggtagaatggnncgccaccaccattgggggctacagagtagagcactcgaatcatgaagtagtcggtcgagaatccttagttgggacttccagaccatttacacagatggagtctcgctnngtacccaagactgcaatggagagatttcggctcattgnaacttcttcctccagtggtcaactgattttcctatcccagcctcgggagtagttgggtttacaggctcaatccgccacagccgggtaatttttgtatttttagtatagatggggtttccccataatgtccaggatggtgtcgaactcctgacctcaggtgatccacctgcctcagccctgcaaagtgctagtattacaggngtgagccaccgcacccagccatcagtaattttgttttaagagtggttggctatccagcagttggaataacaggtggatttttctttccttctcgacatatttgtatattaccataattgttaacaatgatttagttttatgaagagcaaaaaaaaaaaaaaaaa

SEQ ID NO: 12693 - DNA, 1334 bp, Homo sapiens
  misc_feature (1)...(1334): n = A,T,C or G
agctgatcagaggcgacagcacagggcagcagaggacggagcgcacgccctcgacggaggggccccgcagcgcgccacgcaggacgttcagggaactgccggggagcgcgccgatacaccgtgacaggagagagaggcccgtcgcaagagagggacgacggcgcgcgaaaacaccgcgacgngacgaagagccgacgcgacgcnacggcgcacgagcgcgncgaggacgcacccacgcagccncagagcgagcagagcgccagcaggcggcnacgacgagagcgcgcacngacgacgcagacggccacgncggagcagcgcgacgacgcagacgagaaggagcaccncacggcgacagcgcaagcaggacgacgcacgacgcgaacgcggngcngcgaacgancgcgacgcggcgacggcgagcgagccgcgcgcanggcnnncgnagcgacacacgcgaccgcgacgaccgcgcgcgacncgcaaccggcgcggcgcagacgcagcgccgcacgcgacgccgcacacggcagcgcgcacgcgagccggcccggcatgccgccanacacgcgcccgacagcgcgacntntccagcgcagagacagagagcccgcaaaagatacgcgcgcacncncgccgacgacnagagagcagagngcgacgagcaggcgncacacagaacggcgcctgcgcctngacgacgaccagtaccagtgcgcgcagcacaggacgtgcgagacggcggcgccgtccngcngacgcagcgcagcgagcgtgcgacacgcagcgcaatgctcgcgcagaacacgagtaacgcgcgcgcacgcgagcggtcgaccgaccagacaagacgacctacgacaggagcgagagccgcncagcacgacgncgcacacgcagcagccacaacacgacagcgcacgcnnccnccgacaacgcaagcggacnccgcgcaacgccgcgacaagnatcgacgaccctacgcnaggcgatcacagcgaacgccgcgactgtacggagacacagcacgagacacacgacatcccgccgagcccgcgagcgcacgagacacgncgagcgagacgagcgacgcacaaacgacgacgagtcantctgtcgccagcacaggcacgcngacaagcagacgccncncaccgcncaagcacgcagcacgcacgacacgacagcacacacacaagacagcggcacccagacggcgtcgcgcgacacacagatcaccgagagagacccagcacgcgcacgcacacgagaacacacgacgcagaagcacgcgtcagacagcatgcaggagctacatacgncatacacacaat

SEQ ID NO: 12694 - DNA, 915 bp, Homo sapiens
  misc_feature (1)...(915): n = A,T,C or G
acaacccgaacgattacgttccacagcccacccgaaacagacccctggttgtaaactagcacctaacactgccaggaaaaacccaaggtcagtccaacgcgtacaacaaagaaatatgttcttctacactccaccgggctgcaccgcgacaaggccaacggcacagctgtccacgtgggcattcacccaagcaaggtggttctcaccaaggctaacactggacaaggatcgacaacaaaatccttgtatccacaacgacaaggattcacaagaacacaaaaaacaaatttttccctcgaagagcaacttcggtgagcaaaatgaaangaataccatacgaccctaccgaccaaagatctctcaaccacttagacaatcccgataagggcccccgccacattctcacctgctccgaccctctcccaccatccactttcgtccgtcactccgctgagactcctatcaacccctctcacgacacccggcaaccacacctaccagataacagagcaaactatttcgccacccccctcaccccccacgccccaccctctttcacactccgattcctcttgccctccaatagttcaccataaaagaggcactaaaccagagcagtacccgagttcacttcccccgactcctcatcccacacgccacctacccaccccctctacatccacccacacagacacatcaccctatccccctccttatccgcaccctactgatagcacacactcccagatacacagataacaaccgcacatagaatgctagacgcctctaacccacggcccctactctactctagtacaccctttcatatccatcacccggcgcaatccgctagccttatataccctgtcccaattgtacaacgaccgacgtaatccgaacgcaaaacacactgag

SEQ ID NO: 12695 - DNA, 988 bp, Homo sapiens
  misc_feature (1)...(988): n = A,T,C or G
gctcctaagcgggnnggggggggcgcgggcgggaacaaaagaggaaaaaaaaagaaagaagcctataagagaccnaagggggggggctgngggggggggaccgggggngcgnnnnnncnnnngngnngnnnggggggggggggggggggggggggggnggnggnnnggggccnggccccnccgnngccggcccagggcggagggggcgcggagggggcgggagagggggcgggggggggggcgcgggcgcgggccgccgcgccacgcgccacccgcccgcgccccggccccagaccaacaccaacaaaaacaaattttaaaaaaccccnggcgcgcgcgccgggcgggcgcgggcgggccgaagacggcgcccgacgcgccgccccccccacagagaggcaaccccaggccccccgcccccccccgccgccgcccccccgacgccccccccccacccccagaaccacgcggcacgggccgacgcacacgccaaaccccgcgcaggacaccgaccaccgcgncggcaccggcgcgcgaacgcgccggccggagcggcgcgcgccacgaacgcacagaacacgcgcagacgccggcgccagcccccgcaccgggccgcgcccccccagcacggccggcgcccccgacccggggagccccgggcggcaccgnacacccgaagggcgacggcggccgcgcggcgcgcgcgggagcgcggagacgcgccccccaccctcacgcctccgcgctacacacccgcaccgcaaggctccgaccgacaccacccaggggaacccacgccccgcgcccaccccgcgacggggcgcgcaacggtacgccgcgaggaccgggcggccaaggccgcgacaaacgaacaccgacgcgacgcgaacgggaagagaggggaagacgccaggcgagcatccaccacaatacacacgccgcagccacgcgaccgcaaggccgacacccaacacacaaccaagacaac

SEQ ID NO: 12696 - DNA, 842 bp, Homo sapiens
  misc_feature (1)...(842): n = A,T,C or G
cattatctacaaactcacataaagaatggctagctctttggatatacttaagctaatcctgcagaactgatcaaagatatgctttcaggtggtggggagaaggtaagattgcttgattcaagcaaaatatccataatctatcctgttaaactctggacctctaccaggcgacaactagacatcaggcactggggctgaggtagcaacatgcagctgaccacagtcatccttctaggatcttttctctctccactgctgtggacctataccagtgtggatggataaagaggcacactaccggcccatatggtccagggtaaacctgccacagtatgatccttncattatttagggacttagttagatggatacatgaatcatgacccaagggtataaataaaaactattctttgcgcaattgtggttagaaatacaaaaaaaaaaggaaaataggagaaaaaatagaaaaaaataacacaacaaaagaaattgagaaaaaaaggagtaaaatcaaaccaaataacacacaaaanccaacactaaattaattgtncaaaccccttttactccctaacatgaagaataataaaacgaaaatatcatctttacacacttattaccctactaaactaatgatcccattaattgtcgctctgtgtttgaccctcgcttcccgccacgatactattatcgcgatatgatataacagtaccgagcaccatggaacggaagctatttgtcttacactacaaacggcgaacaggttcacaccaagatgctcccgtccccaacaagtcgccgccacaggcgtgctctacggtaataaagcgggcatccaccgt

SEQ ID NO: 12697 - DNA, 362 bp, Homo sapiens
atgttgcattcatatctgaagaacattccttaagcctccacttgggagaaaggtaaaaaaaaaaaagatgcggcacttggtggctctgtaaattgagctggcctgaaaagagtgagactatggtactgtagctgctttgatacccaccagcattgtttgctttcaaccatgtcggcttggatagttggctatttacagccttctggccattgagagaagtagaatctctgcattcttttaaaggatctccattttctaatagtcactattttatagctctacaactctttctcctttttcaactacaatcagccctttctcccactggtttcaataaaaaatgaactggaaaaaaaaaaaaa

SEQ ID NO: 12698 - DNA, 365 bp, Homo sapiens
  misc_feature (1)...(365): n = A,T,C or G
gcaagcacgacgacgtccgcgcaggcacgagaaggagggaaaggggctgattcacccactgcttgaaagagccatcttgaaagcagctctgtggataagcacatgggtgagaaactgaagtttcaactggggggcgggggtgagacatacatcttcnctcctccttggacatcaggactcctggggttcaagcctttggactcagactgaattccaccaccagtttccctgggtctccaccttggcgatgcatatggggggacttctctgcctccataattatgtgggggggggttcataataagtctcattttatatatctcagaaagaaaagagaaagggggctgggttggcctcagcggggg

SEQ ID NO: 12699 - DNA, 1001 bp, Homo sapiens
  misc_feature (1)...(1001): n = A,T,C or G
ctatctcctgcacgcgatcacttaataaagagagctncttcgaatatccgcacacgtgtcaccacagctaatgttatgtgacccaggaactgaagcgcggtgctgaatagaagtgatgtgagtgagggcgtgagcctggcttgctattcacatgagtcattacagtcctagactgcatgttacgtcgcgcaactaccgggggtaccattgctgctaatcatccttgactcatgggccattacgacccaatatctagcgtgcaatccttccataattgcgactcgctacataattatacccacacacctcgttttctcactgtctccctaaaagacaatgcgccctcacatcaccaccaagaccatatctagcacactccttcgctattccttgccgtatatacgcacgtactagtcgactccatcgattcacatatgatcgtacagtcgtgtgcctgatgctctgttgtcatctctgacgtcgacacctagattagacagtaagcacatatcacctacatacttaaatgtcgacgccagaccagtaccacccctcgacaggaagaatacgacgaaagcacggccatggcactcagagtcgcgtcttctaagcggtgtgtgtactgatggtagtgtttgagattgtgtgtgttcnctatttatnttattattaaattancgttnttagtttctatantnttatattctatctacagtcttgtntgtaatanctacacataaggacaataagaagattaacagttatngacgacttaatacacactgngtagatctaatccacgcagtgatgtactgacatgtgagaactacaacagcgaagttgagacccggatacactctcacggatgagtgcgctatgcgcacgatacgcgtcggtagtcaccgcgaactagtgataatagcgcgcgcctcacctnttccatctctgcgctctccagacgtgcgagtgngtggtgaggcttcgatctntggatgattatg

SEQ ID NO: 12700 - DNA, 796 bp, Homo sapiens
  misc_feature (1)...(796): n = A,T,C or G
ccctggtactcctctaggtaatcattgcacatggnatgaacaaacacttataaagtcctgttctaatgcagcttctgttantggggcttagggtctagttcatcttctgcattctagaaaaagtgtcaagaaaagaatatgaaaagtcaaaataaggatgaaattgtagaaatgctttctttttggaaagacacaccaaatttatcctggtgtagagaatgattaggagtacaagaagtcagggggggcaaatggagggaccggctgaagccatggccgaagaatgtggattgtgaagatttcatggacatttattagttccccaaattaatacttttataatttcttatgcctgtctttactgcaatctctaaacataaattgtgaagatttcatggacacttataacttcctcaatcaatacccttgtgatttcctatgcctgtctttactttaatctcttaatcctggcatctcgtaagccgaggaggatgtatgcccctcaggaccctgtgataattgcattaactgcacaaattgtagagcatgtgtggttgaacaatatgaaatctgggcaccttgaaaaaagaacaagataacagcaatggttaggaaacaagagagataaccttaaactgtgactgccatggagccgggcagaacagagccctatttctcttgtttcaaagcagaggggagaatatcactgaattctttttctcaacagggacattcttgggaaagagaatatgtgggtgggggggaggtctatagatggcccccctgggggggggct

SEQ ID NO: 12701 - DNA, 604 bp, Homo sapiens
gccccctgaaagaatttctgtccccccaaagaccccctgatggggccggcccccaggggaattaagggaaagccccgaaagccccccgcccgtaatgattatcactcccccgggcacacattgttggggggtttaaaaaaagaaaaaagggcagccctcccctgagttaaaaagtaattcccgaatgaactaatcaaaagcctaaatgaatttccccagaagacctggctttttgcctgccttttcaaataaaaacaaagttcaatgtcattttttagttccggaaataaaagtaaaaatagtccaatcctctagaaattttccctcaaaggagcaaaattttcaaaatgtggcagaactactttttgtccatttttctatccaaaaacccaataactttttttaattaagaagtttttaaatgagagaagacaaaacccgtgaatattaataaaccgttttgtggcaatgaaaaaagtttttatagattttataaacatgttgaaaatttggggctaaaaaaagtatttttaacctttttaaaaaaaaaaaaaaaaaaaaaaaaaaaaaaaaaaaaaaaaaaaaaagaaaaaaaaaaaaaaaa

SEQ ID NO: 12702 - DNA, 749 bp, Homo sapiens
  misc_feature (1)...(749): n = A,T,C or G
ccacaagcagtgggaggtcaaaaagagcagagaagcccaccgncaggcaccagcaaatgcaggtcatcgacagcaggactatgtgaattccgctgggggtggtcggagaagagccccgccagcagctgaatgggccaaaccccggggaaggccaccttcccactccattcctcttccggctcaccattcatctgntgagagctacttccaccactcattaaaaaaccttgcactcattctccaaccccacgtgtgatccaatttttctggacactacataaagaacccaggatacagaaagcgctctgtccttgcgacaaggcagagagggtctaactgagctgattaacacaagcggcctgcagagggcaaaactgagagtggcatggtaacacacgcccaccggggtttcgggggcttgtaaacactcaaccctcgaaggtgctgtggggtcggcgatgctcaggacttgcccgtctgcatgctcccctacgggtatgagcagcggagcaccaaagaaatgagccacacccccatcgcgtgcctgcgagtgagattagggaacttctgtttcagaatctcacctcattatttgtgaagttgaaaatattttattggccttcattaatctttttctgcgaactaccattggctcattttctttttaatttgtgagtgctttttaataaggaaattttctttgtaaagtgttgaaaaataaactttaccttttaaaaaaaaaaaaaaaa

SEQ ID NO: 12703 - DNA, 173 bp, Homo sapiens
ctgagctgtgcagagcagatgatgactgagacactatagaaggctgagaattccctctgcagcaaccctgacaaatgagcatggaacttcagggaaaatttctccagaatagtgaagctcattaccagagacccacccagacagcaagatgaagcttaacaaaaaaaaaaaaa

SEQ ID NO: 12704 - DNA, 1832 bp, Homo sapiens
  misc_feature (1)...(1832): n = A,T,C or G
ccctctcgtcccgtcncctccnctncgccctcctcctcgaccttgtcacttgcancgccgcagcgcccaccggttttnttttntcgtgcngagcgacaccgcacagcacacacgacgcgcgcacgctcttttttttatcnntcgaggcgcgccgnnnncgccgggcgacggcgccggacgcgtccacctctgatcctttatcccttctccgancantaggntnaggntggtcgcctgtcgatatcaagcntatatgctatctgctacgttnatcgtagctcgcacatagantatagcatcacagtatgtacagtacagtcttggtcagaagnagtattacaagatagtatagattagtatgcacgtcattgacccagctacggtccgcacncacattgcgtagacatatagcgagcgaaatncagcatcgtatgcctcacgtgtatacctcgcgttgtntcgtgnttgcttgtatcttagctctttnttnattttatnattagtattatatcttgtttnatgtcttatatgaatatatcagctcgcgcttttcaccctctctcatgcgtaanctatttatatattctttcgctcgctattgtgctatgtgtggttgtagatggttcttaanatcaataagtcatcgagtacgcgcacgtaggttaaatctctcgtcgcacgagcagcagcctcgccatatcctcctntgccattacacggcgaggccacagcgccgtaccccgcctcgcctcttcttgttttttcttttgtgtataatgttcggccgcgcggtcnccgatatgtttatactatctttctacagagtaacggtgacggacgcgcggatgtggcggccgcgggcgagcgacatgatagtgaggtgactgaggccgcgggcgagcggaccagcgtcgcgcgacaagntaattatcagatgttattactcactagtacgactacgttatcgctcgctacatccactgcccgatatgagtaacttgtcacgtatgatctccccgctaacgcactcccacacgcgtgctcgtgcttcttgcgatattctgccatctcgcatatcttcgtcctccgctcgctccgcttcgtgtattccctcaaaccgcgtactcgataacgactcatcatggtcacctgcgcgtcatgttctatacctcgtatcatatcgcncacggcagcgtctcgccttcaccacgactatccctgcccgctccatctatcaccgctaccacgcgcctccgtgtgccatcgcgtatcgacccgattatcgcgtcattaatctnccttacacactccaccatgttttgtgtgcaaactcacctaattatagatacaatacnatcnaatcgccagcagcgtacacgcggcgcaccactttcggcgatgcagcgtagtgacgatagacgtcacacgacgattcgtaacgcgactacagaagccttgtgcgctctactctcccgtgacatccttgcagagaataagatgcgagctgcgcccgctaatatgtcncaggttgtcggtatttagatccatatgtatgctcgcttgagactncgtcgcccgcctataacgtaccgctcgcgtgattggtgtttctgcccgggcgcgtatgtctcgctcgtcgaggcgcggcgatattgctccccgcgccgncgtgcttaacgctgacagacgacacggctatgatctctaagtacacctgctcgtagatagtcgtagatcaaatacntagtgtacccgcgccgcgcgcttcgacgctctctcgcgtctattcgttcttgtctcgcacgccgcatctccgcgtcagtcgacagctg

SEQ ID NO: 12705 - DNA, 368 bp, Homo sapiens
tagtccatcgtattaataggctaaagaagaaaaatcacacgattacatcaagtgatacagaaaaggcatttgacaaaaatttaccacccattcataataaaaactttcagaaaatgaggaatagagggaaacttcctcaacttgataaagagcatttacaactaacattataaataaataaacctcaatctaaccttcacacattatataaaatgtaagtcaaaatggataatagacttattgtaaaatgtaaaactataaaagctttagaaaaaaaacataagagaaaagagaaaatcttaggaatctaggcctaggcagagagctgtcagacttgataccaaaagtatgattcaaaaaaaaaaaaa

SEQ ID NO: 12706 - DNA, 583 bp, Homo sapiens
ctgaatttatctgactccaagtccttgatcaggaagacaactcctaaagataacaatcttcctaaaggaaaatgggactgttttacaaggagccacagaatggtggatctgagaatccaacatagagaaacccactgcttcatctaccattatgcgcttgtatatgcatgacttcagggataaatgggagccagaagtacaaaggaatcctcagtagtaaacaaaacgcagaacccttcacggtttgaccagggtcattgtgtgtctgcctggtcatttgaccagctcttacgaatcaggaacccagctgaacctcagttgaaccagcccctccaacagaactgaggggatttggggctgataagctcagtgctatgtctacagccagtcatttctcaaagttgcagctttgtaaatgtagctatatttgtgttgcatatgatttctataatgtattactgccccacccctgcacatccttcagagaacagtaaccagccagggattgtgctgactggcttgagatttaaaaaactaacaaggtttccaccaaataaaagagatgtcattaaaaaaaaaaaaa

SEQ ID NO: 12707 - DNA, 667 bp, Homo sapiens
cgccgcgtctctggggcttgtgcggcgttccgtcgagcccccccgcgttgtttttcgcccgccggtgttttcttcgcgggggttgaccgcgctgttttttcccgcggggggtcctgttctgctgtttttgttgggcgcctggttgttccccccaccgtccccccgggttttgtggcttcgcggccgggggtgcttcctcgggcccttccggcccctggggggctggttcgcccccctttttggggggcggggggttttctcgggccttttgtttcccccgggggggggggccccgccttgggcccctccggggggccctgcctggggggggttcttttttttttgcgcccccccgggggtccgttttttttttcccccccgggggggccccccccctcctttggtccccccgagggcttttgtgttttttgtggggttggcttcccccgggtttttctccccgggcgggggggtttcctctttttttttccggggggggggttttttttttttggggggggggggggttttttttttttttttttttttgggctttccccccgcgggggggcggggggggggggtttttttccctttggttggggggccttttttttcggtttagggggggggggccccggcaaccaaacaaaaaataccctaccat

SEQ ID NO: 12708 - DNA, 370 bp, Homo sapiens
ctaggagatgacaagacctggcactgacccagagatacaagtcatgttttcaggatggaaaaaccaacctgtcgactatgaactactcacctatggaccagtatatgacggaagaataaactttgatgttgttgaaaaaaaaaaagaaaaaggaataaaaagatacacgcggagaatggaacaataaagaattaataaaaaaagaaatcccaaaaacaaaaaaaaacaggggcttttttgccctaaccgggggacttttgggccccttcccttttagggggggtaaattaagaaccccgcccaattaacccgttgccctggcccgttgggttgggggaaggggtttcatttccctaaaggggggaaatcg

SEQ ID NO: 12709 - DNA, 364 bp, Homo sapiens
ctggcacttgagctctggagtccattggctggagacaaattcaaactgcagtgttgccacttctggcatgtaacttggaagaattcatgtaactctttgcataccaatttcttcattataaaatagaagcaataacactttctccataatgttatcgcgaacattaaaagacataatacataaaaatgcctagtacagtaccaggcaagtagtaagcgacagatgttaactatattatcattctttttattattacaatcggtatctaatatgtcacacaatttccctctcaactttattttgtgttgctcattattactttcaactaataaaatgtctatgtgggcatgtaaaaaaaaaaaaa

SEQ ID NO: 12710 - DNA, 1052 bp, Homo sapiens
  misc_feature (1)...(1052): n = A,T,C or G
tttacggcacgcaaggacactatataacggagatcggcgatgtgggactaaccacgagagagactaaggctacgtcggcgggcgctcgcgcagcagaaccaggttttgggacatgaaattatacggtactggtagagtgaataaaatagagaagactttggatgagtggagtattatgggcttaagaaggaatcagtgccgagccgaccacagagagcggcctgcggtggagaagccggngggtgtcggtatgtatgtctattggttacgcggtagaagggagatgagaggaagggcgggtgggcggcgggggggcgtttcggctggaaggagggggnggggcgtaanngggggcaggcgaagacgcttcgcgaccgagaaataaaagagggacacgaagaaacagggaggggagtgcgagtggaatgagacgtgcaggaagatagcgggagttaatgggaggataggggtgcgatgataccggtcgcgtgtggtcgatgtggcgggtccaggagtcgtcggattgaggcatgctggatttggcgacaagagtggggggggggtgactatcatggagcgtgggagaataaagctatgtgaagttaatgaggcatcgtgaagacgaggcgtgacgcgcgacaggaacttgtaacttcctaacgacaacacgacggaaaatgtatagtcatactttcgaacgctgtcgcgcttcgacaggcaacgcgagagagtacgagggagtggcgatcgcggtcttatggagcgaagtgagagctagaatgggcacaggacgacgctgatcgcggaacgatgagtgtaacatcgcgtgaggaacaggggcaggatagtgttcgcggcgtgaggtgtcgctgtctggatcgcgagttcctggcctgacgtatacactataaatgatgagcatcaaaagtgtaattggtcgcacacagatcataaggggtctatggatagcaaacaatctatggagatggttgcgcgcgaaattgctctcagagtggcgagggccggcggtctctttcgcgtagacgatgtga

SEQ ID NO: 12711 - DNA, 1588 bp, Homo sapiens
  misc_feature (1)...(1588): n = A,T,C or G
gttgcgcgtcgcgcggntatacacttcctcagctctcactcgatcgtgatactactcgatcgtgactacggtgtganagtactgctgcgtcagacttcttcgtgcgctgatatnantgactatgtgcgcgcacgtcgcagcgacncgngncgacgtgtagacacgatgacgcatcgctatntaaccgagtactgtagtacgacgccgctgcgtccatgcacaganctgtgtcacaccncaatgtggacgtgtanactagatcgtgcgacctatcgangtacngganagatacagtcagatgtcagtgctgtggcgtcgacgcgctatctcgtgtgtcttcttatacaatatactcgatgtgtatctgngcgctcacatcatacgtgatactgatatgtactcnttcgatcngcatagttgtgacgtcacgtatgtgtcgtcggcacatgatgctccgtgagangataagagcggattcgctcgcgtggttcgtagtatgcatcacacattcgcatatactcgttcacacaccnatctacacgtgtgcacactactcgagccgtgtatcgangacagtaganagcgatgcagtcagacgctancggcacagatgcgtcgccncgtgcgtgtcgtgctattnctgtctcgtgtatctgacagataggccgctacgancgactgtgcgataccgcatgcgttggcatccgccacgcangcgtctntggcactatggtcgcgcgtgtngtgatacagtcgcatatggtgcgatcgtatggtgtaagagtganatactgcatcatagtcagatgacaacgacgngcatcaactctaataagatggagactacctacgatccgctnatggactccatcgnctgccaccatgacnactnatgctagtatgannaagactgcagatacgatgatacgtgtgagcgagcttggcgtggatgcatcggccgcgacgctgtgcgtcgatcattagcatcantttccgcgtaccgagctcaagctgcgatacctctgtaatacgcagtctcgcgtccaatactgcgcggctacagctgcgtgtgcggatagagtgtactagtacaccccgacgcagacgatcggctaatcccgctncatcatgtgaagtgcngcantgcgatagcactctggcgtgctagaccagaaagatacgncagnctgggacattcgtatgcgtagcgcgtcgtgccagcgactaccgccgcgtgtcgtgctgattctttcgcttctttcgtctgtaggacagcgtgcgcagcgctcgtaagacgatttacgcacgttcggtcatgcatctcgcatatccgctctgcctcgtagtgcgctcgcgtcgcgcgtgccgcgtccactcatnttcgatccgcgtacaatgtcgtcgtctgtgtctacttgctagcactcggacgatcgagagaatgtgcacttgagagaacgcaggatgactcgcgatgangctatggtcctcgtctggcttaacagtcgttgtattgtttcccgcgccaactcttgtcttcccgtcgttctatctgtttcgtatcgctctctggctgcatagtaatcgg

SEQ ID NO: 12712 - DNA, 1876 bp, Homo sapiens
  misc_feature (1)...(1876): n = A,T,C or G
cttgctgcgtcgngtgcnagacggcgcgtntctcantgctgcgctgantagcatgctntgctgnntcncgaccgtcgtgatggtctctcgtcgcacgctgancgcngtctgcgtcagctgggcagatgctgtcgtactgcggtgtgctctactctcgtgcgntcgttgcgtgtgcagcggctcnggcntngggcgagtcggctgtgatgtcgtctgctgcactgcagtgtcgngcgtggctgnngggtaggcgcgtcgatcgacggtctgtcatctgacgtgcgagtcttcctgtgcgctggcgctgcgctactcctacgtcntcgctntntcctcactatcagcgtacgtcgctcatacgngcggtgatcctgtctcgtcattcgtcngactcangngactcactngtccgngncagatctgcttagcngtcgtgctacggncgncgcgatgccgtgctgcgccgtcatctgtcattcngtccngtagtgtcgntntatgntctatgtcngcgctatacgnctgtagcatactgctcnacacatnatnatgcactcgtcgatgcggtacgctctccgnatcanttcgcaccgctggtctgctnctgtccctttcganccnctatgactctctggcgtcatctctcatcatactcttggtngagttcgtatgtgcttctgtgtcttcgtctctntngctgtgctcgtcgcttngctctgcgtntngntgcgtgatcgctnccgtgtcgncgtcgtgncgacctatcgcgtcgctnacactgtcacntngtgctactgcgncngctngccgttgccgancgctctgcgcagcgcgcatcgactcgtgatgtctcgcgtgtntatgtgcgtcctgatctcatgcgcgtggttgtangtcncgattgctgncgttgctcgctcgcgctgcagtgtcgcgcgcgtcgctcctccatcgtcgtgatcggtactcatgttcggngtcagcgcttggcgtctctcgtccgncgcgcctactgtgtctantgcgctatctatgtgtcgctcggttcgtgcgcgtcccgctgctgntgtngcgtgtcngtctgtcgtacatgcgtcatgtcctgtcgtgctcgcgtctcttccgcgtctcgctacgggccgtatcgctgctgcggcgcgtgcggcgcgtgcgctccgtgtactcgggtgtanctcggtcatggtctgtgtcgtctttcactggctggttgcctggccgcgtcggctgactggtctctgcgtgcctcgctgcgttcgttcttcgggtttgtcgtgtctctcgcgctgtgtcgcgcactcgctgtcctacctcgcgctcntgtgcaccatcgtgtcttctgtcttcgcgtcttcgtaacttctcgtacgtctctgctgtgcgcttgcgacgtgtagtctggtgtggtgtctcgcagtcgcggtcgtcgtcgctcttctgtgtggtgtgctgctcgctcgtgtcgcgttcgtgcnccgtggtgttcccttctgtcgtcttgctcgcttgcgcgcctgnctgtcgctccntgtgcgtntggttgtcgctcctgtccgcgtctactgtcgagtcgctncgtcgcggtctcctgcgcgcctgccttgctgtcgagtggtgtctgtgtgtggtttcgcgcgtcgcgctcgcggtttgctctcgctgtctggcctcttcgtcgcttgtcttcctcgctctgctctctctgcggtgcnttgttgtgccttcggcgtcggcgctataacaccncgtttgcgtngttgtgttgctctcgctccggagcgctctgtccgcgccncttgtcgtcgcgtccggcgctttcgcgtccctggtttcgcgtgcggctgcggcgtgcgctgcg

SEQ ID NO: 12713 - DNA, 744 bp, Homo sapiens
cctaagcatccaagttcatttccatcttcagcccttgcctcagcctgggtttttcagcctgacgccctcttactagatctttgcattgaagtccttggtggcattccaaggctttctgagaaaagtatccactgtgacctccaggcactctagctatggctcttttattattataacccctattattaacactatattattattactacgatcagaaattattttatgtttacttgtgtgcatatttactctctgactcccctccatgaggatgtcagcaaggcaggatcttgtttaccactatttccccactgcctccaacagggtcttgacatgctgggccagggctcacagaacatttgccgaatgaaagtgtgggtgagtgagtggaacaaggaatgtcccaggaaaaaacacttgaagagggaagcctgaagggaaagtcagtgtttgctgtatttgtcttaggtaggggacaagggacaaatgcaagagcctgggcaagtggaccttggaagcccgtccctggatgccttcatcccctgcaccaagcagccatggcgccactaattttgcactgaagatgtctatgtttcacttgtctgtcttccccaagggacttcctgctccttgagaaagaagcctggtcctacttgacttttatcaatgcctaacaccaatcaggcaggcatacaatagatgctcaataaaagagtttgatgaattaaaaaaaaaaaaaaaaaa

SEQ ID NO: 12714 - DNA, 888 bp, Homo sapiens
  misc_feature (1)...(888): n = A,T,C or G
gcgcgcacgaccaaccatgaccacctcattcccaatgaacaaagaagctggcagcgaaactgctgnctgttctttgcgcataacaccataatgcgggtgctggactgggtgtgtcatgtttcaccagcaccgagacactggagcacacgcagatgcagcgccctgaggaccaggaagcctctacatgggcctcctgcagctcaggacccccgccctgttcttggggagaccgactctcacttgttcttttctcttcctcttgagcccctcttttttttctacccaccctttttccacctttcaccaaacagatgtaactatttattccttatgccctagttttgctgcaatttcataaagcgcgaatctgctgtcctgctcccaaaactatacgaaagccgcttatacgtcactccacagagcagaagtataacccaatttcatttctatcgtctctaaataccccttctaagcccccggctcctcccatacctctccactttctacaccccgccccgctacgcccccccctctcgccaccccatacaatctcacgcccctacagccccggctctctccaccacagtcctcactatcatctccccatgccccgctcccccgcccatccccccatcccctcccacgcgtcttcccctcccttacacgctaccctccacctactcccactctacgccctcccgcggccctctccccctagcccgccctcttccctaccccgtccccacccacacgcccaagctccacctgctcaactcgcgcccaccaaccttccctcctccacacccatcacacccatatcactaccgataccaaccacctttcacccccaacatatacctctcaccccccacgctactaaccttcccg

SEQ ID NO: 12715 - DNA, 1591 bp, Homo sapiens
  misc_feature (1)...(1591): n = A,T,C or G
ctcttcctgcgtncntcgctcttnccgctcgcgcctcgcgtcgtgtgctcgctgcgtcgcgccctgctgtctgttggctgatgttcctncacgctgtcgctctnatgcgtttgttccgtgctcgtgtcgccgttgtggcgtagtgcgtcctctctatctgtcggcctgcctcngcccatcctcgtacgtgtcgctactcgtgcncgtcgtactgcgctgncncgtcntgcgtgcgttgtgtctgcgctgtcttgctgctgtggtgcgcangctgtctgngcgtcgcncgtcnctctgtcgtgtcttcgtctatctgctctgtntcncccgcgtctggcgctctcgctctcgcctccgctcgtgactatgtntgtgttgctntcntnctctttcgctcggctgtctctctagtcgtgtcttgctncgcgtccgcgtcacgctcctatgtgctctcacttctcggtcgtgtcgcgccggctcagtgcgtgtgagcgctgtgtctgagcgctcgctcgctcgcctcgngcgtcgctcgntagcgtcgctcgcttcgtctcnctgcggtgccgctgcgctcgtcctttgcttgctgctggcgtgtggtcttgtgcttttgtgcgcgcccgccgccgcgcgcgcgccgtcgctccgtccgtctgcctccgtcgcgtgcgtctgcgtcgtnctgcctccgcgtctctctcatccctcgccgctcactccgtgctcgtgtgcctgcgctggctcgctttgcctgttgtcgcaccgcgccggtcgctgcgccggcctcgcgnttgcgctctcctttgttgttcgcgttttctctgccgctctcacttctnggtgtcgttagcactgcgtcgtccttcgctggcgtcgtcgctcttttctttctcttctcgtcgcatctgccgtctcttctgtctgtgtggctgctgctgtccgtgttccgctgtgtctttgccgtgtctctcggtgttggttgtgcgncggcgcgtgttcgcgctgccgcgcgcgtgtgttgggtgtgttgtcggccgtcctcgcttgggtgtgccggtcgctgtgttcttccttanntccctaaacagaaaatcccttccctttccttctcttccttcgctctgcgtccgggtcgtgctttgctcgggcgccgcctccccttggcttcctgttgtgggtgtcgcggcgcgtgttcgcgcgcggtcccgtgcctgccttcgcgcggcggcgggcggcgtgcgcgcggcgggcgcgttggcctgttcgctttgccgcgtgcgctcccctgccgcgctgccctgcgcncgccggnncgtncgnnncgcgcgcgccgnggcgtgtcgcgcggggcgccgggccgtntggaggggtntctgnggttncgtttctgggtttgtgttgcgtgtggtttgtttntgctcgtggttttggnccccctnttggaggcgggnggttnntttntnnnttgtttncccccnnnngagggnnngnnntttttttctttttttntncttatntttttnntctannnnnnntccnnannnnnnatcntctttcttnatnntntnnnnnttttatctttttttct

SEQ ID NO: 12716 - DNA, 782 bp, Homo sapiens
  misc_feature (1)...(782): n = A,T,C or G
tttacctgagttgagccttctcccgcttcgctgcttcaaaaaatttccttccacttatatanattccatataaaatgggaatgccanaaggcctanatctttctgggtagttcaatttcctggtaattcccaattaccataaaagaaatgggttcctaagcactcacatgtttaaaaaactcgtcggtataaaattgggcctngnattaaaaaaaataataaaaaatttttggtgaagcctaacttaaaaaatctttttctggctttttttcctaaaaaaaagaagatcctgttcccaaacccacccttcctaaaggaggcctattcctatgtgttttctaattggagatgtggaactcactccgatcgccgcaaatgccaaacctttgtgggttttttcttcttgaggaattaacccaaatcgctaactaactagttgccaacttaagctaaaacaaacaattggcctccttcgcctccccaggggcctttccagcccttccctttatgaggcggcatccttagcctccctcatggctccttggctccgcgcttcgctgccgcacggcgtccctcctcccagcgcgctccgcgctccccaatcggggtcacccacaataccttggccgggcgccccgagcccacccccaaaccgccgtctttgcttttccttagcccccccctgcaactcccaaacccccctccccccgcgggaacccccccctctaactccccctttccctcgaattttggccctttatacacctccattccgaaccccc

SEQ ID NO: 12717 - DNA, 1565 bp, Homo sapiens
  misc_feature (1)...(1565): n = A,T,C or G
gtgcggcatcagatgagactcagcgtgtcttctgtcgcgcagttgtctgtcttgtcttaggtctctcgtcttgtgngtaggtgagagtttgctattagttgtttgtcttggtcttgtgtgtaggtatgtgtctgtataattgtcatcactgttcgattgtcgactgctggtgaggctcgagtgtgtgtaggtggttgcgtgtggctgaagtggttgaggcatctttgagttatggtcatatatctcgnctagtgactcagatcgtgtttcacgtgtggttcatcatatgatgcggatgatncacatatgtggtctggttcatttacgtagctgcattgtctgttgtatagtacgcgttgtgtgtgtgtgtgtgngagtggcggctgggancgcggcgtgagctgancggcngtcgctgtatgctcacgactgctgcttgtacattacgctcgctgtgnctcgtcggcgtggcggtgcgtgtgtcgtgtgtactgcgtcgcgagatagctggatgctaggtagctatgtncgctctcatgttcntctcgngcgtcnctcacacctgcgccgccatctggtaacgtctgcgagtgtaggntngtactcgttctcgctgctgggcgctgatcgttcgtcatctcgtggtgtagcgtactgtacgtgtagctgtctcttgtgtattatcttanatattatatttnttntgtgtatatttatgcgatcattatgcgatacgactantntcgantagtnactgctcgtctgtgcgtgtcgggtcggcgtcgggtacgaagcgtccgtcgcgcgancgaggagatgagattaacgtatcagttatgaaactgttggtgctgtcctcctgtcgtgctgaggtggagcgttctgtgtgttgtcgttgtgtttgttgtctggcgattgtgatgagatacgatgangctgactatntctgacccgcgcgtctatctatgatncttacgtacactgctacatctacgtctccaggtgaggctcggttctagcactgatgcgaagtcgtggttgtgtcataatntgcagctgatcgtagatctatgctgtgattattgtctgtcttcaatagttcggtgacgtgttctgaggcgtagattatgttgtactctcttatgcttgttcacgtcgcctcgtccttcgcttatattgctgtgtcttgtcngttctgtgtggatctatgtntgacgtgagagtggttctntgtagtgtgtattgatgagtaagctatgatgagtcgtctgatgagcngtgggtgcgtccacgtcgatctcataggtggtatgtatctccatatatactcgtgntgattaacaaagatctnctcaatatatccctatgattctatcacatcatcgtatgcntctccctctcnacggcgagagtcacatnctatttccaaaagncncctnnntcctctctttgtnngtntctntctctaggattctnnncttnnttctatctactaacttcatatactatatctatctattctttctataatattcantatatatannaattataactaataccca

SEQ ID NO: 12718 - DNA, 753 bp, Homo sapiens
aggtattacagtgttaagccgccacgcctggcctaaaatgtttttttaaattaaacccctataaattttccagatgatcaccttttgtcaaaggtcaataattaagaatggcgccttactaaagtgatgctttctttactaagctcctctctaccctgaatgcaagagaacctcatagttaggcaagaatatcatcaccccattcaacctgaaaaagctacagaagatggatcgtcatccctctgcaaccctcaggattaaggattctttcataaaagggagagggaaatgtcagagacatgtgaaccagagcatctccatcttaaataagagctgggtaaaatgaggctgaaagttactgggctgcattcccagacggataaagcaatctaagtcatgaagtcagcacaaaatacaggtcataatgaccttgctgataaaacaggttgcagtaaaggagccagccaaaaccaaaatggtgacaagactgacctctggtcgtcctcactgctacactcccatcagcaccatgacagtttacaaatgccatggcaacgtcaggaggttaccctatatggtctaaaaaggagaggcattaataatccaccccttgtttagtatatcatcaagaaataaccataaaaataggcaaccagcagcccttggggctgctctgtctatggtgtagccattcttttattcctttactttcttaataaacttactttcactttgcaaaaaaaaaaaaaaaaa

SEQ ID NO: 12719 - DNA, 387 bp, Homo sapiens
  misc_feature (1)...(387): n = A,T,C or G
ctggtgtggtaactccctcccttctgnacagtgcttacaccaaaaaagccctgggcttgcacatacagaaggtagccctccttccatcaccagagctccaagccaccacccttccctgcttctgctcctgaggctggaaccacagtgttacataatgctggccatggagatgcagagctgcccttgaggaggtcacagtttagagaaaccactcacatgtccttcctcctaggactgcatcatacgaaaggaaaattgatactataatgttattatgcataatttgatcccttgaaatcatgtctatatttatgtatgtttatgaagccataacatattccagaagaatgcaaatactatatgtattagtcttgaaaaaaaaaaaaa

SEQ ID NO: 12720 - DNA, 258 bp, Homo sapiens
cttgagggaactctatcaagcctgtgcaaactcctaccccatccttcaaagcccagttttcagtccatcttctccagaaagcctggcctgacatttcagccagcaatgtactagagatggctcacaccagctcacaagaaccaattgttaatatttcatgaattttgtgagctggttatggaacacaggcattattaaaaattaagttatgtaaactcacaagtaaataatttgtattaaaaactaaaaaaaaaaaaa

SEQ ID NO: 12721 - DNA, 777 bp, Homo sapiens
  misc_feature (1)...(777): n = A,T,C or G
cctgnagatgacctgaaatttgcctggaactcctgaactcaggcaatcctcctgcctcatctcctcagtagctgnaacttaggaacgcgcggccacaccttactntcctttgatattcatgagactatttcataaattggacatcttcaagaaaaaggggctcactccaacacacagactggagtgcagtggtgtgattatggagcctcaagcaatcctccttcctctacctctctagtggggtgggactacaagtgcgttgccaccatgcccaactaattttttagtttttcttttggagagacgaggtctcgctgcgttgactaggcttggtgcaagctcctgtgctcaagtgatcctcctgcctcagcaccccaaagtatgttggttggtaaaaataaaatacattactcacaagaagaggaaccggccggcgaacgacccgaggacccaaggtgaatatgaccggacgggcgcgcggcggggcgcgagggtggtataaggggggggcgccggggggggggcggcgacaatttgcgccgggggcctgtggggccccaagggggcatcttgggggccccttcttttgagggggggtagtcgaaagttcggttagtgaggccgggcggcggggggggggggggggggggggggatatatggccttagggggggggaacggttttcccaaataagggggaaaccccagaagagactgggcgaaaggggccagaggggcaacaactgaaaggcgccgggtcgggggggtgtccaagcc

SEQ ID NO: 12722 - DNA, 301 bp, Homo sapiens
ataccgttctctcaagctcttcgtgacctctccgtggggtcgtccatgatatttattggccaaaagcgttctcagcgaggtgcctattgacaagaaacagacctgttccctctatatgtcacctgtgttattttctgctccaccaacgatacatgtccatgtggcgtgctaacgccccgcgctagtgtatgtgcccctctctttatgcgggccggcgcatttaggttgctacttcgggattcgggtacgggggatgccatccactcttttttttccccacatatcgggaaataaaagcaca

SEQ ID NO: 12723 - DNA, 714 bp, Homo sapiens
taccatgctcattgagacaactcttgttacaggtctagagatgtgtcgtgtttcatgagagttatcggggggtctgtggttcatcagataaatcggcaaagaggtggcacgcaataatgtcgaatacggtgccaagctgtaacacgtgcaagttaaaaaaaccaggacagatcttatcaggccttcgcgaagtaaatgggtcttcatgcataacggccgctaaaaggaagtggaacgtgcctccagccaccgggtgagtttggaagtaatccttatccccgttgaaccttgtgttgacggtagcccacccgaagtatatttcaatgcagcaatagataaagaatataccagattggaggtgccagcatggtcaggaggaagaggctctcaaagaaagatgaaggttgcagaaatggtgctatggagatagcacatgctaaaggagtcttctaagcagcccacaggcgatacatatccagtgccagcagaggaggagaaccactgcttcagtatgacaaaaacttcaatgaatcatgctcaatgtggaaaagtcgaatagacatggctgaggataaaagaaaagaacgtacacataatctcactacccagagagaagcaatgttgacatatttctcttcctcaatgcagatttatatacttgttgatatttttactgtctgtgcaattttgctttaattaaacatttagattatg

SEQ ID NO: 12724 - DNA, 825 bp, Homo sapiens
  misc_feature (1)...(825): n = A,T,C or G
cccacccgcccacccaggaaacaaaaaaaagaggaaaaaaaacctangggcacggcctcctngttggagagccacaccgaggactgtatggaaaaaccacagggagagggagaaaccttgacggcacgggggaagagaactaaanaattnanctgacaatgagaattgaggtcccagcctatggtcccagttgtgtgttccagccaacatccacttgtttgaactgcctctatactagtaaacaagtaattaattagtacaaccaaattttttcaaggaggggggggattaatacaacgattaagtgaaaaaaaaaaaacatttacccaccgaatcgtgagcacatcaagtgtgccccccttaaaaaaaaacaaacaaatgggcctcgcctcccctcagccgctggagacctccgccccgcctccctctaaaaacgcctaaaatatgaacctccctcactaactcgctacacatagcccctcgtctccctatatcgttctccccctattcccaggcacgaataccgaaatacaaaaaacccccgacaccccaccgcccacactgttagcccgcaacgcaccacttggccccaaccattaacaccccccccgctcgaggcactccatacgctcacccccccttacaaaacatacccgaaatccgcgccccggccccggcggggggcaacgctagatgaccgtcacgtaaggccgcgagcgataatatcgaaaaccgttaccgggctctgctaaggcagcccccgcccgttaccggagacacataatccatttacccctccaacaccgccggcctttgtcaacgccc

SEQ ID NO: 12725 - DNA, 1242 bp, Homo sapiens
  misc_feature (1)...(1242): n = A,T,C or G
actgccacttagcgcgcgctcactctcactgcagtgactgtggacccccgtatctcaatcagagtagataagaggacatanaaactcacgcacctcctcatcgctgctatcccatccttcactcagtgatacacgcgcctangctcatagccggctggcggatctgaaaggagagataagtagcctcggcagttactcctatcgcgacctctcgccctcgaccacttaattgacctgctacctgcgtcgactcggccacctcgccactaccaccatccatagtctatacttacgttgacaccagaccacagagagagctacgactcatgccgtgaacggcgcgccctcgntnagttctacctcctaacatcttagattgtgctacactagtgccgagagaagtccggtgaaacaagagcttacctctctcgatgtcgctctactccgtgcccgtctctctcctactcactttctacctgcgcggtttgacactcaagtataccgcgcgtggtcagtgtgtgcacgcatccgtgacttgccttcattaacacgcgctacttcgttatacaactctcccatatactgaccaatacgagacaccacgcctcacgggagcgacacacaattgaggagagggctgaacagcgacagaaagaaagaaaaaagctatataactattttagtgtagtactttccgatactattctgagggtgtactttggcgcgagtgtatggtcctctcgtcacctagtttacgcctcactccctagtcacatatggtctgtttcgctcactctttggattcccgttgttgtatctttgatgtatagtcactaaatactgatgtatatagactatcgcatcttcaatcaaatataaattcatatcaaactccacatccgctcaccaggtatttattactcacccgcgccctctcgcttgcccaccatcgtgccgcccggccctcccttcagccatcgccgccacacccattgggcacgagcgccgcgagtctcggtctcagacgctgctcccaacgcaccgacgccgctgtaacgttcctcctacacctgcttcccctttgcgtcttttctcatacgcttgccttttgcttgtnggcgctgtcgaaaccgtcctnngttntgccnggttngnnnntataaagnnnnnnnnnnnnnntnnanttantatnttncnntnnnctccctnnnnnnnnnnnncnncnnnnnnnnnccccncccc

SEQ ID NO: 12726 - DNA, 134 bp, Homo sapiens
  misc_feature (1)...(134): n = A,T,C or G
cctggtaagcaacganaagatggcnctccaaagagagagccctcaccagtcaaggaatttcctggaatgcttctagaagttctcagtctcctgaactgtgcgaaataaatgtttgttctttaaaaaaaaaaaaa

SEQ ID NO: 12727 - DNA, 514 bp, Homo sapiens
agcgggaatagacgccgcgcgagaagaagacgcgaaaaaaaaaaaaaagcttatcttcctcttgatttgctgattaattatatagaaatgatggagtagtagtcatctgtatctccagaaactgaaatctaaggggaaggggctatgctcacatcaaccacaaaacaataaactggcaacttcagtggatcaaataagaagaaattatgcaagataatccatttgaaacttagcattatatcttatttgatattttcaaatgaaataaaattgtccagtatattaaacatgtgggacatgtaccttacaatatataattcttatatgtaagtcattgaaagacattttcatattgtaaagccctataaatggactgtttttttaagtagaagaccccccaatgtttaatttctccaaaatgatcgaagcctgtatggtcacacataaagatctcttcaagtagaaacaaaaaaagaaaaaatggcctagttggcctcagcggaggaacctttaa

SEQ ID NO: 12728 - DNA, 885 bp, Homo sapiens
  misc_feature (1)...(885): n = A,T,C or G
acatatatatatcgctccctccactctcactaacaacaaaagtgggggnagcacccttacgantaaacggtcacaccatgctcggctaggctaacctcaaactcctgggctcaacaattctcctgctttcggacacctggagtgctgggatacaaaactatatccaaatccccacactaaactgatcactatcaacaataaggagcaacacacaaaaaatgcttaacataatgttaaatgaaaaaagcaaaaacccaaactacaatctatttatatctccaaatattatagatccatatgtgcaaaaattccaaccgtaaaacataaaaataaaaaccttttacactccttggcttattgaaaacaaataaaccacccctaccactacatccccctccacaaaaccccccccccatccacctatcatctaccgcccccaccccccctcattctccccgctatccacccaccccttattatcctcccctccaccttccccccctacatatcttaaatatttcccccccccccccccccccatctccccatcctacctaataaccaaccataatcccccacccacaatcccctctttatacttaccaccctatcttcacaccatatcacacttctcatctcacaccaccccgcccaaacaaatccctcccttcccctcacttccatccattcacaattgntcctctttatcctttcttcccttctcgccctatatcaatcaaaaaataacacatcagaactcccccctaatccttattatcctatcaccctcacccgctatccacttaatactccccccacacccctccctcgccccccctcatccattcttccgtcgcatcccccccctaacataattttatacca

SEQ ID NO: 12729 - DNA, 903 bp, Homo sapiens
  misc_feature (1)...(903): n = A,T,C or G
gaggctgggctggcacccttctctcttgctgtttcttaccacatcttatctctttctctagaaccccgtcttgtctgcattgtctttttcattttgtgctgtttgtgtgttctcttttgttgttcactatcggctctgccgtgtttctgctagttttgtgatctgtagtgttgctgcggctcgactagctgcgatgttacctgtgtgtgacttgtctctgtgtgtttccgtcctgatggtggtgtcgtatctgcgactgtcggttgtgttattgagatctctcgatctgtctttgctgtctcttctttcagcctattcacggttgtgttttatctcagtttctggctcgccgtcttcgtccgtctccactccctgctcctcgtcctcttacgtccttcttcgtctttctttattcttcatgttgtgatggttgatgtttttacgagtgtcatatgatgagcttgtgctcgattgcggcgcgcgtccagtgcgacgtggcctgccatcgggtgtcctgttctgtcagtttggtggttgtatgggcttgtactgtctgggagaggttattgagtgtattgtatgtttcttcgctccttcacactggcgtttattgtgtttggtatgtttggtggcggtctgtctgttctttgcttgtgtgtttatttttanttttatccttgtgttctacgctttcctctcttttcttgggtttgccccgcgctttgtgttggtcttgctgacgtccgctcgtgcgttggcggggttctcgattctggtggatgtgcgttcaatgctatcgtcctcgaagcatccatgttttttctctcgtttttccttctccccccaacgtgccattttntagtctttccttcttaccggttnggtttttatnntnccgatttg

SEQ ID NO: 12730 - DNA, 883 bp, Homo sapiens
  misc_feature (1)...(883): n = A,T,C or G
cccccccccacccaccccccacccacaaaaaaaaaaaaaaaaaaaaaaaaaaacctgaataacaaccatctcgctggccgtcaagaaactcacctcacctgtaaagaccatataaattcaaactaaactcatccaaaaagactttggggcacaaaaaaaaaccaaaaactancacnactatctcttcttatatctcntaaaacanactttaacccaaaacactaaaaaatacatcaacattcccattttataatcataaacacatcactcttccaagaagatataacatttcacaatgtgtgtgccccaaacccaacaccacctaaaaaataaaaaccacatattactacaccctaactaaaaatactctcatacaccactagttccgtatttctacaccccactctcacccttacacacattatttaaaccacaaaacccaccccccattcttacacttaatccaccactttacacaatacccacctatcacaaccccccaacacattttttccaacaccctccacaataccccttctctctatcaacaaattaactattctcccccatctacccctctccttcccccaacaacaaaaaacccttagccccccttacctcaacaccaccccccccctcctgactccgtccctcttcccacaaacatcatttcactaatcctccgctcacctcactccccctctcccccacccacttatccctggaaattatactacataccccccccactccataacgcgtaacatcctcctccaccacccacctccaccgtgatataccccacgcaacaaccatcgcacccgccgccatctttcaaaatcccctcccccctcttcctcaccctcgctatctctccatccct

SEQ ID NO: 12731 - DNA, 1041 bp, Homo sapiens
  misc_feature (1)...(1041): n = A,T,C or G
aggcgggtgtgggaggacgcctagcctctcgggcgcgagcgctcggtgccggttactcgctacgtctgacgtgccgcttctctgcgttgatcctcgcccgttgtcggtgatgaatgcgcagggcttgagagtcgcgtgcgcgcgcgcgtcttggcatggcgcgtggcgtgtgtgggcgtcgtccgcggtcgtgagtcgtgtgtgccggccgggttcgggcgcctcgggcggtgcggtcggccccggggcgtggggcgtgtggcctaggggcggcgcgttcctgctcggcttggtgtggcgggtcagtctttctttccctgttcgccactctgccgcctcgtcgccgtagctttatcatcgccctcattttcctctccaacgattcccgtgtcgcccctgccgtctggcgctctccctattctgctctaattgtcctcttgtcgctctcgatcacccgcgcgtctcccactgccgccgacctttgcgcctccccccgtcgttaggtatttgttgtttgagagtgctatgggcggcgagcctccctgggggcgccttacggtcgcggtcggcccgctccgcggccgcggcggcgggtcggtgttaggtagtggtcccgcgagcggaggctgtctgggtgtcctcgccgctcggtcgtttgcctggtctggtcggctgttcgcctgctggtggcgctgttactangttatttctattctattattgttgttttcttntttattcctttctctgtctccgtttttttctcccgtccctggccgcgcacggcgccccccccgcccgcctcccagcctccccgctctttgtttctttgcttgcttgatttgtggtttttaggttgtagttgtcttatattcaagttcaccctgttccgtcatcctgcgcctcccggtatcccgtacaaaaatctattttataatgtcttttttctctacgtttttcttcctgggttgtcgtatttaaaccttcantctcnttggtttccttttaggtttttttcttttttnttcccaanttcaanna

SEQ ID NO: 12732 - DNA, 876 bp, Homo sapiens
acctcgtatatcaccgtacccgcacaacacacacgtaaaagatagaaacgtacgggtaacatcactgaaatttacttggaaaaccaagaatggctaattgtctcccattctatggagtagcacatttaaaggaaattgttaatgctatattaaacagaaatgcaaaggaagtttatgaatgtagacctcgcaaagtgataagctatttacagggagaagcagtgcgtttatccacacaattacccatgtccttatcaaaagaggacatccaacacattatctacagaaggaggcactagtttggaaatgaaattacagagtgtgataatggtgacccattctttcatcatttaacctatattctagacactatatgatcaaatctgtttaacaagattagttaccattggaattgtttctgttctaacataactctgattctggttctaaatcatcccccctttactccacacatatttatctcttcaacaaagattcactcacttgtccttacattataaaaagaacaacgccctctctcacatctaaatatactattatatatcccccagtcagcacacaagtatccattagcccccaccgccccgaaaatccaccctttttttcaccctcccacccagtgaggagagtgctgtacatgactccgccatgactgcgtcgccttcgtgtctccctattgcggctatcctctattgactccgtataagttccactcaccccttgcgcgctctcccaattatcccccacccctcaacaaaccaaacacgacatcagcatcgccctaacatcgacatgagccgctcaaattacccagtaaactcccggcctatctccaaccaccaaatatcgacacaa

SEQ ID NO: 12733 - DNA, 679 bp, Homo sapiens
  misc_feature (1)...(679): n = A,T,C or G
cgnaccctgtcggcccgatcgccttcaactacctgccggaggcccatacgagaccacgccgttgtctcctcacttctcccatacaccttatacctcctgttcttcatctataccgagtacactagaaagaatgaactcgcgctcattcaggacaacggtgaataacaaagcgtgcacaaaatgcgactcatttcttttattgctccctctacgatcaccagagggaatatactctccgggcaacaaacattatgatgctccacgccccatataactctaacccccccctatattatatactgaatggcatgtataaacccacacagggggagaaaaatgaagtactttttacctcaaaaatccccaacaaactgattgtttagaacgaggattcatttcccccccttactccatggctttttaatagtagacccttcttggctttctctcccgaaaaaaacaagaccttgggaatgataataaagccccccttaagggtcgggcgccccccccccctttaaccctgatttattgggcgacctgtttgaattcccatatgaagctcacaaacctgggatttttggctcccacatttttttcgaagcatccctcttaggggttttataagcatttgtgttcctcatagagaatgggatcaatgcatttctgggggtggcct

SEQ ID NO: 12734 - DNA, 1013 bp, Homo sapiens
  misc_feature (1)...(1013): n = A,T,C or G
cgtgttttgttgttcggcgttgcctcttttttctttgtctccctccttccctgttcttttcttgctgctgctgcgcttcgtggttccttcgcgctgcctctttcgtttctcgtctttctttctgttctttcgccgccctgttcggtgctcttcctgttgttcttgtggtttttgttcgtgctcgtgcttttgctgtccttcgctcccgctgttgcgcgttcctcgcctgccttgtcttgtggcgtctggccctccgctcgtcgtcgcgtcgcgttccgtcgcgtccgttttgtctgtgtcgtctctctctcctgtgcccccgcgctcgtccctccttctcgcgcgtctcctgtgcgtctgcccggcttctctgtcgtgcgccctcttcccccttcctcgttcgcgctccgtgcccccctttgttctcctggcccgctccctgtctcgcgccggcctccgcccgctcgctgcttccgcgcgctcggttcgtgggcgtgcgcgcgctgccgtgtgcgcgggcccccgcgcgggcggttgctgtctggcctcctgcgtgcgcgcgcgggccgtgggccgcgcgccccggcgctgttggcgtcggccgcttcgttccctttccggcggccgggcgggctgtgtcttttctcgtctttcgcgtgtccgcgtcgcgctgttctcctgttccgccctctcccgcggggcgcgtgtcggcttangtcttggtatttgtttttccttgctggttctatctcctcctggctctgttctctgtgtcgctgtgtctctgtctcctgcgcccgtgttcgccgtccctgttttcctctttgggttttgggttcggcgcgcgtttcggtgtctcggtgcctggtgggcgggggctctcggcgccggtcgcctgtcgggntcgcgctctctcttctgtgtctcttcttctntcctccctttaaatctttttttctttcttcctctntctngctccnccctcccncccnggttcttttccgcttcacccc

SEQ ID NO: 12735 - DNA, 505 bp, Homo sapiens
tgtatgtggtacaaggccaaagaagagatatgctagggccatccacgtgcctcacagctagatggacggctctgtgttggtgctgtctttggaacaagttcacctggccagaccagcccagctgtcctgtcatgccagctcagctcccacctatgacaggtgtgcatgcccccatctcttatgattggtgttaacaaacaactagcttggcccatacacctttaccttcagcagtatgggattatagattaatgggggtcgctactgtttaattcactggcttgatctttttaatgtccacaatccaatttttattgatcattaaagatgtcataaatgacttttttggccaacaggcttagtatgtgaaacacatataacttttgaattatacattcaaggtagggccaaatgtaacacatccatcatggaatgatttatccgcttacacccgcccgtatgtttcaataactttgtccaaagtctcaaaaaaaaaaaaaaaaaa

SEQ ID NO: 12736 - DNA, 904 bp, Homo sapiens
accatgactataatcgaattacccttggtttctgtaataccccaactttttactatagccgatgagccgatggcgctggatgaaagctcccgcccgacgactcgcgcacgacgggtggggcaggccgtccgccgcgaaccggtgaacgccctccccccgcgatcttcaccccgcactatactctcacttctcccgttttctctcactttgttccccttcccccgtgccccactcatcccaggcggaaaatagagaagtagaatttgcaagtggctaccagcgggtcatctactacacaaccccaggtaatgcagcatcttatcgacacacacgtgagcgttgtacgcaaatcacccactatgcactctcacgatgtgaatcccactgctgtaacactccggccacgccctactacaccgcctctcgatgtggcaccagcaaccagtagtgcggaattaacatcaactattatcggaggaataacgtgtcacactactatgtacaatactacatatagatatctcgtttcggttatattttaggagcgttaattatacacgtaatcttcgcaatccgatattgtgaaaagtcgcgagtgactacactcgggccgatcgtatacaaattatatttcgacgaattgagtatttatcttacacatggacaccgctatctctgtgcttatatattgtgaatgaattcccccgcgcgtgtatcggtattacatgtcatgagccgtctacgtctaatacgtgaccaccgctccaataacctcgtcaaagtgatgaacacagatgagggataggatttatattgcgcactcttttagtacgcacgccgctaaacgcaacaacagttatcatgtatggtcacactcgcgcgctaggttaatacacggtacctt

SEQ ID NO: 12737 - DNA, 747 bp, Homo sapiens
gcgtacgcagagaggggccctcgtccctctatcacggctcactggcaaggcattaacgcggcgcccgcccagcctagacacggtcaattttgctaagcatctccgccccactcctgcccgctctcatcccagccacaagcgaaccatcgaagaaccctctcaacggcggcacacctctaccctttcatagcacatccgagaggcacgagctattacttaagcggccctcaaaattcctcacaaaaccacctgctcgatatcaatcccgcggaccccttcatccaactttaataacaaactcgacccacataactattccggcccgcctcgtacattcacgtataccactgtagcaacaaatgcgcccgatccccacccgctccgcgtgacgaccccctttcgctatgatgcccctataaacacgagcggtcaatacacagcggtataggagccgataaccggtgcctgcgttttgtcgacattcagatacaacttcgatccgcgctccggcctcgcgataagcattgctatatcaaatacatcgcatcggttgcctcgcccgtcaacatctacatcgcacgagcgtatccgagtcccacacagtgcgaacagcaccgccggcccggttcatgagcgacattaacaccatagacggtcccattggagagacaacgcctcaccgacgtgtcgatgtctccaccctaccgtctaagcatcaacgcgaaatagccgcggatgtcgagtcgg

SEQ ID NO: 12738 - DNA, 1832 bp, Homo sapiens
  misc_feature (1)...(1832): n = A,T,C or G
atcacgctcctacataagccacgtgcccgcgagcacgacgcgcaccgcaccactccacactntcanatgctatactactactcatgtagctagatgatcatgcatactacactcgtcgcatactcggcgtctctcattacatactcacatcgcgcagatacagcttaggctacatcgctacctaaactacacagctaccgtatatatctagcattcgcttactattatgttgatcgctcgntncacctncttgatatggtcgatgtgctctcatagacgcaggtacagatgttcgtgcnatctgagantgctcgtgggagtatgtaggtttaccagctggntacacttacatangctctctgcacacagtgaaagtgctaagagagctagngttctcncncnacgacgcgccatgtgagccactntcagagcngcgtnatcatggagcgntnacncagtgtgtgtgancaagagtcatcacgctgctactatattgcgcatcatgacgatagacgtgagagcncgcgcnnncatacattcaagcgagcactgcgtctnnagcacactgtcacgcagcgtctctcgacntcacagctgacagtcgtctcactaccatagcgcgcncgccngangagtcgcatctatatactctccatacatcatcagcgcgtatacacatatggatngtctcnctctncttcaccnccacgccactacacacgttacatatccataagcaagagagcacagtacaggtattcncatngacatgcntatgctgtnctncntcatgccngtgcgntctacntgtntcgtatgtaatgcagattgtactctactaatgcatctacgntatcagcgtcncagcngttagcanagtcaagagctagtcgtacagnactctcactcatcaccgtcctgtagctgtgttntatacttactgatactantagcgcgtntcnaacntcgagcngncaactgntagtcgatgcgtnatcngactagcgtcntcctcagtcacgttccntgctactagntgcgcnatcgatcgtcntcanncnnatcgacgcgagtngacactgaaatttacatcgtcatctatgctattatcagtcncnnagngcntcgacgtcgatagtcncgatcatctcnncatnncncgtcatgactgnncnnagtangncaggacgatcgacgattgntcnatcgtaacgtcacganntnncgagncgnctantacanacgtacangcnancccatctngctcnganctntgctncactcgtcgntncnctncagctgactatctactcagctgcncgatcnntgatgcttgncctgagctgtctcngatatgntacgttacatcnctcatcgcacgtcagtntgatntnatagcagtngttgcagtcacgnnntcntaatnagtactgcnatcgnctangtcagtcgacgtncacntcgtcgcatcatnactagtagcngcnantgacgntgatgatngcagctggagntcatcgagctcntcgncnncncnncantcntcagcgtgccactgnagtcgtagtacgctgcgcnncagcttggggtgntaggtaacgtcagcagncgatcnttatgcagtgangtagncanntannatgtaataggancgtctgatcacntcgtcngcnncncaagctaacnncgcagtgctgncagaacggntcgnacnntcgtgncatcatgacgtatgtngctgcnagntcctcgtcacgcccttgcaacnttngccncntgctagatcacnatngcagcantcnatacgancactactactgactacgantcng

SEQ ID NO: 12739 - DNA, 811 bp, Homo sapiens
  misc_feature (1)...(811): n = A,T,C or G
aggagaaagaggggcaaacaggnaagcaaatgnncacaagtcccgcggcacaaaaacgcacgtgccagcatcacctgttgtaaataagttcggctgcacgagttgggacccatccggtgctctcccatagctgcgcctgcgcgcgcgcagctcccgtaatcctctgaggggagcgccccgcaaattactctacagaaacagcagcttcatagaacatcaaactagggtacagacctttttttctctggcatgaagcagaaagcaccacactaacagcctctcaatataagaacaacaacaaggcgtggaccgtaaaggagcagcacaactgcaggcccgtcccantacacaaaacctcggtactaatcgcgattcaagaacaccccgagaatccccccttactcgaatcccgaaaccagagccacaatggcgagccacagaagtaccaatacgacctcgccacgcctatacaacacacaactaatacgccaaatccggacccccccccacggcagtaggtctccaagcctaacgatcaacctaaggcctaacgaacggggcacaaaccggccctctctccacaaggtcgtcagctccgcaacccacacgtcctcacagtacacacccccaacgcaccacaagcggacgaacttacgccacgcgacccgcaagtcggcccaacctgtcgcccacnncaaacgagagaagaagccctcagagcaatcnacagaataacaccaaaacagacccccaaccaggacactccactaaaaagcaacacccgcacagaacgccacaacaccctccagct

SEQ ID NO: 12740 - DNA, 1675 bp, Homo sapiens
  misc_feature (1)...(1675): n = A,T,C or G
accccattacacgggcgggagggaagataannnnnnnnantgtcgtccctntgtactcaaccggagctatttcttttcttttctcatattcatcccatatcatacctattataaatccgctatctaccctgccgccaatcgtccacgtcacattattactagcaaattctatgcaaaccgtttaggttactcctactgtttcgtcatatcctcctccctagtatccctccataagatgatacagtaaaacaggagaacgtataagagccaggaagggtgcaaaatgaagttaaatgcgcgccgcaacagtgaggctatacgccgcttcgacgtggtccgagcgctaggtgatgatgtggaaagagagccgtcactctgntggtgggtgaaggtaacaggagccacgagggcaccacaggtttagcagcaggcagcggatgaccggtgcaagtgtaatccagggaggtatcctggtcgtgtcggttgtgtattgtagtcctatactccgtgccctctctcttttcgctgttcatctacctgtctgctgtctatgatccttatatgtgtagggaggtaagagaaaagacgcatcgtgattattttatttataatatatgtaactatacatattacactcgcatatttaatcatataccgttgctttcatgagctataatatcgtcgcagcgttgttcgtgtggtgtccactctcnagatatcggcgttttgctangaggccactcattccgcacagtatgatccgcactatatgacgcgtgagtcgcggtcagttattttgccgtttcatgtgccacgcggtacagcagattggcacgagtatcgttacatcaggcattaatcgtagtccactccantnagttaagatctgtcctggacctaggtgatatcgtaatagttggatgagaaacgagnctgacattagtctagcgcggatatcatagtcccctgtttatcctcttgcgtcctgcgttacacactgtgtcatctcggcttcgtatgtgtgtatatcatattcttagttgcgtgtaactatttgtatatacgcgaatattatcatatagcgaggtacataatnatatgtataaaaccgatatattatcgttgccgtgcaccgacgacagtagttttatatnccatgttctcacacgttattacgtcagnagccagatagcgaagtttatttttgttgtaagttagtgatatgtcagatgtatgaattagtgttgtgttagtataagaggaatttgcagagcagatattattgtgtgagagatctatgtcgtatatatgagtatataggagagtggagtggccacagcagagatgagataggatgagtcaatcggaagatgtcgtgattgaggaggntgcatgagtcatagtnatattagtatgagagacaggcgactgacaataattancgagaggtgatcgatttcttctatatgtgntggcgcgatggtgagngncgggtanagtagccgcnagcgtnttngtattnaatgcgttatgtgccttgatgcttgngtactacggcgacccacagctntgtagcacgncgagtacatgtgagagtantgtatcatggtgttntctgcgctcgtctatatgtccggtacctgatgcattcgcgctttattaatgcgaccagtat

SEQ ID NO: 12741 - DNA, 166 bp, Homo sapiens
agtcggttcctacagcccattaaattggttcttgttccacctcattgtgcagcggaagtttcaaatcagtttaattaccgtgttgacatccagggacaacgcaacatgtcaagtggattctaatggaggccttgtgtttactgtgatggtgtctacaattatcaat

SEQ ID NO: 12742 - DNA, 2043 bp, Homo sapiens
  misc_feature (1)...(2043): n = A,T,C or G
gggcatggaagacggcctgcccatagacgccggcacccgcctcgcagttttctaggaannnggngngtggngggtatgaggataacacgggntccttccccttcgnggntncganacggtcctnncgnannaagnctgcatnnatggncncatnagnnagacnctgatgcacnagtgtgaanatntggcttgaacgncaagatacgagatggcgtgtgctnganactaccanacgagttggctagcgcacacctttgagagtctgcggcgagtagggacgtgctagctgttcagtggcgaggcgccggcgccggcgtcgagcnggnggacagcatatcggcgtagaanngttccgaagaaatgagatgtatgagntgggagaggggagagtaggagttataaaaccacagtatccaaatatcataaccacacgcagcactagccaccaatgttctntgtagtacaatacaaccaactatcgcgantacacgagtcgctctntaacgtcacncttcgatgtgctcntctctttcgcgctcgccgcggttcctgccgagngtgtggntgatccatctcgtgtcaccgctgagcattgtgacgagacgtactgtggcagttataacagcagatgatgcaggatgcgcgatcactatacagacgctcacatgccacgcgcgatatcgcagcgcacatataatggctgcggttcgtagcanacataggaatgtgacgagcggttcagatggacancgtatntacacagtgtgatactantacncttgtgcgctagtatatgtatacgctcatntggtgggtacttantcatanggatgatgacgtgtaagtagtagatgtacgtgtgagtcnacagaccgacaatacgntctatccgcgtgaatntcaggccactacgagctctatatcaccagacgcgcncgcgcganttcacgaagacagcgtcgcctcgatattagatcaagtcggtgtgccgcgcgctctagacagcacttaccgcaatcaaaagagtgtagtgtcgcgagtcatggatgaggtagtaagtattanatcgacgtgctctggtcatcacacacganctgtctcgcgtagtcgccgcatggacacgcaaacggcggtgcgtatgnagtttnagcggtanagcgcgtgcgacagagcgcngaagtnccaacagagtctacgtgacgctcgcgtcatgagcatatggcggactgatcatgcagcacgctccnctattgtagtcatgttgtctccgcgtcatagtgatatacnatcntcgtgggggtactcnctatcacagagagcgntcgactacactatcaccatatcgatcatacagcgagatatncagcgatacgtactccacagcggcnatatcggcantatgcggcggctgaacatttntctatatcgttctcnactgggcncatcatcatgtttagacgcntcgcgagnccgtgcnatagatgtatctnatgtccgatcncagcatgtaccttaccagtcgaacncacnctgcaancagagactgagtatagtgagcttgtggtagtgtatcgtatataagcggcacggtagtnacgacgtgaagccatgttgatnattgtacnaacgcnggntatagacgatacgcgacacgcgcgacgacaccgcgaagccgacgtagagattagtgtacaacgtgctgtcatangtgngcagcgcgcgacacgggcncgnagtgctgtgtgatactgtcgcggtctagcatcgcggagcgcgagcacacggcantgcacgacgcagacngttcgtatggcagaacggcgcacgagacactgcgagacacatcacaactgcagatagaaggagcagantcgtgtcaacgcaccatgtgagcgtatanatcaatctaacactatntataaacacaatgcgcagaccgcgactctgtcantcagacacgtacatcganagaaataatgtagtggggtcgtgtcacgatntagtagacgagaggnatgaaagatgcgacgcacaacacgcagt

SEQ ID NO: 12743 - DNA, 671 bp, Homo sapiens
tctctaatttctcaccgctacaggctcctcatccatgtttatatactcacctaggttggttccacgcattgcccatatgcaggaggcagagggacataagttttaatgacctttgcgtgaacacgaacctccacatgggctagaccatgagcggtctcaactatgtgccttgcacatgattgtctggtggagggcccgcaggccagcggtaggaaaaagaagaggattgaaaaacggccaacgcctaaatactctttcggtggtgccgtttattctttattgccaatattacaaatgcttagaccctttttccgtgccagtttacaaagacctcagatgtagagaactcacgggtgaaatacctgccgactcatagaacatgagctaaatgatccttacctctcatactttctaatggatgaaacgcaggcggaggagctttcttattacccacattcactgcttatgcacgacaggttatctcgtgatgccagttggaacatgaattaagccaagaacgttatttagttatccttcaaagctcaaaacaacaatgggtaaagtatgggatgccaaaggccttaatgactctggtgttgtagcgagccattgacacaagcaagaaagaagtgcccaccgccccccaacacagagaaggtaattacccttaa

SEQ ID NO: 12744 - DNA, 513 bp, Homo sapiens
  misc_feature (1)...(513): n = A,T,C or G
aacattaaccncatgggcccagtttttgnaacttgtattaattanagttccccggacnccggtnnagggtaaagntcttcgagntccagcccatagtcaagcaaggcaaaagcttcttttataccatacatggcagccaagacccaggaagtgccagcctcttccagctggacccaagcagtggtgtcctggtaacggtgggaaaattggacctcggctcggggccctcccagcacacactgacagtcatggtccgagaccaggaaatacctatcaagaggaacttcgtgtgggtgaccattcatgtggaggatggaaacctccacccaccccgcttcactcagctccattatgaggcaagtgttcctgacaccatagcccccggcacagagctgctgcaggtccgagccatggatgctgaccggggagtcaatgctgaggtccactactccttcctgaaaggtgagaggcctggccatgagctcagaggatgggtcaagatgctttagaaat

SEQ ID NO: 12745 - DNA, 789 bp, Homo sapiens
gctgtgttttctgggctgttctggaacttctggcctcaagcaattctcctgcttcagcctcctgaagtgctaaattacaggaagaagagctgccaggtcctgggagaacaagaacagtgctttctccaaattttaacaggagtacacggtgggagtgagagctagttttcctgtagaagaagctgaagacagagtaaaaataattaactcatgggaaaaataaataaacaaacaattggactcagccagaggaaaaagatagttaaaaccaaaacatgtaacgcaacctagaacagtctgtgtaatctagcctctgctgtcaacttaatctaccatcacgtgccccattattcacggggctccaccttgtattccagttgttcctctctggaacattttatgtcttttctctctgagggactcagctcttggtatttgccttgctcagaaatttcttccatagatcttcacaatggccggcttgtcttaggtcttagttcaaatatcacccgctaagagagaccttgcctgacttccactatatacatgggagggtttccagaacaaatgaaggtattgaacaaatgagctccataaaatggaaaccgggtgctctgcttggttttttagacaaatgggaaatagcggccctcacacatagagttgacattcctgagattatccagtagatctggacttttggagctcttagtctaaatgtactgctttccaaaaggagtctgcaaagggacctcttgtatttactactgggcccctcaatttgtatca

SEQ ID NO: 12746 - DNA, 799 bp, Homo sapiens
  misc_feature (1)...(799): n = A,T,C or G
ctggtgatcgctgcatcattatctgtcaaacacacctgtgcctatgcataatgttagcttggtgctttagtgcaccctcatattccttctggctggaatggaaatagtattaacttgaattggaatgtgtgctcagagacctgcaagcaatatagtcctgggctagtttggagccctactgagcctcatatcttgtgaaattatgaagagatgaaacaggatatttccctgacctttttgcaggcaggaacgggagtgcatggatgccagcaggggcgaattccatgaattccacccctcatcggaggagaagtgcaggtgaaaaggtgcaggagctggggcaagcacctttgggcaccatcaagagcaaactccatactggccccacggcagcatctagggaagggtgcctgagatcccagaagccccagaagaagtgttacagtgccctattagcttttctgtctgtggatggcttaagtgttaacagctcattggagggtcagtgtcacagccttttgcaccgacactcatggcacctgagttcttgtccggcatccaggaggaatgaggttgcttggatgaattgaagatggtaaatgcagaagattttattgctggtgaaagtggctctcagtgggaagcagagctganaagaggaccgtgtgggaaggtaatcttcccctggagtccggccagggacagactcttctctgaagctgttccaccaagctgtccatctgaagtcaagcagcttccctcggacatcgaactgtagtcccagatgtccagttccttc

SEQ ID NO: 12747 - DNA, 2225 bp, Homo sapiens
  misc_feature (1)...(2225): n = A,T,C or G
ggcccccgcggaacagagatgcgagcacgagngcacggaggatcagctatgaaatagaaacttgagaggacagccacagagnangnnnnttttncagganaggcgcaacacngacncagacagacanaaacgaacagcacaacagnnagattttttcatccagagacgagagagaggcagagcaggngganagcnggntgnagagncgtgaacgacggagggagnacagccgtangcgatgacgaggccatcgcgacgacgcgaccccgatcgacgtgcggccgagcgcggttgnatcgctgtggcgcagcagggatngagcagcgatgngtgaganggnagnatgatagngangacagagcagttgtngtacgggcgaggncgaggcatctggacgctgagagcggggncgcnagcgcgcgacngcgcgcgcgcgcgtacgagcccctgagcagacgatngtgtgcggtagcgtagaggcagagagagcgacnacacgcacgctgagcgatgcgacgacggttgaacacacagnacagcactacgcacncgaggcgtcgctgacgtgactacgctcgatccgacancgntccgcgcncgtgtgtgcgtcacgactagagngatgagaagatcgcaggtaggagcagcgacgtagattagatagtangagacnatngcgcgngagangacgccagcgtacgacacgacacgacggcgcaagacgcgcntagatctacaccgactgatgagcgtaaggacaggccggagaaggcgcgagaggcgcgtgcagatagaggnagtagagtggcggngngatganggtagcgcgagagagcgagcgtcgtgatgtacnacncacnaggangacaccccnctacaggacacgngancacaagcacgagttgggatgtaagcgtaccgccggaggcgcgcgtgangngatcggacggagcgncgtcgctgcgtgcgcggcatgcatatgtcgtggcggttgcgcgtcggcagagacggcgagcgcgatanctcacactattaattnataaanagngagggnggaaggcgatcgaggagcggcgcgcnatagcgcgagtgcggcgacgagnaacacgacacagnagacacgagcagagcagccnctgcgcgcgacgcgcatgcncgcgcgcgcgcaggacgggcggggagagcgcggtatgcgtagcgggacgagctgagagcacgacgcgtgcgaggaccaagcgcangcgacnacacgaggcggcaccgcgcactgcnctccacatgtcgcacncacggtcgcnaggcctgaccgccgcagcgacgcgggngccacgacgctcgacgcgcgcgttagccgcacantgcgagcgtcgtcacggagcggtgcgcgcgccgcgctcacgagctgcgcagacgacgtccgatgaacacagcgcgagcgcgaggcagcgtgacgcggagccgcgacgcggcgcggacggaagcgacggcgcgcatcgatgtaccgcgcagaacacgatgaccagccgagtcagaataacgcaaatcgcgtcgcacacgcaacgcacgccaagcgtacgaggcggtgtagcgaagctggcgatcgcggccgtcngccacagtgtgagtcggagctagttagcnaccacatcgggccgcgcgcgcgcgtagtgatgtacgccagcggccggctgagcgccancacaccagaacactcatcgcagtacaagagagacgcggacactcacagagctagcgacgcagcgccgcggcggcgaccgcgccggcgtatgtcggcacgagcggttgcggcacgccagacgcggcgcagcacgcgcggccggcccaggacacgccggcgnagacagccggcgcagacgacccgcgcagccgcattgcgtagaanaaggtaagacaacgctatgatgggcaagacggcgcgtcgcacgcgagtgcgtcgaacgccggagggagagcgcctctcatatcatccgcagccgggcgtcataccagtcgcacgagacgacagcagacagcgcgcggcgcgcacacgatagcgcgagtacgcacggttgcgtgcgaggcggcagacgacgcgcgcacatgaccgagccgtcacgcacgantnagaatacccacgcaacgcgcgtcagcggcacgacacgagcggttactcgatggtctcacancntacaccccacacatacgccacgaccccgcgacaagcg

SEQ ID NO: 12748 - DNA, 812 bp, Homo sapiens
  misc_feature (1)...(812): n = A,T,C or G
aacgaccgcaccgctcacaattaaaaagaaaaaaaaacctggnaggacgaggaaacctaaccgaaaacctngacctcngggccaagaagcagagcccacatgaaacggagctcgccttcaccctcagagccaaagaccatcaaaaggaagacgcacccacgcacaccaggccaagaacccaccactatacgactcccacctacactggaggccgaggcaagaaaatagctagaacaccggacgcggtttttgcaagagccgatatcgcaccactgcactgcatgactgacagacacagccagactccatccgcaacgataaatacaccaacgacacccacacccccaactctaaggccaggaaatctatgaccgaaacataagagaaactaacaaaactaaaggaaccaaaacacgcaaccacacaacccacccacactccccacggcccaagggataactcacaacacgcatgcaactaggagaaaaacaacccaaaccaacacccacaaccccccccaacaacaaccaaccaacccccaatcaaacccaaacaacaaaaacacacaaaatacacaacaaaacacataacacaaacaaccaaacacacggaccccaccccccgaacatagtacgataagcaaaagaaaacaacaaaatgcaccaataaaatcacacaccacaagcaaaaaacggagaaaccaaagagaaacaaacaccaccaccccccccccacaccaaccctaccaacgcaccccagaacaccacgaaacgacacacacaacacacaaacaaccacatacaacaaaaccc

SEQ ID NO: 12749 - DNA, 1473 bp, Homo sapiens
  misc_feature (1)...(1473): n = A,T,C or G
cttgtcttcgtgttcgtatgcgtctagattgtcgtngatgntgctgttctgcgttgtgtnttgtgtgtcagttgctgcnggtgtgngcctgcagatgangncancctgcgtgatgatgactngngcgcgtggtgtcgtcctgctcgacttcacacttctcgctctgttntcgtgattccttgtgtgcgcgtgcccgtctgacgtgttcgctctctacgcgtcagctgcgtgctgttcatgataattgtgtgttatagacacagctctctattcgtgtcgcgtngagttgcgttcgngtagaggcttgcgcgtgtcttatntcaccatctgangtgcatgtgcttgacggttcgcgacgtacgctcagcgtgatgatntacngtatcgggcgactatctcctttatgcgtgctatctactctagtattgcttataccgcgtcatatacgtcgtgcgcgtgccgataatggtactcatcgagtatacgtngtggcgtnctcgcttgtgcacgcactacacttctcgtacactgatcgtccggatctagactatacgtgataattgagtattcgtcttctgcttcaggctggctgttntccgtctgattctcttgcgtgtgcgtatcatctcacacgccgtgtgtgatcttctcctgtgctgtccgctgcnactgacgatcgagtgacgctggcaggtgccagagcgctcgcgttcaacctgccggtccgncgcacccgcggattggttggtcatgagattgatgtatgcggatagtgtgtcggaggagtgtgggggtgctgatcgcgcgtgcggtaggcgaagcgaggctatcgatatgcggatgggtgntggtatgcgtcgctgcgttcggaataaacttagatctgagttacagctataacgttacttcatgtgtactagtgggtatgctttgttctgtcgagcgttggcttagtttgatagttctctctgcgcgcggttactgccgcccctgcagtagtcagcttcttggcgactggcgctccacttcgcgcggcgtgttcgacgttgtgcggcggcgtggctggccgcgcagtgtgtgttgtgacgggtcgcgtgtgggttgcctccatctgttgtgtgtgcggcggtgttaagagactcgtcacgtgataccttccggtcctactctgacaagtatagtcatacgaatctcacagcgttgtgcttcaggccacctgctccctatactcgctctctctccgtttctcactcacactttcaaatcttnctcntggtttctcttctccgcctctccctcatatntcgtctctcaatcagggttctcnncncctacnggacacccccagcctcctctcttttgtttttctccgtctaaagcttttctnnntctctctcttactttctttcctttctctcttctcctctctcccttcntctctcctccttcctccctctttnnctcttttttatc

SEQ ID NO: 12750 - DNA, 233 bp, Homo sapiens
gatcttaccttaagaagagtcttttaagcggccaataattcagctaggagaataaaaccatagattttgaagagcacagatccatcactgaagaacaataagaatttatatcttgggtaaaaatatttgtgtccatctattccttaaattgtcaagaaaaaccctaatgcctgagttttaaacaatgagtaaaagaacagagctacattgttctgtgaacaaaaaaaaaaaaa

SEQ ID NO: 12751 - DNA, 299 bp, Homo sapiens
  misc_feature (1)...(299): n = A,T,C or G
atgagcctcttggacaatgaggtgactgtaaggatggagattaattcgaggacagtggagtggaacgatggaggcctgatgaacgtgaagccaccattttagccctgggctacctatctctgaaattattttatctgacgagagaaataaacttctattttgtctcagctactattgttttaggacttggctatgtcacagatctaaaacccacttgatttactcctgcaatcaaaatatattgacacagaaaagacaacaaataaatcagtggaataaaacgganaaaaaaaaaaaaa

SEQ ID NO: 12752 - DNA, 309 bp, Homo sapiens
  misc_feature (1)...(309): n = A,T,C or G
ctgattgcaacttccatgaggaaagtacttgtttccccagtgcttggaccagttcttgacatacaaaaatctctcaaatatttgttgaataaatgattgttattctaaacattgagggcaatgcaaaactgtctagttctccattaattactccaggaaaaatataactaagagtgtaaaatgatatttttacatcaagaatcaagtcacttgaaaattcaaattaaaatgttgattatatacaatgattccaagtaaaataatattaaagaaagaataaaactattgaaacacanaaaaaaaaaaaaa

SEQ ID NO: 12753 - DNA, 1536 bp, Homo sapiens
  misc_feature (1)...(1536): n = A,T,C or G
cacccccagtgatccggtagaggtgagaggagaagaggagagggagggggnttcnacancaaacgccagccacgtgtgcgaggcaccgtttttctgcgttgtgttgtattttcgtctgggagatattactaattacttatctcaaagcgtctcaggcgcgtcggtgccgctcgcctgtcttgatttatgctgtctgcacgccgagtgcggttaagaganatataatagtanaaagacgacatatataatgtcgtgcatgagcaatacatgtgtgtggacatgtacttttgngagnacggatcgccgccaccttcaccggctacgaaagacagccggtcaccgacacagaccacacagatgttatagtgctggatggtcgtgattgtncttcgatctgtacagcaggtcacgtccgcggacaccgaatttagtgccagcagctcagtttattatttatattttgtcgctctgtgtagtgttagcgatattgtcatcattatatgtttaattatttcatcacgaagtggagagatatgttaacgtgtcgcgcacgcacgtntatataacactctgagcgacgtacattatcatcacgcaaggcagggagagatatctattctctttagttgagcccgcgcgggcctgtttgtgtagatttagtacatccgattcgacggcgccgcgacgtaatctgtgtcacagacaaatacgaatacgcactatcttcccgaccccggtgtgttcgacacgtgaccggttgactcaattgcgtggtgcttaaggtgatctgtattagtcttatctgacgcgcattcgcctttctgtctcggtggtttggtagtggtgagccacggcccgcagaggttatatcttattatttatacttcgcttcattgtgtggagcacgcaccgccatcgtggaagcgcgtattcgcatagttttagcgtttatattagggagggagaagtataggtatgattgtggcggtatctatcgcaatgtcgtctggactgcggacgttgaattgttcgcgggtgtggttctcggcgcgcgcgcatgaggcgattgtattatggtagtaggtgcttcagacatttatttttattctaatttttgtataatcgtaaatgagttacgattggggtgacaaattaagtggcatcgtacgcggccgatgttaaggaacgattgtggacacctcggatggtctccttcttctgctgttggcgtgatggcgtagtatagtcacagaatatggttaagtgatttgattttcctgtgcgagtatgtcacaagtcttttatgtcncgtctgtgacttgcccgatggtcgttaatgtatggtatctactcatagtcatgatcgttattactacttcgcggccgcagcggaattaactcgtatgtccaggagagaaaatactcttttcgtcacgagagtgtgctgtagtatgtacctctctctccgcaccagcgtccgcactgacgtgcgtgcattgagtctcgtcgcgcggccttaccgcgcacgcgatcccg

SEQ ID NO: 12754 - DNA, 1096 bp, Homo sapiens
  misc_feature (1)...(1096): n = A,T,C or G
gcgaataaagacaggtctcatgatgctgcggctcgtgtatattaggtgtcggggaggttgcgtgataaggagagaggtgatgtgatggagcgaaagggttgtttggttnacatgttataagaatgaatatgggttcaccctttttgtcgagggtgttgctgcgcactctgatgctcgcgcggccggtcgcgatgtagcacgggaagtatgctagttgtctgagcgagcgctatgtgttaagatatgcgcggtgttgatagatgcgcgctacgctagcacagtccggttcgctatatccgaggtgtaaataaagtacaagggcgnggcctgccagaccgccaccgtacgcgccgctcctctcttccgcgcgtcgcggtgttgtgagctcacttaggcagtattcttctgacctatataattaatttatatatcttggcagatagtacagatatctaagtcacaaccctaataactgtagcaaagagttatagagtgnaccagtaaagaattactatagcccgctatacgcagtcatctcgctccgcatcagtccgcgcatagagagagagataatacgcnacgaagaagcgaggcatacgaggaagagttcgttncacgatggcgagtgatagctctaagagatgtaaaaatactaagatggcgctctatcctncaactcgcattctaacgtcgggcttgcaggacggccagcgcgcgagtgatcgcgtctcgtcgcggccggaaagtggtagtgtnctcatgcatagtcgacagagaggtgagtatcgtgtatacagtagttcgtatacgtctgtcgagatgaacagccagtcgtgcaacataagtagatgtctcacatgcggagcagagtagacaggctcgtgtaggcctaccgcgaggtctagatgatgattatagatttgtattncttgacgcagcagtatagtggctctagagagcagtgagnagtttggagagtatctcactatcgtgtctatcagcagagtgctactacgacatgcntttatagtntcgagtgcatccagnaccgatagtatgtgtgacgatacntantagtctgtatgcagcgcgatgg

SEQ ID NO: 12755 - DNA, 204 bp, Homo sapiens
cctggaacagacgtgatgaccagaggtgcagcagccaccatgtgaccatgaggaggacatgtatagctatgacagagcaggaaaacagagatcccacgtccccagggacatctttgagctactgtatcagctcaggactgccctctcccagacttcttattggacaagccaaataaactcctcctttgtttaaaaaaaaaaaaa

SEQ ID NO: 12756 - DNA, 152 bp, Homo sapiens
  misc_feature (1)...(152): n = A,T,C or G
tctgtgntgtaatcacggcggctgctcntgggcangaccttttcaattcatcggcggcttgaaaaaagcagtgaaaagaagacaaaagtctctatcctcatacagattactgtttaataaaattataatgtttgcttttaaaaaaaaaaaaa

SEQ ID NO: 12757 - DNA, 645 bp, Homo sapiens
  misc_feature (1)...(645): n = A,T,C or G
ctgatatgggcgttttactatgttgcaaatgccaacaccagttctgtgaatcagaagctaaacccggaaccatggcaacatgaggaagctgaagctccaggatccttgaagcgcacactaaagtggtccggatgccatctggcttttagcagaggtatataaaagtccttctgaaggaaagcatcccaaatgtaggcccttggaatttccattgatttaaattcaataaaataaactcacaataaaaaattacagggagattaagccaccatgagtcagtgaacaaaaacaacaacaaaaaaaaaatgatttagtcccccagaaacttcaaatattggaattatcatatagggaaaataaaataagcctgtataaaatattcaagaaaataaaagatgaaataaaaagcataatttatgtccacataaaaacctacacatgaatgttcatatgaactntattcataagtgccaaaatttggaagcaaccaagatgtnccttcgattggtgaatanggttaaaaaaaaaaaagaaggtacatccagacaatgggatattattcagtgattaaaagaagtgagctgtcaagccatgaaaaacacagacaaaccttaagtgcatgttgctaagtgaaaaaaaaaaaaa

SEQ ID NO: 12758 - DNA, 948 bp, Homo sapiens
ttatttatcttttattttttgtcggtaagagcaacaacaaacggaagcgttacacggaacaacaccgggagatctgagcgaatgccgacagtcggatgtgaattaccttttagttgctgacaacagaaagttaccctgaaccactgaccaaggggcgaacagcgtacgtgtactattagtaattctcagaatcatctctgtccccaaccaagtttggaaagccaaccacagcatcatggaaccagaatcaaatgctaggctcacagctgccgacttgtttgccttcaagcgccacttgacagatcttaaatgacagagaaatgcctccgcccaccctaacacactcacagtgcccgctacacagtctactctctgaatcctccagaaatcactccccgctccagaacgctagccctcggggctggtgggaagagcgaaaacaataaagaactcaacagtcgggcagtttttcttgttgttaggccccgacacagcaaacctgatacacccctacgactccacgacgatcacccactcagcagggggtcgcgcccacgcgcaccgctccacacagtgtgttttctaccatcaactatcatcaccatcagcaacgctctcacccgagaacgtactattctctatactttagtctctctatttctcctccgccttacatcacacgcgccctcatgtttcatacaaaccccgaccaaattagacatccctgttactcacccgtcaccactcgaaccacccgacctacactcagactcaggagttagcacgggctcgtagtgctgcttcagttgcacacgttagtcataagcctaatgacacaaataagccagtaacctaaacaccacaccgcgcctgcacacatgtcctcaccaacatcgtacatacccatctgactctctcagcacaactctactaacaagtttgtgctca

SEQ ID NO: 12759 - DNA, 1326 bp, Homo sapiens
  misc_feature (1)...(1326): n = A,T,C or G
gtagcacggtcgagccggagtacgacgtgctcagtcggcacgtcgtgtctcactcgcgcgcgcgtctcaccgtgcaacgcgccgcgagggcgcgagcgcggtggcggtcgcactatgcctacgatgcaatagcgaggcgtctgaccgagctacaacacgagacgagtgccgatgagtggatgggctactcttgtcagcgatgaacctcgccagaatctaagcacagtgtgcatgcacttttcgtaacagggtgtgtgtgatctactcgcggcgatgacgagattgtacttctcacttggctcgggccgcgcgacgctcacaccactctacttcttccttctcgatgctacatcgtctcacgtnccagcgcgcccgtacagagagatcaaccgacataacagtgagacacacactcgcgacagaccacgcgccacttcgacgcaccacgcgtcgcgcgggcatccgtcgcaaaccgtttcgaactatcactcactgagatactgatattcaccgaccgacggtcgctccacgcctcagcagagtgtctatacgagagatcgccacagaagcgaacgtagacggagacgagtggtacgaggtagtgagtggcgcgagtggcatgtagagagaaacgactctagctctcgcctgtctctcgactgcgctgcgttctgctccgtctgcgcgtcgtgcgctgcgcctgcancacctgcgtctcgtcgtgcgtccgcttccgcgctgtgtgcggtccgcancatnttgcttcgtcgatgcgtncgtgttgatatgcttgtgctttctatccacctaactcgtcatcntcgtgcgccctcgcttgcgcncgcatcgacgctgctgtgctttctcancnataattttttctacnttcttctgtctancgctccttctcctctctctacactctttctcctattactgtattctcttcgtcttcnncacgtcgctagntngcgtgctagcatttacatccgcgtcgcgtattagtcgacgagtctcgtacaggagcgaagttnagataaacgctcgactacatgtactacaatncgaatctcgcagacagaataacagagtaccatctacttatacacatcaacgtcctactctctacttctacttacaaataatgtcatcattcatacataacctctactatcatntattactcatctctgagaatcttacnacaataaacgttcantnnnnnnnnnngttnnccnnnnaaaaannncnnnntnnnnnnnnttnnntnannnncaccctttttttcccnnnnnnnnnnnnnccccnnnnnnnnnnnnnnnaaaa

SEQ ID NO: 12760 - DNA, 263 bp, Homo sapiens
cctgatttgacggagtgatgcttgacgtgtgtgatcagggagaggctagatggccacaactcctggaaaatgagtcctgcttctcgtaagatgcgtgttccggtctgcagcctcgccccccacacactggttattcccaattacctgtagaacctgttatgtattctatcttcccatattccccaaacagccccttttttatcctagagatgtctgactcagcaattaaattcagccaaaaagctgcctcaaaaaaaagaaaa

SEQ ID NO: 12761 - DNA, 154 bp, Homo sapiens
  misc_feature (1)...(154): n = A,T,C or G
ttatgtagatgacaaccacctggnactttacccagnatatacaagtaatgttttcaggatggaaaaaccaacctatcaactatgaactactcacctatggactagtatatgaggaagaataaactttgatgttgttgaaagaaaaaaaaaaaaa

SEQ ID NO: 12762 - DNA, 119 bp, Homo sapiens
tctagaaaatgaaacaccagggcctataaccccatcaaacagaaaagaagctgcagctagatttactgaagtttcagcttaaggagaataaaatctttgactctccaaaaaaaaaaaaa

SEQ ID NO: 12763 - DNA, 700 bp, Homo sapiens
cctagactgagcctcactctgtcatgcaggttgaagcacagtgatgtgatctcagctcacccgcaacctctgtctcctgggttggagacattcttctgcctcagcctcccgagtagctgagactacaggcatacaccaccatgccaggctaattttttttgtatttttagtagagacaaggtttcaccatgttggccaggctggtctcaaactcctgacctcaggtgatcctcccatagcaaatgaattatacaaccccttaaaaaattccttatgatgacttacatagaccattcgcaacatgcttagacttactgttttgtcctaaatatccctctctctttaacaatctagtcattttattttaggacagaaatttaccgcatgagatcctttcttatataaaattactttcctttttatcttcttcaccaacatacttctttatagatttaactttctttacatcttttatttcctgggtccttttaacttgtgtataccttgtataacctgtataaccttgtataacatgtataaacaaggtaaaaggtataaaaccttaaataaactttgaattagacaagatatttaataagaacattaaaaaatattttcctataacttttagattggaaactatctagatacttaatatcaattaataaaattagattctaaattatgaaaaaaaaaaaaa

SEQ ID NO: 12764 - DNA, 193 bp, Homo sapiens
  misc_feature (1)...(193): n = A,T,C or G
ttatatctaccatactagtgacataaatatagaatagagtaatatctcattgcaaccacanagccttttgggagagctttcctaaaagcagctctgcgcctgggtgatatctactggcagggcctaggtgaaggggccttcacacacaagaggagaaaaggagttataaatatggaatttaaaaaaaaaaaaa

SEQ ID NO: 12765 - DNA, 931 bp, Homo sapiens
  misc_feature (1)...(931): n = A,T,C or G
aaaaaaagccaagaacagtaagaatagacggaggcgcccccccctgatagccacgnagtcactgagtgctnagaataacaaaatggtagctcaacaccagatgcaattatttaataataaactgtgaggtgggggggcccccttaataaaactctatattccaatattgaaaattaaaaaaaaagaaaaaagtgaagaaaaaaaacgaaaaaaaacgaataaaaaaaaaagaagcaatagaagaggtaggaatctagaaactacaaagaaagaaccatccactcacgcagggggggagatgaaatcgctaccccaagcccctcctataacagagggcgcaagaaaacaagtcgcatccagaaaaaacacacacaaagccgaggaccagaaagcggacaggaaaacgcgccagaaaaatagaaacgcgaaagaacgggaccgaagacctgagggaggcgaagtactgcggccaaagcatagagtcgacaacgaagagacaacaaattcataacaataagccattaataaataacgccggtcaatcgctcccccacagaaaacgccaaagagacaaaagaatgaaaccatagaacccaacagtaatcgctcgtcggcacaacaacagtatatacgatgttcaaacaagccgcgtgcaacaatagcgcaaaggagagatggcgacgggttctgtaagggcgaccgcaacgacgcacacacaggaaatggtagcgcagcgaataatacatggaatgagaaggctgattcacgccaacccggcccaccgagaaataaaacacggaatcgagcgtaaggaagaaagctatccacccgagtccgagtgcccaaggcatcagtcaatcgaggatagacccgcccaatacatagacaatacgcgtaataatcgcgacgacaggaaactcggagagaaaat

SEQ ID NO: 12766 - DNA, 1076 bp, Homo sapiens
  misc_feature (1)...(1076): n = A,T,C or G
cctaccgcacctgcgcctcgatctcgttcgccgcgctgcggctgcgtgctagtcggcgatcgtccgcggttcgcgcgtctgtgatcgcgctgcggggcgtggcgcggttctttctgcgttgctcaccctgtcgctgtcctgctcctccgacctcctcgggtgtcgcgcgatgtggcgcgtgcgcgctgacggtcgtgctgtggcgtgcgtcggcgtacgccgtcgcgctgacgtcgccgctcaccgcccctcaccaccgtccctccccgtcccagctcaccgccgtccttccgtgctcccgctcgtggccggccgtgcgctgcgtgtccccgcggcggtccgtctgttggggcgtcgtggcgtgccaggcgccgcgcgcgggccgcgcggcgcctgtgcgtgctcgccgcgctaggcgcgacgctggtcgcgttgctcgcctgcgcgcggcggccgactcggtgcctgtccgggcggccctccctctcgctgccctgcagcctcgtcgctgtgtcggccccggctgcgcccgtggactgccccgcgctgcgcgtcctctcgtcttcggtgtgcgtttcgttgtgtgccggggttgggttttatgtcgtgccagtcgcctcgcgttgcctctgctcccggggcttcgggtccctccgctatcctctcccaccccgctcccgcccggcggctgcctcgttgccgcgccgcgctcgtccgtcgccctgtcgtctgcgggtctgctccgtccctcgctcccgcccgctgcgcgtgcccgccgtcgcgtgcttcttttttcgttaatttgtgttntcgtttctcccttttcttcttgcttctgtgtcgccgtcctccggggttcggcccgcaggaggcccgggtggtcggcgtgggcgcgcggttgctggttgtgtgctggttcgggtcgtgttgtcgtgtggcggggctcgtcggttgcccgtctntttccgtcggtttcttcttccctccctgtaaaacttcgcttattgtcggttgcttggcttggtcgggggtngtnggtttgggcaacagttgtttttttaggtattataaatagc

SEQ ID NO: 12767 - DNA, 336 bp, Homo sapiens
cctagggaggagggcactgaggaattatcaccccttggacactacaccaggagcccgacatcatgggaatttatccagcttggttgttacaagtatgtcaagcccatggaattctactttaaggctctgaccacaagagtcaagtacttactatatctcatacatacattcacactcatcactcaacagctaacaaaattagcatttaggaaatgaatctgagaaatgttttttttaacctcaccctgaagacaaatatactgactgtggtttgtttctgacaagaaaaaaattgtgctttgaaagagatgctttccatgttcaaaaaaaaaaaaa

SEQ ID NO: 12768 - DNA, 881 bp, Homo sapiens
  misc_feature (1)...(881): n = A,T,C or G
tccgttctccccaccatgtccgaattcgcgggtaagaagaaagcttacttgcgactgctcanaacagtcnagtgagcacacttgcagagagtgcatggacagaatcaaggaaagacctctttgaggggagatgggtgtgaagggaaaagatttcaagccaggagagacactacaggtgatgtggtccaacggatcccaaaatctgaccctgcttcagaccactcaaatcagacactttgaggatggaagactcggactctgtattgccattattctctgtggaggtcagctcaattatcacacgctttaatcaccaagttaatttagaaatgaggaaactagaactccatatgatgccgatcttcagaacaaaggcaacccccaagactggccacagcccacgtgttccccatctttcactaactgtaaacttcaatctctcacgcctcttttttctatcccacccgctcgacttctatccatccaatatagctcgcttcgtttaaccaataattgcgccacctgcttctcccttatactcttaccataatcccctccgatccggggtagacggacatccctcattccccacctgtttcattaccgtacccagcgcctccattatagcacgtctcctttatggcgccaaatcatcacccgcaacgtcggatactacgaagggttaccgtatcaccgcaccatcgcgtgctatccggacctttacgcgatgtttcgacttcccttgtatcttggctggattcatgtgtacgttgttagctttatcagcgcagacgattccctgacgcacacattggcacctacgaccctccgcaccgacctaattataccttaataacattaccataccctcccccatatat

SEQ ID NO: 12769 - DNA, 1283 bp, Homo sapiens
  misc_feature (1)...(1283): n = A,T,C or G
tatatagggtgtgttaggatgaggagagatnntnnnnnagtgaataatgtggtggnnnngtgtagnaaantaanantaannnannnnnnnnnnnnanannnnnnnnnanaaannnnnnnnnnnnnnnnaaggaggnnnnnnggannnnnaaaaggagaggnngagggtggagagtagaggggagagagaanagaagnnnaagaaagaggaaaangtgtgatagaagagtatgaagcacgagcactnctcattatancccgcccnccttggaaagctcctatatacaagttagttaagtgttaatgaatagattgcgntatttatagaaatgctgttctccaacctggcaggtctatgttgtatagaggtgaagagtgaagagtaggncagagggccctcgtgtgtatatgaagattgtggaggtggtgtgtggtagaaggaagttgtccgtgtctgggggtgngttnntttgttgggagtgagcggggcgaagcagagatgaatagctcaatattgagttacncctagagacgagagcaaaggtcgaagccctaaaccgcgtggttccgcgccccaacggtagtgtcccaccgacgaaaccgcacgatacgcttcccgactcaacttactgtctactctggcccaaccagacaggctcacgacgtagtaggtgtgtgaaggaagagatnnccgtgacgttagacggacagtagcgtcctcgcgctagcgcgctccggactcgccgcgagagagggtncatagtgtgcgcccatggttagggtccgaggtcggtcggcgctacacaagtgatgggcaattgtacccaacacacgcgcgttcagacacgtgagtttatcttgacgtgatcncgtaatcgccactacaccaatcacaacttataagggctagtgggggaaccgtcgaagtcgaaggtntaccatcncagatacgtcctacgtcgtgaattgacgtgaccgtcacgactcacgctacaacgtggagtgaaagaactcgcagcaagaagtatattgatataagatggtatttnacaaggaggtangcggcgtgaggaggtgcgttnntccgttgttgtgataagaagagagattggtaagtgagtgtcgtatattagcatgctcgggaacggtgcgaccacgcgaggtgcacagtggtagtggtgttagagagtgcgctcgattagtgtnatgagtggntagtaaaggagtcttactaaggagagagcagncggaagtgagatagtagtcgagcgtcagcagacagag

SEQ ID NO: 12770 - DNA, 735 bp, Homo sapiens
attaaagacaggagggtctccctttttgcccgggtggtttttaaatcttaggcccggggagtctcctgccttggctttttaacctgtggggattacaagcataagacccccttcctggcctagaagcctattttaaaagaaaatacaatctcccatggggactggttccctgcctcttttgggcagtcccatggaacttgcctccagcaagaggcctaagattgaattttttttgggaaaagtctttttaggatgaaaatcctatgttaaggccgggggcagtggctcacgcctgtaatcccagtactttgggaaacccaggcaggtggatccccttaggtggggagttttagaccagcctggcccacatggtgaaaccccgtcttttctaaagctacaaaaattagctgggggtggtgccaggcccttgtgatccccgcttctcaggaggctgaggccggagaattgctttagcctgggaggtggaggtttcaatgaaccaaaatcgctcccttgccctccagcctggggggcagtgaaactccctttccaaaataaaagaataaaagtatgtttgtcatcccgctcctatgtttgttatccagctccaaatacagcttgtgtatatcaaccttttcaaaaaccttttaacttcccaaaggaatcccgaaaaaaaaaaaaaaaaaaaaaaaaaaaaaaaaaaaaaaaaaaaaagaaagaaaaaaaaaaaaaaaa

SEQ ID NO: 12771 - DNA, 175 bp, Homo sapiens
tcgttggctacgaacatctttacttggaggatcagcgctgagtcatcacatggaggaccttgaatccacagtgtactttgggtgataaagacaaaatcattttaaaaaaaatcgccaatatttggcattgtttgttatgagagaataaatttactacttctgaaaaaaaaaaaaa

SEQ ID NO: 12772 - DNA, 536 bp, Homo sapiens
  misc_feature (1)...(536): n = A,T,C or G
gttgtgtaggcgaactaggggtaggccgggcggaatgacgnaaggttctttaggccacccaggctgggatgcagtggcaccatctcggctcatgcaacctccacctcccagattcaagcgattctccttcctgagcctgggcgagcagcatgaaactacacntcatgcaccaccatgcgccagcgttaattatgtatttgtaagtgagagaacggggtcttcacttatgtgtggtcagggcgcgcttcttagaactcctgatctgcctgtgatctacccgtgcttgggcgtcccaaagtgcttgggagtggcgggggatgagccaccagtgcccggcactaaattaagcttcttaaggtgagtgctggcatgaatgagagtgtcaccaagtatcttttctgcaagaatttgcctttaaaaaaaatacccaagatttatgattttagaagtctttctggagcaaaattgtaaattgccattccaaagtaaattttattgggaaataaactctgaaatgtgttacaaaaaaaaaaaaa

SEQ ID NO: 12773 - DNA, 570 bp, Homo sapiens
agttttccaggcagtctggcagcgacagttgtcactctctaagatatgaagatattggacggagtcggtcgcagatccttgggtcataggtgcatggggctgctgggagcggcttacgtgttgtaggtggcctgatagcactagcattgtagtccagcaccaaagtgtctcatggggttgggtaagccgcctccccctagtcagacagctgaaccagggcctcatccttatcttgtggtcaataattacctcaaggtggaataggggctttgcaatcagacgcttctaccattgtgcccctacaaggtaacatagacaacaccactaagtaggtaggcatggtcacagtcttaaggaataaacaccgtaaagcaagggccacttcaaccaatattggcaaatgagttctgattaagttaaagagcttctcctcagcaaaagtaccatcatcagagtgagcgggcaacaggcagaatgggtgaaagtttttgcaatcgacccatgtgtcaaagggcgaatagccaggatctccaaagaaattaatctcatctgcaaaaaaaaaaaaaaaaa

SEQ ID NO: 12774 - DNA, 1040 bp, Homo sapiens
  misc_feature (1)...(1040): n = A,T,C or G
aagaccaaacaggcgacgaacaagagccgatcaacaggacagcccccaccaacaaccaaaacaacccgttgatgaggaangaccacgacgcgaacnangcttggnanagcgaacagaaccgcancccacaccaggacatacacacgacaaanacacaaacaaacagcacgcagacaggccacacggcgacccgccacacagcctgccacacctacagcgcgcggacacaccgaacacacccgaaccgcgcagagnaacccaacccaggcgccgcgggcgccgaacgacgagacagagcaaacacgaaacagacccacaccaacgcacacaccacacacacnaccaccagaaccccgaacgagaaccacgacaccgcgccttcgcaccccacgacccggacaacgaaggcgcgccccaccagcagcccgacgaaccaggagcgcgcagagaccgaaccacaacccacacaccccccgccggcacacgcacaaaaccgcgaaaccacaaaccgccgcggaaaaaagaaccccgcaaagcccccgggacgcacgaagaggaagaaccgcgacacccgccgccaaacgacccccgccaccgagaaccccaagagagaccccgggacccacccccaagcaacccccgaagcccggcccaaaagccaagcaacgcacacaccgacaaaacaccgcacaacgcaggacaaaccccgacaacgcccacaaaccccccacaaaagggaaacacccccgcccccccacccaccaacacacacagacacggaaccgaacccgcacccccagcaacgcacgccacacaaagaacgccgaaacgccacagacaaccgcacacaaccgcaggcgaagacaacgcacacgcgcccacggcacaaacacacaccccacgcaccaaaacaaccaccggcaccaagccgccccccccagcacacacgacacccaccaacagcaaacacagccgcgcgccacaccaccgcaacacacccaccccaaacgcccacaccacaccaaagaccacaagacagt

SEQ ID NO: 12775 - DNA, 1384 bp, Homo sapiens
  misc_feature (1)...(1384): n = A,T,C or G
cggtggggcaaaaaanggnnnggtggagatatcataatnnnntnnnnaaagaaggnggggttgttnnnngagggaaaaagaaagtttatnnnnnnnnannnnnnnnnnnnagnaaantannnnnnnnnnnnannnnangnnnnnnnnangnnnanaaaaagaaaangnnnntnntaagagngggagnnngngggagtgngaaaggnggatgagagattnnnattattgggaagatgtatgtgtgtagtagtcacgntctataactatctctncacacacatatatcacccatacacatatcttcattctcctctccctctacgatcaccttagtatacgagccnanncgccacctnctcaagacgagacgccgccgcgcgcgacgccgacctcatacgcccactagtacatagagtagataagagannccagggcgtcggtggggtccgtgtaggatggtcgagaggtagggcaatctcgcgtgtgaagacctgggggcccattcaccgcatcctatgtcgctcgctgggttggtggagagggggccgagtagaggagcgccgcgcgtcgcccaacgcgcggcggcgcgcctnatcatcacgcccgccccccccacccgccgcctcccaccatcgacgactgccgcgacntnctcgtcgctagtaaatcacatctatcgattctaccgtcgtcatgtcactatcgtatgtctgttgtgggctagcaaggagcntcaaaaggagcaaaaagagaagcgagcacgcgctcggaccgacagtctaaggacgtatagcgagattccaaaaggagcgtgtcagatgtgcnncacaccgacgtggtgttacacgcagaggggtatagcagactccactcaggagtctatgtagcgttgtagggcgtcgctacttagcaggcgtccataattatctataaacctgtaacattgcgatgaatcctatgagaagatgattncagtacacgncagcacgaggacacatgtaggagatgagtgtagaaggtagtggaagatcggcttcctcttgacgtcgcgaaatcaggataaccgtaatagtagcacaagaagatgtggacgttgtcccatcgagtgagaggccgcgtgtggagtgcgaccacgccnctgagcgatgcttaaaanaactgagagcgtgcagcgtcatggtgacgtagcgtcgatcgccatgagcnatagtacagagagctctgncgcncactcagcgtagtgactcgactgcgtgtactcctcntcaggtcgcagcgcactatctgcgccccatgcggcgcttcgcacgcgtgcgtccgcgagaggtacatgtgcctgtcgctggagcaggggcgngtggaagacgctncctgcgcgggtcgg

SEQ ID NO: 12776 - DNA, 809 bp, Homo sapiens
  misc_feature (1)...(809): n = A,T,C or G
gagtgaaggggaagagttacaattacaggcatacnnaaaaactttgttgtgacgcccgcnaacttttnnggggacganacacnngaacnggaaananagaacaatagaccaaagagacaccggaagaacccgcaacaagagagaaagaaacagaaaaagccagaggccgcgagaagggaaaagccagaggggcaaggagagaggcccacaccaaaacaagacgnaagaaaagcaaagaaccaaaaaccaccactttttttttacacaagagaacgacacaaagaggagggcgagaccaaggaagaagaaaagaaagagaagccggagggagacgcagccagaaacagaagagcgcagaagaccaagaaagaggcgcacaacgaagagaaacccgccacgaacaaaaccccaaaggagacggccgcgacaaacacgagcaccaacaggagcgaagaaaggaagaggaaagcgcaacaaaaaccccccgaaaagcccggagggaaagcgagcgcggcaacccagggagccgagaaaacggaaaagcaggcgggcgcagaggccgcgcaaaggaggagaccgcaaggaacgcccgggagcgggggcgaccgagagagcccaagcgaaagagggagaaaagaagaacgaacacacgcgaaacgggaaacacgcaacgaaaggaaacaggggcgggacaacaaaccgggggaccacagaagaaacaaacaaccaacccccggcaaggaaaggcaagaacaaaaacaagcgcacacgcacacagcaaacaagaacaagcccccaacacacaaaaa

SEQ ID NO: 12777 - DNA, 980 bp, Homo sapiens
  misc_feature (1)...(980): n = A,T,C or G
gaagaattatcactaaattataatntcttttnttatataanaaatatataaatnnaanaanannnnnnnnnnnnnnnnnnnnannnnnnnnnaagannnngagnnnaggggaggngaaanaggaggggagaggaanaaannaaatanaccataattatataaacacaactccccccgccccccaccccagccccccaaccacatccgagtgtgtaaaaagaaataaggcaaaaaggaagtcacaagacgccaactatttaataatatggattcccctagctctgttattatgaggtgtaaatatctataaaaatagcacaaagccacccatgggnggtgtttntcagccagcatacacacnaatcaacatctccacccagtcatcttaatagcaggcgactaggagggaaataatataaccctgcatcaaggatatccgtgagagggatctcaattctaaaagttcacaacagntacataggtccaccacagcaaaaatacgcaaataataagtaccaaagagnnccccagagtactctgatgacacaaacaccacagagtttattaataattatatgtntaaataatcaatatacgtcccctcgttcaacacgnccacgcgcgancacacagttcccgaaggtccaacacatcatagaacctactccaggcttccaccttcaatactcatatgtacagtagacataatagattacaatatatattaacacttaaattatatatacaaacaacacggctctgttaatgcttcctgttcgcatcatgaagtttagaatgatattnnaatcaattacaaagataagcaattaacaatatatccactatcgacgctccagagatgatcctagtcactgagagatgtccatgataatctacatcattctctgcagccatagactcacgttggcgagagagntaacaataaacagatcaaaaatgcaatctgtatccacttggaa

SEQ ID NO: 12778 - DNA, 748 bp, Homo sapiens
  misc_feature (1)...(748): n = A,T,C or G
catcnngagaacggaagtacacagtaggaccagtaaaaggaaaataaagagtctcttttggaacatgctcaagaggacatgtccagtgagggtgaatatgtggatttcaagtctgtggccaaaaagatatggattttaagaagtctgcttgaggcaagtcatgtggagagggcaaaggctgaggaaagtgcctaagaaatttcccaacataagaaaatgaatttccggaaaaattaagtaatcatccaagagattttaggtgaggtcacgaatccttgacttgcaagctcagcctttctcttgtcactaggatgagatatcaccttaatctgataaccagtagcgagatcactggattggatggtatttctacttttagttctttaaggagtctccataccgaatggacaattctcaaaaaaagataaacaaactgtcgagaaacatatgaaaagatgctcaacgtcactaactatcaggaacttccaggtttgttccatggtggtttgctgcacccatcaacctgtcatctacattagtttgctgaaatgatggtttccagcttcatccatgtccctgcaaaggacatgaactcatcactttntatggctgcgtagtattccatggtgtatatgtgccacattttctttatctagtttatcattgatgggcatttgggttggtccaagtctttgctattgtgaacagtgccacatanacatacatgtgcatgtgaaaaaaaaaaaaa

SEQ ID NO: 12779 - DNA, 336 bp, Homo sapiens
  misc_feature (1)...(336): n = A,T,C or G
ctggtgaaggaagaaagattttctangacaatggatgcatttggcggaccagatctcaatatcttcagatctctacattgtgtttcagctccttcagatgtctgctgaagatttactgaagaaatacaaattggtggcatgttgattagtcaattatgttacatattagccattcatatgaagagtgtgaaggaagagtgtggcaggaagatttcctcaaacaatactcagaaatgtggaaggtttaatatagtgatactaaggccacagttcactgtatctttgaatagcactccttaaaatacaatgctctctcacatgtcaaaaaaaaaaaaa

SEQ ID NO: 12780 - DNA, 846 bp, Homo sapiens
taggacggaggacctagtttctaacgacacgtagcaagaaaaagaggaacctgctagggaactcagggataactccttcgggagaccatacaagtagaaactggaacttcttcatcctataataccagaacagatcacgctcaaagtactttcaacaaagattgaaattaaactgaaaaagccagaggctgcgatacgggaatagccataggggcaaggagatgtgcctacgccaacacaattcgtagcacaggcaaagaacctatatcccatcatcattttcttatacacgaaattgggataaactgtcttggcgagaccaaacaccacgacccgaacgaaccgctcgaggcagacgcaactttaaacagatccccgcaccaaatctattcgtatggatcctgatgaaccgaaacgtgccatgaacaaatccttcactaagagtgtggaggtccagctttgagaaccacccgccctcgagttggtacacacgaaagtgtgaatccatcctcccgaggggatcgccctggaaatagctctaattaggaatggcggtctcaaagaaaaaaattacggcccccttctcttccccggccgcactctgcggccccttgccattaaaggagagaaattctacatgccgctcacacacctaacagtcatcagatctctgggttcgctcgactgctcgaccttacttaacgggagttacacggttgtcccaagagtaggagaatttctgctgttaatgatcctgctaattaacgccttctgacggggcaataataccaaacagcgcccctcgccagcgttcatcccaaccgcacctcccaactgcacccctcg

SEQ ID NO: 12781 - DNA, 2145 bp, Homo sapiens
  misc_feature (1)...(2145): n = A,T,C or G
agtgtgttagtagatagnnannaactcatcantatntaatattntattnttatnnannnntagtggnngagnnnnatntnnnnnnnantntnaanatcnnnnnnnntnnnnnaagagggtagnggnnnannanannnannnnnnnnnnnnatagtatagtatttgttannntaannnnnnnnnnnnanannnannnnnnnnnnnannnnnagnnnanatnnananannnnnnnnanannnnnnnnnnanannanagnnnannnnnnnnnaannannnnnntnnnnnnnnnnnnaannaananannaannngngnanannnangananananaanggannannannnanannnaaagnaagtganangnaggagagaaagngnannnnannagagaggaagtgntannnnagnagnagatgngagagntcatagnangngatatatncnncnactanancaacantncnnaccnncacatgacatagatnctncacacacatcngactcatctgctagagctgcgagtagtagaatcgtcgagnagngtantgcatacgacgctgacataggagcacacancgacagtagncacagcaggtaccaacaanaactgaangacgtcagcagatacggagagacgangancagcgcgcggcagaccgaancatgcnncccancacctgtgcccgcgacanctgcatcagactctctagcagcagacactancnncncaacnatancttcncncncacacagtgacncnnnagcacagagataggtcgcacgntccagaaangaccatnaggacnntannnnncnanacgtncggangngagatagcgtcancagatgacagcangtctatctncntctcnactantatcttctcagacgagtagngtcgcgtatggagnnntgnagtgcgcgtagtgngagtgtcnctacggagctggtgagttaggtgtacantatnaatgcctctcacncnagatatcggngtgcatagtcacactcncnaactagacacatcgatctctcgcactcgtatataacagagcgcagancatcgcagaagatcagagacatncgcagtgagcgntnacnngtacgcagtgcgntcactatnatacgcacctaanataagagatacnagcncgacacgaagtcgtcanacgaacacgagcagcgngagagaagtgtgtgagaacgagantaatgcagaggtntncncancatacagaccnatcataccgcgtagaagcgagatcacagcgctcacagngacncnacnaccgagtncncacatatcattatatcacgtaacagcacgctctcgcganacagcgacgngtcgacagagcntaggcgatcggtgancncacagtacganatgtgagtgcgtncngagcagcgcagaagcgaagnacacacacacgagcgcncnntcacaacagtacngtcattacaacgcacgagacgagcnactagtacagcacgtgctacgcncancaaccacgaacactgcnacncatcacatcntnanataantctctaccgacgagnactatntacgtgagacctngantagcntnagcaacgatcacacgagntcacaacancgacnnantacgatggatagtagtacgnatatnaaatnantactncgtagaggaggtagngtacgagtgtggcgtagtcgagcntatcacagtgatgntgataggatatcagtntgntgcatgtatgatntgntantatangtagcgtntgacgacgcactagacangnantagnncncacaaacgatgcgagcgactngcnacntaggngacgagcgacgtcgtntccgcacgacacgagcgactncgncanagcacacacgaggatgatcgctcnctcacagagccgacgcgagagcgttcgcnagagcgactccncacagtggaatgaggacaggcttnanagaggcgtgagtangngacgacgtagcgagcgtantgtacgagatcgcagcgacntacatcactgtacactcagatacgcnctncgcagctgtgaagtctgtctcanagtaagnanagcagatgatntgagatagagagtagagnganncgcagagcaagcgatacgcacgtcacgatact

SEQ ID NO: 12782 - DNA, 880 bp, Homo sapiens
  misc_feature (1)...(880): n = A,T,C or G
gggaagagaaaacacggcaagcaaattggaaacgctagaaaaaaagctttttgngacacccnangcttgaaaggagaacagnangananacngagagngggagccaaccgtaggaaaagaggagacgcgagaacccacccaaaggacaagcacggagaccgaccgcgacagagagccaaacaagaccaagcggaccaagcaacagggaacacacgggacaacgaaccacacggaacggccacagaaaggcaaaggagaaaattttttttttaggagaccggcgccaaaaaaacgagacgacggggagctaaacaaaagccgaaaagacgaagacaaacggaagaggaccggcgccggccaaccgcgaccacaacgcgcacgcacgaaccgccaccacacgagtcccagaaaccactccagaggaaagacaagagcagctaaaagaaacagacaccgcacacaagccaggaggcccccacggcggcgagacaaaataatccaacacaacccacggaggagagaacacaccacccaaacactcacacaccagacccaagcacagcaaagcaccaaacacgccactaaaaggagggcagagataccactccaccatagtaccgaccaacacgacacacccacgccatcaccaaggaaatagcagacataagcgagagaagaggacgccaaccacagccgcagcaacaaaagccacaggcgacaaaaaactaaagaccacactccgacgtcgacggcactcgggagacatcgctgcgcgaagggagacgacgaggcgacgcgaaccagccgtaacagagctaccacgaattgcgtccggctccacatcacatcacacatgacataacagtcacggaaagcaatg

SEQ ID NO: 12783 - DNA, 1992 bp, Homo sapiens
  misc_feature (1)...(1992): n = A,T,C or G
gctgaaaacacatagatacagatgtagtaatnagtgatctatatatntattnnnttntnnntnnnnnnnnnnanatagngnnngnnnnnnnagaanagggggnaganngnggtgtgttntnnnttatgttttttanagagngngnnnnnnnancannannnnnnnnnnannagnnnaannattttttnnnnnnnnnnnnnnnnnnnngnannnnnnnnnnnnnnnnnnaggnnnnnnnnnnngnannggngaaagnngnnnnnngaangnganaagagnngaggggngnnnaagagagngaggnnngaggaggaggtggaanagagagaagtgagtgananagagagaatagatagaagatgatatatnttatatacaatanctttcntctnncccctantgctagtatcctccatgtngctctttctatcacaccatactaagtcactntcacactcctgctcncaccacgtacgctcgaccacgagcagacgtagacgccncacatnctgacaatagctcacnctatangcncgcacacaccatacgacgccacttaatctacagcacacagctatganatcagtaagaggatagtacgancncacgcatagccgacgacgcgcaagngtnactgagaagacgagaanctgcactcacgagcgcngcgcaccacgcagtctctcgaagtataacgcnaccgacagcacgctacttctctncatagacgtnatcagtactcacgcagtcacgctcacgatagtgtagcatagacgctctanctacactctatgcagtcatcctctagntcctccgcatcagcgtatggagtgacntacattanaagcacgatcacactctcgtcatcgcctacagcgcgcctganattgctgcgccgtgtgcaggtgcgtgtacgcgatgcgcgtgcnagctcatcntgncntntcgctacgatgtacaangnatagacgtacnaatacatctacatagtgtcacagcnatagacgnacgagngtagtagatatgaggtcgtaacagntncgctgggncttcnatcagactgagtatcgtctacgatgaantagangatcgcaggtgtagcactgaagcgctcacnagcaatatagtncactacgatcgtacactntaggatgcgngtgcncttcngtaatcatctacgcgtngcactagagaggcgcacnncanacataggacgagacgcgcgntacncgacgtcgtgagcgacgtnctgtagtagcgatcnntctcactcactacttnatcactacnctagtanacgactcncgacgantgatacanctacttnctcgtcgcgtagtgtacnnctcaagcgactgaacgccacgcacacgacgcgagacncncagagcactgcagcttgctacagatcgangactgacnacnncanctcccatccacnacgattcagatactnctccatcattatgctgtananctacagatgtcgncngtcacatatcctactgantantccatcnacttatgncataangncgncngnagtangacgtcgagacgtacgtgacncacatancgancagtgagggacagtcagtatacntancnaaattcacattggagtagcacgatgnangtngccggtcatgtcgtcggtcnctacgatnttgcagttctgctatgncntngagatagtagtcgtcacnctcntcacgctagttgcngacgctgtgcantactntagcgatntcnctcctactacgaatgcacgacagnntntntcnacgtaatgacgagcgtancgcacataccctcgtgatgcntcgngaatgacgtatcgtgctgtcatatggtaagcanttcgatgcacatgctctntcctacgtagtngagatnnacgcatcactaggtcngatgcngangtcctncngaancacgctgacgatgctgacnacgaccgaatgattactacncttcgtagntgncgatatg

SEQ ID NO: 12784 - DNA, 355 bp, Homo sapiens
cgttggtcgtgatctccatcctttgttcttgacctctatgcagatggctgatggactacattgatagatccccgtgaccgctagcagtcaattatgtttgacgaaaaggaagcccaggcagaagatgggaaaggaagagagaagaggatttcttctgtccgctgatagacaacaaatgggttagaggactcattcaaaagacagaacaggccgagctcatgcctgtaatcccagcactttgggaggctgaggcaggccgatgacttgaggtcaggagttcgagagcagcctggccaacatggtgaaaccctggctctactaaaaataaaaaaattagctctgaaaaaaaaaaaaa

SEQ ID NO: 12785 - DNA, 464 bp, Homo sapiens
  misc_feature (1)...(464): n = A,T,C or G
cctgnatgattacatagaggcccggtatggttaagcggcaagcccagagtcagccatccaacgcagcgcagagctgtgatacaacccacttccactcccacggcatctcggctccgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaagcgggtgttctcatggcctccagtgggctcgactatttttatatttttaatattttggtccaatcactactctatacaacttagctgtcttaaaacaataaagccaaaacaaaaataaaacaataaaaaaaaaaaaa

SEQ ID NO: 12786 - DNA, 189 bp, Homo sapiens
  misc_feature (1)...(189): n = A,T,C or G
ctggtgccgggaactaagnagaccatggttaaggctggaacaacaacaaaatcaagtaatgaagaatgtgctgtaccaagaccattgctgctttctgatcattctgatttatcactgaatcagtccagataatactggatataattaaaccttagtagtaaacaaattttaaacataaaaaaaaaaaaa

SEQ ID NO: 12787 - DNA, 783 bp, Homo sapiens
  misc_feature (1)...(783): n = A,T,C or G
ccttggttgatacgggaaagggacttaccttacctcagcagagactttggacttggactttaggttagtgctagaatgaattaagattttgggggactgttggaaaggcatgattgtgttttgaaatgtgaggacataagacttgggaggggccaggggcggaatgatatggtttggctgtatccccacccaaatctcatctggaatgatagttcccataattcccacatgtcatgggagggaaccagtgtgaggtgtcatgggctgggaatcttggcagtgtttacctccttgttcttcttgtgatagtgagttctcacaaaatctgatggttttataaggggctttttccttctttgctcagcactcacccttcctgccatcatgtgaagaaggacatgtttgcttcccctgtcaccattattatgcacaacccaaccttgaagtacagcagaactaacattcccaggggcaaccttcaaccgatttaagcaaaagaggatgggaggtgttgataaatgtacaagggtccccagcccttaggaagattctgacatatattccacaatttcatatagtttcttacagtgtcctgngtgggacaagccgagttgtccatatggtgactcattaatgacctctttgtgccattcctcacacaactggctttcccccttctgtgattcactatttctgcacttgtgtttcctgggatgatttcccaaataagtggtagcttcaatagtgctcttccctccatacacacctagtgatgtgtactga

SEQ ID NO: 12788 - DNA, 806 bp, Homo sapiens
  misc_feature (1)...(806): n = A,T,C or G
cttgactgaggtcaagaggcaaactgtcacccccatatctggaaagatggaagcacccagaaagatacagcagaaagatccgcttagctggagcagaaggtgttccagccgaagctgcttaagccataaaatggaactctaccaggttctccataatagtaaagaaaaatcctctcatggccctgccaagggtgcagaagaataagctgttgttcaattatacccagagcctccctcacaatgaagtgttactctccagggaagaatttcacaaagcacaagattcaaaccttatcccagctggtagaagaaaattcttatcccagctggaggaaggaaatcctatcccatgttgtggaagggaattcctccccactctagtacttctcaactttcatgataaaaaaggtataaaaggcatattgcttttctcctcacttcaggtacataggtaagtagataatttgttttaatgcttaagtttataatacaatttattttatctgaaacctattaacagccactaaagtcctacattntaaacttagactnttttttttcttaaagcccctaaaagtgagttttttttgttgaagttaagacaacttggataccaaatagaagacaacaatgtgagcaaattatctttctcttgttaactggactatttgtttgagttgttcaaaactcaccaatttatgtttttttatatgggaggaaattttaaatgcctctcttattggaaaaatgaattgctatattaaaatccggcgcaacacttagtatataagtcagaaagcaaaccg

SEQ ID NO: 12789 - DNA, 177 bp, Homo sapiens
agctataacaccttcaactggctggatcgacaagacgttcactatgtggatgactaccacctttgaaaataaagagtactctgtggtcaatatatttgactaaatttgttatataagcttaattatttttaacatgaaagtaataaaagaatagtcatcctttgaaaaaaaaaaaaa

SEQ ID NO: 12790 - DNA, 202 bp, Homo sapiens
tctgacttaactacagagattttccctaaactgttgccatttctgaaactcccagttatttattccttgatggtcttctgaagaaatgagatttgaattgcattaagacattatgtagaatgggaggaacaaatcattagaattataaggtcaagggctaagatagaaaataaactaatgagcatcttgaaaaaaaaaaaaa

SEQ ID NO: 12791 - DNA, 425 bp, Homo sapiens
  misc_feature (1)...(425): n = A,T,C or G
tggactgcagtggtgcgatctcggctcactgcaacctccgtctcccgggttcaagagattctcctgcctcagggtgccgaataactgggactacaagcacgtgccaccaagtccagctaatttttgtatttttagtagagacggggtttcaccatgttggccaggatgatctctatctcctgtcctcatgatccaccaccttggcctcccaaagtgctgagattgcaggtgtgagccaccgtgcccagcctgatatatttttaatttagatgggttataaggtttacgtctactgtgacatcctttttgcagacaacttctataaatgttccttatgtttgtaagcaaaatacatacgtgaacatagataaatgtatatacacatgcaaataanaacatctggcagaatgtgaaaaaaaaaaaaa

SEQ ID NO: 12792 - DNA, 849 bp, Homo sapiens
  misc_feature (1)...(849): n = A,T,C or G
ggtcactaggtattgttctgctcacgaatacactcgatcacaganngggngcctgagttgaaaccctgggacaaatttgtctgaagtgacaatggaaaattgagcttcgccattctcatccgtagtgtaatttcctgataaattcatcattgagctccagttgcaacaacttgttcaccataggtacattattgggatccgaaaatttaagcgtgtacgaagaaaagaataattaacatgacttaaaacacaaaatgtttacattgttacagagaaatagttttctactcataaatgtgatccctagtcattttcctaaattccaacagacagaaagatgctctattaaatacctagatatataatataaagtatggaaaatacattacgaaacagaaatgacagggtctcgctacgaaaatttggaagtagacgcataaatgagaattcattttttattttgtagcagtgcggggtagaatagccggtactccacggaaaagaaaaatcttgggctttaaaacacatcatacgtgaaataatcagccgaattctgatgtggggaagggcgtgaaaaaaggcaatcatagtcccctgccaactttcccctgtagaactatggggggtagtggggtgagaaaacatctcttctacgggggagtcacttttacactccccctccttgtgggtgcgcgccaatgtcacctctcttttgcctatttgtttcccccatctttgttgtatctactcagttgccccctttgcgggtgctatagaagagtcatcttgacgggagaattcactagagtcgtctccacttttgaccctcgacaattctcggttgatttt

SEQ ID NO: 12793 - DNA, 859 bp, Homo sapiens
  misc_feature (1)...(859): n = A,T,C or G
aggaaaaccgaggttaacagttaatcgcgcttaaggaaaagttcttttgttaaccnccccaggnctgggaggngannacggaaaacnagnngaaaagaaaggangacacaattgcagaaccaaagccgggggaaagaacaaggaaagcagaggagaggcaccagcagacaccggcccccgaaacacagcacaaaacaacacaaacacccagcgacaaggacccaaccaacacacagaccagcaaccgagggaacacaggacaacgcttttttttcccagccctgacgcggaaaacagacaagcgaagccgaaaaggacaagagcaagacagccaacaccggaacgcaacaaacaccaacccgccaaaccacccaacacacgacacccgcaaaaccacgacacacgaacacgcgacgcgaaagccccagccgcaccaacggacaacgaccggccaaccacaccccgaccggggcaacaacacgaaaccaaaccggagcgggcccacccacccaccaccggaagaagcacagccccgacccccactcaggaaaacggcccccggccgaaaaaagcccaccaacaccaaagacccccaaaaaacaacaaccaaaaggccccccaaacggcccaccgggaggaagcacccaggccaggaccccgcacagcaaggcgaaacacacgacccccgggcaacgacccccaaggaccccaaaaggacgagcggagggaacggcaacacacccacccaacagcggcacaaacgggccagcaccaaacccagcgcaacaccgcccgaaacaacaacgacgcacaacggcccacaaaaggcacacgaccgacacagacgccaaccaaccca

SEQ ID NO: 12794 - DNA, 1508 bp, Homo sapiens
  misc_feature (1)...(1508): n = A,T,C or G
atccagatgcgatctctccataatatatttatntatnnttntcnnntnnnnnnnnagnaagagaggnanngaaggaggnannnnanaagtttgngggntgggttgatannnnnnnnnnnnnnnnnnnnnnnnnnnnnnnnggnnnannnnnnnnnnnnannnngnganaagnnnnnnnnnnggnnnnnnaangagagggnngagaganngaaggagagagaaagaangaagnnanagagagagagagaatgaggagaagaaaaaattatcnnannaanntttttntntccatctatacnnnnnccnacacactatccccgcctacctgccatactcttcttcacacaaccganacacccacatatcacttcctacacgcacactgtctagtatacangtagcacgaagtgacanatagataaagagttatctttcgaatgttngacacgcgacggacgacgctctcactatattnatctagttccatcttatgagtgagatgnccnnccacgagagnggatagatagtgaggatagagtgntatgacaagataggaaataanantcgaatataagatggacacacatcgtttgtggtgnnatananactgcatctgtttctctatgaatcaccagaatagcacancatagagagagtacgtancatatgcctacgctgagtggataagttncatctatatcactcaccaccgagtctcaccatcggctttctcacacagtactcagattctcatatatctacttaccgagcatatattattcgtgtcgtccgatcatncacacagngcagatggtgacaatatatcactnanatttacttgcctataatatattgttnncttatatgttctgtaatgatagttgtaacacactcagtcactataactnctattaggtctgtgacagatgactcaatacagcagtntgcgctcgaactgtccgcagtgatgcggtgagtttcagaataccgagncntcgagggnctcctatagagatattatgacgacagctttatctatgtatttattcaccttaatccnccaagcagatatatcatattgtactgaagttagagagtgctacacgatagtgatataatnnncgaagtgcagtgatcgatccactaatcgctagtgctccagcatacgtcgctgtgtatacgctctctcaangagttcgctagtctctgtcatcactnacatataatgtntgtgacagagagaagtgagngnangacatagaggatgtatgagtagttagtaatgagtgaatagagaagtagngtcatagataggatgctctcncacggtagtcgcgctgccacatagtgctcaatctgcgtaatacactttcatccagcaatactactatacgtcgatacataatatctgactcatgagtattctatcgcgtttaacgatagagttttctccaatgacatagagcatcgacggatgtagtagaacgtagtatgcgacgtgngtgact

SEQ ID NO: 12795 - DNA, 1066 bp, Homo sapiens
  misc_feature (1)...(1066): n = A,T,C or G
gccccctggcgcggctccgcgcctcctcggcccgtcccgcgccggcgccgcgcgcctgcgcggccccgcgttgcgtgtcggcccaacgcgcctttctccgccgtcctgctagccgccgcgtgcccgccctccgtgcgcccggtggggggctcccgtgccgtgtcggtagccgcggcttggtccttcggggctctttcgtgggcgtctcctcttcggggcggggcgtctcctgggccgccccacgtggcgttgctcctgcgcgtccgcgcctccggctcggcgcgcccgcgcgtcctcgttcgccttggcggcgtcccccccgcggcgtctggcgcttgggtggcccccgcttctgcttccggcttcggctggctctggtttcggctctgggcgtgggttttgcgccgggggtgtcggcggggcgggcttgtcgcggggtcgggcggtcggggccgggctttggcggccttcccgctgcgtctgtcctcggtccggccggttctcncggtgctgcgccgcgtcgggttcgttcggggggcgcgccgtgcggggngccgcgggtcccgcgtcgtgcgcctctccccccggtgccttccgccgggcggcggtctctgctccggcgccgctcctctgaccccgttccgcttggcggcgggcctcccctgctcgggttcggcagggacgcccggcctccggtccgggcccgccggccgtcgcaccggccgcccggccggggaagggcgcggcgtcgcgccgctgcctcgcccccccccccggccccgggcctgggtggggccgcggcncgcgcgcccctcggcccgggcgtttctggtctcgccctcgtggccgcgtctggcgcgtggtgtttttcccttgtgccgtggcctcttccggcccgggnccggggcttttggtgccccccgccacagcgcgctttcctctcccgtcccttcctcggccggcngtggtcctccccccccaaacaccggcgccgggtcttcccgccagccctctttctcccttcttgttgttcctgcgcctcggctggggcccctgttctgctctc

SEQ ID NO: 12796 - DNA, 733 bp, Homo sapiens
atccagcaacgcaatgaaaagttaatcccccacttatcaaataggctttattcctgagatgcaaggttggttcaacacatgtaaatcaataaatgtaattcatcacataaacagaactaaaggcaaaaaccacatgattatctcaacagatgaagaaaaagcttttgataaaattcaacatcgctttatgttaaaaactctcaataaactaggtattgagggaacctcaaaataacaaaagccatctatgacaaacccaaagccaacatcatatagattgggcaaaagctggaagcattatccttgaaatccatctcaagacaagaatgccctctctcaccactcctattcaacataatattggaagtcctggccagagcaatcaggcaagtgattggaagagagaaagtcaaactatccctgtttgcagatgacatgatcctatatctataaaaccccatagtctcatcccaaaagctccttcaacctataaacaacttcggcaaagttttaggatacaaaatcaatgtataaaaattactaacattcctatacaccaacaacagccaagttgagagccaaatcaggaattcaatctcattcacaattgccacaaacaggataaaatacctaggaatacagctaactggggaggtaaaagatctctacaatgaaaattataaaacactgctcaaagaaatcagagatgacacaaacaaaaaaaaaaaaaaaa

SEQ ID NO: 12797 - DNA, 444 bp, Homo sapiens
cctggtcgacaccaacgatatcttttataacaccccacgagatacgacattatgatgagatgcgatatgctccttagcaccaatcaacgcccggactgggccagtcttgagatcaaactcattcccggaactgacttcaggcgacatatatcaatgacgttggtgcaataaaagatagttgatgtaatacatctattcaaatttgtgatacatgtcaaaaaattggttgaccaaactcgttatttatataagggcacttacgaagtgcactcttttttaaagcgaggaagtaccaatgaaagagaataaagtacagcaaatcagtcataaactgattaatatcgttgtttttgtcgcaattgtagaatacgcctatttatttctccatttctattaataacggaaataaactgttcacttcagtgatatttaaaaaaaaaaaaa

SEQ ID NO: 12798 - DNA, 1254 bp, Homo sapiens
  misc_feature (1)...(1254): n = A,T,C or G
gggggtgttntncgcggnngggcgtgtgtttttgtnggttttgtnnngggggatatcctggggggggnnnnagggagaattgtgagatattagtggcggcgnggcccctggccttgggaggacccaccaattgtctcgcgctgccgcggttgactgagtttctgtgggttgtgtattgttttggcccctccgggcggggcgggacctcgcgggcccccacgccgccccccgcccgcgggggcagctaccgtcgccccagctgtagtccccgtcggacgagctgctgcggacggggcgggcggcccggagaggggcgagacgacatggggcggagagggagagatcagtggcggcggtgtggggcaagcagggtgcgggggcagtgtatggaggggggggacaagaataaaaaaaattataactgaaaacacaattcttaacacaacatcaattatcgacatccgataatccaccaacggacgaagacaaacacagacactactataccacccgcatcatccgtaaatggtcaattgtacctatgcccgtacccttggtgtccgttaaatatgtctgtcgtactttactttacaaaacgcggcagatcgcgtcaccaaacaataaccattaatgtaccacatccaataatagacgcttaaccctaccaccacagacaataatataatctataaataatacaaaaatacagtgtccagaggatttagagagacaagaagctcgggaagtcgattaataacatgctagacatcattgactaccagcgatatgaattgatatagcgcaacttgcgcgagtagacgatctctgtacaaatattactttgataaacataattctggtcgagatgtagcgggcggacaaatacgcgcgtcgtagcgacgcgagcgtatctacgaggaacaaagacgaccacaaatgatcaagggagcgtgcgggacgcgaccggtataaaccaacgttttcggttgtaacccacagagctaagtgcatacaacgaatacacgtgacaagccaccgtgatgagtcgacgaccaaatcgttcaataaatagaccatctagccagggtacatncatccaaccggctcacaccaccgtataagaaaaagacaacaaacagaggcgatgttgagagaataaataacgaaactacataaacaaatacaaattagagtgagananagagacgtaacaaaataacacccagcacgaacgatagtcaagtatagcacgcg

SEQ ID NO: 12799 - DNA, 839 bp, Homo sapiens
  misc_feature (1)...(839): n = A,T,C or G
tgggggagtgggagtgatgtgtaagacataaaataatccaatccgctgctaggcgcanatcctgcttctggaacactaaggcacataaggaaggagtgcccatcagaactgtggacatccctacctggaaataggtacagattacactctccagtcaacagctgtcattctgttacatcatcagatacccaggggctgttgctacttgaggcgtccacagaatcacagcattttccagtattgaaagacctgaaagatcatggtgccttcatatcaactgtgagacatgaagcattttcccaaatctacgacattaagatatggtgcaataaggaccagattaaaggtgtcctgattttcaaccatgttccctccatctaatttactcctaaacacagtcactgctgcaaatacttctgctgccaagcgggaaatgaatgctcctaccagactcaaagttgtgaacacatcactgaccatctcagaggtgggtcacagtaaggacccaattaaagagttccccttgcaaactgggttcaaccctttccagtactanactataccatcttttaaagagggaagtattttcagaagacggccttcatactgcatttctaaccaccacctgatgatgataccggactcagatactgattggttctccaacgccggaattctccaatcaggagcaaaaaactactcccttcctccttatgtttggatgccaagggtgggcgtatacctcttcctgaatgcaaacttgccttccacctggaacatggtctgggctgtttccgcagggggggcttacggttgcttggttgaggccttgcctgccc

SEQ ID NO: 12800 - DNA, 342 bp, Homo sapiens
  misc_feature (1)...(342): n = A,T,C or G
aaggaagacccaaatcaacaccccaccgccacaaagaaaagccctctanganactacgcccaaaccttcnnggggagngacagacaaanngaaaccggaacgaccacagccgataacaccagaacagagcacgcccaaagcacacccaacaaagacagcaaacaaaccgaacaagccagaggccgagagacgggaaaagccagaggggcaaggagacgcgcccacgccaaaacaacacggaaacagacggaaagaaccnaaacccaccatcttttttttaatacagatatagggataaatcgggctgctgagaaccaacaaaaaaaaataaatgggctcgtt

SEQ ID NO: 12801 - DNA, 1026 bp, Homo sapiens
  misc_feature (1)...(1026): n = A,T,C or G
caaccacccccccgctccacaaaacctgctgncgcccnnnaannccttttnngnnaccccggccanacctccngcnggganaacangacaangnngaaacagggaactncngncatcctataatagccagaaccagagcacgccngaaagcacctcccaacacaacgaccgaaacccaaactcgaaacaagccagcagggctcgcgacgacggcgaacaagcctacgagcggcgcacagggagcatcgtcgcccctacagcaccaataacatatgtacgtaagccacgaatgtcaaccgcaacccctattatccccnatcatcttctttctcttatcacagagcagaattgggggataacatccgcgtctcggtcgacgattcacacagacagaacgaacaagcaatcgataaacgtcgcgagcgcgagactgcactctcctacaacaatatttattctcatgcaagatcctatctccagaatgggctcttgatgaaagccgaaaacgtggcacatgaaacaaaatcccttcatgggagcccgggctggcaaccagctctagagctacccaacctggccctgaccgtaaggcaaaaaaggcaaagaccgaaaaatcatctccttccccgactgaatcatggaaccgggaataacgcgacctacacaaacttactcgtggctccccacaaaacaaaacacaaaaaaacgggccttctcttgggcccccaaccgggggcgaccctcgcaacgacccctttctctttcagaggagcggctcaactcaagaaccccctgcttcactggacccccgtccactcaccgtccccaacggcatgccgctaaccaggtaataactcccccctacaaggcccgaaccccccgctctccaccacagatcacgggcataaccccacgaaacaaccactcgacccaaaagcccacacaaggggcacggaaccccaaaaaggcccccgcccctgccgggtctcccaaggcctccgccccccggacaaaacacaaaacaat

SEQ ID NO: 12802 - DNA, 993 bp, Homo sapiens
  misc_feature (1)...(993): n = A,T,C or G
gtgaggacagacggcggtggagagaggngaggnnnnnaaataaattataaaaatatngagggagggagagagaggnnnaaaaagcttannnttgganaaaccanannaaagagaggntttttaannngnnaagaaaccaannaannnannnnaaagaaagnaggagaaaagaanaaaagaanagaaaagaaaaagaagaggagggagaagaanannnnanaatgaancaagggagattcnntttaaacanaccgtatttgctctatcnnactataacatacactatccgctgttgattgagtccncaccttgttatgccgcgcggctctatgaggacagccagagaagcaccacttccggactcatcatcgcacgcccnngccgccccacactacctcgttcttttcgagccgtatcccaaccgcgctcggcgaccacgcgcccaccctccccaccgtgcgcatctctctacaagatcacaaatggagcaatagcaacaccacgaccatctatatcgggactcccgtcttgtcccccccgcatatctcactatattctcatantttcacaacacgacagagcgagcgtgagccgagaagagtggccatgttcagacgcaaaaaacaccctactgccccatgtgttagatttaagccacagaatccgcctcgcgcccgtacaaccccacacccgtttagagcccccaccctctcactgtacactcagccccgcggcctctctgtatgccgacaaaagcaccgatgggacaagccctttttttgaaccaaattacacacgatacacccgcccccctacgggccttcactcacagaataaaaggagcaatccaaggcgcggagagaagagtaccgaatagtaggaggttgtagtagcgggccagattggaaaggaataagtagacccaaaaggaccatctctgaagtcactcaacccggaatccgctcgcacccctgtcgcttccaagccccccga

SEQ ID NO: 12803 - DNA, 806 bp, Homo sapiens
  misc_feature (1)...(806): n = A,T,C or G
aaaactgaggggacttgatttaattttatcgcanacataacaaaggatgatacatatcgcttgaattaccatcacagttgtaaacccaataacacatgtatgactaaaaagaacaagtggaaaacgaacgaaacgattcggcaaataaaacagcgaaatggtgatatatcatcaggtggggttcataaggtccctactatcgtttctagttgcaatgagataacgttcgtcccacttcatcataaggcaaggcgggatacattatactggttggacaaggcgctatcaacaagcaaataacgatgggatgatatggtacattaatcgtcgagtgaataacacgggaataaaggcggtaaaacacagcaattgacaagggactgaaagttgataaaacaaagccattaggcagtgaaaatgaaagtagtcttgagggcgcaaaaagagtgtgcgtacgcgagacgcataattgtagacggatgtaaaaaaacatataatcggtcgtcgatatctgtatccaaaggacgtggagataacttggttggtgcgatcagagtggaaggaaagatattatcagttggaggaatatgcagcttttaacatatatattgcagcagatcgattcagatggttcagacaaagtgaaacgtgccatgaacttatcctctatctagacgcggtggaacagttttgagtaccacctggtctgatgtaggtaaaaggaaagttggaatcaatcctcctgatgatatggaatggaaaaagtactaaataaattaatttgctctcaaaaaaaaaaaaaaaaa

SEQ ID NO: 12804 - DNA, 748 bp, Homo sapiens
aattcagtattaacatttgggcccacttccattagtagaatatgaaagcttaatgtgttgtactactgattcttaatttgatattcagttatattcctgtgtcaattttttgtgggtattcatctacaatatagtaagtatatgttttcatacactcacacacacacatatactacattcttctaaagtttgatatcattgagcatatcaataaatatttgtgaattgtttaaatatataaagtaagagccttgttggtgtattcatgttgatttgtcaatatgctataaaaatatcagatttggttttcagtttttcatgtttgatatacttttaaaatgtataggacagaacattttagagcattaaaatcactatcaggataataaaaccatggtaacttgttttaacataattaaaaatgtggagcatgaaacaaaatgtactgtatgattgtataatgaaaattgtatttatgaacaggtagtactgaaagctaattaactacaaaattatttgtcttagagacttagagtgttttcctatattttcttcagtattccttttaccttttaacgttcacttattgtaaaactataaatatggccttaattttttattgtagacaatttccaagtagcattggtcttacacttctacaaaaatggcactaaaattcagtaatctgtcttcccttttacaaaaaaaaaaaattaaaaaacccgaagtgctaaaaaaaaaaaaaaaa

SEQ ID NO: 12805 - DNA, 906 bp, Homo sapiens
aattaaatgaatacttaatataaaaagaaacaaaaacaacctggtgagaactcgaacaatcctcgcatgtctgaccttccagagagccttacagtcatttttataaaagcaagagttcaacgagacagttcagcaacacagcatctgcctaccatctccctgtagaatttttactgccagtatttcaccaccagcatttacaatgatgataggcttaacgaattcattaaactatatttaaaaagtctttccagaataaaaaaaattgttgttgtttcaaaagaatacaaaacaataataataaaaaatataaacaatacaaaatcctaccagaaataaaatacatattcacctacccttccccccttaaccccctcccacgcctatgaccagccgagtcggcgcacagaccgccctttctctatttctctctactccaaacatacccccttctttagcaaattcagcctgtcctgctcagcccagattgcctggtgcaagcgcccctctcaccacctgctctcttattgtctctcctatctcacaaaccataaaacaaatctaacaataaccagaatacccaaccccctcgcatcctttaatctcacaatatcgtccacgacgcattccttatcgtctctctactttgcatcaggcttaactaatcgctatatctatctatacacatctttataatatattatgttttagtcccccatatgaataaccaccaacaataactaccctaccacccctcaccctctacactcgatcagtttgctatcctctctcctctataacaccacccaatatacacttgaaagtgaaataaataatatatctaactagtactataagtaacacacaacatcatctcaaccatcacactaaagctagtaaagacct

SEQ ID NO: 12806 - DNA, 105 bp, Homo sapiens
acctcctaaaatagcagtaaaataaatggagaagagtatactgatgcttgtattattttttgggccatgagtattaaaatccttaacctctgaaaaaaaaaaaaa

SEQ ID NO: 12807 - DNA, 171 bp, Homo sapiens
  misc_feature (1)...(171): n = A,T,C or G
acaaaaaaaaaaagaccaaacacaaatataaacaacaccccgaaaaggttataaggngacatcatatccttttttactggacttaactatttttggcattaagtgaatggttgtagaccagctaatgaaatatagcatttgtcttcatgctgaaaagcaaaaaaaaaaaaa

SEQ ID NO: 12808 - DNA, 1558 bp, Homo sapiens
  misc_feature (1)...(1558): n = A,T,C or G
atacactatacgcactacgcacacaccctaacagatcaacgagctacaccatgaccgtagagtatgtgcgtgtcctcgtcatctggcgcgagcatgccgtccaggcacttacactcggcgagcgcgcgtccagacagtctatcgaactcaccagcactacagaanggccgcgtacgttgttactacggatagtacggtcgatatgtatgatcgctcctagtctattattgctcttatgtgtcacagtattaggacactactagcgagtcgtagtcgacagacgagcattatcaancataagtaattcacagtacaaagatagagactgattatctaggctttcgcaggagcaccgacaccagcgatgtacgcagacgcagantacgcgttccgagaatggatcctacgttgcggtagttcgcacgactcgcgacgtcgaagaacgacatgtactcgataatattaagtatctatccgctacangtacgttcgcnacgatcgcccgacgctctgatcacgtggattcgtagtattagatgctcttcggcgatcttgcgcggcggagccttcttatatctcgttgtcctncaccaaccgtcctaccactccaccgaccctctcgttcccgcgccgtcgtccatacgtatctgaaacctcgcgcatgcctgaatcgtcctgcgccgaccacatcacatctcgggatctgacgcacanctcaacgtacagacgtcaaaagacgtagtgactttagtgatggctacacgtactccgctcagacaccgcccgcacgctcgcggagtccacgcgcatcntcagcatcggttgtagcgtcactgctgagtgtacatcgtgcgtggtacgtattgtcacagngtctgcgcagacgcgcacagagatcatcgagtcacncggcgcatacagtccacactcacgaccactcagcaagatnagttntatnacgctccatggctatagagagantatgcagaatgtaggtattgatagagttgagtaggcgngtcagcgatacacttgtcactcgttctcgtctcgcacacgtctgtgtctgcgtctcntactatgttttacttgtacactgncntcccnacacactaccacactacactaacctcgatccttagtgcgcgcgcatgctcactggctcactcgtccgncgtctgctcatctacacntgtatcactcgacgncgcgtatcgtcnacgctatagtagcgatatgtgtaacttacgctctctagacgccagacgtgctgtgatacgctcgtccgtatactgtntcagcgtgatagtaatgttacnacacgcacatccacaactattcgcgactgctcgacgtcacgctcactcgcagtctcagttcgtagagtgcgatgagactgatctcaggcacagctngtacagtaccgtcgtgcgcgcggtcgcgtgtagctatatctgtacaaacgctccactntacnacctctctgttaccgtacgcaagtcgcacgcgcttgacgatatactgntctatcatgttgtcgtccgcgtcagagctctcg

SEQ ID NO: 12809 - DNA, 1260 bp, Homo sapiens
  misc_feature (1)...(1260): n = A,T,C or G
gggaaaaaaannnnnnnaaaaaannnnaaaggaaagnagaggtnaagtaagaagaagggggaagaannaaaagttgaaatttttcaatataactggtattgttagagtatgcttctagcgnttagtttgagcggatgtgtaggnattgtgttattgtggtgtgcnnccaaggcacccatcgatccactaatttgtcgtgccccgacgcaatctcatagttatgacccaaaggtcacttctcaccagttnatagtatattggggacgnnngacaanagagtccgcggacaancacaggacgacatgaacaaactcgaccaacccgcaagacgcaaggtcncatagcattactaacgacccaacaacganacacagctgatgtacgagcccacattatcacgcgcncacagatcccacacactccggcgcgcgcgccgccagccgccgcccgcgacagacagcnacgccaaacgctgttgtcatattcaggctgtacccctatctgtacagaanacncacaccacaggttgcactcctncctnnntatattatctccattcttcagctttcgcgtcccatacctagttcaccctcgannccagccgcccacacctccaccatcgtcctaatatcccccgcgcccccacagtcgtccccctgattcatcacctgtttctctccgccctatttcccgatggcgtggcacccaaaggggaggtggttctatagttgagnatagacgcagagtagatatctgagtcgccccgttagttacggccggctaaaccccgccacggcgacgcacgcgagactctatgcnaccaacctctgttagtctgtaattgtgggaagctgcctnacgacgaccacccagggaccaacaacacactcaggacatatactaacgtggacncaattgagggtgtcaatgcgaatgttcttagacatgagtaagaggtatgagacccacaggttacccactcactcgtggcactccaggctcccgtccatccgggtatnncgcccaggagtaggggtgcgcaccgaggcggaggtatncatgtgctgctcncccacgcgaacgtctactattagctagttttcaacgcccactcagccgtggactcaacagggacacagtatctgttcctccgtgtctgtncacctcccccttgccttgtgctccccgccacgtcgcgctnnccttcgttcggttgtnttggtcgtgtccctctacatgcgtggaccggagntagtcggg

SEQ ID NO: 12810 - DNA, 1708 bp, Homo sapiens
  misc_feature (1)...(1708): n = A,T,C or G
acgtctctgccgcgtgcatcatccatccgcgacatcgtcttagcacancgatcgacctaggcatcgaactcatcgacgcgacgcagacagtacgcgttccgagcatcgcgtcgcgaatgtacgatacctacacacaaatatcactnataccaaagtacagagaaagtacatctgtgtgtgcgcgatatngtattgcagctgttggtggtacgtgtcgacgtgacagcacantgtggagctggataagagggtgtatgtcnatatgttgacagtcatatagtggtaganatatgtgctagtgatcataatgatatacttcgcngtagacgagaactactgcgtttgaatacaatatctctgtattcnattgttcgtatgagtgtacgtatgctatgaagagtattcatggcaggcagtgcagctctgtgagngcgagtatgtgaagaagagtacgtagacagcaaggtagatggagacagantagatacgtngttccagaggtgcgcattttttacctagcggtgtggcgaatgcgaccggtgngtctgagatgatagcgnagagagacatgctgtgtgtagccgnctcttctgatatatgatggtgctgatcaggacgtcgaggtactgaagcgctcgacagtaaatcgaacgtatagangcgctgacacngaactcgcgtgtctctgcaccgtcgcgcacgcgtcgtcggtcacgcgcaccaacatcgcgcgccggcacatcantacggcactgcgacgacccgcggtcctcgncgtctgatagctagatgacaggcacttcgcgatagtgcgatagtagatagtaatacgaatacgctcacgtcgccagctagcgtgcgtgtnttacgtctctctatatgcttgtctgtanacacagcggcgtccacgcgctagcgcaatcgtgagcgagtngcagctcngcgtgtgtgcgttgagtcgtcgtatcgagcttaactgagtgagatcactgtgtcaggtcgatggatntcagcatgtcgtcgtcatncgctcnactccaatctctctcgccactcgcctactcgctctcaacatcaccanacgtagtatatcgacacatcgacactcaacacagctaantcactatctactatcctactacattagtaacaatagtgaatcgtggtgtctcgagtattatgcgacatatngcggtacngntacactgtacatcatgtctctcggncgtcaacgcgcgcaccaatacatcacacgatcagcgcacacagatggtagagcanccacgctacgcatcatattcgcgacagcgcgngcagagcgctangcagcggcgatcagcgcgctgcgtacgcgctcagagatcgcatagagaggcgagtcgcagtcgggctccagcggnctacgcactgcacgacacatgtgagtacagaattcacgtaatcgactgaaatatcggtacagtaagagcataaaattnacgcgatatatcagaatagcggcacacacatatcacatacacnccatcactccctcacatnattcntatatctatagactcgcgacgcgcgaagcgtgcgcggcgcagataggcgcgcgcggagcgactcgacacgtgcataagtatnagaagacataancacacgatcactaactactactgtgtgatcgtgcactaanagcgacgcaggtctacgtnactcgtactct

SEQ ID NO: 12811 - DNA, 822 bp, Homo sapiens
  misc_feature (1)...(822): n = A,T,C or G
tagngtaccccggcatccaaccaatttcaaaagactgagggcatgtgccttttttccaacttaattaaaagttaacaaataacaaacaggcaatatggcacagtaacgtgttagaaaatgacagctggaaacaagcccacattctttgccactcctcaagtttggacattctatctcctgcctgaaaactgatattgccagaatgagagaaacagcatttcctcccaattatttattcaataaattttgctgtgagactgcacagttgatagcaagtgctattaaaacaatagacttgagaactgatttgtgtaggtattaaccatggcctatgctcaaatggaaaagattgcatgtggcatgtgtatctatacacaaatcaacattatttgctggggtgttgtaagttttaaacatttgtatttgttatggcactgtaagttttaaacatttgtatttgttatggcataatactctgtgaagaatggatgtaaaaatcttcgaaaattcctacttaaatataataaaaatatcctctgatgaaaaaaacactcccaaaaaaataaaaataataattcataccccataaaactctcaaaatcacccctcacaactctttaaacatactccttcccctctctacctaactattattccacaccctccttccatctcgcanactgcctctgtgtgtatgccccctcagggacaccgccacattctgcctctacgcgtccagcgcccctgatgtacatcgcaacttctacgttctatctccaccatcgtacactatcatcccaaaaacctccagtctctcctaag

SEQ ID NO: 12812 - DNA, 1937 bp, Homo sapiens
  misc_feature (1)...(1937): n = A,T,C or G
ctttttgtcgatgctatgtgtcgctccactcgtcttgacatgtgtcctntctgtcccactgttcacagctactagaaagctacattgatatcatgccgtacgantagctcctgactcactgtacccatagtgtatcatctgtctangagtcagtctgagatccaggatcgtatagntaatagatgacgtantctctgtgttacgtncgtgtatacacgcgcgcagaagngtcgatgcgcgcatctgaatgtaacgtagcgagtgctgctatgtgtcgcgtatctgttgtgtagnccngactatgacaagatagtatgtaagtcgagttgatcagagcgcntacagagtatgctcagtacgatatancatgtagtagtacgtgacntagctctatatatgtgatgcagcgancaatcntagctagatgacgcgatcatctgnatagacatcgtaagagtagtacttactacgatcatatggatctatctgacncccgacatcatgctcatcaacgcncancgactacgcacgtcccatatcgcgctgagctactctgactgatgcatctgtccgtcgacctctccactagctccacactgaccactatctacaatcactcnctatcgctncatgtatatctactcaganagagcacgcgacgacgagcgtactcngcacaatagacagtccgacgcancgctctcgcaccgcacatcgcgcgtcgtnctcantgcctctccgtcgagatccatcgtccgcatcgcnaccttctatcagatgatangtatgatgaatagtnatgtnantcgagcgccctgatgatagtctgtttactgtatntancatagctacagtcgtatgtgagtatacaanactnctagcntnagtgacgcgnanagcnagcgaagtagcangcgcgcattgcgatntngatntcaacgaccatgtgagtagtgccnncagcatatagacacgatccactactacttacgatcacantcactacagactgcgtaagagtatntatcgtagactactcggtcagacagccancgcganactctncanagcatcgtatcgtcagatgtgcgtagtgtntcattcactaccgagcgatacgcgcgtcctgacgncncgtctgctgcncgcgatnatcgtcgtctntcatacgtcatgttagtnggctatatagcgatactgcactgactcagcactcactcttctcatcacagcacacatgttagcanatacancntgtgantcgcgcagccgagactagcaactaanaactatgagtagatcgtgcggnatgtnntgatcagagagagacagagagtagacaagacacgctctatggtctatatcgatcacgagagaacnacnatacntctacattacaacaagatcatncaacacacagntntacagactgcgtcagatgantctncagaatccgcgcgtcgcatgngcgcgncacacacgcgcagcacgctcgcgactctcngccatctgtcgctctgcgttcgtctgtntctcgtctccgacaccagcaccnatcggacctcgtcacacgacaccantccaaccncgcncgcnccgccntgcagaggtcatgacgagcacgtgaggacgcatagtctcacacacangacgcaacgcncncnacacagcgatatcagactgcacgcgaagtattattgcaatgactncgccgtcacacggtgctctccgtntgtctgctgtatcacgtctntatctatactcgtatgagtggtgntctatcgcgcactcgatcgcgcnncatgatgcctcgtgcgatctcgcncgccaactcgcatctctagantcantcacacatctncagtcgctctcgctcgtatcnnntcctacgactcgcgngtaagtatagagactagatactcancactatgttgcat

SEQ ID NO: 12813 - DNA, 943 bp, Homo sapiens
  misc_feature (1)...(943): n = A,T,C or G
ggggggaaggaggagagggcgcacagcgaggcaggaagcacaaanaaaaaaacttgaagagggaacgcgcgcacgagggtgagggggcaaacgcagacacgaaccgaacaggacagacaccgaactttgcgacggggcaacaaagccgcaccggaacgccagaggacagccaaacacacgccggacggcaaagcgaagacaaccacaggagaccagcgggcggaaagcacagcggcagagacacgaggccagagcagacagcaagaccaggccgccacgcgaagcaagggcacgcgagctgggaacgcgcggggggccgcggccggccgacgcacgcacaaccgcgacgcgcacaggcgggcacagacaagccacagcgggaaggagccgagggaggaagagagaagagaaccgcggcccggcccgcacgagcgcgggaaaacgcaagacgagcgacaggaagaaagagacagggagaggaaggggggggggcggccagcgagccgcggccagggcgggaggagaacgagacgcggcggggcgagcgaaggagaaacagagggagcgcacgcgggcgagaggtcaagacgaaacggccacaccccacgcggcgccgcaagcgacgcaaacggcagacgcggaccgccagccggagccccggcgcacgccgccaagcgcgcaaaaaacacgccgcacgcccccggcgaccgccccagcccccgcggagcaccacgggacagagaagggggagaagagacgaacggacagcaaaaagcgaaccgcggcgcccaagagaccgacaccacaccgggccaggccggcacgcgcacggagcgcggagacgacgaggccgagaccggagagcggccgagagccgcgccggcgcgacgggagggcgcggacgcgaaaagcggagcagcgcacgagcacgggcaccgggcga

SEQ ID NO: 12814 - DNA, 1206 bp, Homo sapiens
  misc_feature (1)...(1206): n = A,T,C or G
aaatgtaatagtgctctttaggctgaggtaggagtagatactatttnttgtnngtgtttnnnnnnaaannnnnnaaagtatnnaaagttttgtggaannangagagaannnnanangaaagttntatnnnnaannnagaagagnannannnnggagnnnnnngagagagnggannnnaaagagggaggnaaggnaangagagaggnagaagaggaaaaataaatnnaatantaggtagagagatgagaagaacaacagggnttagatgaanaaacacgaacaaaccgcgtggggccngatgacctcaccgacgacaacggagattctccgattagaaacanccaacgcaactaacacaaaaggaccagcgagcggacgcagacgccattagtaagagaagatatggtgtgggagancnccatagtgcgatcgacagtataaacggatgtaagtgatgcggcggtagcgcaaccacgcgccgacgcgtcggacgacgaggcagcacaccctcaatactcaccagacgtcagcacacgatatgcagagttgttgaccacgctcagctgatgtagacatcctctcactaatatcttactattactactatccgtccgcccgacgagacctcacccacaagaatgtaacaagtctactgagttttattggaattggcagcttcggcgcggacgatgagcacgaagatgagaaatagaaatgtcnagaagagacaaagatagaagagagacaggccaaaagtatgatagacaaagtatcccgacagagcgacgtgcaccacgataggacgctcacggaggataaagtcactgatgaggtaacgggggtgtgttgtcaggaattaaagaaataaatgaaatcgcaacacacaggcacccgtgaccgccattaagtgtcatcgtaggtagtagtttccctatattactgaaagttatatttcatatgtgtgtatggtgtgaaattaataatataaagaaaggtaactacaagcagagtcgcaggggtgaggtgatatctagtatgtcgacgtcagagtcgtgactgagtattgaggagggacggatgncacacgaactagtcnaccgtgaggatacaacgaaagcgaacatcatgtccacaaagtcgaccagctgtgcagctgaccccacactgagcatgagtccgcaaggtaagacatgagtaaacaggagg

SEQ ID NO: 12815 - DNA, 220 bp, Homo sapiens
  misc_feature (1)...(220): n = A,T,C or G
cctaggtgataacggatggacgactttagatgaatgactgcccttgtagaacagactcaagagagactcnctcnccttacgtcatgagacgacacagaaagaaggtatcatctatgaatcaggaaaccgttccttgatcttggacttcccagtctccagaactgtgagaaataaatgtctctggtttataagcctaaaaaaaaaaagaaaaaaaaaaaaa

SEQ ID NO: 12816 - DNA, 187 bp, Homo sapiens
  misc_feature (1)...(187): n = A,T,C or G
ctgtctagtaactacggccacccttgtcgangaaaccgagaaagaagaatcgcttgaacccaggaggcggtgactgaagtgagccaagctcactggttgcactccatctagcctgagcaacaaagtgagactgcatttccagaaaaacaaataaataaaaagaccttatgtaacaaaaaaaaaaaaa

SEQ ID NO: 12817 - DNA, 1547 bp, Homo sapiens
  misc_feature (1)...(1547): n = A,T,C or G
gactccacggtacgcgactacgccgngtatcaactacgcacaccaatacgtatcgatatggttactcagctcccatacgtttatcngnnctagagaccctngacgaatagtgcaatctgtancatntagngnctacactacgcaaacgctgcaccgccgctgcgcgngtgaatntccacagtcatgtnctcactacacctggtttgtactgcgcacntntgcaggnangcatagacgtntntgtgtatctagcaacgcgccactcgctggcaacacntcagcagccaccttgggcatcaacgatgttagctactgtctattcaagtcacgacgcatngcgcgcatcttacctcgccatcagtatagaagcacatcngctgtcgtggtatcttccgcacagcgtgcactactgagctcgttgcnagtgaactcgcgatcgctcgangcacgcatactgcgtgtagngncnacctccgtcgcgagactatgctcagcactgcgtgcggcattagtatacatcgtcgtcgtgttgctacngtccacactcctcagctnggcgctatcgtgtcatgcacacgcttctctgattatttgtgcgctgtcgccncgtccttacgacgtacgcgctttgcgcggaactgtgcgaatatcatgtatacatacggtctcgtactagtcagagagagtgtccgtctccatgtaactatgccgtggggcatttgtgtccagttgtacaggctgacacgtgtagnggaggcgctacttcagatcacggcgcgtataatttgttcgcaactccacgaatttcattctcacttagtatagcctagattaacacgcctcgcccagaccaagatcatccatgctaccacaacatgactcttgtgatccccatacaaaggtcgctcaacgtccggcggatgtagcgttccgaacacacatatgcgcgctcgcgtcgacacgaccgttagcatattgtcctcctatattcatatctattacgatactatcaaccgtcgntacactcattttagcaagctcatacgcaccacgccagtgtcacatcgtgtccgacctatgattcctgccttacccactcnctctgtcctgtcagtatggtctccgcggttctatatgtcacatactgttctctctcgtcgcctcctcccatatggctgcgtatgatatgtaccctgctcctgctgtcaataagacggcagacagagacgcgcacccacattgtattatatcagcgtcagnactaacgtgtgacaactacgccaccgaccatgtatcgccatcgttgctcttaaattcgtgcgaatgtacccgcaacacacacggaatacgctacatattgtgccgcacttcgctgtctctgagcgactatgcagcccaatgtcagtcgatgacccgtncnatnagatagcggccntcacatcgcatattcgtacacgtcgtgcgcgcggtgcaccanaattccgatatacaggtgcgtctccgagtgtgtgtgttcctcgtgtctctttatattatataatacgttg

SEQ ID NO: 12818 - DNA, 1451 bp, Homo sapiens
  misc_feature (1)...(1451): n = A,T,C or G
attaaaagacgcgaaccacacacgaaaaanagaagganacgaaaaatatcatatattattttnttagtttttnnnnnagnnnnggtnnnnnnttggagatanaataangatattgaannnnnnnnatgatatannnnnnannaagtagatgtttattnnnnnnnnnnnnnanagtnntngnnnnnatnnnnggnnnnnaaaanngnnanatnnnnnaatganannatnggnnnnagnnnntaangagangttaaattattgnaagaggttagtattanaatcagattaancaantatagattaagtanccgactaagtgntnctctntctttatccgcgcctcgcgagcagtgcaggccgcgcacgagccgcgcgctacgcgtcncatctccatctcctcttatccaatatatcactacacagatataatattaaatatatgattacaagacgcatcagcgcttattgtctcaatacttatatagagacgatcactatgcnccncagcgtcccgctgcatgagcatatatattattacacataatgaggtntcnntaggtgtgagtgtgttcagacgcacgaccacccncaccacgcagntaaatcggagaaacgccnacaagagganangagtaaaccggagaaattgnaaatctcatgatatataacattagagacgagactcgttcacttcgacgtctactcgcgtctactcacgctcgtgcgcctattgtgtcgtgttcgtctttctcgcgttgtttgttcttatcnctatccagggcacagcgcgcgggtcgccccgtanaccgtagttgtggcacggatatcacgcncgaagacggatgccgcagatgtcggtgacagagtcgtcccctatgtttacttcgacttcttgtcacgtcccgagatggatgtcgtattcgttctcacagaggagagagtggcntctaacgcagtgtacctacatgacccaatacgagttagaacgtctgaggttagtttgtatgtgctgtctaccgattgcntcgcagtcagctacctactcgcgcagtcgcagcgtcgctcacgcgcgancacgtacgctgtaatcgtacgtgacggcaatataatctctatcctccgcgcgcacgtcacatgcgactagccttctacactcggatcgtntncttgcaccgcgtacgcgctcagtggaacggatagatagtaatnncaagagatatagntcagtgtgcgggtgtcgctgtgtctcactgtggtgantnagtgcgtagggatcgatgacagtgggtgtcgtcagtacgcgcgcgtacacgagangaccnaccaggagcacgcgaccgtcattcatcccgtagttgcctcctacgcgcgcccatagattcacttttgatctctccacgtacgcgacggccgcacactatcgtaattcnacagagtatcctacgccatgt

SEQ ID NO: 12819 - DNA, 205 bp, Homo sapiens
  misc_feature (1)...(205): n = A,T,C or G
tgtcacgaactctcacacacactcgccacaatcgcagaaacaacaacacaagaccttgngggctgaccatgtgcaagccgttctctggcagaacactgatattcaggatgcaggagaagagtactttgtaattaggtcagaataaacgcagttttttccaaatctgaagaataaaattgagctaatggacagaaaaaaaaaaaaa

SEQ ID NO: 12820 - DNA, 1154 bp, Homo sapiens
  misc_feature (1)...(1154): n = A,T,C or G
ggagtgtggngtggnatggaagatgataaggagtagatnaagggatnggaattttattattttatgatgagtagtggttgntattgttttattnggagagtggattttaagnnntangnnnannnnnnnnannnnnnnnannaanngnnnnaagaatangantnnnnnnanatnnagatattgaaaagtggagtagatattaaatataaataatggtgcgnccnatatctccttctctgtatggagaaatgggcatttttaaacggtctctcataatttacttatttttttatagcacctgaaccgcctaagcataactatatattctctttcgccgatcctatcgtcatctttttcccttattattgacttctaataggatcgcacgccatgcagctgcagatcgcgctgtcccctctcctccgacttttgaccgcgacaaagcctcacactacgcccagtacacgttcgtntttgtatgcgcagcgcccccgtctctccttccttcttcttttatattccctctcaccgtgttttttctttttgtttttctcccgacctacatctatatgttctatattacactcatcttctcccctctcctctctctcttctctctctttcctcctgccgccccttacacaacagtcaactcgcgcagtcccacaccatcgcactccatatacattcccactccatactgcatctctcatacatgtctcggcttccctccgcccttctctctcctcgaatagtaatttaaatcatacatactacattccgtacgctgtcccgacggtcgctgcgtgtccccgctaccagacgctcagtattactaattacgtatatatgttcttctatactcaacatcgcactagcgtcctcgcaacgtcacgccgtaccaccacgatccgtcgggtatgtctgtggagtatattcaacacgagtgatccactcaaccatactacacaaaccgtctaatatccagtaatatagtccacaggtcagctgcagtactatgcttacgtctgcgtgtgcatgagtgatatacctcttaactgtctctcagttagcgcatggtatctcgtcggattgtctgtttcntactccgtatctcggttactttcttgctgtacatcacactccgttaacat

SEQ ID NO: 12821 - DNA, 360 bp, Homo sapiens
ataaacaaaaaaaacaagaaaaagaagttctaaaggacattactattgagacaattgggaaatttgaatatgaactgcatattagataataatattatatcaatgttaaatgttccaatgatatagtgtggcatattaaagaatgcctcgctttgaggggatgaatattgatgtactcagaggtgatgtccgcaattaattcccaaatggctcagaaaaaaaagtagagagaaagataaagcaaatgtggcaaaatgtttccaaggatctatgtgaaagacatacatgttcattgcctattcttgccccttctatcctcttgaaattttctcataattaaaagttggaaaaaaaaaaaaa

SEQ ID NO: 12822 - DNA, 904 bp, Homo sapiens
  misc_feature (1)...(904): n = A,T,C or G
gctcctctcgtccttcgctacgcaataacgccacaacttanaaacccggaaaagaacttgnaggtctatacacactggattgaatctgacagacaccgaaaatttagactcagccccctacaccacccctacctgttgcccgccgatcacagccggaatgcagctgaaagattccctggggcctggttccaaccggccactgtggactctgaggcctctgcatttgcgggtggtctgcctgtgatatcctggacatgggctgttctggcaggtttcccatttcgctcggcctgtctctatgagtcttattcccttgaccttaattagactcataactacgtaaacacgtgttataaatcattgtattcttgtctcttaacgggggagttaccgttgatattataactttagtggagggcctaattaattattcctcgcttcattacctcgtgccgcgctcagttttcgacggctgaacatgaagtgatatcaattcatcactcggagggccgatcacctccatgttcacacccgcatcggtagggtattcattggacgattgtttctttgccgatgcgctttgtggtacgttataagtcggtccgggcttaatggaaggttcgtatcgttttccctcgattggtatggcgtgcgtgtgtgcggttacggggccagatgacagttgccgcaggtcagatggtgttggcatgaacacgcaaatgtatcgagctgggcgtgtggtgcttaatttcagctcggtcgcactcccgccatccgatatgatgcattgtgtaaatagatctggtattgtgtgcgagctatactatagggtgctcgtgtgtgttcatactcatgagatttgcgctcgttggtatagttagagtatgctgcaggagctcgagag

SEQ ID NO: 12823 - DNA, 845 bp, Homo sapiens
  misc_feature (1)...(845): n = A,T,C or G
gctccgtctgctcccatcctctcccgntnnnttgcaaaacacccgtcgcagaactgccacacctcgtgtggacgcaaacttgtagctctatgacacactctgattgagtccgacagacaccgacaattttgactgagcccccaaccccacccctacctgttgcccgccgatcacaggcggaatgcagctgaaagattccctggggcctggttcccaccgcctactgtggactctgaggcctccgaatttgcaggaggtctgcctgtgataacacggccacggacttttttcgtcaggggaccccccgcatgggcggacgctatgttgtttttttttttcgcaattcatctaagctcgctatcctgcatcgggtgcccctatccaataacgtggatcggcgcggacgcaactggtccgctcccctgccctcttgggttggggtccgatcgttgacagcttgccacggtctacctggtccaggggccctaaggcagttggtgagaatagtgggaatcgcgagcatatctactggtaccgcctcgacctcattcacctatatatgcttactcacacccctatatctcctcagtgaggtccgcccgtcggagggccccccatctcacaccgccactcctccttgttctctaagcagccatttcaagcccccgtcccgccatgtccaccagcgcccgctatagcaccacatctgatgtgtttgctggagtccgctcccgatccctgctacaatcggcttggcccgtcatcgtcgcgacgtattccaccagacagtgatcgacacacagctgatccagtagacaggaattgttatgctcaaagtatcaagt

SEQ ID NO: 12824 - DNA, 741 bp, Homo sapiens
agaatcaagcattaatgactattaatcatagtaaggaccaaaacagacataaaaaacgatggtaacaaatatggcgcgcggcaaaaagagttaaaacgactcagcaatgtgatattaacaaacgtgcggaggacaacgatggggggcaaacgtcttcgtatttggtattgaatgttttagccagagtcagactctgttacccaggctggagtgcaggggcccaatcttgccgttgtgcaattccggcgtcccatgtacaggatgaggcaggagaatgtccttaacccgagaggtggagcttgcagtgggccgagatcacaccactgcaccccacctgggtgtcagagcaagactcgtctcaaaaaaaaaaaatctatatagtacctgggtcacaaagtaatctgtacaacaaaccccaatgacacaagtttacctatgttggcaaactgcacgcgtaccactgaatccaaaataaaagttttttttaaaaaaagaagaataaataagacctagtatttgatagcacaatagggtgactacagtttatcataatttaattgtacacttaaaataactaaaagagtataattagattatttgtaacacaaaggataaatgcttgaggggatagataccccgttttccataatgtgattattatacattgcattctgtatcataaaatctcatgtaccttataaatacatacaactactatgtacccacaaaaaaaaaaaaaaa

SEQ ID NO: 12825 - DNA, 869 bp, Homo sapiens
  misc_feature (1)...(869): n = A,T,C or G
gtgcgcactgtcacggtaaccaannaannnnttgcgacnncntgtgtatgtggccaggtgcctggtgcaccaaattagtggggtggggcaggatccttggtgtctcttgctgagcgggatttacagggtggataagacaaatttgttttactgtctacgcattgaagaacatccatgttgtcttaagtgtttggctggtatgaatcaacttgccttgaacaaaaaattaaataatattgaatgccaaaataaaaaatggccttagttggcctaacatggtttttttttgatgggcggttacctttgagcgaggggccaaacgtttttttttttttcaaacaagatatgtaccgtgtatgcgttaagctctggtggggctcctccatttctccgtaatctgatgtggatgccaaaaacaacgtgtgcgtccctgttcattattgttatatgtattaatgcgaattattatgttagactggtgagtatgagttagtgggcatgataggtgggttgtattacttatgcgtagtactatagatttcgcacaagcaaggttcgttatcgctgacaaattataaagccttaccttataaagtcactataattatatgttattttgttgtccctcaataactgatagcgtgcttcctttatgttattaactggtgagcaagttacaatatcgatgttttataggattgtgcaggtatggacgcgatattaaatttaattaaggtgggagcaagatgatagggtaaatcagtcggttataggatggtcaatcgcgaggtagtctctgcggatctatgttattaggcactcgaaaacgcgttcgggatgaaataggtttgggtaaataagatataggg

SEQ ID NO: 12826 - DNA, 1080 bp, Homo sapiens
  misc_feature (1)...(1080): n = A,T,C or G
acaagggggaanagggggaaaangagatatctttntttgtttttatntgggaganaatgttangggttgtgaggnnnggaannaaagtaaagnttnnnaaatttannnagnnnnanattntnnnntttgtttnntanntnntttgtgagaatttttgtnggatgnagntaatttnnaaattttattgtttgtgangcggtgtgacaatggatgccccggaatttcagttcccttcccatcgtcgccaaagataccttgggtgggtcccctctgctcggtgcccgccgcgcgcgccgcccccgccccaccccccgcgccaggcccccccccccngccgcatacgcgcccccaggggggtctcccccctccggtgtcttccacccccgagacacctgcccccagtcccgcgcgccccttccagccccccgatgcgcccacgcgcccgcacccggcctcagtgatttgtactgtctcccgctttctgtctttcttgcggctagtgttcttagtccttcnttgttatctagtggtgaacaagggttcatgcacgcgcgatattgtatggtttttagatgatcattcgctgtccccgacgcttccgtcggcgtcatctctacctgccctcctcgcgctgcgtctgacgacgcgcgcccgcgcgcgactgccccgcagcacccgcacacccccccctcgcgccgtctcctagctcccgcactccttctctcgcgctcgttttacgatctccttccattccgtgcgtcgccccatcctgcgctaccgccgccatgcgtaccgccgcccgccgcacacgcctatcaccatcgtctgatatccgcagcaccttccgggcgtcgcggccgcgcgcctggccctcacagtaatcgaccaccgcatcaccgccgcggcgcggcgcagcncgcgcaggagctcgccaccngcgtacggcatcgccgcggtccatcacgtgtgcaccccggtgttgccccgcccacttctcactcacccacaggacccacgcatcgacgcgtgcgccnccggtgtcgccgtctcactcccacgcaccgcgcgcgtcctcgcgct

SEQ ID NO: 12827 - DNA, 220 bp, Homo sapiens
  misc_feature (1)...(220): n = A,T,C or G
cctggtgataaggatggagttcctangaatgagatgactgcccttgtagaacagactcaagagagactcctgctccttacgtcatgagaagacacagaaagaaggtatcatctatgaatcaggaaaccgttccttgatcttggacttcccagtctccagaactgtgagaaataaatgtctctggtttataagcctaaaaaaaaaaagaaaaaaaaaaaaa

SEQ ID NO: 12828 - DNA, 357 bp, Homo sapiens
tgggctcggcccagcagggcaaagaccaggggacagagagaggaaggggataactacctgcagggaggggggatcctctttgctgaaagcttcaaaggcctgcagagacatctgaacaacctgcctacaaagaggagccaccctcttcagagcctcctctctgctgagaacagcagacagcaggatgaccagtgggcagagaagagctaccccctccagggggggctctttgctgacagctgaacactccatgggatgacctgcctacagagaggagctacccacttccggtctcttctgagccattctaacactaaataaaattcttcttcatcttcatcaccaaaaaaaaaaaaa

SEQ ID NO: 12829 - DNA, 202 bp, Homo sapiens
tgagatgcttcttcaccaataacatttgagattcctcatctgattctatatttgaactttggacattagaactacaattcggaatcgcaagagttgactcttataaatagaataaaacacttaatttccattccttccatttatgcatcctagaatcagacataatatcaacaatatatgaatgaatacaaaaaaaaaaaaa

SEQ ID NO: 12830 - DNA, 109 bp, Homo sapiens
tgctcttccggatgcaggagaagagtactttgcaattaaatcagagtaaaagcagttttttccaaatctgaagaataaaattgagctaatggacagaaaaaaaaaaaaa

SEQ ID NO: 12831 - DNA, 197 bp, Homo sapiens
gcgcacaacgaccgcctacacaacatatctcagccaccgcaagcgaggttaggcgctgccgatctcaagccttgctcttgcagggcactgatattcaggatgcaggagaagatactttgcaattaaatcggggtagggggcagttttttccaaatctgaagaataaaattgagctaatggacagaaaaaaaaaaaaa

SEQ ID NO: 12832 - DNA, 956 bp, Homo sapiens
  misc_feature (1)...(956): n = A,T,C or G
attaaannnannnnaannannnnnnnatttnnananaannttatnnttnnnttnnnnntttannnnnnttannnaaatttttnnnttnanaanannananttatatttnttattatannnnattatnatattatnnattattttattgtttaaaattattaaaattaaaaatttgaagtaggattttgttttatctaaataatgtttattataagtataatttataaagttaatatataaaaattttagttaataatataatttttttgaagaatatataaataaattaatnaaatatttataatatgtaaaagcattaccccacgccacccccccacgagcaaactatcaatcataagcccaccctgctcaacccacccatatccaccgtccgccccgcccccccaaccacccccccccccacgtactcaccatacacagcatcaatctatatggttgctagtccgggggcagcccgtatacccacaacagccccgagcatctgccgcatctcaactaacattcgtagacttccgtatctcgctgctcccgttgctgcttggcataacgcgtccgcgcccccccgcgagtgtcagtatgctagcacataagatccaaaattgactcgccccgacaactatcgaaattatacccgccgcgtcagcgcacgcgccctactgttcaccgtccccgccccacatacctccctcgaacgctgctccactgcacctacatgccccctcccccaacccaacaccagccccacgacacactcacatcgagtcaaccctatccacacgacgcctccatcgcccccacgccccagcgccctccctcccaccaatagctccatctccatagacgcccaaccacgcatcgtccccgacccctcctcttgccatcctccaactccccccgcccccacctcattcaatatccagcactactaacactat

SEQ ID NO: 12833 - DNA, 606 bp, Homo sapiens
  misc_feature (1)...(606): n = A,T,C or G
tttngggaactttaaaagncnnaagggactnttttttaaattaacccccccnnttcaagggantntaaaggnntttttnanggnccttaggnccnaaaacccttaaagaggcccccccggnaaaaacccaaggaaagngttggctttttntaaccaaaaaaagggcaaaanttgcccgagggaaatttttcaaaaaaanaaangnntngaataaacaaccttttngnagganccaggtccccnttangttttgggaatgggaaaaatcccntgnngtttcaattttattttttgcatccgnttgaaantttganaaccgggaaaataaaagaccagtgangtttcaggggcagttggtttccaccacttgggtctctcccttaaagacagatttctcaagcaccaccccagacttgctgggtcagaatctccctacttgggacatgaaggatctgtcatttcaacaactcgccaagagattctggtgcaaccagctgagtctgtgggccagctttaggaaatttctgctcttccatacagcaatcctcaaaaataccactatagatctattgtttagagaattttatggtattgaagtatgaaaat

SEQ ID NO: 12834 - DNA, 619 bp, Homo sapiens
  misc_feature (1)...(619): n = A,T,C or G
tcngaaaaaatncctttcngngtttnngggggacccggggcccaaaaacnaggaattttttaaaanggccaancccccccnnctttcnnggccttntctaangggagntgccccccnntnnaanattggggnnctnccccnnnnnttcngnggnattaanccccttagaancncnccaaaaggggggcccntttgtgaaagcccccattaatttccccccnattngtttnnggggggnaaaaanaanccaannggtccccccnggaaaagtnctttggaggccatttttaatngggggtaatttggccccttctggaccaaaaatcttacaccttggggagatttttggctgtnaattagatccccnnttcctgttgggagctaagnaatggggaaaggtagggaggctgggttggatgcaaanacatggaggacagacagggaaaaccacttggcttaatgcttttgcatcaggaaatgcagattccctggtcttcttaggaagcctcatgttgaccctctgtaaccaaaacagaagttaagacctanaaatgaaaatgattgtgtttctgtggagattttaaaaaattaaataacgggtgaaagcaaaagataaaat

SEQ ID NO: 12835 - DNA, 120 bp, Homo sapiens
taaagatttcttgacttccctctggtgaagcttgataccaactgacctataagggcttggttttcacaacagagtcttagtccaccctcagccatcgcaccaaatactgagagaacaaat

SEQ ID NO: 12836 - DNA, 629 bp, Homo sapiens
ggtgtggtatttttaagtgtgaaccagctcggaggggttggcccgcgcccgcggaacggtgctgcgggctgggaccggggtccttgagttgtttggagaggtgccggggaggttgaacatgctaggcgcgcgtgggacgttttcgaagaacgcgggttcaagatcgctctcgtcccgtttgagagcgcgttggcgcggttgttcggagggggccgctgtgactttgtgagggggaggccatgcggcgtagggctttgtggccatgaggccggtgtctgtgtgcaccctgtgtgcctgcaattttgagtctttgtgcggctcgattggctcgttattttacgggtagatcgttacgaagttggcctgtgacggagtgccgcgtggcgttttcgctgttattagcgggtcatagggtgtggaaccaggttcgactatccggtgtctagacgagaagaaggagaggtcgagtaatttttattgttggatgtggagtgcacgcagtgtggtggtggtgggtgggggatctagtgtttttggagggaaggtgggcctttaggggtggtcctctcggagggccacgtaaagcagagtaatagaggcagttgttttcagagagaggcggggggggg

SEQ ID NO: 12837 - DNA, 282 bp, Homo sapiens
  misc_feature (1)...(282): n = A,T,C or G
gtgngcgaggnanctaanaccnattttacttttcttnacctggattngngaaaaanatntcntnccccaaangggtntcccgganngnggggnaagnaaaanaacntttttgggntaaatntngttatnntcggggggcccctttgtnttnaanngggaattggtngggaaccgggatngttgtcnggganaactggaacctttgaaaaaaaggnaaaaacccnaattatttttggacacattttttgggctttccaancttgnaccaangtttttgggcaa

SEQ ID NO: 12838 - DNA, 316 bp, Homo sapiens
  misc_feature (1)...(316): n = A,T,C or G
accatntacattcttacccatganttgtgagactgatacntgccccncaaggaataccagtactgagtgatgaagaacattttgctaagttgttctatcgtggtccttgcttaaggggattgttggacggatgttgtgggaacttgaacttgaagaagnaagagcccatcatttggacacatcttagggcttcccagctgcaccaggttatggacaagggacctggaaccccaacccttccagtcactaaccacatggcctgagatgtcatttcatgcagctgggctctttgtgctcatcagcaagtgatgtaaat

SEQ ID NO: 12839 - DNA, 442 bp, Homo sapiens
  misc_feature (1)...(442): n = A,T,C or G
cctctcctttttggctcttggcgccctcgtcgccgtcctcgttctttgccccccctcttgcctcgtccccccgctggctcggcccccccctcctgtgcccgttcccggtccctctcccctcgttccgggcgccnctgccctccgggtncttccgcgcccctcccccgccttcccctctgccggggttttccctgcctccgcccgtcttgttcttgtcttccgcccctctcgtttcctcgctttgccctccggccgggcgtttcggngtcctccgcgtccgtggtgtccgcctcgctctgtgcctctgtccggccncttgttcccggncccngggcgtgtcttttccttgccttgtgccgttgctctccngcggttccttcttcccgcggntngcntggcgccgggcctttctttntgtttttggcgtcttcctgttncggag

SEQ ID NO: 12840 - DNA, 522 bp, Homo sapiens
taggggatgccagccacaatgcgttcggcgtaggttcttggatttaaactcttcagatcatgctccatcaacccaacacttccaagtctcctttagtactgatatctggtctaggctacaacacctctactctcccttgctgaatactgtgcgacagatccttgtgacaggttactatccatatgaaggaactgccaggcgccaatgaagatgcaaggatgagactccttctgggttcaatgtaaatatcctcacaaacattatcacctctaaaccatattcctatctactctcctgccttctgtcttagaactaagaaccacagtctgaccctctaatgactgtgcaccataatattaatcaacatgaacttatggattcctaggttctacacatactaactaggcgactgtggcaaagttgggctccctgtttgggcctcattgttgaggcacagtttcttacttagacataaattgtagtcccctttatccggttccaccttttcattcagggctgctc

SEQ ID NO: 12841 - DNA, 796 bp, Homo sapiens
agaccgtgcgggattgctcccttctcacaagccttactggccctttatggatcctggtgctagatcgaaaccaacacagcctgccctactgagcccatagtagaaccttctaatttccccatcagccatgctaaagaataaggggcctgcctacgcaccaagtaactaccgggatttcaagcaaaaagccttctgcgttagtgcttaggaataaactcttttgagattgcttccttaacccgaccgctcgcaagacatgctgggaatcagccgccttctttaaaaaggaaatccacactgggcttcgaaaactgaacatatacttgattttaaatgggcccctacccgcccccattaaccagtatcgtacgactgatacccactatttttacctaaaaacacgaaaccctcgttaacttgtaatacaaacccccctggtcaataccttggtgtttggtgcaggggaatgaacttggtcgctgcaatttattccccgagtgaaggctcttttcccttgcttggacaaaccaagatatggcattgggtcgtgttcccccgcttatttttttaaggttcgagaacctgggagtcaacccaatgttaatatccctaaaatcctcacgttcggcgaagcgtgtacagttggcaacacacaattcgcccagctttttttgtttcttgtttgaaagaaaagaacatagtatggcgcacttttggggagagggggcgccatttgacttggggctcttaagagggtggctcaattatgcattttgtgcccacaagtgagtggcta

SEQ ID NO: 12842 - DNA, 498 bp, Homo sapiens
  misc_feature (1)...(498): n = A,T,C or G
ggcaaaaacacangcagccncttaaagatggcccataaaattcaagacatgaactttggaatttaagtggtctgnatttagatcnngntccgccacanctagntgtggncttgggaaagtaggancctgttggcnttnatgngtcatcacagctctttngctcaacatcagttctagtccccatcntntgcgatagcaatcantctncaggnaaagttttcacctcttcatttaaggttgntccaactctnaagcagtctgggtncccttttccccaactcccaccccagttgtatctgttacctgtgnccttcccttctgaatattgcctcaatagcatgaacccttttatactttgaaagncagcatggaaatatggaagcanagagagtgcatagaatgtggaatgtgagtccgggctctgctaccagctgnatgnccttgggcagtttatgtaacntggttgaacttgttccctattttcgataaaaaatcaat

SEQ ID NO: 12843 - DNA, 1694 bp, Homo sapiens
  misc_feature (1)...(1694): n = A,T,C or G
cgcgctcctcaggactacttcgcgctggcagcatnctctcttcccntcacactctatcatacntctcagtgctgtacgactccacactacatatatcactacatgagcgctagctcagttntcgnaccagacgncagcttcgctgtcgagtacgacagctcggctggcagtcgattacctgtctcgcgagataatgatagtgacagagttcagntactactcgattatgcgntatcatgcgcgagatctcgacgttcactcgattccatacgacctcgatatcacgnctgactatantacacgtagataaactacacagcactacatactntagattcatcacgatagtagatatagcatacgatcgcgcatgacactcatgtcgttagagctgcgcgcgataacagtatcttgtgagcggncatgacagtcataactatacgtcctatgtatcgatagtcgtcgtcagtaagaatagcgttactgtgatcagttgctagcgtcactcgnatattattgactgtaaagatcatgagcattgcacatcatatacaaggtgccgctagtcgatcataggantcatagagtcgaacattcataaccgagactgagcgtagttgtngcagtattatngacagtgatgcgtcagtcactctatagtcgactctgtagtcgtaacgcagcactatgtcnacgccatcgtccgtngatcgcctacagacgtgtctccgtacacgtctcgtacgatctaatagcttatgagtgcatacacgatatatatgcatatatgcgttatgcanactgatcgatctaangcatgcgacgtagcactngacctactctatactanatcgnantcgagtatatagatcctagtgtgtgacgtatgcgtccgcgtgtgcgtgtgcgacctacgtcgagtgcatctacgcagcctaggcagnatcagtatagactgacatactatcactccgatatcatatatcacgtatanctagctcgaccgaccacntgtatcactaggatactcatcatagtcatgtatctttcacatgactatgtatcgtctactgactcctgatcgtcacgtgtcngtagtanctactctcgtctatacatcttntacaacntcatcgaatcgctctgttgcactgacgtagcatagtacgctgatgatantgatanacacgcatcacacatgncactcacatcactacacttgctntnaccggatacccagcatcgatacagtagacacgaaagacacgatccgactctatatattgcgtgcagtatgtattctagttcgagcttatcgagtagactgagattacgatattctcntagtgatactcgtacgcatcgacatatagagctctgtaccatctaagacgatccctagcgcacgtgcgtatatgtatgtatgtcgctcgtttgtgcaccagattcagcacgcgatgatatcgntgtcactnaagtaagtgacagataccatctnancgtgaccacgacggtgngtntgagcgatagagatntgtgttattcgtgtcgtgtccgcgatatcctctagcggctgtatatatggtgctgtagttaggactattggtgagtaagacttcttagtgacgcgtcgtctgtagtcaagttattcanacccgcgtacgctcactattctctnattactatatgtcatg

SEQ ID NO: 12844 - DNA, 933 bp, Homo sapiens
  misc_feature (1)...(933): n = A,T,C or G
ttttattattaaatataattgaatgtaaaatttttatagttatttatttaaatgtttnatggatgtagngttatgaatataaaattnnntaaaataaannnnaatanaataannnnnnaannnnntannnnagatgaaatnantagaaaaagagggaagtagtttgatggaaaacaaagaaaaagaaatggataaattgagggtagggggaaggaaagatggtgtgatatttttgtgtgttagtgggggtgtgatgtgttgtggtgcaattccctgccccatgaaagaagattatctcacgcacacattatattcctctcccgattaatttaaaatgatcgaaattaaaatatatttctttagttgtctttttatcatcatgaaattatatatattataatgtataaatatcttatattaaaaattaatatgattttttttagtgccttttcatatgctagcacgtgatttatgtgccgcctcagcgctacatacccacatagatagcggcctcgccaatacaacggtctcgcggtagtagagccaagtctgatccgtcttgtcgttcaacacaacatattttctccactccactccattgaaatagacattcgcgcggcctcttaccgttaaaagtaatcgttgcatatggagacagtatcttcaccatatttattcttttacattggtatgtacactcgaccatcgatgcgatagtccaccacaatctcagtcgcatgaacattttacaggtggttcctgcgacgtgcgtctcactcgaggagttatatttggagtctatatttgttcgcctcatgtttctatgacgactntccggggacgattgtgcggtattggtggtctattgtctttctatgattatcctagagctgacatactgcatgctattgagtttatcatgagtcatgttat

SEQ ID NO: 12845 - DNA, 896 bp, Homo sapiens
  misc_feature (1)...(896): n = A,T,C or G
gtgtgagaaattatctttctctgagaaactctacttcctgctgcccctctttaaaaantgaaaagggtgtnacaaaacctattnaaanttnccccctnngggggtcccatncctggcccntctaccgccttggggagggaaacctttggagaaaaaaaagggtgaaaagaaactcgattctaccaaaataactggccttcaccaacccctactggcttatgggggggggccttcgctattgtgctgggctctaaaaaaaaaaaagaagaaaaccccccgtctggaccaaaccaaaaacgctcggcccccctcggcctcccgcgggggagagctctaccggccactctccctcttaggggaggggtaatctcctaagtacccgccgtaaactaagctcccctggggctcggggaccttcccggtcgccggaaaggccgggtacacctccccccaaagggcgcggccctccccgcgcctncgcacccaatcccgcggggctgaaccgccaagagcaaaaccctcgtcacgccaaagcgcgcgcccccaccagggcgccaaagccccctccacaagagcccccgcaggctgaggcggcctcaccctaaggctccccgccccccccggagcgaagcctncacacaacatcccgcccctcaccgcgccaggcgggggcggaaaccccccccgggggccatcaaagactccccccgggctgctacccccgtaggaaagctaccctccggccgcgcctacctgctcaaagaccctcggcccttagcacggagaccctccaaccgctcttcatccccttcggaagagaacggggggggtctttctcataaaatcaaccgcccccacgcccctcacacgcaacgcacggcggaacgccacgctcg

SEQ ID NO: 12846 - DNA, 1078 bp, Homo sapiens
  misc_feature (1)...(1078): n = A,T,C or G
tttgttgtggttgttggtgttgtttttggtnattatgttgagaaaaaaaaaaaaaatttaattgaacacaaaaaaaaaaaacttccgggggnnnaacccgcacccacaaacncacagcaaagaaaaaaaaaattttaangaggaaganaaaagaaaannaggganngggggggggaggaggacagcggggggggannngngccngggccgggagaaaggagagcgagggcgggggggagggggggggggnggcaaagcggccccaccgaggncaaacaaacaaagacagaagacaagaacaccacaaattttttttttaaccgaaggtcgacggcagacgccgggccgcgagaccgcagcggcgcggcccaccacggcgcccgggcggggcccggcgccccccgggagcgcccgccgccaggcnaacgcccgcggcccaccccgagagaccgaggtcacgaagacgcgccccccgccccacccacccccgtcctcccaccccggcccaccccaccccaaaccgcggccggccacgcccccgtgcggtccgtgtgtgctctctcgtctctccgtgttttattctcttactcatcctctttctctgctctttctcgcctcctcctctccttacctcccccgccgtcttgccnccgtcgcccgcctgtgactaccctctgtttatactctcccgtcacctctcgcctctatctttcgtttttgtcttgtcgggctcttctcagtcgttcggtgctcgttcctcgtctcgctctctgtgttcctttgttgtttgtgctttgcgtccgtgcgccgtgctccgtggacagtcgcgttacaatcttcttatgttttatacctattcttctttctacttgttcgtatacatgtctagttattaatgtgtttgttcttatttgtttatttgttcgtgtgatttgatcttgtgcgttccgtatgtgatcgtaggcgcgattctctgtcatgtgcctgttncctcatcttacttcgtctttcacctacttctcctttcctgcttctcgccgtcactagcggtcgtcctatctgtgcatacagcatttat

SEQ ID NO: 12847 - DNA, 678 bp, Homo sapiens
  misc_feature (1)...(678): n = A,T,C or G
gcgccgggcgtgggacgtacantttcaggagaggagggtcccctcccggccagggggaagggtcggatctcttttggaccacaagttctgcgaccaattggtcgggaaatcgtgggccggggggtccttatgggggcctggtggtgtctcaataagggtcataggcccctaggccactggactctaagcccagatcaatattagtactcatctacgaggttcaattcttgggggccagactgggtgtcactttattcaagggaccagagcgctgcgcggccacatgggggaggggtggtgaactcaaattctgaccactgggatgggcaattctcatctgggcaggggcgggtcaaatgcgtcctctggagggcagggggagctaagtacaggctagttggggtttacactgggatagggggggcatggggcgtgaatctaaggctgacagggtagcgggggtctctctccctcagggggcaggttctgcgcaccgcacagccctttcagggggtggggggaggggtgggcttaccggtcggagagtcggggggggggcctcggggcgggccggcgggggcggggagggggaacgcggggtgggggaaccggcggggtgatgccgtggcggcgacgttggggggaggcgggggggggggggatgcctaaggcgggcgg

SEQ ID NO: 12848 - DNA, 1313 bp, Homo sapiens
  misc_feature (1)...(1313): n = A,T,C or G
ttttaattattattgagtaaagagtaaaagtagtaaaagtggaangggagggtgggggggtgggggtaatatgaatgagnaaaaaagatatnnaanttntanaaatannannnnnnnnanaaannaaannanaanannnannnnnagatancgaaggtnncgggaggacatggttccttatcaccacattatatcaatttagatggctctgcattttgcgggacggggcacgcacaagtagtggctcgggaatggttattcgggtgtcgcggaggtcgccacgacaaacgctggagaaccactcattactcccaccgacaatgcgccatactaaatataacactacctccaccgttcgcgaagccgcataaacaatatttcacattatcatacaaaaaaataccataacacggagagctacgcagaatagatccctaaatagcagactactggtagaatattttatatattgatggttgaactacgatgattatatatcaactattagtaattttaattgtgtntaatcgtgatgtgaangagtgtaacggagatgtgcacgacaagtgagatcaagagaatagataatatgtagagagagagtaagagtacancacacagaaaatacgcagccacgaccgagcacacgcgacccacgcgagctaaccattcgtattgtcgttcgcggtgacgcgctgagcgggcgcngcacgtgggcgcacgcaagaacatgagtcatgcgaacaccgtagagatatcgagataacgccggcaacaaaatcacacatctcggatgatatgtaatgtatatacatagtcaccgctgcagcgantacatcgatgtgtatatatatcctatatgtgagagactagagatcatnattaagcaccgaaatgagagaagacgatcnagcacacgacagggatgtattagagtagcacatactacgcgcgatagctattcggcgtatgnacctagatgagacagcatacantcagcagcatacatacaggntggtgcacagcacacgcgaggatgctnnnaagaagagtaagagaactgaagtggtagagaaaggtgatatagtatgaagacatgngctcaaacatgagaggacgatctcaacgatcgagataagatctatagagaccactaacatcatagacgacgcntcgcatggtgcacgagcgagacgcgtgaagcagcgagagacgatgagtgatatcgagcggagtgggcgagcagcgtatgacgcacatgacagatgagtctacctacagaagaactagcattagataatcacagatagacg

SEQ ID NO: 12849 - DNA, 362 bp, Homo sapiens
  misc_feature (1)...(362): n = A,T,C or G
tctactttccaagttcgcagttacccaaaaacatctccacctcctctcctttcctcttttttaaaaagattatgaggctatactacctactncaccaacccataccaantcaatnaacacnataacnccaactcaataatacacatcaacaacactacaaccatntcttcatcccttactcaaaaacaaaaatctattttatatctnaattttctttncactgatagaaccatatcanccctatatactaaataaaatataactctatccatcttttttcaaatcctaaaataaaatctatttatctcccaatcatctattcaataaaagacaattcccttctcatcccaaaaaaaaaaaaa

SEQ ID NO: 12850 - DNA, 2038 bp, Homo sapiens
  misc_feature (1)...(2038): n = A,T,C or G
gagaaaggaagaatagtatatnttaatgatgttntnntnnatntantnttnattanttnntantntntntattatnnatatagagngngtngnagnagnnanannganannaaannatanagnanaannagaganatannnanannnnanannanannanngaannnanntnnnnnnnaatnttatagattgtgtagtagntgnnagnnntatatatannnagatatannannnannanagaannnnataaangatttagatnatannnntnnnnnnnannnannnnanannaaannnannnannnnnnnnnnnnnnnnntaaannnantnnnnnnnnnnanntatnannnnnnnnnannnnnnnnnnnnnnnnnnnnnnnnnnnnnnnntnnnnnnnnnnnnnnnnnnnnnnnntnnnnannnnannnnannnnnnnannnnannnnnnnnnannntaannnnanngtnnnnnnaanannanntangnannnannnangtaaaatnangatgnanananagtagcgtagagtgatgatgnntnnntatgttatggtntgtcgtcattcngctgtnagttgtngatgtagntcgtgnatctntnagtcagagtgagtaagntacngtnaatntanatttcactgnngngcnagtngangntcgagcgctagacatgcagtttaagtatnatgantaccatatgagatagttnatatatagataatatatatagacgctacntncggtatagggatctcatatctatantntgataatagtgatnatagatagtactagtangatnaactactngtatatgaatttcncncaacattcananganctagcagtaatgcatcantgatctatatatngtntcattacgntcacgtcactatatcgtgancnganacanagttgtnacctataatatacatactatcatatatgtgtantattantntntntattatgttatgtatagagagatngatgacgcgcanancnanatnanatanagtgaatgaggaagtcanacantnatanataatgntagcagatgatcgagatatatgttgaannacccgacngcgtcaaattatgtatagatctacanactttaatttgtcgcaacgaacnatctacatagctatactanatcatgattgcacagtacacnctagtccatgtgtgtcgtatgcgnagcagtatagtaagatgcagcacatacgtgtagcacacacacnacatgcaagcgctaccaacgaacagagcgtactatcgaactaatatggtattctgatcgtatatcgnaatatgactctctttgtgtgttacgtcgttcacgtcgtttntncagacgtttctagcctctctctaacatcgaatcacatctactatncntatgctcctttactatagatacctccatttgtcacnagacattacgccatatctgcacacctatacagccagccgntcccatcgcttatatcttagagaagtccatnactatgatagtgtcacgctcatgtcaccagtaatctctagaatcccgaacgtcgtcgcgtctgtacatcnatatcacatagcagtcttaatagagtattctacgcatancatatatctttgtacccacactctcgactctanaatgattatactatattaatntttagatgtatgtgtctatcataantatagtgatagtgagatcgatgctcaacacagtactcttgatattagtatnatatcntcngacgatagtgtgcatagtgtgtaagtttagctagtccngacaatgcaattantctntcgncagaggntcgtctctntaggtctangtgtagcctatgttagtntcngcatgangagtgcgtgacncgacgtgtatgatatgagatacaccactctgtattctatagttggtgactatatacaantgtngagtatatgatatatgtagaagaatatatgtgaatatactactaagacaacantagtagaatgatatcngtacgtcgatntataagaacgt

SEQ ID NO: 12851 - DNA, 417 bp, Homo sapiens
  misc_feature (1)...(417): n = A,T,C or G
cggggggggaccgccgcgccgcggcgcggggagagacgcgaaaagaaggacctcacactcgccagctctttngcgtatnaagggttgacctgagaaaacctcttnngtaactccancaaccaaaacaaaaatgcaacggggggggaatttcaataaacantacaatcatcccaacctaatctgggttaaaatacttggaatgggggggcccctcataatacctcttgggtgggggtgtaactcagtcctttcttttctcaaagcancaaaccaaaccctcggaaccggggggggggggcctcccacttgcccttcataagtacgaccctttaagattgaaacccctggaggctgcgccacccggagaacaagggctccttcacattaaaggcgaattgggagttaaaaaaaaaaaaa

SEQ ID NO: 12852 - DNA, 1612 bp, Homo sapiens
  misc_feature (1)...(1612): n = A,T,C or G
tggtagatgtanggtggaggagnngnggngnnngggggagtatttgggtnnntgnnagatggtgtgaggagatatgngagtatgttaggtgatgaggnnttggngangngnntaaaaaaanaataagntatatgtnagagtanannaataagaagtagagtaaatnatanntnnntatatatagntagaatgattannnannnnnnntnnnannnaanatnnnatnnnnnnnnnnnnnnaannnnnnnnnnnnnnnnannnnnnnnannnnnnnnnnnntnnnnntnanannnnnannnttnnnnnnannangnannnnnnnnnnnnnnaaanaagnannaannnaacnntgaaanaaaaanataaatagtatactagtcagaagngatatcatgataatattttatataccgtcggttatttgtcatacggagcaaatgngagaatacgaacggatagacgagagcgtggcgganacccacgatcagagcaataacaacacaatacaagagtataagattacgcgagtgcctcagcactcagcgatgccaccgatatagacgcgccgtcacagtacagtctgcgagtcgtgtcaggtgccgcgcaacgctcatatatacactntcctttatcctacagctcgcgcttacactcgcagatcgancttncatacatatatataacatctacggtcagagtttntttccnttanttattttctctatacatgatacttgttctntttcgtctatactatgtgtctatcatcgtatattatgcgcncttggatactcgagcagtatctgtgtatgtgcgtgttttcttattttagtacctcgtacgctcgncgtcggactnatcatcctatgtgggcgtgtgtgtgttgggctgtgcgcgcggcgtcgtggagatantacgccgtgagaacgtccgagtctgtgtgctccttccattctctnatatgttcgcgtatcagantnatgaaacgtcacgcacagagaggcgggagnagcagcacgcatcgncggaggngacacgggagagacgaactgaggacagcgtcatcgtcgactgcgcgtcacaggctacgtatcgcttactcaagcacagacacgctcccatacactaacaancanagacgccacctcaacgtacacggatgccgtgcgagtcgacttattgccaatcggcacacgagccagcaactaacgtttctcagctgtctgtatatagacatacagaactgcaatagcgtacaggcgcgacagcgcggcatttacttatacacactgttgggtaacgaatcgcacgaactcgatgctgactgcgtagatcgcgccgaagctccaatgcgggacgaaccgcgtctgtccgtgtaaatagagtcgcactgccgcgctacgggcagagagcggctattctacgtgggccattgcagtagtaagtcacatcacgcgaacgacctcgaaacatcctcacggcgacagcccaactcgaacaagcagaacagcgcganctctcggatgacccangatcttcctcaagtgtatgagaggtgccactatggagctgcgtctctgctgtcgtgtgttgacggtgattccactcgtca

SEQ ID NO: 12853 - DNA, 351 bp, Homo sapiens
  misc_feature (1)...(351): n = A,T,C or G
ccgccgcaaccccccccaccccacgcacacacacgagttaaagctgacataatccccacacgaactccaagctctatnacacccttcattcaatataacagacacccaaaatcaccactcaccccggtccggggccctacctaatncccccccatcacancccaaatacacctaaaaaatttccttggcgccttattccaaccccccactatagactctaagacctctacatttcccgcgtgggctacctgtcatattctacgtcatagccctcgctctcggggggggggccctttctgctgcgcagtctctataaaaaaataatcccaaaaaaccttcattaaaagccac

SEQ ID NO: 12854 - DNA, 1922 bp, Homo sapiens
  misc_feature (1)...(1922): n = A,T,C or G
tatgtaagagaantagtganntaagaggnngggtnngtggngngngtgngtgnttnntagtnntataatagatggtntaagtantgtanaatatgatagtgtagatgtgaggngtnggtnngagtgnntngtnnngngaananagataaataatgatanagatgagaanatgntnnngtgtaaggagatagagatngtgaannnaattagatatnataggntnagnagannnntnnntntntntattanaanaannttgaannanannnaatanntgnnnannntnntnnntnaantatanntnnnnntnnannnnnnnntnnnannnannnnntnnnnnnntntnnnaannnnnnaannnnannnataannannntntnnnantnnnnnnnnnnaaantaaaatgaaatnnnnnnnanngaaanaganagataaagnaagagantgntgattgntgtgtgcanngtnatatcgtatatattacnnntattatnattatatttatcactactnattgcaatatatagtgtagtagatgatatatcatatatagtaatagttatanatttatagattgactntctngcgtgctgtatntantcaaatcanagattantagcaacagaanacagtnatnaaatattatntaatctcacntctcatgattctagtgctatatcatntatatctcgtctnttaattttntagtactgtgctctcatgctgatgctcactcatcgcacagncgtatgtcagactgtcagatacgtgatagtgcatctgcgatgtccttcgtcatctcgatctcaacanacctaatatacatntcactaccatcnatcagagatgtcgctcacatgacatgataatcaatcatatacatagctatnttaatctantatagatagtgtgtcncgagagtgagtnatatctgtctagtttgtatgncacgcggtgtagacatatatagantgttatgttgcgtctgtggtggtatgcgcancaactcgtatactgtagacaggtggctatgagtgtgtagttgtgattgttctatcatcgtgatcagcatgtagatccagnancntcattagagcnacacgacagacgcgtacncncgaagtcangtgcacagaattatacagttcgcgcaagcncgatgactactccctacancacgctatataacgcatgagcnactgcatcttcactctagacntccaacgtgtgtcgctccgggcttcgtgcgtctcgggctcngcgagcgcgaacacnaatatacgattnatgcncatattctatatcagcgccatcatcggtatacgagatatatacaatcnccagtcgcatacatatctntataggtcgctactgctcntatacagtatcatatatatactcagatacatctctntctatatctgttaatatcagcgtgtgtctgggtgagtgacagcagagcgacactcacagtcacgtctgttcganaactgcacncttacatatataacgatagagtcaagcggtatcgttcagagacgttagcatcacacgcttgactcgtacagccagcgcatagtacgccacgttcaatagcgctcngccacactcatntngattatcgagtatctattattatataattagtaatgtgaatagtntcataagatgtgtgacantagactagtattcttagcacttataatatgtccggtttcacatcctgtcagacacagcactataagtcctacatacacaagtgagcacttagtatgtatagatcctgaatacgaatgtctctacagactagtgctcctcaaatagattctctaagtacntntcacacgtgcacactcaacgcgtgcgagagagacgcgcntagatcatgtgcgatcgtgagtcgtctcnaggatgaaatgagg

SEQ ID NO: 12855 - DNA, 975 bp, Homo sapiens
  misc_feature (1)...(975): n = A,T,C or G
ttttttttgataaaaaatatatggaatattaatgattgaatttttattattatttttttttgaattgaagtagttgaaatgagttnaatattannnntanagnnnnnganaanannnnnnnnanaaanaaagnnannggannnggtnnncgaggaatggtattaaattcatactagtttgagagataatgtttaaagatgtaaaataagtgagaggggtggttggggattgagaaggtgagggcgggcagaaaataaactatgtcacaacaaatgtccccataactattgcacgtcataccctgccactagccacaaattaggtagtacggatagggtgagtacggagggtacgtattaggtttgagttcgttgtttgtgtattaatattatagtggttctttctctccggcctgattcccgttaccttctctttaatattaacgtgtgcctatcctctcattagtgccacgcgaaaggcacgtccagctgcgacgatgtgctcaataatagtctatttcataataatattatattatcctcacgagattgttgagagtcatggcggagtgtcggacggcgagcaagagctacaaagctagaaatccacagactagatatcgccacagatacccgccgcgaggtctcatagccacgcagcggcctatatggctaatcgctcagttgcgcgtaagataagagtaagtcaatatatacatttgttaggtacatcaggggtcaatagggttcgatagagggcttcctagtacagtatgttttattagatataagttaatatatatttattctgtttttcttcctcaccagtctatatctatagttctcgtgggtataactcaaccacacgaatacaggcgcagtgtagtcgtatgctagagatgttgtatgattatctacaatgaatctaattcgctattatattgtttccaccagtttctgccgtgggcactacaat

SEQ ID NO: 12856 - DNA, 729 bp, Homo sapiens
  misc_feature (1)...(729): n = A,T,C or G
ttccactagactccttaacaacgaaagggtgtaaaaacacataaccttcaactngtantcccagtgaccctcaccccctggcttcagctcccaggggaacagccgccaacccccctggaatacatactcgctttccaagagcccgcccgcactacccgtcccatgcccggtgggcgtactngactggacaccctgcttatcgatcaacacggagagcctatcagactactaagtcaccagtcaccctcagccctggcttcagctcccacgggagcaccaccccaccagcctngaatacctactcctttgccaaagccagcctgcactaccangcccatgccaactatacctactggactggaccccctgctgtgaaagaactcccgagtgaaccagacccactcttagtcttatcgaacttctattctacggaagggggaccttgggtactctataaaaggactctgcatccaaccaaccccccccgacacaacattctacccccccggcctgccctaacccccctcactcccccccggcgactctaaacaactaccacggccccgacaaaacacacgcacgcaccggcctccccccggctcccccggcgggctttccacgccgttccctttccggagcgtcggctcctcaggcctccccccctcgctccgctccgctccgaaccgccgggttacgccgagcagaccccgcctccctaacgcggcggcg

SEQ ID NO: 12857 - DNA, 196 bp, Homo sapiens
tctccttcctagacctcacctcgaactcctaacaccaaacactcttcctgcctcaccctcccaaggaactgggactataaaaacacaccactctaccttcacctcttttctattcttcctggtttaccttttctgaatcgatcacaaataaacccatgcacgtttgttcgccttctaatacctaaaaaaaaaaaaa

SEQ ID NO: 12858 - DNA, 222 bp, Homo sapiens
  misc_feature (1)...(222): n = A,T,C or G
cctangtcatgaggatggagttcttatgaatgagatgactgcccttgtagaacagactcaagagagactcttgctccttacgtcgtnggaggagcgcaaaaagaaagtatcatctataaatcaggaaaccgttccttgatcttggacttcccagtctccagaactgtgagaaataaatgtgtctggtttataagcctaaaaaaaaaaagaaaaaaaaaaaaa

SEQ ID NO: 12859 - DNA, 863 bp, Homo sapiens
  misc_feature (1)...(863): n = A,T,C or G
ccattggcatcacaaccatgcagatgtaaataacacagaaaaaaaaanctgactgtaaaccaacctttcttttaaatatcctaacacagacccagactactgtgtgtgggcccacctctatatcaaactgggtatgggggaacccatcttaataacaactatggctattgattgcttcacaatcccaaaagaaaaccttgaccatgtgacatggaatatttggaataatgtatcaaattgaatggccatagaagtttagatgattgatcataaggtctggtgactgggggggcgttctgcgttcttaggttcctaaatatatctgcccatatgattctaatgcatttgatattcatgtccaaaacgtgtttatatatgtatgtaaaaaagagaaccatatgttttaagattttgcaaaccgaaaaaaatgatcctattaaaatacgaaggcaaaaaaaaaaaattgcgctttatggccctcaccggagaaaactatcagggatcgtaccctttaattagggtcaaaccataaatcctatcctcatcgactcaatagcgcctcggttatatcgatgcgaagaatcgatatcacctaacctcaaaacctgaatccccgccaccctaccatgtcaaggataactccgaaaaagaacatggggaacaaagaacgcagcgaaatgccaagtaaacctagaaaaggacacctctaagaccgcatataacaccaggctccaccaccctcgatcgatataaaaaaatctaaagacataaaggaacaacgggggcgaactcgtacccaacgagtcataataacgcagaaaacccccggaaatcccccgttaccctcaatagggtcacgcatc

SEQ ID NO: 12860 - DNA, 862 bp, Homo sapiens
  misc_feature (1)...(862): n = A,T,C or G
agaggtagagtgagcagatattcacatcaacaaaagggcgggacgcgtttaggacacanaccgcaggctgaaaggaggacccnccacacnnagcagggaagaaagacagcaagacaancgcggcaaccaacaaagacccagaagcgccaacncaccaagcggcagacaanggaacacccgcagacccacccaaggaacgccccgaaaagacggacacaccgaagaaaaaaagaaccaggaccacgcaccaaaaagaaaaccagagagtttttttttccattgaaatcacagatatagcgcgggcattataacaatcattcggaaagcatggagagctacatttaatactctgagggaaaaattctaacagatgccacaaagcttgtttatgggatagcctgtgtatccttttaactacttgcgggaccaaaccagtattgcgggacacttacccaagcctggactaaactctataataaagccgcaccacacccttaaatctcgtcaatccacaagcaacccacaaacagcctcaggcccagttaaatgccgtgtgacccgtaacaagaccacccacaacaccgacccccctgcctttgaaccagccccccccagcactatcccaaaaatgcgcaaacaccagaacacacacatccgcctctcaccatcctatcgctctctaccaagactggcgaaccacgccacccaacccaccgccgctcaccgacaccctcccagcactaccactacacacctcctcacaccccacaaccacaccccacaccaacatacccacccaaaccactaccaccacaataaaaagaacgcacacgcatatttattcaaaaccccaacacaacaa

SEQ ID NO: 12861 - DNA, 1391 bp, Homo sapiens
  misc_feature (1)...(1391): n = A,T,C or G
tttttttttatattaagtttanntatatattaatataaagttgatgagataataagagtaataatngagatggagaaaggtagagatgttttatgtggaaaaactctaaganaggaaaagagtctgtgagngatgtactatatatataagttttttgattatgttaactatgagttgagttatgattgtatgttgtagganatanattgatatganagtattatgttggagtgaagattggttgtntgttttatgtgtttgtcaatgttatggtttaagatgagaagaaggcaggaataatgatatataataataaccgatncaaatgtntcatagtcncacannanncgacaaatgacgttgtgtctggagtgtgtaagtggaatagggtgngacgaagacgtgatgtgtntattgatattgaattttttgtgtaggattttgtaggtgcattagatcttgtgtgtaaatctagtccgatcgccgttccgtgttntncgntgccgcgggtgcggtggataccgcgctggctcntgtgcgcctgggctgcgtgcgcgacgcggcgctctgcagtccacgctcgcgcttgcgagcacggatgctgggatgcgcgcgtcgtgcagctgagtcgtatcacctcgcagcccgccgacacccgacgtcgcacaaccgacgacggcggtgctgcccgtcgccggcgccgatgcgctcacacgtcgcacacccccagcgcaccgcatagcncttatacgaagctcaactacctgtgtgcaccnattatatactcgtagatcattaagtaagccgcgacagggattaattaggacttcggattgttcgtgcgtgcgtcgtggcttcgtctcncccgcgacagggcctgacggcgagcgaggtattggtcgtcctagcgggtgagatgtcgcaggtgtcgtgttgcctgtcatcgagcgtgccccaagtgtgcctagtcgccggcgancatcacggccatagacgtcgacacgcagaccacttcccaccaggatcgctaattctgtgagcctagacgtcgactacacgcatcacacacagaccgacgctcgcgctatgcgtnactgtaacgccgacagtagtgtgtagtcgtgtnatcctacactatgtactcacgatactgtgacacacntctaccagagacgatactacgccgcgtgacgcgccncagcgcgcgcgcgaagcacagacgagacgacgtatacgatgatctcnaccacgctactccgcgtcgctctgcacgtgcgaccatcgtatgttcactcatggagcttgagccgaggcgtgcgagggaccggcgacgcgtgctgcgtcgtngcgtgtgagacggagaggtgtngacgtagangtgtnagcgtgtg

SEQ ID NO: 12862 - DNA, 862 bp, Homo sapiens
  misc_feature (1)...(862): n = A,T,C or G
agaagttaaaggaacatgtaagaatacaaaagaacgacaaagagttaggctttacctgctttaatcttttcaatgcccaactcagagataaatcttcctaaaataacattctcaccatgtcgctttgctggacaagaacctacaggctctcctcatagattactgcatcaagatcccaatactcacctgggcatgatggctcatgcctgtaatcctagcactgtgacaagtctaggtgggtgcatagcttgagcccagggggttcaagaacagtctgggcaacatgtgcaaaccccatctctaccaaagaaaaaaaagaaaggaaatttggccaagcatggtggagcatgcccgtacttcacctacttgcaggctgaggcaggacgatcacttcagcccataaaggttaggatgcagtaaccttaaattgcaccaataccctccaaaccaagttatagactgaaagactctttcaaacagacaaacggccaaatgcctcacaaaacccttcaaatcttgccctttgcacttcacgggttctggcggaagacccaccccataaaaaaaaacaaaatggcctcgttgacctacaccggtggatcccttgcccccccttcctttatccgagggtaactcaataatcctggtcacctaatttttgccctcgtagtacacctgcgcgcaaccgtatcagctcctttaaggccctactcgcgttctccacaaaaccagggcaaacgccggacagaaaancaaaaataaggaaccaaaactgccggaccacgaaaaggccatttagatggctattataaaaggaccacacctcactagcataaaacattatccttcgttacatgtgtcc

SEQ ID NO: 12863 - DNA, 301 bp, Homo sapiens
ctcgctggaactggtcccggtctacgcctataaagattccagatgcagccagtggagacgagaagtagctggacatcatggagaggtgacttgacttcagagatgatggctgcacgtacgggagaagcctcttgacttcggaggagagaggcagagaggcgacttgacttcaggggagagcgacctgcccttgccatacgctttccagctcccctctgtgctgctagctggttttattgcacaatgaaattctctgcactcaccatctaaagaaaaaaaaaaatggcctctgctggcctca

SEQ ID NO: 12864 - DNA, 1697 bp, Homo sapiens
  misc_feature (1)...(1697): n = A,T,C or G
ttatatttttatttnatnnntntnntttatttttatattatttttatattatatattgttgtttattaagttatgatagaaaataattttctattgtaggatgaattgttatattatattcatatatttgttatgttataaaatttctataagttgaataataatgtgtaatattatatattaagatatgagtatatagtgaggtgtttatatatgtaactagatgttgtgtagtagaatggaatnaaagagagagtggagggcagttgtatgncgtgtggaagaaggccgctgtaagtatntctcaccacgacctgtgtgcgtgaggcngtatatgtgcgcgagaagagattcgcgctgtcggtgagcaagtgtgtgaggcgcaacagctggnagttaagtggacggcacgcgacagccacacagtctacagtgttgtgtgtagattatatgcgtagtgactgtgcttgcgcgntctngcnagtgtcgtgtgcttgtctagtggtgtttctgtgcgctggtggtcgacgcctcatcggtncactagttgcgtcttggcgcagcgtctattcttacatctcaccctcgactcgtccagctatcacgcacgcgagcggntggacccgcgccgcgtagcgtacactccacctgcgtcnaccagcgcgcagatgagctagaatctcctcaccttctgacttctccacacacacacagccactcacgcgctcgctccgcaggcgcaccgaatngtagtcttaccgcctncgtgctcgacacgacacgnagtgctntgatgcttctcgtctctgatgactgcactactacacatcgatatcgcttgcntcgcgcccatgcgatagtttactcagctgtactgctattattcatctntgtcncncgtcgtgcacgcacagtgttgtagtatacgnatcggcagngtcatgcgcgcagattcnantgtgtggatatgnaatgtgtaggtngtacgcgctcatggttctgantgattcagcggtacgtacgcctgcgttgtgcagcgntactccgtctcgacgacgcgcngactatcgtgtccaatagagngtcgctancagctcgtacgctacagtcgagtcgccctgagtantgtggcggtgtnaagattanacctcctcacactcacgtcgtcgatgtctcatacatattgttgagtgtatcatctctctgtagctcgctcgtngatcgctcctctccgcacacactaaccgtgcgccgctcntcccgtcgcgtcacattatctctgtctcctacgcgccactcctgtctcgctgcctcgcccagcgtgcgtgcacgcgtaatcatncgcgntatcactcagtgagcnggcatncatcacgattagtcaagagtatgcgaactgcctgctcgcgacggagtactacgtcacacancgcggcgacacagattatgcttatcatcacgctctccatcactcgagatacctannactgcgatagctncgcntcactcaccggtgcncgacgtcnccatncgctctcagacgtatatatntcgtctagcagtaatcgagtatcacgagctgcgcgtctttgttntacatgactgtctctntccatatagttagtgtcgtgcantacggttgcacagcggacacgcatagacgcgatctgctactgtagacgncgccatggaganag

SEQ ID NO: 12865 - DNA, 327 bp, Homo sapiens
tcgtgtggtaacctcgctacctctagagagccattctttcattaaatttaaaaacattttgctgggtgtggtggctcatgtctgtaattccagtgactcaggaggctgaaacaggaggatagcttgaggtcacacgttcaagaccagcctgggcaacatagtgagacttcatctcgaaaaaaattaaaaaaattagctgggcatcatggtgcacatctacctgtgatgctgagaggggaagatcacctgaacccagaagttcaaggctttcttgaaaataaataaataaataaataaataagaacttttccaccaaaaaaaaaaaaa

SEQ ID NO: 12866 - DNA, 390 bp, Homo sapiens
  misc_feature (1)...(390): n = A,T,C or G
tcgtggcgtgaacaggnaagcatgactttggggaggctataaccaaacttacaatcatggcaaaaggcaaagaagtaggaggcacgtctacacatgtccacagcaggaggaagagagagagaaatggaggtgctacacacttttaaacaaccagatcttgtgagaactctatcacaaaacaacatcntggggatggtgctaaaccataagcaaccaccaccgttatccaatcaccnctcaccgtgcccctcctccaacactgggaattctgatttgatgtgagatttgggtgggaacacaaatccaaaccatatcagctatgtaataaacctatacatgtaacccccagtttaaaataaaagttaaatcaaaaatttaaaaaaaaaaaaa

SEQ ID NO: 12867 - DNA, 425 bp, Homo sapiens
gtagtgaatattctagtttaggtacaccaaacacaacggcaaagcgtttcaggtgaacctcgctaccttttgacttttatgtatatccatatttttgaatggcgtggtgctctgagatacagtgactacatagacacacagtagttataaaaatattgatagcaatttacattttaatttatatttagattagatttcttctaagtatttattgtgaaataatgtatagacttatggaaaatgtacaagcatagtacaaggaatccctctttactctttactagattttaaatagatagataaacatatagacacatatgtgcatacatacatctagttattttctgaaccatttgagttgcacatagtttgcttctttacccctaaatactttttactttctaagcaaaagaaaaaaaaaaaaa

SEQ ID NO: 12868 - DNA, 808 bp, Homo sapiens
tgtgggccactactttgtgcgcttgtgcgctgcactccatgcagcttctccatgaggcagcctaggcctcccaggacttccctgcgtgacttccctgagcaccggccactgggagctgcaccccaactcttcccagtcttggccccggaagtccctgatacctgggtgaatttctgctgggaccttgactgacaacttccttttccctctgcacctggcagctacttttggcacttggcggctgctccaaccagtctcccatcctcagaggtttctaggagagaagcaggcatcattctttctgctcatttctacttccaaacattcaccaaatatctctcaggaacattgtcaccagggaccgttcagctaattgcacagggtgggcacacagtcatgtcccctctggcggcaccctgatttctaagggtatctcttggcatcacgtgacctggttcgagggacacctcttggcactcccactgcatgacaacctactgctcccctcaagaccctttcttgccccatttctcttaattcttcatacattcctttacagctggattggctggaccactggtttagagttgcaaaacccgtttagacttcttaataaccctgaaaatggggttcttgggggtggcggctccgtgccttttcgtaagggggggaaggactttaattccagttgtcctggactttggcaccggaccaaaatccaaggctccggaaatgcctccccaagggttgacggtatgggccctggtttgctccccctggtgttgcgcccaaaaatctggcaacacat

SEQ ID NO: 12869 - DNA, 335 bp, Homo sapiens
cctactcagacacctctgtcaagtactgcagttaatgtcatgacgaagaggatgaaatgcgtcagagctttactggagttgccttttaaaaagaagcccacgaagatccttttaggggagagaaaattcctttgcaaagtgaataataatactgtaattatatgttctgccaattttggtcttcttcagaggaaacagaaacagtgttcctcctcttctgaaaacttctttcctgaagtttactatttactcatccagcaaccatttacttgattttgcctaattggttttacagaagcaataaagctttttgtgaggagtcaaaaaaaaaaaaa

SEQ ID NO: 12870 - DNA, 443 bp, Homo sapiens
cttagatcagtgcaattgccttcatatcctgagcttataagcctctactaattggcacggatgggcatgcaacattaagtgtggaaaagattaaaaggagtgaattgaaacataccggaagagggatcagccacttaggaaggaggcttggacttcgagcaaaataatccagaataatattaaaaataaggattataatctacctccaggtctttcttgagtaattgtcagatacagacaaagaggaacaggttatcttcacccacagaatcatgcacctctgaaaacaatatgaactgagtattaacaccagcaataactatttgtattttggacatgttcaatgcatagaagttagagaagagaaacgtgttacaatgaaacagtctatagccattaaaataaagcattctgtctaaaagttggcccgaaaaaaaaaaaaa

SEQ ID NO: 12871 - DNA, 524 bp, Homo sapiens
ctagttgaaactgatggtgcccgtggaagctggccacagtggctgggatgccctcacagaatgtgcatgcagggaagttctcgtctcaacaacacatggccgtaattttgtttatacacattgtactgttgcagtgtaagaatttttgaaatcacaagtataattgcaaaagacagagttatttctatgaaaaatggattggatgatttggcaaaacccggtagaggtttatgtctaagagtatttatttaagtacatgtgttctcatgccataaacgactgggggaaaaaaactcttgaaaatcaagaaggatgctgcactcagcttgcttatgttcttcaagttctgctccacttaaaaacaccaaaattagaaatcatagatcgtgggtgtgatttctgcaggaactcagatcagttcaaccctaatcaaagaacacagggtggagctatctcaaagtactgatgaatgagcatttatatatttaatataaaataaaatgttcaaggcaaaaaaaaaaaaa

SEQ ID NO: 12872 - DNA, 1318 bp, Homo sapiens
  misc_feature (1)...(1318): n = A,T,C or G
tataaataantnnnnttatatattaaaaatataataatttataatatatataataaattttngnttcttttttaatattttttatttagtgttttttgtttttgggcttgtgttattgtgtaggcaaatgttaagttaaagtgattatattgcaatatataatttattaagaaattggaggatgcatatttatggtatccgacctagttgaggcggagtgcgggtggagngggaatgatggagagtggaagcgtaagtaacngggtagagttatgantgagtgagagggaggtgatgttatggggggttgggaggatttagttggtctcgttgtgtggcgttggttttccgttatatcttgttctgtctgtcccgacctgggcggtggtgtcgcgtcgcgactcatcgcctaagttcgnaaccagccgngcgtcgatccctcgctgcgtactacccgagactatgacccccacgatcggaagaggtacaatattagnataatatcataccccccacgcgcctctcactctctccgtatcgcgcacaacgcactcgaaatactacatctacgaggctcttgtacaagtactatactcatcgctgtcaccgcgtggacgctcgcctagtcgagtggtgtgtcggtctgttgatcttgtgacgttgtgtgtaaatgtgtcgtgattcagaatatgacatcggctaggagagtcgatagtgtgagtacggggcacagatgttatgtgtgggtatgtaattctgcgctgcgtacctncgactgcagctgccgcgcgcgcttgatgatgtctatgagctantgaccggagtgcgcgagcgcgaggagagtngacgtngangatgtctcgcagcaaggcgtcgtantagcgtntgtgttgaactacgcgacactgaagaggactcgctctgtcgcgctctactatgctcgtgcacgntccgacgacacacgccgcgccacaccgcgcacaccactaccaccacgacccgtacacgtgcaccgccaccncnctcacgcgctagcggcgcgcggcgtgcgccacgcgcgggttagtatcctccngcgacgtcgaaccantcagtcaacacactacacacgagcgttanggagaagtgagtgccgcactcgcgctctncacagcgacgccgttaacactctgctgcgtccgccccgcgtcgcctcctcctgcnactcgactagcgacacgtgcacacagactgccacagctgtcacctagtgagacangcacgcgtatgcaaggcntagnccgcgagtggcagtggacgtggcgatctcgcgtcaact

SEQ ID NO: 12873 - DNA, 697 bp, Homo sapiens
cctagttgcacgccaggcaacacttcaccaaactctcgtccaacaccacgtgtacagaaccaggatgctgacacggacactcaacacacggagcacgtccatcaccacgagggtccctcctgttgctgtttcatgaccacgctcactttcctcctgcccccactgcctccttaacccctggtgccagtaatcggttctgtattcctaaaattttgtcatttcaagaatgcccttgaatcccatctctacaaaaagtacaaaaaattagccaggcatagtggcgtgtgcctgtggtcccagttacttgggaggctgaggtgggaggatcatttgagcccaggaggtcaaggctgcagtgagcatgattgtgtcactgcactcctgtctgggcaacagagttgagaccctgtctcaaaaagaaaaaaagaaaaagaaaaaaaaagaaaagaaaagaaaagaaaactcttgaaatggaatcatgtgatgtgtaccctgtaaggattgtctttttttttcactcagcatctttctctggagatttacctggtgtttgcacatgacaataacacgttcctttttattgctgtgtagtattcatggaacggacggacacaacttgtgtagccattaatgaggtgaaggacatcagagttgttccaagtttttggctctaacaaataaagctggtgtgagcctt

SEQ ID NO: 12874 - DNA, 831 bp, Homo sapiens
  misc_feature (1)...(831): n = A,T,C or G
aattttccacaacaatatatccataaaaaaaaaggaggagaacttanggattactctatgctggttcttgatgctcacgatggcagaaactaggacagctgacaactcctggacttacattctcatggattcatcaaccagataaagatctttctttgggggtcaaatttggaaaatctggagaaggacttcaactggctccacttgagtaatgtggctatctctggatggaccactgtaagggtttagggtactatgattgactcattattgaggtaactggtgatttcctaaccaagcattctgatgagaaagaccaagttatataagaagaaagaggaagcttttagaatataaattaaaaccagaagcaaaagagactttttataaaaagaaagaaatagtataaacacggctactgaatcatttaaaactaaaaatccattcttatttattcttcagatagtgaatattaaagaaaaacattctaaattcctcgaagcctgtgtctaactgacacaacaaatccataaagcattaattagcatctctaaacttcctattcactaagaatcctaatatcctataccaccagaaattgatcatgcttttttacctatgttatcaaacaacaaacagctgtccctatcatctatacttgctcactcacaaagatcgttgaccaattgggaacttaactaaaccactcttacgggcatattgctacatcgaccactgttgaatacctcttctaacatggccacatttactgctattgcactttctaccttcaactcgtctaacactaccagccccacccatactattctc

SEQ ID NO: 12875 - DNA, 774 bp, Homo sapiens
ggatcgtgtctgtggctggtcctggaggctgtttagggattcaagacaggtaccacttcccacctcttctggaagtgatcagctcggcttggcaaacagaatctctctctgctgcccagcctggagtgcagtgggatgatctcggctcattgaaacctccacctccaggttcaagcgatactcctgcctcaggctcccgagtagctgttactacaagtgtgcaccacgatgcccaggctgcaggaaactgagtggcccagtagaaaagaactgagattctccaacttgcagccagcacaactgccaaatatatgagtaattttggatcttactgtttaaaccgccacattccaactaaaatggagctacaagagtgaccttagacaaaaccaatccacagagtcaagagacaataataatgtcattaatgtgtatgctactaaactgtggatggttatatagcaagagacaactgaaatattcatcatattgtctccactcctgttataaaatctgtattcggtctccactgcaattgaatcaaattaaattcttcctcataccgaaaacacacatgctttataatttatcaaatgttgctgcatcttccttaactcattccttattaccaaaggcggtcaactcacttgaaatcacaggcgactctactgtgagttcctttttggagttttcagatggagggtagttaaatcactagagcctggataactcaatgttgggaataattagataatggaggaagacttagtttcc

SEQ ID NO: 12876 - DNA, 797 bp, Homo sapiens
  misc_feature (1)...(797): n = A,T,C or G
ctanggtgttacgctggcgaatcatttttctgtagggcgaaacagaaaccacaaaaacagaaatgatggcgcaaaacgtggcacatttcagggagtcacagctgtcccgcgcaaactcgactttacctgcgtgctactcctcaaaggcgcccttgcagttactcagctgcatggtttgagactgggcgggagattcaggcaggctccgagggcacagcgagtggaatccgctcagctcagtgaacctgaagttgttcattgcggagccggtgccgggtggaagaattcaaggaatgcagcctgatgcctccggcagccccagagaccggtcaggtgacaggctgcacctcacccagcggagttacctcccagtgcaacgctctgtttcctgaggtgaaacacaaagcctgctccagtaaaggagagttgtttttaacagagaaaacagaactccctgtgttcgtgaaaatctatactttcccagggaagaatggggggcgggggcgagccacgcagganacaattttcaacagaactcaagcaggtgaacggaatggccgtagggagccacctctcagagctccaggggaggagaagagaactgcagcttcattaacacttccctctccctgagatctcacanacgttttggaaacacagagtgtttgtccagtaagagtcacctcctaaagaaaggatcccctttactctggctctagagtanaaattgttgaaggttgaagtattgcggaaagttgctaataaacagaacaaccttcacaacaaaaaaaaaaaaa

SEQ ID NO: 12877 - DNA, 629 bp, Homo sapiens
  misc_feature (1)...(629): n = A,T,C or G
ctagtggggacgagcttcttctcttggccaccatcaccactagtctacaggggttctgccaggccactgctgatgctcagttagtgcccaagggctctcctgtcagcttgtggtaaggactagaactcacctttcaaggcagtgggcacagaagagggagggaaggagaagatcaatattgactggcattatcaaaggtcactattattaatgctttccctatttgttttttaatagatgtttcttttggctgagctcgatccttagaagggaaacctaggcaggagcttctgacaggccacaattatctactccccattcattcctttgccagtccccttgtataaacactgtgattttccacaacctactgtgcccacaagacagcccccaaatggtggccctaagctttttaccttcctctcctgcaggatcctgaaagggcctagacaagtaatgacgcctacccttctcctccacagtccagaccttacgaccagatctcaacaagcaaaaatttaataactggtcaaccaacctttccaaggttagagaattccaaatganatcccttggtactttaacagagatgttttataaatatccgtccaggcccaaaaaaaaaaaaa

SEQ ID NO: 12878 - DNA, 608 bp, Homo sapiens
ctagtgtgacatggccaatgttagagctggacttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttagtgagcccagcatactgcacgcaagaatcaagagaggtttttcctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttcaacaggacgccctgtgcatcagtgaaaacgacccagagcagtcacaaatgcaaagatggccgaaaacacagcgtggttggattgatggcttcaggaaaggaatgcttccattggctgtggaagccagtcccccttggtgcctttcacatggggagaatcatgcaagaaatggcgggaaaagaagaaagacatgaacagaaaaaaaaaaaaa

SEQ ID NO: 12879 - DNA, 463 bp, Homo sapiens
ccctagaggtacttgcgtataccttggtcgcacacacaaatatctgcagggactaggctgttgatggaaaagagagctgcgaaatatgcgggcaacagtggaaaattgcagaggctgtgaccctcaacccggccacaactgattcctaccatacgagagcacagatccaaatgccagaacttctcattttccaagaaaacctggaaatctgaacttgtctaaaatacctaaatgttaaatgctaccatctaactaataaaactaagcaaagatgaagacaaaacatttgcagctctgttaaaaaatttctacaggctaaattcagcccgtcacctgctagtttgcattgtcaaatattatcactgccctcattttctctcttcttaatttttcaagcgattacaatacagctctgcatgaattaaactgtaaataaaactctacataaacaaaaaaaaaaaaa

SEQ ID NO: 12880 - DNA, 769 bp, Homo sapiens
tgttgtggctctgcctcctctggggtcttggagttctcaccatgaccaatctccaagtcatttacttatgtgtcaggataaaaatatgattacatagatgaggaatcgtcgggttaacagtacctcgagatgtgttttgatccagccacatactcaaaaggaaacgctcagaaacagtatttgtcgccacaaatgaagaatgttcacgtttgttttacaacttcttaatgcaccgcattcagtcttcctgtaaacttgactgcttagtccttaaagtatattggtggagcaatgtctgcatgccttcgtcagcacatctattggcctgtttgtcccagcatcccagttggaatgggaacccttctagaaaagcctttatcctttactcacctacaaactcactgcgcacccccggaattgtggccctgggcgtatagcaggtgtctagacacttctttctcgtatgtgccagtaattcggggactgaatacaaattctggttcatccaagggcacctcaagggagagaaaccaccaaaaacttatgctttctgcaccaactccttcttgtttatgagggaaagcgaaaaaaggctggaaatgcggtagatcggaggaaccagcaaggccacttaaccaactattgacaactttagggaaacatgggggaatttgcattgccaaacaggacgacccttaactttcgggacaaccccaaccggaaccccatgagggtggccataccagggatccactagaagtgggcgtag

SEQ ID NO: 12881 - DNA, 403 bp, Homo sapiens
  misc_feature (1)...(403): n = A,T,C or G
cctagngggcaacatcagcaacgtgtaaagtgatgactctctcacggtgactcaattggttgtgctctttgattccccatcaggagctgaagcttcatcttccctccggtatatgtaataccttcttaaaagccttcaagaaatggtgggtgacaggggctgattaaccccacacctctcctccctgggccacaactcaagtaatgctgacctgttctttacttaataatctaattgagtgaagcagttagagagcaaacaaggacaatgaaattgtgtggagcctgaggaaactgaaagatgttgttttgcatcatcttgcatctatgcagtttgtactcactttaactcagtgtggcccaaggaacagtaaataaatattaaacaactaaaaaaaaaaaaa

SEQ ID NO: 12882 - DNA, 505 bp, Homo sapiens
cctagactaaaccctgcggagcagtctcacacacaggctgcttacggagaagacaagacgacaggatgcacgaggagagtgtgtgacaatgtgattccccagcagatgacctacagtaatgacacagtacagagggtgtccaaagaaacattgtaaggggcccatggggctgtgaagcattgagaaatctgagctgagctctcaccagcctggtaaattccactggcaccaagatgctgagccaatttaaatgcaaagcaaaaaacttgcaatgtttgccagactctttaaaatgtaattatagcaacccattcaaggatcagtttaacgtataagcaacttggagaagactgctgatcccattcaaacattttacattccacatacctacgcaatgacattacctggaggatgtactttcttaattaaaaaaaaaaagttttcccctcacattttgaaaagtatgttgttattaaagggatttgtatctttaaaaaaaaaaaaa

SEQ ID NO: 12883 - DNA, 820 bp, Homo sapiens
  misc_feature (1)...(820): n = A,T,C or G
ctttgggacacggatgaagctgattaccatcattctcagcaaactaacacaggaacagaaaccaaacaccacatgttctcactcataagtagaagctgaacaatgagaacacatggacacaagctctccaaaaccatgagggagaagaagtcagagaataatgaagttcttccttacgtgatgtgcttcttattcccaagctatctttgtactctggacctggctgatgttgaaagcagagcattcacatgagcattttctgggttctttagaggctcccctgctggaatccctcaattaaaatttaaatctacaaatggcactaaaaggagaaacattaaaaaataaattccttgatagaaagaagaaaaatggaggacaagaacttccagaccacaaatggaaaaaaggtggctattcttcctgaacaggggactacctaagaatgaatggcctgccgaaaagaatcaagtaccatgaaactgaatattaaagaaaatatttagcaaataaatatcttcaaggaaaatatgtgaagattatgattgatttatattttcaaattntttataacagacatgttctaacaaaggcattgcaatgaaaacctgaatggaagatcggtcctcttatgggaaactcatgagaaccttgtagagtataaattaaaatgaaatataatttctactactggaaananaaaaanaaaanannnaaanaatannnaaaaannnaccanttaaanattaaannncctannnnnaataatnnnncncattttttcccttttcttccttttcttctctctcttttctttctt

SEQ ID NO: 12884 - DNA, 425 bp, Homo sapiens
  misc_feature (1)...(425): n = A,T,C or G
cctagtagtaacgctctgccaccctgnatgagagttcaccggcatgatttcagctcactgtaaaactccgccatcagggataagtcatcctcccacttcagtctcctgagtatctgggactacaggcacgtgccaccatacctggctttttttttttttttttttttcgggggagacacagtttttccatattgctcaggctggtcttgaactcctgggcacaaggttctcgtctgtcatggcctcctaaagtgctgggattgcatacgtgaacccctgtgcccggctgacttatttttaaataacttctgaaaatgcacaaagcttaattgtgtagcttggtatattttcacaaatgtatacacttctgtaactattacccaactcaaaataaaaaaaaaacatttccttcaaaaaaaaaaaaa

SEQ ID NO: 12885 - DNA, 808 bp, Homo sapiens
  misc_feature (1)...(808): n = A,T,C or G
cctagggtgctagctgtagaagctccatactttgaacttggcattcttccagtgatggcagtggctgctgccatcacgtcggctgcagcagggaggagcagctggggctgcacactccatggagcgggtgggagccacgccctttctgagttggggtgggagctccctcggtgccgctgcccctgcccgaattgtggctgcagacccaggcctcctgctctatggagcaggcagaagacctgccctcctgggtggggctatagccacccaaactgcagctatggatcggagcctcccagtgatcttgggtgggggccggaaacaggcaggatctgccctcctgggtgcagctgcagcagccagacccgaggctgcagacctgggcctcctgtttcatggagcaggagccggtacaagcaggaacccagcccatttcctagttgatggggctggagctcccgctctcctaggcgcaggaggaccctggcgtccctgcagcctgtaccttgggggccccaggaaaaaccctcccttctcctttcccagtgtctgctgggatatctgagtggggttggggccgagccctgngccttgaatggcagcgagaggcanagtcctgggtggaagggggcagcccgcattaaggccccaccttcaggctgggaagggcctgaaggcttggatctgggctgccagtcctgtgggtgggaagtggggacnnnnngnngnnnnntnnggnncnnccnngggngncnngggncannngggcacccnnnnctnccccggggggcccnagggccgcgggccg

SEQ ID NO: 12886 - DNA, 496 bp, Homo sapiens
gttacctattcactagtggagagtatcaaagaaagaaaaatttaaaaactaaacaacacatttgacaagctgcctgccatctgaaagtgagaaagaatgtgatattaattgagcatcttctgagcaagctatatgctgtacatatgcttttcttcaaaacatcccttcaagaaaatggaaagagggggcggaaggaattcaccgtactctccagtaccccagttgctggctggttaatgaagcattcttctcatcaagctgcctcagttatttaccaagagaatgacaacccattccccacccccagctcgaacacccactgtgatcagctccctcacttcatgacaatgaggcgatatgtgtgggactggttttcgcataactacaaagcttcaaaaaaagtgagaataaatatttacttccagtgtatttctagcaacacagaaggaaaatcttcaatattaaactgacttatttccaacgaaaaaaaaaaaaa

SEQ ID NO: 12887 - DNA, 637 bp, Homo sapiens
  misc_feature (1)...(637): n = A,T,C or G
ttangagtgaacngagaaattttgtttgggtttattacagacttttctctggagacacacttgtgaagaaatggagtcaatatttggaaaagggagaagctgacctgaatgtagcgggaactgagccttcaactaacctcagcctggggatctttttgccagcagttgataccattccgaagagtgaccaagaggagtacgaccagtgtttccccaggaagcatgaacaagcaagatcctgagagaagctacagttctgctataagaagcaagtcaatcgtggcaaatcaaataggagaccagaagactttggtgggttatcttgtgctccgccaaaacctgaaatgcatacacctctctccaggcccctggctaattggatgggatcttttcacattgaaggtgaatcttccccactaagtcccctgactcccatgccaatctcctttggaaacaccctcacagacacacccagaagtcatgctgctntacccgttccctgggttttctttcagccagtcaagttgacacctaaaattaaccatcacggtcactttgtgagatatgctgttgaaagcaattataaaatggtgtagatacccacaaaaaaanaaaaaaatgggctcggttggcctca

SEQ ID NO: 12888 - DNA, 815 bp, Homo sapiens
  misc_feature (1)...(815): n = A,T,C or G
ctcgnattgatctcttgctgttgcttactgtttgggtctgcgctacttttaagagctgtaaccctcgctacagaggtctgtgggttcgttcttgaagtcagcaagaccacgaacccactggaaggaagacactgtggatatatctgaaggaacaaactctggacacaccgtttttgtgacttcttaacactcaacaccaacgtccgcagcttcattctagaagtcagtgagaccaagaacccaccggaaagaaccgactccggacccactggcctcaagggatccttctgcctcagtctcccaaagtgctggagccgccgtgttcagtccactgtacagggtttcattttggggtgatgaaaatgtcttgtaattggccgggtgtggtgggtcacgcctgtgatcccatcactctgggaggctgaggaggggtgatcacttgcggagaggagttccaacccggctggccactcctggtgaaccctcggttgccgaaacaccacgggtgactgggtgtggtcgtggtctctgtccctgccctctcccctcncctttaggctcaggacctctatgggccaggctggccgtcccctcgtcgtgaagacttcccccccgggccaccgccgtcgtactgcacgagggggcgccaggcggcaggtgaggcccggtgcgggtggggctccttagaacgcgagcctcagcttcttataacatgtccctccatgtatagggcacagttcttaccacccgctccgcgtgggtccgctcgtctgttctctcccgagtcacgtatcaccccatccctgattgccttc

SEQ ID NO: 12889 - DNA, 255 bp, Homo sapiens
ccttgacagacacacacaagagaataccatgtgacaaaggcagagattggagtgatgcagctgcaagccaaggactgctagccaccaccagaagctaggaagaggcaagaaggattctacccagagtgtctgagggagcatggccccactgacatcttgattttggacttttagcctcaagaattgtgatagaataaattactatttctttcttaaaggaataaactgaaaataatggatataaaaaaaaaaaaa

SEQ ID NO: 12890 - DNA, 850 bp, Homo sapiens
  misc_feature (1)...(850): n = A,T,C or G
gatagaaataagaaaaatgtatacgaagtagaagaacaaggggaagaagtttattgcngaagnncagacccctcctcgggtggaacaactcaagatgncatcagaggctggagngcagtggngcaaanatggatcgaggataactgcagactcaacttcccaaccttgagaattcaagcaatactcccacctcagcctcccaagtagccggaactacaggcatttaacaccacacccagctaattgttaaaaaaatattttgtagagaccgggtctttttctgttgcccaagctgatctcaaactccatggttcgacctcctgatgcccaaatcctggaattacaggcataagcctctgcacctgcctgctttcttactatcaagagcttttcagaattcaaacggattgaacctttatcgagattaaagcgacccatccctgccctccctttctatcccacgattattagtgccagttagagacacatgcttactccccctcacacgcggcagagacacggcataatctaagaagacggaaaccaacacctccccgaatcctacagatagacacagattcaaccccacaaaaagctgcaacctccggcgaacgccgcaccgcgctgcctaattgtgaaaacatcaaaataacgggcgcctcatattctggcctagccggtccctaacaccaggcctgacaccacacagcagactcaacaccaccatataacatgaaaacgacacaaaaccccatgccaccgcacttacgccctctttaaatacccccaacggcacagacccatccacacacttggatcaccacgacgtttatcaacgccgagacaccca

SEQ ID NO: 12891 - DNA, 375 bp, Homo sapiens
gcttaggctgttgaacagaaatcagccaccgtgaagccgccaagctggagagatcacacacaggtctcacagaggtaaaaggtgcccaagcagccctagtgtgggacccaggcacaaacttagagatgaccccatctgcctgcaactgaaaaccaatcaactgagcccagtcaatccagagccatgagttgttaacatgatcattgttgttttcagccatgaagttttggggtgatttgttaagtggcaacagataactggaacatgtttgttttactttgtttgggggacttttctttcttgctggtttaaatttttttatatataaaatactgacaaggttcaaagtcaggcctatcaataaaaaaaaaaaaa

SEQ ID NO: 12892 - DNA, 433 bp, Homo sapiens
ggcaaaagaaaaatcgagataaagaaagctgctcaataaaagaaatggctcaaaactacctaacctatcaacagtttcagcaggggtgaagaagagtgagctgcaagaatcaagtggaaattctgccctattccgtaagacttccctggaggaagattccatcactggttgtcacagtccttacaggaatccttccttcctttctttagaaagaaactgttgcttaccagacatcaacacagggactaatatctaagcacctgatttccaaggaaaataagaagcatttaaaatttagggaagtcaaagtaaggaatacaaggatgctgtcttacatgtattataaaaccttatccaaacatgaaaactattaatttagatagtcataataaaggtattctatgagatgaaacaatacacaaaaaaaaaaaaa

SEQ ID NO: 12893 - DNA, 471 bp, Homo sapiens
  misc_feature (1)...(471): n = A,T,C or G
cgtggtgttgtgtgtccctcttcccgcggagaggggngcgctctgggcaaacccaaagaagaaattagaggaaatggcacttaactgaagtgaaagagcttcatgagaccttacagagtgtgcgagacgttcctgtaaaagaggacaccaacagtgtggtggagaaagcaatggatgaaatcaaatcccaaggcaaagaatttataatgaagactccaaaagcaaatgcaataaaacaaaaaataaataaatgggacctaattcaactgataagcttctgggggggaaaagaaataaccgtcagactaaactgacaacccacagaatggaagaaaatatttgccatgtgtccaacaaagaactaatatccagaatctacaaagaaacaaatcagcaaggaagaaaaaaataattatccccatcaaaaagggggcaaatgacatgaacagacatttctcaaaaaaaaaaaaa

SEQ ID NO: 12894 - DNA, 1006 bp, Homo sapiens
  misc_feature (1)...(1006): n = A,T,C or G
aggctaataaacaaagcacgaatagctgaacaaacacaacagaaaaaagcctcgaagtnnacnnccagnccgnncttacagnggncccnaccagnaaaagcannaccgagcacccccaccagccatncnccagaangaccacaacgaaaggaccgacggagaccacggcgccgaggacccagggccaccattcgcccgncccgcgcagcgagaacacacaagcacccggggcacgcaagagccacccggcgaaccgacgcccgaccccccaccacacgcggcacgcgaccacagcaggagaagcagaacgacggtttttttttccactaccgggccccaccccgactccctggggagggaggagcacggacacacggcgctcccgggaacaatcgcatcgtgcaccgcatacccacacagacactcaactttcctgtccctgcccgctccctccctgcgacacctacgcctgctcaaaccctgtaccatacggaagcgctgggatcacccaggtacggaaagccgtaaggagctatccttagaacagctaaacagaagacgcacggcgaccctcggaaaccgacgacaacagctaccagtgaaacccaacacctcgacacgcgcaccacccacacactctaaccgccgacgccgtcagaggaacgccaaacgccgccgttacccctacaacccctagccgaccggccacgcagacgacccgcggcaccaacacgccgcggcgggggcccagaaggggtacaacaagcataatcgccaagcgcaccgtaacaccatctctcgctcctcgggtgggaagagaaaggcatacgagaccgcgtcaggagaacacacatatgcgacacaagagtgcggaaaccccaaggcatctccaggctcgcccttccgtcacgcacacttgagcaccaccagacatatcttaacaacacctacccggcgcaagggccaccacggcaagaaggatgctcccacgcgcccgtacgcgcag

SEQ ID NO: 12895 - DNA, 1138 bp, Homo sapiens
  misc_feature (1)...(1138): n = A,T,C or G
attatatatttntttaattaatattaataaatgtttttnatttttattttgttnttttnnnaganaaaagactctttaaggagaacacatgaagatatgtgaatttttagtcggaaggaccggagaagaggagaggtcgccagtggggnaggtgagaaaagaaccaagatggagcgatgagttagtatgggtggatatggagccaaccagagaacaaagtccacgctccctggtaggcccggtgggaccggctggcctcctggggcggcgcggacggngacgcgaggcgcgccgtccggcctgatatctacgtggcacccaacaccgcggcgcttgtacgtagtgactatccgcgcgtacacctccacgcctattatcttgacccgattcccctactgatcataagtgccgtgttggtcccagcatgtgtgaaggaaaatatgggcgtggtcacacnatccagtgaatagtccggagcgacgacaccaacataaacagaattctactcctacaaccacccccctaccaccacccccctccccgccactcgccatggcgccacgcccccttacaggtgggcggacagaccacaagcggacgcgcgggcctggttagctggtaggaggatcacgggacgtggtcggcatggtcgtgggccaccgcaatatctcgtatcatcgccgcagatttatgggtcactcgacaaccgcgcggtcacggtatccgtgtggttgatggtgcccacggagcgccaatctccggccttcatactaggacgccgacgtcggagggatcacgtcctcggcgcgccccgccgccgtcgcacggggtgcgctcgccacccaccgatccagttccacagagtctgtgcgggcgcgatctgagtgcatccgcgtccgggctcacgagagtttaaacttaggtcacttnacttactcaccacacactccaagcacgctacccacacacgagcggcggagacgagtgggctgcgtcggagggaacgagagggtaggcggacggacagagagaggtataggagaggtgatgagagagaagcctcgggtgccctggctcggcgtgggttatcactcatcgacggcactcgcgtaggagtttgatagttgggtaggtgtgg

SEQ ID NO: 12896 - DNA, 1478 bp, Homo sapiens
  misc_feature (1)...(1478): n = A,T,C or G
aataagtgtaagatgngantgactgagntggagactcaccgtctngctcagatgcctgcgaagtcacgcacgaaacgcggacagacncgcgctcncatagnacgacngnngactnnnacncacacncgnnannanggngctggncacncgncgggagagaagtaaccgaancgngncacnancncnngnnacaacctangngcgacggacacgactganancgcgaccgccacgtgtcactccatacnaccgacgctnggagacgacaaacacagacgcnnacaaggtcacaagacgaagtnatctgattatggaagnatatgaagtgtgcatgtactcgcgccatatacaacccactcactcgatcgttcgacatntntcacgcatacgagcatgcgatcctccncgcagtcnacgatcatcncagacgcggattcgcatcgaacacgcacagatgaacanacgtagctagncactgtggccactattcatggatcccagacggtccaacgagnaccgcacgnactcatagctctttttttctctatctagagacgcgcacgacccgcacaccaccacaacaccacagcggccgccctcgctcgcctctcaacacaactactaccatttctcgctacccgtgcggacntntctcacaacgcactccactgcacttcatcactattcacgcatgatactacgagacaactgccaccgccatacacgcgcgacaccgtacaaccatcggtccgaaccagcaccgtcgccagctcgcccactacacctaccaccggtcgcacaccactccgacacctaacacacccgactctcgctccataccagctgttcgcttacagagcctccacactcttccactcctacctcgctgctccttcggtatgctgacgtcgcagtctcccaccagtatcctcccacttgctctngcgtacacgcattacgtctcaccgttatcctacacgttctgtctctctccacgcacaccacccgcatcctcactatcctcacaacacagcacacacgcgcgctctaccggccgcgcactctcatacgaccgcagacgccgctctccactccnacacacgtctcttcctaccctcgtcgcccccacaaccccacacagcgacaacactctgcatgcaggccgaactgcgctgcagcgacgatgccatttagccgcgattagtaacgtatgagcgcttantctcgtcgactaccacaactccatgcgcgaccctcctcgtcacacgtcgtccccccaacccctcgcagcaacaccgaccgctataccccccactcgtcccatcgacacacttccctcccaccacccaacccgccatcttcctcatcgcctctctcctacaacgccaatgagccaccgtctctctgttcctcctaccgcctcccgncccaccagccgacgtacttcctcgccgcctcccccaccctacacaaccatc

SEQ ID NO: 12897 - DNA, 1657 bp, Homo sapiens
  misc_feature (1)...(1657): n = A,T,C or G
tatatatttatantattnnaannnattaaanattaatataataatataatanntatatatatntnatntnnaattanatnttnatgatttantatanagagnagnanagatnnaaagnaagnngaaannaagtctttatagacgtgtggtgagaaaccacaagaacaccacaacacgcgagcaactcctctcagntcttcgtgacgaaagcataccaacgacagagcagctgaggtctacgcgtgaggagnagcaggagagagagtacgacggaggtgtcgtgctaatatagtcttatatatataagagntataattnatatagacgtaacaacgcagatatcgtagtgcgtcgcgtgtgtatctcccactcctcaattcgtcatctcattgtctgttcctccgctcgatcntcttctatagctacttgcgcttccatcctcatgataatagctgcgaggnatcccgtactcatagataggctagaaatattaatatataaagatagagcgctaggagggcgtgtacctngataacgtatagacgatcagtctgggagcacaccgccagatgtgaggacgcagctgcacgtacggtgagcagattgttgcatattctctttgtcagctcagcgcagtaacaacactatctgtcagcggtgccatgacgcgccgccactcgatcctctcggatgcgagcagntggtcgnctcgttagtgttgtcgcgtgtggtgtagctaccgatgcaggttgcgtcgagaggatgttgtggcggtgtgatgtggttnattgcgaatatattcatctccacgcacgccgcgccgctctcccgtctccgttctcatcccgtcacgccagacctcgacgagtccatctccgagccgtcatctggttntgatgtttgtgctcgcgctntctctcgcgttatcgaacacgaaagactatctgtgatatcaccaacgcagataaagaggtactccgancagggtgaggcagagcgaccncacgtatgtcncgcgctgtgcanctcgtgtnatataagtgcagtcacgcgcgcgntattcgtaggctggagcgacatcgnttggcantcgctgaatgcatatcactgcgcacaccctcgcttgttgaatgcagtgctactacgcagactgatctctactacgacgcnttctacacgagacacaatcctctcactgtcaacgcaagtatagtaaacacatcctattatagtatagaacgaagtagtattgtgtatgccgctncgatgtctgatgctcgtaactcctgtacatgtacnatctgcgaatcgccgccngcgagttatggcatgcgtctgtaacatacgtcaattcagcaatcgcaaatgcgagagttgtacagcgaaacgatgatatctcatgtggagctgcgacacagagacaacgtcganactagtcagtctctctgtccacacgagtaactggcgaaaccgcggacgaacgtcagctataacagtaccagcgtacacgtcataccaagcagactgtcgcgagtgtgctgtacactaatacattaaatactcgtgcactaanagacacttcataatgtagaatatgtattacctagtatcgatatctgacgactgatacttccatatattgatgagtagctacatt

SEQ ID NO: 12898 - DNA, 772 bp, Homo sapiens
  misc_feature (1)...(772): n = A,T,C or G
agcnnnccgtaaggnaccngagggttggccnnagtnggantanncngnctttttnntacccccgntnnncaaangcntnnggngncccccacnttgcnancaangaatggccnaccctccccttgcaaagngccnttnttttccccttaaaaaacanaagggntacctggaaanacagttttgaanaananccttaaatgatgcnccaaagcttnggctntccnanggagtnntagaagnaaggtnnaaagntttcccctnnccccnccctgnggantttttataaaaanngaaggggatnggggcanattttcttccaaaaantgntccccaccagaaanaaatattaaattnncttgntngtggatttgntttttaacggggctttaatttaaaccccattaaaagcnaatttaattanccnctcagggaantctncggtatttaactcaagctccaacccttgcaaaaaggaactgcagagcttgattactncaggagtcaggtgtagtaaatgagtgagaagaatgcagaataggtatntaagccaaacacgtacgaatggcaagggctgtttggaagtggaaagagcacgaatgttcaatggcatcatccatgtctggcaccatttttatctggctgatttctgtgattatgaggcatctaccgttgcccttattttccagaacatntgaacnncccntgtgcaattttgtgatnntcnaatgttgtcttaaaatgacataatgacatgagtcaaataaatactgat

SEQ ID NO: 12899 - DNA, 882 bp, Homo sapiens
  misc_feature (1)...(882): n = A,T,C or G
tttttcnccnttacggangtttnttaaanacccgccgccccagntatattttnaaatacagcncccccnatataaagggnaaaattntgggntacncggggccccccccctntgagngttnggcggggtatatcgaaataaggtccanaagnggccatataaggggccnttntnccccnggttnaanattgnntaanccccnaggcnaggggntttntgaacancaaccagtttttngaactttaagctgcncagggaactttnnctttaaatttancccacccggcttancngggtntcatnaaggggggagntccaccctttgggaccttaaaaccncntttnggaaaaaattttttttnaactgggccagggccccccccangtggaattttnggcnaagntttgggtaantttntnanggaanaanaaaggggggtttccccaacccaaagggtttttccccaacnttattttatttctagcgngtgntcnagcatgcccaccntccaagcggcttttttnaacgcttccctttctcaatcttccttttatccnatcaggtgcaatacaaagctttccgcagcatcaaagtcccgatcatggaaacccccacattcctgtggcaaaaaagcataatggtgaatggaggactgctttcaagactcaccaagggaggctgcatgcaggaggcagttcccatctccagtagttgccaaaggaagcagcctctgagaggtgggatccacactcacccaccagttcaaacgccctgtagaaacaagatagtggaggaaaaggagattatccatgaagcccttccaccttcctatttctgaaacagactccaaagcagcctcctctaggaggcctaccaagaat

SEQ ID NO: 12900 - DNA, 957 bp, Homo sapiens
  misc_feature (1)...(957): n = A,T,C or G
tnttttttnttttccccccccccnagggtttnggaagggtgccaaangggnatagnttccccttgtttnccnccatatgacaaacccctntttgccccttcncgggggatttccnaaagcgaatttttntttcggggggnggtcccanccccttcccccccaaaaggtaagcctggggaatttaaccangggcgtnngaagcccccccnttggtggccccnngccccccccccccccccattttttttttgggnccccccncctttgaaaggcccncnannccccncccnccttttttgggtagcccanaaaaagaagggaagcntngaaaaaatggttccnantttgggaaaaagggacctttttccnttggnttttaaaaaaaggtgaagnaaagcccagccccccaaggtatanctttggcccaaaaagantaaaaggggctttaaaaaggnggccaaaanncnagggtttttaaanacnaggcgggtgaaaggtttgcttccaaagcccnaatgcaattttagccccccaancaatcaanggttggntcttntngacttcaccnangcttaaaccaaagtaaattaaccggncaggtgattgaggtaaataaccagggatgaggtaaataaaagagggctttacaccagtgctctaaaaggatgctttgaaggaagggaagatcccaacgaaccagccatgagaagaaccctttacagagggaataacaagtggcaaagcttcccaagtgagggtggggaagaacctgatgggttttggaactcaaagtttcttcctctaacggttcaccaatttaatctttccctacatagagtaaattgagttcccctgctattaacatttgttttgtggataagttagtctttttctttcctaagagtattatttaaaccacctgatcactaatttcataagcaaaccctttgcctttta

SEQ ID NO: 12901 - DNA, 733 bp, Homo sapiens
  misc_feature (1)...(733): n = A,T,C or G
tatccccntaaagccaaagtaaattanaaaagttcttaaaataatgtcataaggggtggagtctctccaataattttagccccaatgtaccagntnccaaacccaaggagatgattcttaagaagttataaaangacntaaagatactctggagccccaaaaacaaccggattctaanatttattgatgatatgaatatgcnagttcanatantgtatggagcccagccccccctggaattganaaagccaattgttantttgggaggaggtttatgattcttgaaaaaaatccatnggaaggaatattccaaggatctgtctatagnttgcagcttggtgttccnagttgtgaatgatatccaggcccacgtctttctccaaancactttttcccatggctgggtattaccctcatcccttcccaagacatcttatgtactattttccagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattcagtggacccaagaaaacctgatgaatcactcaactgtatttttggacttcttggatataaacaagactcatagaaaaaagatttatcagaataccagtgactataat

SEQ ID NO: 12902 - DNA, 735 bp, Homo sapiens
  misc_feature (1)...(735): n = A,T,C or G
gtantgncatatatnatggncttttttagcnaatggntngnttnagtatccataggtaattcccnccccatttccccatgtctttantaaagttccntngcanaaattctccaantcaggnagaagncctaaaatttgttatttttnntccatngaaagggatttggcttttttaattttccccatttaaaatgtggaaatcaanattgtcaattttctggccaaatccatcaacnnggaaanggggtttaaaanaatttaaaaatccatnaaatcnanncnggggccccnataaaaaggtaaccataanaaaantttttgaattcataaangcaacaaatttcttnatatatttagtttntctcaanttttcccatcaatttttatagattttagtanacacatttttcttataatctgttatactgtaggcctaagcatttcatantttattctattgtgaattatgtcatttttaacttttagttttctgttgctcataactttcctcaaatgtaaattattttgcatattggcatgtagacttttgatactctaaactcatttattcttagtaattcgatggtacggcctgtaattttctagtcattatgctattcacatataaaatacncaaatataatacaattatatgtctgttttttcaaactctgtnccnttttattccctttccttgttttattgtatttcccaacatatccaaaaatgttcaat

SEQ ID NO: 12903 - DNA, 929 bp, Homo sapiens
  misc_feature (1)...(929): n = A,T,C or G
cntnttcnnactgtaaagannnacnctctnncganagggctttttnatnnttganaaaatnnnantangannatnatctntgtaaaaagggggaaanactaatgnntcagganaatatatangacataangtanangctcctttcatagggngaggggnaantttgganttatatanttttaaaagacanaaagaattatntcaaagacccgggtattccanncccntatttttttttgnnactanagantangaaatgncncnagcactttgntttatttaatataggaccntanttcncccccgannggttatttataaaaatganattctatgataagggccnnaatttantngaaggagaattgattnatnnagaaaccnagaatatngcgncncaataanttngnagtggatataagntgggtcncttagaagagaagaaaaananaatangagtntannntngtacatanttcaatanggtatnctantttnctanaaaannnaangancttttnagaanaantttaatttttgggagaagcaattattanaanttattgtaaanttnantataattantaatatgttntttaggtnaatatnattcnaggaaattaaaagnnngtgaaatttatttggaaatgttttctgtgatataaggnaaattattggcgaanatnanagacagtgttganttaagcaacagggttntanatngttatntataangttagtaggccntatagttgaaatatgnaggantaatccagtcagtngagtaaaaacaaataaaaatntagtttnatngnagatgtnaattaagaataatgttanagtcngatatanatgtttattatttcncncacacaancnttttttttgtgantcatganaatgttttgatagtaatgatttntttttaa

SEQ ID NO: 12904 - DNA, 289 bp, Homo sapiens
  misc_feature (1)...(289): n = A,T,C or G
gaaaangaatgtcacaaactttgagaggcaggaatggcacangcactncnggacaccgcgcttttnnaagtcttgagcaacaggcttgtgccacacaattgtgtgcnttaatggatgnnaacaaanccctttacctntagcccccttttttttngntaaaaatggggcattaaatgaattaaggcncnncntcaaangganntnttttgaatcaatntccncaatatatnntntctttattaanannccngttncatagntttatttgggaaatctatgntaaaantng

SEQ ID NO: 12905 - DNA, 739 bp, Homo sapiens
  misc_feature (1)...(739): n = A,T,C or G
aaccngaaccncntcccggttcanttttcacaatancnaccacccgaaggccganccaaaagggtcctgcanttnttccccctccnntccantntntttaattntcccgggaggctaanggnaaaaggaagtccccaaacttgaaaggcaggaggggcccagccncttccaggancncgcgcttttggagttntngagcacaaggcttggccacccaanggtgggcgtgatgatggacaagcntcaacccttagcccccntgntttttttaaattgggncataantattaaggccccccntcaaaggccctttntgcccattccccaaaaagatgccctnttgaaacccgtagcaatggtcatttggaatcagcaaagtgttcaataaaatgttagctatatcagtgctatggtnaancattttaaaaagcttgaggctgggtgcgggtggctcacacctgtaaccccagcactttcggaggccgaggcgggtggctcacctgaggtcaggagtttgagactagcctggcaaacatggtgaaaccccatctctactaaaaatacaaaaattagccaggtgtggtagtgtatgcctgtagtcccagggattgggaggctgaggcaggagaattgcttgaacctgggaggcagaggttgcagagctgagattgtgccactgtactccagcctgggcaacagagcaagactccatctcaaatataaataaataaatataaat

SEQ ID NO: 12906 - DNA, 848 bp, Homo sapiens
  misc_feature (1)...(848): n = A,T,C or G
attnccccccagtnattntggnccccanagatttnccngntttttgggggggttcttcnnnaaattccnaaggcaaattttaaggccttattcttttttggttccnacgaanantaaaaatttttttttncggnccaaagtttttaagnctaaggncttgggncaaataaaaaaatccngaaattncctancnattggaagtaaggattttttnaaaaatttattntccatttgttcttttccccttaattttttaggtccaataaaatgggntaaggcggtggntttgncctgaataaaagaaggtttacgggaatttttngggattccnttttttntnacccccnaaggggctgaaaaaaccaggtttaatggccatntnttttttaangcctttnacnaaantntaattatttnnnttnggctntggccnatccntatntggcccggaaaacccngctttanttttggntttcantttgtttagttnantaatatcntgtgatctgaatgatcaaaatatttttaaaataaaattacttattcaggctagatgtcataacacaaagttttaaaacccncagttactaccagtgtcnaccctgtgagtaaactgccatgatatttaattttaaatgccatcttttattgatatataatatttgtacatatttagggggtacatgtgaaatatctgcatataatgtgaaatgatcaggataattgagatattcatcacctcaaacatttaacntttctttgtgttgggaactttacaattatnttctaganatttgccattatatgataatttgttgaatgatattcatatttttatcttatacaat

SEQ ID NO: 12907 - DNA, 776 bp, Homo sapiens
  misc_feature (1)...(776): n = A,T,C or G
aantttttttaangtcataacatatntgncaaagntttnttttccttttaaaantanaaattctgcnaccccttgttgttanagaatagggaaagaagggtatnanaaaaatgtagttnaaacttcataggaaaggtaaatatccttctanagatataggatgtnttncctntcttaaggtccccaattncatnaaannntanancaagaattggcnaattntccaanttcttaaagnncnagaaggtccccnccnaccntatcngaaatttnattgagtatnncgaaanaatggcaaaaaaaagangnccnantttanccaaangncngtantttaagaggtatcccaatacaacccaatttnttttctacttttcaggnnnagtagtcaataaattancataagatantncaaacaacgtntatttataaaaataggctttgcattagaatgatttttgcccaactgtaggnaaatgnacgtggttgtgaggatgtttaagnagngntagacttaaggctataatgatttggtaggttaaaatanttaacaatattttcaacttaataatgggtttatcaaaagtanccccatcataagttgaggagtatctgtattaataatatagtgcatactgtgcttaaatatttttccctgcctttttagcaaaacaatttgaattgatagtaaggttatttctcttaccaaataaagcnnnngagagatcnggtgnaanntctttaccaaaacataaacagaacacacacacacaaat

SEQ ID NO: 12908 - DNA, 755 bp, Homo sapiens
  misc_feature (1)...(755): n = A,T,C or G
ccncnngtggacnaagggngggntttttaatcaccccgaaggggcgccnccccgtgggtaaaaataggntnggngggttcccttngncccgtngtgcaatatanccggganacccnngtcccnggtcccnannttattccgccaataancccaccccanccgnaagggnccangcncaaaaaggggtcncngcaaacttttatccnggcntccaatccnagttnatnttaaattgtttcccggggaangctannagggggggcccttaatcccaantctngtcaattataaanaaggnggaaantttggncccccaaaaaagaggcccccaagggggggtatggtacncagagaaaaagnntcacgggaggccncagagaggttcttgcaaanccaaagaagangaagcctcagaagaaccaaaanccagccacccccttgatctttgggacttggagcttccagaattggtgaggaaataaatttctgttttaaagccactccatttttgttatttttgttatggcagccctagcacactaatagtgttttaccacaggagtctccaacttaaaatttttcaaaacctttttcaacttttaaaatcagtcccttcatcttccctatttccacctcattaacatttagtgcatttttccacacagagaaaatgttttagagacgcttcatgcnctgttaaaaaacaaatagatgctgaggaaaggtggtttaacaaaatagtttcacagtaaaat

SEQ ID NO: 12909 - DNA, 735 bp, Homo sapiens
  misc_feature (1)...(735): n = A,T,C or G
anttttgggcaacnnagtagnccaacctggncccnccccttggacagggaatgaaaagtgttaaagttagccttaagaacncccaantcaaaatttaatttagaccntgggtccccaaaaaagggtnccctccnaacctggnagtcaggngggtnttcatctcttagatgggcaccccttatggccagcgtggatgaagtttccagggnctgggtntgctcctcatgactcccnttaggtggcattactggnggccntttatngcnnttcccaaaggcccccnnccaaanaaagatccaaagnccaggncagannttgaaccntgcgtagcccacaaagtgcattctcnccctcttgtcctttttattcacaatatttacttctaccaagctcagttagagtcttaaancccaactcaggtgaatcttgaggcagagaaataagagagcatttaatgaattnnctttgagaaaagtgagtccaggggccagctttatgtctacacaagatgatagacaagaacctatntacaggacagactttgcctcagaccagcccaagtgagagatttaattgaaatagtcagaagaaagactanaatccacagagccacagagaatgaaggcaatcacgagagaaatgaggataggaaagaaaatgataggnaatcaggttngttcattcattgtctgtanancctgctaccatgtaataagcacctgatgaaatttcaat

SEQ ID NO: 12910 - DNA, 988 bp, Homo sapiens
  misc_feature (1)...(988): n = A,T,C or G
ctcagganatttntgtnggnnataagaacagggttntttcatntatnnatnaagnntntaaaantagaggggnncgagagaattgnttaaannagnaatanacttttaaagaggnagaatttggngtancngngagcnccacccnantgagagtgatngtgncggagnattcagtatagtntgatacantnatgagaccatatagnagggggcnttnattcngnaagagtntganantttgngtntaanaagcnacagnatacggngtgncnttttttttggaaataatagatcaaggtattatntgggggaatattttnataggaattgtgananagatgngnatntattttttnnttttaaattntttagaacccactntcgagagtataaaagggggaatatntnatntaaccncacattntgtntggnagagggcnnatagttatttattnntgattataantatataacnncccccagagaatngnntggngaatattntatgggcaaaaaanantntnattatntggggnaatgtgtttattnttttgggacnaaggggnatatnnggnttcaaggttggatanttcaaaatgnantaaaaaangggntactnaaattaatttnaaagagttnttntaagnaangnacaaanatnttgacagttgatgaagaccntaaacgtgnaattcaagtccaaatttaaantanagatgagtccnccttaggncgaggcaagtgcntnaaaagcataaagtaacnatggcagagntngntttgggatcatggagaaaggtttattgccagntatttttgtaaagttngtggaagggccnccaaccatcnaanttgtgccaacaaagntggcagatggccatgcaaaagagtatattaangtgnttancaanagganntttgttaccccnccnatgatnaggagattnanactccgcagagtatatattttgcaatttattttataaaa

SEQ ID NO: 12911 - DNA, 818 bp, Homo sapiens
  misc_feature (1)...(818): n = A,T,C or G
cngngccaangtgaaagttttttttatgttnagcccaaaaaaaatggggntnataaantggttntccangccagtagggnttttnacccaaaannggcnaagagggcnttttnacccgggantagttngtntaagaatccagggccccttncttgatggtcnttcttgattgagggagggaagggnctttaaccaggtaactttnttttnaangattttttaaagaanggntggtgggttgggttttttngntttggtttaacctaattggtctggaattttcttttatttccattggaaaatccaaagttttggnggtaggggagnccnattctttgttaaataagtccaggccgtccaaaaaaaaaaaaggaaattgaaatgtcttttctcccctcctgggtttggtcaccaagccccatttttataagagctgtcatttttgatcgatccncataggtctttatgcctttgagggatgaccctgtgggctagcacttaatattctgccccataaaaaccacntcatccagacaaccaagctgagccaccagcttaaatttcccaggagattgacctttgcaccaaaattactggggagacctttggaacgtctgttttatttccagggtcattggtatttatttgaggaactaaagtcatgatcttcaacatccataactttctgacaccaaataagcctcctgatggggccacaacatggaccaaaaaggaaggacagcatgctcagaggaatttagttttggaaaactgctatagtcctacacatttaatagctgtctttaagcatgattaaa

SEQ ID NO: 12912 - DNA, 588 bp, Homo sapiens
  misc_feature (1)...(588): n = A,T,C or G
tctgtgnaattngnggaggtccattcccaggtgctgtttgcctgggtatcncccagtggaaggntgncagaacaagcgaaaannggctgcctgctcccttcctttgggaaggtttcatccccaaaggcccccctggccnaattnncaaanggagntntccntgtataaggtgtcagatgaccgcctgttggaagagantgccctgcccaatcagggaggaatctagagaggcagtctggccccagactctttgctgcagtgtgttctggagnntgggaagtccacaatcaaagcactagcatatgatgtctgaaaaattacacancagcctcagactgatcggacccttcaggatgaattccggaagaagacattgctgtcataggagatgacagctccaagcgttattaccccttcatgaagatgtttcagtgggacaagatgtgaaggtggaagacaatgatattgatgatcctgaccctgtgcaagcctaagctaatatgtgtgtttgtgtcttagtttttaacaaaaagtttaaaaagcagacaaaaanattgtaatagaaaaaaatgcttacagaaaaagaat

SEQ ID NO: 12913 - DNA, 637 bp, Homo sapiens
  misc_feature (1)...(637): n = A,T,C or G
attaagagtntgnaggcntggaaanattaaggngccctgaaaaattcagtgttttgatgagaggttntntggtgcaaaagacaagagcnttntagctgtgtcaaccatgggaaaagggataaancaattntctttcggatntaaaagggggntaatccccattcatnagggctttatcccttnttccnctaacccccnttccaaaaggcccccccttggtnataccaccacattaaagggtgggttttaacatatgaatttttgaggggatatgccaacattgagaccacagcacttctctactcacccccagttctgggagccttaaagcaatgggagctgaagagtttgactcaagnaaaggaacaaatcgtgaaggaaagaaggtcagcagtttttcctaaattgtccctttttgcattttcttgatttggaagttttatattgcatttttcttaacctagcagtaactagtaatacgtaatactatatttttaaagaaaattttctattttgggtatcactaccatattgttacacaagaaaacatatacatattctttagttatctatttaccnntcccttcttgtaacgtttgtataaaatttgaagtcatgtcattttaatataaataat

SEQ ID NO: 12914 - DNA, 663 bp, Homo sapiens
  misc_feature (1)...(663): n = A,T,C or G
gctcnngagnagaattacttatactgccctccaaagggtcnccattgaagccttaaatgagataatcccattgaacagtngcaaaaatcagggcncaagaaataaatgatggctgttggccagtacttgtaataagtcnccaagaaaaagaaaagccnagagttccanggaaggttttttgctcttgcaagggacttggaggtcctgggggaaaacccnccttttnnccagaaganaaatatcttgtgctggagtcaccctccaggtctccccccatttggtgctccagccttttccaccagaggacttggtgttcggagcctgcccctggccctggttgcttgtggatgcctctggctctcagaaaaggccatgtaaatcagagctgaagggaagggatggagaaattcaggccaggccatgattcaaaaggcagcaggaaatgaatacatttgttggaacacagggccaaaaggacttgaagcgtctggagtgagtcatcaggtatgctgaatgcgtacacagctcctggctcacagactgggctgatagctactgggagatcaagctatgaataatacggtatatgttcccgccaacagaaattatttttagattcgcttctgtttcacattattcattgcccactttccatttactaat

SEQ ID NO: 12915 - DNA, 747 bp, Homo sapiens
  misc_feature (1)...(747): n = A,T,C or G
gnaatttnccccngttnaaacctttncttcctttcangnangggnttccncatnangnaaagcngctcattggnncagtttatccaaacctttttttccagggcttnaaagacccttccnatgggngtgggcccccannnngtnncttcatttaaatccnncatgccntccactcccattttggtttnctggggncnnggcgaggacaangncctcttngctccccctgaaggngaaanttttggcttccnanaaaaanntttgcngnctnagaaagttaaaaggccngnccccnttgggntnntttttacntggaaanccctaanccctgggggncaactcatcaaggaatcccaatccactggcttctccccatgagattcatttgtcctcacataatgggagcccctgtcaatctttcagctggttggcacagacctgcctgacatgcctgatttcacagcccatagccagtttaagtcctcactcaaggatcctaggtaaancagtaaggaaaatatttagctagttatggtttcatcatcgttaattacagcattgataaatttggaaaaaagcactgagacgttctagggcaatagctatcatacacaatttcttccccagaagtaattaatgttagacatagtcaagtggatgagtgtcagttttctctatacacacataatagcatgtatgacatagctttgaaactgagttttgtgttcacctagtgtgcttcagaat

SEQ ID NO: 12916 - DNA, 720 bp, Homo sapiens
  misc_feature (1)...(720): n = A,T,C or G
ccntttattgccngntggagggcacggcatgntntcagncccntgcaaantntgccctcttgggtcaaggatctctgccntaancntcccaagnagtgggattacggagatgcccccaggctgggtatttttatattttagtagagtgggggtttccccatgttgtcaggctagttngaactcntgncctcaagtgatccacccnccttggcctcccaaagggtgggattatacgcgtgagccnccaggccggntgcatgaatagttttnattncnccccctnnccttggntttnattcccnncntgttagcattttgacttttgaagttcctcttaccaaaaggcagaatatatttccntgcctcttaactttgggttcaagccatgtgacttgctttcaccaatggaatgttagtgggtgtggtatcactaatggctggaaaagcacttgtgtaattgttccttgcttcactgctgtaaccaagagatgaacatcttgatctagcccactggtcccaggagaaggatgagaaacacatgcagcagaatcagtcccagccaagcccaacccagaatagctaactccaggccagctggagggctgcagacacacaagctaaatagatgattatgttgctcactgctgacattgtgtgttgttatagagcatgattgtggtaattgttaattaatggaatgtcaattaattgttatttaat

SEQ ID NO: 12917 - DNA, 931 bp, Homo sapiens
  misc_feature (1)...(931): n = A,T,C or G
gaaaggaacaggattcacccncacctccccnccccgcccgttccctagcttgcaacnaaggagtgtattatcagcaacacacagagccagctaaggctcatccagtcatgcaacatatacctcctgagcatctactatgcagtgagcactattctgtgccaaggacacaacactgaacaagatgagtgagctttctgctgtccagctcaccttctagagggggaaggagttctgccacacccatggccctgtgcttgtcagaccgcctcgaatcttacggcccatccacataacatcgtcaccaccgtttcatacttgggcgcaccctactgactaacagagaggggcaccagccacatcctatgatatattcacccacctacacccaccgatgccccgcacggcgacatataaacactcaaagcctcttctacctgatctattcacactatgccgaccaaacacgctccccactcccgttattcatacgataatgaatccgactttttcgtatcgcccggacttgccccttccgccaacctctcgcgcctcaccgcatctacaacacacgaccatcatcaccgacgtttataccccatgttcctaccgtaaaatcttattccccctccctctcccattcgcatccttatcatacaccccaattcaacctgcgctcgcccctcctacacctcacactctcaactctgccattaccagatactcgttaccatttattagcgctttctgctagtataatcattattcgngccgacttgccccgctactaaacccccgcttcaataacctattctacatcccgcccatcttgctgccccaccaaaagtcttcatccgccccactatattactcacacaacacgccgctcacccctccctagcgcccgactcatgcgatcgccgcgctccagcgg

SEQ ID NO: 12918 - DNA, 1270 bp, Homo sapiens
  misc_feature (1)...(1270): n = A,T,C or G
gtggcgcatagcagcgaagactgcgatacgggagatacaacccctcatgtatcagctcgcttatacaattcatcgcgattcgatgatatacatactccgatggcgttcacacgtcgagcgacactaattatataccacgatcttcatacacactccgacccgaacacgcgtgcgctacgaattcgtaggagaagagcgaaaataactatcacataagccccgccggtgtgtatgccacgtgcggttttaatggagccgatgcagagagcgacttcgcgcggactccacccttgcttccttatatgtcatcaacatagtgttgaccgttcataacagaagagggacattacgagaactaagagcgtcagacagagcgggagcggtccctatccattgtgttatatactccttgaccaatcttggccacacgacgtctgtttaggatctaccacagacatgagttcgaattctagtcaggagtccatatctcacgacactgacgactgctgacggntacgcgagagcacactcagtacttacacccacccgagatgagcaaagcaccgccattctgtctcgaccatcgtctggtgcgtgcgacgcgggggtttgaggaaactactgcaaatacgctctgtccatctcaccgctcctaacctaagtgcggcgcacgcgacaatattagttgtattgtgcaccagtgatgaccccgtgtccacctggctcagtctccttgcggcacgcaagaatccgtcatgcaacgtccggccgcccgtaatagatcacgtctattcgcgacataacagtacgtgcagcgacgtaaactagagcggaacagacgtagatacacccgcctcgctctcgccctaccagcgcgatagatggcgcacggcgactcgcgctccgccggcagccggaaaaattacgcgatttaagtatnttcgactcaccccatcgacgcaccgcgtacgcaatgtttcactagtnatcccgggcggcatagcggtatttcgctgcgtgcggtaaattccaagnccgtagccgtgtgctatgcgaccggattgggaattgcgtatcggcggttatcacccggcgattccttaaatgttcgccaacgccgatcggtgggtgagttattccgccgcgcgaggcgcaggataattagcaagcgccgcgggctccttaattatttctattaagttgtgtaggaggacgacgaagtgatgagaacacagataacgcgtgcgacgagtgtcatgctcttcagaca

SEQ ID NO: 12919 - DNA, 1730 bp, Homo sapiens
  misc_feature (1)...(1730): n = A,T,C or G
agtgagggtgagctagtgcagtgcgcacgtcctgngctctcaccanctcnntccaccnncgcncncnnantnncnncgcannnnccccccctctcccnncccnccnnncctcccttcccncatccncncnnctncncnnnttccttccgcgcgatgttccgtcccgcnctnctcttcctccctgttctcctgtctcagtgtattttggtttatatatatttattattaaatatccacaacattacgancacgccacccaggtgacgattatctcgcancataccatgttntagtgcagctgcagtaatatatatataancactactgtagtataacgaaacgcgaacaacgtgtaacaataattaatantattatacgcagcagcacatatgttctgcgacggttttagatcgtgagcctattccggtctcgacagcgtctatatagatcncgaccactacgntcggccagagatatagcgatatagttagcagtatgagtatttgcgcgacagtgcgtcgcgagctcgcagacgacagatatcagactgcgcgagcgcgcgaggtgtgcgtgtcgagagtcacgngngacagagtttcattggtgnantagagtangagtncgccgaaagtccgctagagccagacagtaatgtgtgagatgaggcatgagtgncgtctagtgatagcgtccccacactatcgatgtacatccgtctgtntctgatttcgcgtcactcactgtaggagtacgancgctgcgccaagtctttctgcgcgnctgctcgtcgactgncgcgcggagccgggcgagagcgagtgcagcgntgttagctgtgctagcgactcgaagcacataacggtattcgatatagagtgtgnctatcgcagaggagacgtagaagtatatgcacgcgtgntccgatccgcgctcgcatcacgtattggtgctctatcgctntgtcagtcgtacacacgcatcttanatttatattcaccgtgggctgncancatatgagntgcgaactgagtagaggcgcgcgcgacgtacatcgctgcctcncncttcgcgcgancaggacgtagatatattgtatgagtgttacgtancaccnatacagncgcacgatagtctatatatatttgcagcgcgtaagtagtagcggtncagcgacatgagatttccgaancgctagcgctntcacncgtatactccatcgctgcggactcacgacatacgctatatgtcgttcatcatagtgcgcgtngaatgatgtacgtatcgcgatcagcgacgntaccacatatgcgctgacgtcacgtggtagagacatgtactatgatgcgctgcaccgtatatatgcactcggtcgtacgtacactagcctgcgatgcatgagtacacgtatcgtgacagcgagctgtcgctgctgcagtngacgagtgangcgcgtgtcacagcggtagcgagcggtgcgcagatagagttaatgtcgccgnacgagagacancgtgcgtctgtgagtttgatggtcagagatgcatnagtacgcganacgaatgtaatagcgcagcgagtgagagaggaggtaganagagnnacgtangcgagcacgtngagtagcnnagacgtgccgactagtcgtgctgactgcatnacgtcagcgatctatttcgcgcacgtactcgaatgctgtatctgatatccagagagacagggacgntggtngt

SEQ ID NO: 12920 - DNA, 186 bp, Homo sapiens
ccccaatcaattccacccccccgccacctctcctcccaaccaaccccaatctcgaggactcacaaggtccatggaaaataagaccaggtctgcagatacaccgtgccctcaaatactcatttctggaataagaagaaacaatcctactttgctggaaataaagtttatatggcaaaaaaaaaaaaa

SEQ ID NO: 12921 - DNA, 1220 bp, Homo sapiens
  misc_feature (1)...(1220): n = A,T,C or G
caggaacagaggaaagacgcagacaaacagacggaacaacaaaacgacgcgaacacccaaaaannnttttgagaggaanaatgacncnacagaaccgttgcccnggggaacccagcanancaccncacacccaccagagaacaagccgaacacgccaccctttaagcggggagacacagaaaaccacggcaaaggcccgcgcagaagaagggccagggacgccccaccacaccgcaagaaggcaaacaacaagccgccagcacagagcacaagaccaagcgacaaaagccacagggagagaagaagaaagacgcagcaagagagacccacaccggagcgacgaaacaggaaccgggttgtttgctaaaaccacccaaaccgcacgaacaccacccacacacaagaagaacaaccaggcggccgccgcaccgcaccgcaaagaggagagacgcaggacagaacaaaaacaaccagccacaaagaaaccgcccgaggggaaacccccacaaagagccagaancgaacgcccgcgcacagccgcacacacacaacacccacgaccaacacaccaaagaacgccgcgaaacaaaaagcagaccagacgcccgcgggaggaggaggcgcccgcgccgcacgacaaccacaaccggacgacgcggacgcagaacggcccggcgacagcccttcaacaaaagccagagaaagacncagaacacacagaacagacgaaagaagacgagaaaaccacgcacgacgaccgcacgccggcccggaccaaacacgacggcacacccacaccggaccacaaccgccgacaacacagagagacgaaagagcggngacgcagagcacacacgaaaanaggaacagaacagaccgccgacgacgagcggaatacaccgagaagaccgcaacacaaggagtcgcaacgcgaagccgaagccgagcgcaaaagcgcgaaacgccgacaacgcagaaagagcgcgcacgcaacacgccaccggngcgcgtgaccggcgcgcgtcgaacgacgacacncgaacccacccgaccagcaagagagagaaagtgagagaccgcccgaggcgcgcgccgcaacacgnacganagagtagacgcaccgcacacgcgcgacgacacccgacgagacagagnagcgcgtactgagcacacacccagacggacggcgcgagatagcgacgacacacggacgacgnaca

SEQ ID NO: 12922 - DNA, 1401 bp, Homo sapiens
  misc_feature (1)...(1401): n = A,T,C or G
ttttaaatattatattaatattattttttttattaaatatattattaaaatattaaataaatttatatattaacttttttagaaatcccaaaaaaatatgaaactcttagaagaagcgagggcgagggaaagagagatagcagngaatggaaggagaaagaaatggaagaaaaagagatgtaggaatgtagattaattaacccacaataagtggcgatttcaccgccgcagcgggcatgacggtgcgtcgggtgaaccgacccagtgtcgcgaggagagagagagctggtgggaactgagaaatatgaggacacggaagcccaaaagggatgatattagggtacgagctacgccgcagtaatagtaatacaccccctcattcccagagaaccacgctgaacttaatagaaaaggtcgaaagtccgacaaaccgccttgaggcactcatcgccgccaggctccgcccggccgggcccgagaatgagcccgctatagatgttaacatctaactcaccactcgcctcgcaaccagccacgcacgccctcccgcacccactactacactcaaaccgnacacacacacacgagattctctctctctcccacacactactcctcactgtctcgtacctctgttatgtcacngtcgaggcgagtaggcataatacgcgagatagagtgtgatagtgcagtgtangcgtgtaaattacacgccagctaatggactactatacatagtacatgtagcctcgtagtctgaatttgttctggncgacantagnacacgctccacctcaactcgctctcgactcatcgancagcgtgtgtataacttagactacaccagacggtgacgtgtagtcatcgacgtgagatagangcgatgtgataggcgcgtacgtgaggaaggcgatactcgagccacgcatcagccatggcgggcgcagcagtcacacgacagaccacaagtccgtcgacagcggctcgatctattgtcgctcgccacccgcgtcgctcgtcctctaccgtgatcatcaccaatttcttagtgcagcccggcgcgctgcccgcggagcgtgatgacacgtcgcgcgtattctgccggcgtgctggtcgcgccggtgatgacgagacgacaganagagctcgacgtangtgcntatcagctcaatacgtggagcgntgaggatcagtgtctgcttacatgaacacgtcacnaccgaagctctcacagcgctgcacatcatactcatcagctcacacttcgccgcatccantcagtcgctcgcgcacgtcgcgtactctcgtgcgtacgttcacttcgtcgcgtactgcgccgtcacgagcacgacgccgtgagcgagcgctgctcacgtctgacgacgcagacactagtaggcg

SEQ ID NO: 12923 - DNA, 408 bp, Homo sapiens
cctagttggagcgaagttggaattgttgaagacaaggcttggcagtgaccctcccttgaagcagaatcccaagtgccactggagaaactgccaatccggaactgcaaaaccatgttctgcaagatcagatgggcaacactgctacttggaaacaatttcatccatcattgtgaatgctctacatcatttttccacaatggccgggtgcggtggctcacgtctgtaatcctaacactttgggaggctgaggcaggcggatcacaaggacaggagatcgagaccatcctggattaacaccgtgaaaccccgtcgctactaaaatctgacaaagggctaatatccagaatctacaatgaacacagacaaattctgtgccctaaaacttagagtataataaaaaaaaaaaaa

SEQ ID NO: 12924 - DNA, 222 bp, Homo sapiens
atggtctcattcctgtcagttagacttgaggtcatgctatttcctgttggggtcacgaggatgaattagtgattagacacttaggtgctggactgaaagggacctggctccatcacatgcaaactttttgtaaaagaaggtacattgttttataatgtgcgtttttggttgaatattaaactaaaacttgagagcaatctagctcaggtaaaaaaaaaaaaa

SEQ ID NO: 12925 - DNA, 813 bp, Homo sapiens
  misc_feature (1)...(813): n = A,T,C or G
caatatagaaacacacgtttacacatttaaaaagnangnnaaccgcttggtggaaactgcaanaaagattaaaacgtagaacgaagccatnggaggaaggatcaagcccgnnngttctgactggnctgactgcttgcccaagattgctggttactctgtatgtacagctactataaatgatgagggaaaagactccagcttctaacagatatgttttgttatcaggatgatgctggcctcatagaatgagttagggaggatatcctactctttttgtaagagcttcatggtatcaatctaaatgtccatcaatgatagactggatgaagaaaatgtggtacatacacaccatgaaatactatgcaaccataaaaaggtatgaaattgtgtccattgcagggacatggatggagctgggagtgattaacctcaggaaaccattgcagaagcagcaaaccaaatactgcatgtttttacttttaagaaggagctgtatgatgagaacacatggacacatggtagttaacaccacatacttgtgtcttgccccaggccaggttgtggaaggagtgagatcttcatgaaaaacacctaatgggtactgggcttcaacccctagtgatgtaattattcgtagaactaggaccaaaggacaacattgcctggtgacaaacctttagagcgtcccgtttgccctgaattaaaatgataggggaaatctcttataaagaattaaaaacgatggcctcttggacttgataagatagctttacccgcgattctttatgtatggtatgttatgacccagttgat

SEQ ID NO: 12926 - DNA, 1094 bp, Homo sapiens
ccataccggggttgctctgtgcgtctttacttctccccctctgtccctcctccggcggctttttttcctttcttccgctgtgggtgcggccgtctcgttccatgtgggcgtccccttagctctttgtgggcgcccccgcaccgtctcgattcgtgatttgtatccggccattttgggggctttttcattcgggcgcgcttgtcatggttagcccttttaggtcgcgtgtggggctgttgaatcgctttgggtgtaggtgcggccgcgattgtgttggggcgtatatattatgcaggacgcgggtcacgttggtctatattatgttctcttttgatgggatgatgttggtggccccgtctgggggagggactttacgccgcgtcattttgcggcggcgattacaggtcggctcgcggttttcgggcgggctatagggcatattcacggagcgttgtgcagtgggtccggtttcatgctatcggtgattacgcggcgcggatcattcgtcgcgcgggcggttgtgctgggttgctgggcgcccgcgctctggtccggcttggattcggatgcattctgcgtgcggggttgggtatgcaaatgtgtttggttgtgtgactcgtgctccgcttgcggccgtggacttacaggccgcttccattggtctggggtgcttccgtgtctacgctctcattgcgccgttgatccgcgtgtggggcaagaatgggtggtgagtgtggcgttcgcatcgggggtgggtaacagtgatcctatcggtctggggtgttgcgtcttcgatggcgctaaatgggttgcacggtccctcatgcatcatcccgtcggtccgcgtttcgcggggtctcgcatcgtcgtgccttcgctccctccggctctgcgttgccacgcgtgacggtctgcttcgtccggcccttctgcgaagtcccgtccggtgctgcccgcccgcttgcttgtgtagtggtcgtgcgccgccctaaaacccggtcgttttgtttgtccttcttaagcgttttttctctttttctggcgtagaattctgccttcggctttcctctctgtcccgctgtcgttcccgtgta

SEQ ID NO: 12927 - DNA, 758 bp, Homo sapiens
  misc_feature (1)...(758): n = A,T,C or G
ctattagtttgcacagcagtagtgacacttgagaggtctcgtcgacggactcttgtggcgcaggtgtgtgcagtgtgatagtgtgtaggtgttctctacgcgagattcagtggctgctctgggcgggcgggagctatcaaagtctttccctctccatatcgagcatagcgagcgtcacctctagaataagcttatgactggtcttcgtaggcgatgaactgacagccctctcagaaacttgctcaggtttgtcgcttccatgcaccatatatcgacgtgaaccccagagttttacaaaaaggcgggttatttagtaagggacatgcaataaagtcatcgatcgagtcgggataaaggaaagcatgcgaagagataggagtgtcgtgggcgccagggaagaactggcggagtaggggtattgcgcgtggtgaggtgttctcttactttgttcgtactggttttgttttttttactggtactattcttatcataaccacgcctacaccacttctatttttatccagggcggagatggggaggggggggagggtcgcagtgttttnttctggcctctccccctccttgggggcctaagcgtttcgctcccacaagaggccctccaaaaggttttaaagatttcagggggtgagggcccccctcccccgccacagaagaaaggtttttaacttgtgggtttgatattttctaaattcttttttttttcccaaaaagaaggggtcagaaaaagagggggtttg

SEQ ID NO: 12928 - DNA, 279 bp, Homo sapiens
  misc_feature (1)...(279): n = A,T,C or G
tcgtgtgtactatatgctccttttgcctgtaattaccagaggacaatgccttaaaaagaaggctttcccaatgcagagagcaacatactaacagattgaaataagctccaccatccatcataattgtaggcgataggaagagaatcttgatcatcaatctaccctcctgctcttgtcagcgctgctgtcctcagataaacataatttgtttctactgtttttatttncttgtaaagatttgaacaaatggaaacatacaagcttttaaaaaaaaaaaaa

SEQ ID NO: 12929 - DNA, 603 bp, Homo sapiens
agcacagtgggaagactccatgggagaacgcaatctactgcttggctgtggcaagtgcctttaaagagaaacgatggcttcagcagttagaaatagcaagagtcctggccaaaaagagcatttctaacttgactacccgaggaggtctgacagcgtgtgaaaactctctagaaactgtgctttgaaaagtcatgacaacttcagtttggacaaagacctgatcaaacagaatgtccagctctaatgttaacatttctaataacagttctaatgttatcatctctagtaacagttataatgccacataacttttaataggatatttaacaccatgttttctcagacttcatcacactaagtgaaactttagtgctatttttgcataaagaatatgaggaagaattcagaagaaacttagaatagtagttgtccacagggtaggggagctgagacaatggaaaacaaggaagtgggaatttttacagttcctttgtttggttttctttttttttcctaaaaaaacgtgttttggttttttaagccatatgaatgtagaacatatttaaaaataaataaaatttttaaattataaaaaaaaaaaaa

SEQ ID NO: 12930 - DNA, 178 bp, Homo sapiens
  misc_feature (1)...(178): n = A,T,C or G
cctgntcagcatcaacatgcaggcttaagtcaccaggggatgtagatcctggaacaaaaccggcactgtgctccatcatcctgtgtttacactctccacgcagtttcagtctctgtgaccctatactttcttgtcaattcagtcgtgtattaaaatttttaaaataaaaaaaaaaaaa

SEQ ID NO: 12931 - DNA, 129 bp, Homo sapiens
tctggagctacgagggtcctggtaaatagagatcacggtctgcagatacaccgtgccctcaaatactcattttctggaataagaagaaacaatcctactttgtggaaataaagtttatatggcaaaagg

SEQ ID NO: 12932 - DNA, 836 bp, Homo sapiens
  misc_feature (1)...(836): n = A,T,C or G
attatttgttttggtattcatctgggaggaaaaaaaaantttgtnagcaaccagcgnnatttanaaggnaaacatcggcggaagctcagcaggnccatctccctgtttngaagaaggaagcagggaaccgactgcaaggaagacaggaccggagaaccaggaaaagaagagaaaaggcagggccagaagcccgagagaggagaaaactacagggcaacggcgcacaagaaccattgctggactgcatcattgcttacccaacttttttcagcctcggtattgccacagactcacggagctcctaatagaggagaattagtgtcacagaccgactggaaaaccattccacatgaagccaggaagagaaattgaagctgcttgtgctgaatccatagctggccttaatgatgctggctaagaaagacggcccattctgggggagataagccaattttgcagtggctgttattatcatagtgactattagattcctgttttatatttattcacctcaatggtttaggatagactcagaggattaaaatacgtgcccactcttttgtataaattgtctcacctgacttgtatgtcccccccgcttatgggtttctcatttcctagtagctttgatcaagttgctgtgcctctgaccacaggatggatattgtttatttagggtctgtattctaaaactcactcctatatcaggcattaattaaatctttgttcggcgtccaagaagatataactccatgtcttagaccaacacgcgagtatttgttctcattccaagtccattaattttttacggtcaatatatggacgtcttgtaaatg

SEQ ID NO: 12933 - DNA, 1191 bp, Homo sapiens
  misc_feature (1)...(1191): n = A,T,C or G
aatatattttataaatattaaatttttttttaaatgataaaatntaaggngaaaaaaaaaaggaanaaacttttttattttcatcttaatttatctaatttaaaaaangcataacccanaagaaagtatgatatcaaatattgacattgataataataactgatttatcaacacgaaaagaatgatatggcgttgggtgtaaatgattagatgatacgagccgcaacgtcgggatccccgttgacgtgtcccggacgctgctacgaagaaaaaaatgacacgcagaaggaatagaataacaaacacaatggacacaataagataagactaatccacagcactcaaccaaacacccttatgttttgcgcgtcacatctgcgacaccctacatatccaatgcacgttgcccactcatgagcgtataatctccagagcggcgccgtgcgggagatcagacggaatgaggagtggtcgagcggggacgggaagatgcttcgcccagaatctgtgtactgaagctgggagaagctgttataagacgtctgcgtggtacgagcccgctgctaaaaccgcacccacccgaccacacaatgccacaaccagtgagagagggttggctgccgtgcctggtcgtcgcgcacgacgccttccttctcagtctgatttcctctacctagtatgtgtgagcgtaagtcccaactgcaatttatggaatattggcacatagcgtcaacagcagaactgccgatcagacgaccgtgattgcgcgccacgtcacaaggtctcgcatttgccatctcagtgtcgataaatcagtcaagacgcaacacatatataacatattctgtgagtacagccacgcgcgagccaccatagacatcaataatgtgaagttgtcgctccctgactccggattagtacggtctgtgcgggcgtgcgcgatctcgtggggacagngttatgtagcggctattatctgtcgatccgacctctgtactgcgcgctcgccactctcacataagaagaatactaatacttcatgacccgctaccccgtagatagttgctcaacaacgtgccacacgcgagggtgtgccacccaacggcacacttgcacgacgtcgtcccaaacgcacctctcggaacgcaatcgcggagaacataggtgtccagatgaacggtgaactgacag

SEQ ID NO: 12934 - DNA, 1225 bp, Homo sapiens
  misc_feature (1)...(1225): n = A,T,C or G
agaaagccggctggtggcacgaggtggtgcgttaacatacctcctcctcgctctgtctcactctcctccgttttcactgtcctgctcatncgattctnctgacctcacgcatggaacttgactcgtatattattcgatgtacgcgagtctgtgctattatgtcatcgacacgtattgctgcatatgttaacaacgggcacagtccgtggtgcatgacacatacagctgtgtgatgatatataggcgatgcgcacatctgtgcgttggaagagtgtcatccacggaatcgcgtaaggtgctcaatgagacgattatgttgttgtattggcgcggaatccaatatatcgcgagtctgcggtgacagtggttaactactcagacgacacacttgcgagtatggcngcatgatntctgcgctcgctctgcacacatgcgcgcatgagcaaactaacgtagggggcnatatatggaggcgggtatatactacggccgataatttgggcaatccggcgtgcgcgccatagcgaagattaatacagggtctcagtgcgtgatagtgcaggtgcagattgtcgtatgtgacatacgtctccagacacagtactcatgggggcggtgcgatcaagctgcaggggcggcgcccgtctgtgcacatcgcccggaggagcgtatactgccaagagccaactggttcgctgcgcgtgcggcgaacagcacnacgcgcgcatgacgttgcgagaatactggcgcactcggatcgtatgtgcgggcgattatnatcggcgtgacgagacatcggagcggcactatcgatccgntcatgactgctatgnctcgtgccgcaagaaatgttgtgacgagggatcacatccgtgtgtgacctgtgtgctgctgtcatcaggcggtctcgtaacaccctctcacaatgctcttgtctcgatttggtcgcaacgcttcgtgaccctgtgctaatcacccccaactaaggccacaaaccactatccacgtacttgtcttgtttctatcacacaccagggtatattgaacctgcgttcccgtgtgggcttctcctgtggtgctctacggcatataaaaatcaccgcgggtcatcaacaacaactacattttggctctcgttggctaaaagcggtgttagtgtttccgccccacgtatttcttcccataagatcatactattaatactgctcctcagatatgcactcat

SEQ ID NO: 12935 - DNA, 442 bp, Homo sapiens
  misc_feature (1)...(442): n = A,T,C or G
acctgnagtgtnaactaaaagataagttttaagagaatatactaccagacacatgggaatcagtgacaaggcctgacatatacattacgggagcaccagaagacgcagtagaatgaatgtgtcaatggcaacagttgaagatatactgaaaaattgatggacaaaatgccaaagattcatcacgttctttgaactccaagcagaataaatagataagtagaaaggaaatcacatggagacaaatgcatagcaaaactccaaaggagcaaggaaaaagtctacattttaaaaatcagcttgtgagtaccctttctttccaatactcgaatttgtattgaaaaagtaatgaatatgtaaatcaatttgggaaaatataataactacagttttgggccttccaaaccactaatataataaattctactatttaaaaaaaaaaaaa

SEQ ID NO: 12936 - DNA, 1017 bp, Homo sapiens
  misc_feature (1)...(1017): n = A,T,C or G
taacctactctttgagcccgttctgggacctctctttaatctcaatccgtgngccatnntcaatggccgccagaccagggactgcctgannnaaaactcctcccactcttcttacctcctgttgnggctctcgcactctctccccgccgnngctctcgacccgctgggcgatcggngccgccctccccccgacggggtgcgcgacggcacgggtngcccgccgcnnccctgcgcggngcgctgtgtgggaccccgcacacctatctgcccagcganatcccgaccattnccctgaacccgtcaantccattatatctaactttctatttgtnncttctgcttactctatctatgaacaacgaaaatcctaaccccgaacaacccatcccaccgacgctaactcgcctcaccctaaaatctaaacatatttgtnnttccagcgcaacccccatacttgacgcggagaaacacacanacgtaaaccactcggacgcggccgactaacttaccccacacccaacctacanncccccctatccatctacgcgcccgaggggtatgtgattactaataatctctcctanactgaggcagtcggcagagaaggggctanacataaaacggagaagatganaagatctctccccctctctnccccctcccccgccccccatntcccccccccataccgcgnncaataaaactatccaggctacagggctctgtgcgcactgnctccccacccccccccccacccaccccgccgnaccgttatacctctncctttaacttaaacaaaatnaactcacctcccacactcaacactttccccacacatcttcataacctttccnnnctctcccctcttcccctcttnnnctcctccttcctcctctccctttcccctanttncccttcctctnnctcctnnacttttccctcctnnnnccttctcccctactttnccttnnccctccctctnnncccttnnnccctctccccttnnccctcttcccc

SEQ ID NO: 12937 - DNA, 757 bp, Homo sapiens
cctggtagagcactttgatggcttattattggcctgtatcccctgatagcccacaagaaatgaatgctaaggcagcacgaacaggcgctcttgagcccggtctggttagccccgaccctccgactaggggttgtgggctgttttgagcaccagcgacacgcccttgtggcgccggagatagccttcccatgtgcgttcggatgaattacgccctcacctcagcgtgcttataccgggagatcgaccgtatcgcggacctagctactgttgctattcggtgactgcaccggtggcacactatcaaccaggacgcagtgctgctggctggactggttctactggggttgtacggcatgctgcagccctgtctgatctgtggttgcacgacacgctattctcctctggtcatgctgctttgctagaggccatttcctgtgcactgaattggacgcatataccttgcctgtgtccggattgatcaggagtcctacctgcctgttgacattgctggaggagttgacatctattatggtgtatcggacatctaggactccgtctccctggattgccgtacgaatcttttagtgctaccgatgacgccttaagtgcctttagccttgccttgtgctaatgccacagtgtagttctgtgctcacacgcaggaggggcgactcgtcgctgctctcctgctgtgaagaggtagctgtgggtttggagagaacacgaccgtctcgcgagcgttcattgctcttgacca

SEQ ID NO: 12938 - DNA, 1189 bp, Homo sapiens
  misc_feature (1)...(1189): n = A,T,C or G
taaatatttttattattttttttttttnttatatgtattgaaattaatagagaaaatanaatatataaagtntcctacagagacacacnaanaanacaaccgacttttaacgggcgaaaataaanagatgaagggccggcggcgagggtggggactgcggatcccgttcgaattcntgtctgtatttcgtgcggctctcgttttcgtacctggtcgctacagctagtttgccgttttgtagcttgtctggctactccggtgacttgtgtcacttcgcgcaatcatgtgtatgatagtatactccgagtgttgtctgattgataacatacgcataacgcctgagttgtgcagggtgtgcctgtaactgccctttcgtttctttttcgtttgtcgtgacagcccgggagtgtccggcgcccggtcgagatcaaatctgcggttatgacactaatggtgtataggaaaagtctggatgcttaagagataatcggttttccttttttatcatgctacatacgctcaagtctttcctctcatctatccactccacactcctcgtctgccttctcaaaccaacgagcccacgccccccgacgggcgctgccaccgcgtaggcgcggtgtgtctgatctctcgcgtccgtctatcttcgggttgcctctgcttctgacgctatgtatatgcttctgtcagtgtatgttgttgcctgctgcttatgtctcttcaccagcatctatactccacctcgtattcactgcatctccacgaatacgacgcgccgtcgatgtcgattagcgcatcgcgccggcgatgaacgtgtattagaagtacggcgtctcccatctgccgccgacgccgtctataccgcgatactgtctcagcgtcattatagtactgtgatcacgtagcgtagcgccgtcgtactgacgcaatgccgacttctcgcacgtactaacttcgtcgtcgtagtacaacatcgccgggaatgcgctacccccacgcttacttgtcatctatacctgctttatgtgtcgtagtcgccgtctagcatgtcacgttttctctcanccactgcactcactctctccgcctctgtgacgccgatagtcaagacagtcatctctgaccctgcgtgtaacgcgtagctatacttgttgcacgagtatcacacttaccacttccgtcatcg

SEQ ID NO: 12939 - DNA, 740 bp, Homo sapiens
gcacggtaatccggccacaatgcgtccggctggaatccccttcacttgcaagcctatgcagaagaacaaaggtagagcaaaatgcaacacattattattgctgggagcaaacggaaggcaccctatgaagaagagatggagtttgagcatcctggcaaatccagactgaagttagatggcatccaccaaacaactccaggctgtgaagaaacagacagctctcctcccacttctcatcttccttttctaggccattaaactgttgcactgaaaaagatgaagatacctccccaggctttggaattatcaaaataactttggaattcttgatattgattaatatcaatgctattcctattctattcaggtcaactaagacaatgttttcaaattttagattatgattcattagttgataacaaaatcaatttaattggctttaaaagagacataaaatagaaaagaaaatataaaagcatgcatcacatgcagtaaggacgagtctatgtatgtaaacattttgtttcaaatatatatgtgtgtttgtttataagatgtacatattgcgatagtttaatgtttcttattgtgagttatagtcaacaaagtgttcaaaaattatttaattaaaatgtaagctccccaaaggtacagtttttgccttgtccatcattgttcatccagcacctaaaacacatacataataaatattagctgaataaaaaaaaaaaaaaaaaaaa

SEQ ID NO: 12940 - DNA, 197 bp, Homo sapiens
tattaaaaaaaaaagtcagtggagcagcttgtcccattatcagcacactaaaccacaggattaacgaatattctagcaaaagtaatcacatttattaatgtccccatggagctgtggtctgaaacaaaaaacttaaccataataatttggtatccattaatcaaataaattaattcttccatctaaaaaaaaaaaaa

SEQ ID NO: 12941 - DNA, 365 bp, Homo sapiens
cctggaggacttgcccaggacgtagtcggtcaaacaataaataactacattgtttgttactggaaattcctcacaatcaacttattggaggcaacagtctacttatctgagcaacaggcatttcagacaacagcttacttacaaagacttatttgaagaccctggcttctctgtgtccaccaatcctgaactattctgtggcaaacttagcccagtcccatcagttttctaaaatgaaagccctaaaaatacccaactcctgactttctcctcctaagacacttgctaaccttgtcaaagtagaattctcccccactgcagcaaattttttataaatttagattttcctaataaaaaaaaaaaaa

SEQ ID NO: 12942 - DNA, 202 bp, Homo sapiens
tctgtaagaaacgaagtgatactgttacccgagaggactacagagactactcacagtaacaaatacttgaacatgcatggttgtgatcaccacaatatcctcactcaattttctcatctggcttcttcaaggaaaaaagaaaaagaaaaaaaaaagacatagaaaaattaataaataatgtctaaacttaaaaaaaaaaaaa

SEQ ID NO: 12943 - DNA, 789 bp, Homo sapiens
cctgaggcgtacttttctgcaccttccttggtatttgacaactccagccaattttccacttgcttcctcaccaatgcttcttcagcttgaagactaacatctagaagagtcatgaagtctaaagtcaagaggagtcttatcttctagaaagtttttcaaacatcccaacctcaaaaagtttggctaaatggtgttcttctacagccccacacatgcaaacatctttattgtacttgtgtcattattttttcttcgtatatgtgtttttctataagtacatttatatgaaggtatattttgaaataagggcacttcctcaacatttattcctgaacctggtacagaatagatgaacaatccatgttaattttctaaaatgaatgttatttttttcaattttctaccaagatagcaaattcctaaggctgcatttttctttcctcaaaatatcatagaagaaactataaagggaaaactaaaatccaagaaataaaacaacaataaaacaccatgaataatgccttagatgcaggtgcagaaaggaaaagagacagaaaataatacatgcagattttggcaaaaggcccaatataaaaaagaaaatattgataagttatatgacattaaaattataaacttctgttcaccaaaagactccaataggaagtgaaaactgcaaagcagagagagtgagagtcaatttttgccattcatatagtagacaagagacaaatctagaatacacgtgaaatatcactaagtcaatagaataaaatgcagataaccaca

SEQ ID NO: 12944 - DNA, 751 bp, Homo sapiens
  misc_feature (1)...(751): n = A,T,C or G
acgaaaataaaacggacatcaattctacttagctcactagtaaaactacaatatataccattgatcacggtctagatgatcgcgtcaanggaccacccttctctaaaaccagctcaattgngtttccccccctcccaaaacaaacactcaacggcaggagtaccnggcctcttcttccccctacaaggaccccctaccggccctctcaaaactccgcaccatcatattccacccatacgatctacccactgcatcattataggcagaaccatgcaaaacgtcccagggagcaccctgatccatggctctagttaaactactcccatataacacgacaacaaaaaagtcttggagtggctctgaggatggagagcacgtagtnattcacagccccaatccctgaccaaggcaaccatgaactcataggcccaagcaatcttcatgcctcagcctactagaaagtaaggataacaggtgcaaaccactgtacccagctgtcattacagcttctgttggttaatgctgatatatacaattttttgtttctcttacagcaaacactctgattcctgttcctggctccaatgaattttcagttccttcatattttttaagtacataatcaagtcatttgcgaaactatttttgttttttcttctcaatgtttatacgttttaattctttttattgcttagtgcattggccaggacttctaaaataaaatggaataatataaaaaaaaaaaaaaaaa

SEQ ID NO: 12945 - DNA, 443 bp, Homo sapiens
ctggggaactggcccatagggatgactcatctctaggggtttcacactctaaacttatgaaatactatctccaatcagctaagagaccagcggcccagaactttatcaacttctgatgggagtttgcagcccacaaaacccagctcagcacactccctgcagagaaaacatgtgcacctgggcttcttggcccagaaaaaggtgatgtagtcacttcagagtacagtagagccattgttcctcctccccctctgtaatcgtcaggatggaccgactgctgggggcccttactgggatattgattctctgatttatcttgcagcttcacgtaaaatagcaataagcgatgctcatcacaagcatggtcctgaaattcagcccatgccttaatgctgaaaccacgctggtaaattaactcgcactggctgataaaaaaaaaaaaa

SEQ ID NO: 12946 - DNA, 1357 bp, Homo sapiens
  misc_feature (1)...(1357): n = A,T,C or G
tttttatattaatatatattattatataaaaaaannnnnaaaaaaagtgtaatttagaggannaggaaaaaagaaaaaaataaaaaaanaatttttaatagataaaactaantatanataaaggtattttagaaagagagaaaaatcttgtggtatttttgtttgagattatgatttatttacgtaataagttttatctaaataagggaaaatatgaaggagtacggaggcgagggtacaacgagaatacaagcccgttcgaagctcgcgttggttccgcctgctccagcaaaggagcggcaggtaagactgagaggaagagcgcaggcggcggacttgtaggtggtggatcatcggtgtcgcagacctgtcccctcgcgcgtgtagtaatacatatgccggcggttgcttaggtgctgccggccatcataggcgttgacggttatgtgtgctacgggcccacgaacnggcgcgggtgtcacgactgcagagggtccacacccgataccccacgccttaagcgacagtcgacgcggcggccgcgagggacggggttctgcgataggacatacctaggagacaagcgagttagctcgcgcgccagccacacgccgccgacccgcgcgaagatgtcagctcgacacaccacgtctacgaagttatcaccgtttcttacactcctcccacccgctcaacggactctgcaagatgtttcgagatgacattcgtacctgatggtgtgtgtgttatggcgtggagtgcgaacggcaacaatcggatgtagtgggtgtgcaaggataggaggcgacgacgagcgcgcccactgagtacagttctcgcactcgtccagtgatgtccaacgtgtccgtgacctacacgagagcgaggcaggcgaggcgccgacagggcgtgatgatgacgcgcgcggcgcgtgccgacgtcgcgcaggagcgggccncgcataggagtcgccatgagtttgcgcgattgtggttctgcactctcgtcgcgccgcccgtctcagcgtcacgtcgtctgccccggatccgcgcgccgtcgccgcgagtgtagtatatagatcagtgagatggacgacagcggacgcgtgccagagaccgtcgcgatctagtcttcacgtccccacgattccaacgcgcctcacntgcccgcctcgcgcagtcgagtgcgacagagagcgatcacgacgcctcggtgcgacgtcgactgcgtggagaatggnacagtggcgagcgtgtcngcgcagacgctctgctcgctagtgacactcgcgagctgctcgcgactacagtgtagcggcggagagcttatccggtcgcgctccatcgacgccaccggg

SEQ ID NO: 12947 - DNA, 231 bp, Homo sapiens
  misc_feature (1)...(231): n = A,T,C or G
tagagggaagaaaggcgcaaggcggaccgtataaataaacatggggggaaacccttgtnngccnacnggacagcgcangttgnaaggaganngacnaaagaaaaagaaggaaccngaagcccagaacctcaaccagaacaaagaaacccaagagagcagcccagcaagcaacagccacgagggaccaagcaacagaganaaacaaagacagacgggcgaaaaaaaaaaaaa

SEQ ID NO: 12948 - DNA, 208 bp, Homo sapiens
ccctagatgtacacgggttaaaattacttgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcaaaaaaaaaaaaa

SEQ ID NO: 12949 - DNA, 1181 bp, Homo sapiens
  misc_feature (1)...(1181): n = A,T,C or G
gcagatatttgagtttacatgatatcaattatatnaatnannnnnnttnntgggtggtgggggtggnnggggttttnatntnattnnntnnananannnnnnnnnnnnnnnnnnnnnnnnnnnnnnnnnnnnnnnnnnnnnnnnnnannnnanngnnnnnnaaatggnnnnnnggantagngggagangtaaagaaagtggaaggggngagataaagagagagaanannaatgaggagtgngtgtggagtgagggagagattgntcaaaataatgtcacacactggggagggcgagcgagctctctctcattattcttgttctcctctcacgtctcnccgcanacagagacgcccctcagagttgttgaggatgatattcaatgaaggaagtggtaattgttactatgagacgagaaggaatgatagtcncacgaganacaggttttaaaagtgagtttgtgtatagtgtgtgccgagggtgagatggacccggagcgcccttnagtaatgagtggggtaggagggnnntggatgtagagtcgttgtgtgggtgtcggtatgggaacggcaatatgacggtgcatcaatatgatgggatggtggggtgagaagccgacagggcgcggcgtcacaaatagtccgaagagcgaaaccggtcccagaggcttaatgttggggcatacggaaaaaagaagaagtgatgaggtnnncaggagnttgagtgtttatatattctacggtatacatgttcagaagaaagagagattttataagtgtaaagcagtaggtccgtcggggcgagccacgtaggggattagaggcactgagacgctacgaatgtctttttttatatatgggtcggtcctagatcgtgcgagagtgtggacggagccgaggtgacatatctacctgtgtgagactgcggtttacagagtcaggaatggggatcacatatgggggtgaaggaaggaaatgagaaacggaagcgtctcttaggttggtgtggaaatgagtagcaacgagagaaagcagagaagtgaagccaatagagtaaccgcagttcctcagtgtgtgctcctgtgtgtgccgcaggtccttctagtgatgacagagattcgttagattaagggagccncagaggaaggcgtgcacgatgggcggacgagtgcggcgggggtat

SEQ ID NO: 12950 - DNA, 789 bp, Homo sapiens
ctagagtgctactctatccgcccactctgaagtgcacaggagcgatcatggctcactgaagcttctatctcctgcgcctcaaggcggactcccacctcagcctcctgagtatctgcaactacaagcgctcaccaccacacccagctaattgtttgtatttggtgtaaagacatggatgaatcatgttgcccacactgatctccaactcctgggctcaagggatcctcccacctccgtctcccaaagggctgtaattactggcatgagccaccgagcccacctgctagccactattctaacagcttcgtatgtgtgaccgcatctagcactccaaacagtagcagggacttttactaacaccttcattttgcagagagtatagagaacttacctgtcactccagaggggcattcatccagtgtatggtgctcttaagaacttacctgacagctcagatatgccgactgtatctagccaggctgatccaggttctgagcttctaaacgagccacagtaccttgatgctgatactaatgtgaaactttcttaggggcattttctgaccccacgccgccttctctgggatagcatgctatattagggtggcgcaaaagtagtagaactcttgccatagaatgcagggatacattcacctacgtgaagacatattggtttttttacaactgttggaaagtgactattaggggttgctaataagcaaaagaaaaaaacataaaattgggcttcgttcgcccctaatgggtggaggtttatgggacgcttacgctt

SEQ ID NO: 12951 - DNA, 1034 bp, Homo sapiens
  misc_feature (1)...(1034): n = A,T,C or G
gcggggtcatctttattattaataaaaaagnaaaaaaagggagaaaaaaaangaaaaaaaaaaggtttttggagaacnannaanaanattttnangggggaaaaccnnnaaannnnnnaannnggnnngnnnggnnnggnnnaaaagaagannnnaggaaagnnaangaggacgaggggagaacaccaacccaaacgagccgcgcgcgcccccaccgcncccccccgacccaccacaccagagcgggggaccccacgacgaaaccacccaaaaaaagcgcccccacccccgcggagaggcggggcccccgaggagagaaaaaaaaaaaatttttttttttagcccaggggccgaatcagacggcgcccccaccaacaaaaagggaggataagaggaggcccatcgagggcgacaggtccccctcaggggcnaanacaaaccgccacgcccacaaccccacacgggtcctgtatgtgtttctagacgtgttgtgctccgtatcacccgcaggtcctaatacgtcacagaaagacgcaatagactccaaaaccaagagtagcaccccgaggcccagatacaatgctctcgtggcgtcttcacggctacgcacgtattccctgagagcgcgaggcccccagagatacacaaggtccaaagtccccacccggagtcatgtaccagagccttgagagcctcgggctctgtcctggggccaaaaagaacccaacatgagcgaaccagccgtcgatggagagtagtgagccgagagtagaaagcgtaaggacggtcgcagaggtggcgcgtgactatcgctgcagtataataacgtgaggtgtctccgcacattctcctggtgaaggaagagttagcgagtaccgccgcggagaggattcaaggcgagggttcggagaagtaaaagagcaagtcnagcgggagacacggggagtgccacacaagttcctacggactacgttgacttggagaggtcatgaagagaagaagcaaaagagagagntaaggagacgcaacggtga

SEQ ID NO: 12952 - DNA, 1378 bp, Homo sapiens
  misc_feature (1)...(1378): n = A,T,C or G
cgtactccgtcgtgctagccacgctacacacgtnattcatcgattgcggacgtcgtactctacaccgaatggcgagacgctgctcttattgtatcaacgtgagacagtgtcgcntggagccgacgtcctgatnaagctgttgtgaccaccatatccatttatccgcgtgcacgcgcaatgtatgcgcgaaagcatatagcgggcagagtgaaaacacgcgatctgtctggtggcgaccacgatacaagcgtcggcggacgcaattatgtggtaccacacatgtctgtgagtatgcactggggtacgtgcgaccatcggtgtgcgttacactcgagcggatatgacaatgtatatggtgaggataacactcacaagagcggtatcgcggtgacggcgggcgactgtattactgggacagcggtgcgcggcggcacgctgatccgcattctcgcatgtctgcggatgggacttcgctataaggcgaaataatcgcggggcgatacacgaacgcgcgcaacacggcgcatcgctggacgcgccacactttggtactataacacgtgacatgctgaccatctgaatgggcagcatgtcgaaaggacagcacgtggcgcgctatatcgacattggtggtngctccatactgtgggcggcgcgagggggagtctgcgctcatagttgcgcgcgaggtgacttcgcatcacaataagtgggtgtgtggacgcgggaacgcaactcgcgtgaggcgcgcgcggcgtcgtggaacacgtatnggcgagtggtcgatctatatgtgcgcgtgtcattatctcgatcgcgcatcagtatcgtgttatatctncctcacgtctatctacgncgccagcgaacatctggtgcgatanattgggcatggtagtacgctgtcgaggcaantcggctgcgagntacactcttattcaacaatagagatactcggacgtgtgattaccgtcacggcgtgcagtccggtcgcactaatattataataaatcgatnaatatacgtcacactgctccactatcgagctatgtgtggataagcagaacatcgctgcacagccacaaccgcacatcattgactgtcgccgaatatgattgtctcaatctanccagaggtcaatggacatcaataagcaataaacaatatagaatacaaatataacatatacaataganagtatacagagcatacaacacatanacantacatggngtccctncngttggtgccactaactangcagngtnggtatgttgtctnngctgcgcnnctgacgncttctgtctgcctctcttctcttcactcatctatacatcttctctctcagccagcgccgcctaccactgcatgctactcc

SEQ ID NO: 12953 - DNA, 1014 bp, Homo sapiens
  misc_feature (1)...(1014): n = A,T,C or G
agaatccaataaagaccaatacgtgagggataaattaccgtagtatgattgncactagaacaataacgcatgacaagcatgagtcttgtgnnnntctatgcctgtctctcctctcgngctctctctngggcctctcctttttctgcgtgggggaccggttcgtcgcgtcccgtgngggagtcgccatctctatctgatggtgagcggtccacgtggngcacagaatggattcttggtgggcttcagtggaaacgtgccagacagcggnccaccganacttcaattggcctctctctttganacttattcctataattccttagnccttttacgctatacttgtaaaataagaagatgaacaattgaatattaaaaacctaacactaaaaccaagccttccgccctacttatcccctctagngnnaaacgttttgcatactttttccgtataactgtagganagtgtagtnaactccaaaactctataacacaggactagaagagacatagacacacccctcancccgctacanaagactcacatattcttcttgatttnacctcttctttttttantcgtactatgtatttctctttctncgttctgcggtactgtacgcggagtggtattaagacatatatttctcatggctttgttnntcatcactcttcctccccttnncccccccctcgtcctctcanncactttacttataattttgnatctaaaattagagattgggcataggcaattaagaactgtgnaaagctcctatcatctgattcccnnntctggangagatactttttactttgtatcgtaaactattntccagttttattatctataataaaaaattaataaatctnacatttnnnataacactatcactctannaaccaacttctcatccgccgtccaaacaccgtncctagtctttncacttaaaaactnccttccnnnncctcatcctcccccattcctcctctnncctnnncttnccctcccctccc

SEQ ID NO: 12954 - DNA, 843 bp, Homo sapiens
  misc_feature (1)...(843): n = A,T,C or G
tagggaagagacacctcngcgtacnctgtacagaaggagagcncctactcgtgtgcccacgtnntagcgcagtacaagaaggaacagaaagatattacacaagaacgctctgtattatatgcggcntcatcgatgctcctaagatgtgggagctccggatctctacccatagggtgcattgtcagacatgttcgcgccatcttccagtcctggggcgtcggagatgccgagctcgatgcgactgtcggagaagatcttatctgattactagatctgcgacattcgtctagagcatgttgctgacagtacgaaactactcaatcactgtgtatgaacaatcacactctaactagcattatttgtgtaaacattacataataggtccttttatatgtgacaacgacttggatctacatctagtgtgttggtgctctcatatatttgcataacgaccgattggctgtgatagattagctggatatgcaattcttgctctttgaatgtgcacatgttgctttgtatatttccggggaatcttttgaacacacggatgctatgagctctaacctcatagctaacattttcgctcttatgtgagagagggcagggttttacgaaagtttaaactacccaatttcctgtggaccagatgggcagctacttatggagccctgcctaacagggacccacgctcaggataggatcgcttcttctgtattaaatacttcaatagtcatgttggggaggtactatttcttgagtggcagactgcggtagttattctattttaacattgcgagaagtttggttctaatggcaggaaggtatcatgcggggtgcatg

SEQ ID NO: 12955 - DNA, 1580 bp, Homo sapiens
  misc_feature (1)...(1580): n = A,T,C or G
gtgtggtgcgtgctgcgtccgtcgctntgttgtttntntattatatatataagannnaaannaaaggtttnnnnnnnnanagatnggnnnatataggtnntntaantattnatntnntnnnnnnnnnnnnnnnnnnnnnnnnnnnnnnnnnnnnnnnnnnnnnnnnnnntnnnngnnnnnnnnnnnnnaggggnnnnnnangggggtgtaggagggagtaagaggggggagagggggannnngagaggnagtgngngagnnnnaatcantaatgagttnnngaagtaaaanaatatgtagatagagtntggtgcgcgcggctctcttcctctctctttccanagctcgccatccctagcatcatcatacaacnacatcgaagagataaatgaagagaggaggtgtggagaggagagngataantacaaatanaaattagtgataggtgtgagcaagtgctgtgagagacgcgggtcgcgcctaacngtgcgcgactccgtagaggagagagcgagacgcccgcagggggtggggggtggtgtgtgaggtgtggaaagatgtggggtgtgagctgctatgtgcacagtgattcgcgctacgagccaatccagcggtccgccggagnatagaattcgtctgtggaggagcgcgngcgnattanctgtgccgtaggtgtcctnatactagtgagtagagaccccgagagaccgcggactctctgggatagatacatccnattcacgccacgtgccacggtgcctcatacaacgcaatctcccacacgaaatcaatccatgactcaatacctctcactcgctctacagagcgcaccagagcaagggtcactgatggtggtagtagcggttgaccatcattatagatgtggatggtggtatggttnncggtaagatgtcgatgagtctgtgtgtcnatgctgagggcncgcagttgtttatcgggtgtccagacacgcacgagcctatgactgtggagcgcgtgtgtaggaggcnangtcggtagagagtatccgaggtgtggtggttatttcgatgtccaacctcaggcggaccttggacgtcggtattgaggttgcgcgtgtgactccgtgtcgcggcnccatggcagtccatagtctcagcagcatcgctatcaccgctgcacngcacgcgtgataggcgcgccnacccacgatgtataatgagtcatatagcgttcccntactcgtacacgcagagtgagagcgcatntcaagataaacgtgaggatntaacagcagcgcaccagaagagcacaaagatcatgcgatagggaatacaatatcatggtattaataagtatgtagagacggatcaggagtaagttgctnccatggaggtcggtcgcntcgatgcagcgacactcgcgcctgagttatctacgacgggttattntntactatatgtgtggtatgggatagtatgtagtngttgtggtctgagagttgcgcggtcncgcgatgtgtcacaggggcgagcgnagagtgagcgcggggatcagncacaaggagatggtagccacggaaggcggcagaggcgagtggg

SEQ ID NO: 12956 - DNA, 739 bp, Homo sapiens
  misc_feature (1)...(739): n = A,T,C or G
acctacgaggggcctagttcagtaaaatctttatcctacatatagattcctccaaagtcaggtaggaaggtacaatagtttaatggcggccatggaaaaattggagtggtttagccagacagaattggtgcaaaaatgccaaaaggtatacaaatttcgtngcacacacgggtcgttgtacgtaattcatggaagttatcaggcttcataaaacacagaatttataggcaaccctcatctgtaaattagacaggattctactttaattttgcgcagcacaatggtctagattagcctcaatcaaccctgtgttgaattctgatatttctgtgcagggcccagaaatccgaaaaatgctgcattattatcttattttactaactcagttacccatgatagaaattcatatgctagtatacgtcccatgagctaagcccaacataatcacatatggcagagcagagctatcttgatgataggcaggcggctgactcttcgccttttgaaaggttgctatagtgtgttgcatccctcacaatgtaaagtatccatatggtaagatgagaatccctcacattgctgacccactgcatgttttcctctgaattttaaatttttttacactatctgtagcttctctgtcagagttacccccttgcttatatttcctgaatagattttaaatgagacatttatgtgcataaaataaatatgtataaataaaaaaaaaaaaaaaaaa

SEQ ID NO: 12957 - DNA, 1861 bp, Homo sapiens
  misc_feature (1)...(1861): n = A,T,C or G
aggggcgagaggcgacggagacacgagcgcggagaggcggagcgaggtcggaacgcgatggtttctctcgctcgncagttcgatctacgtgatgttgtatagaagttgtttctttcatatgcgcgnagagcaagaagtacgaatcaccagaataatnaccacacgtactggtnatgtccgcgcgcgntagatacgacgacacngcagcggtntcgntacgacgcgngtattgttatgcttagatggatgtgtagcgacatgcgagtatggtgatgcaccagtatgcgatcaattaccgcacatcacagcacacaatatctntatccnatatgactatatcgcncgcgatatatatataggttagtgantatcgtaggttnagtatagttcgcatctcggcgcgcgttttagtgtgtgaggatgcttcatcggcgagtcgccgtagtatactgtgcaatataaccactacacatcatccaacatacagcggccaacgcacagagcgtatacaaatganaaagtaatataatagagagggccgttttagtagcgctcgagcgggtcgggatggaggcgaaggagagggagcgagacaagagggcgcgccaaacgatatacaaaatgacataccgaccacctattgataaaacaagacactaagacggtgtaccgggtacctcgccgatgttctggcggccgaggctggcgacagtgagtcgctcggagagagcgtgatacgagatcattacacaatcacgtgtaatcgtccgccacgacgagaccgactgagacgctacagtgtagacgacagcgagtaaggcgtgcggtccgcagatggcggccgcggcagtgaagaagcgctttagccgaggcgtgttgtacaaccgctcgacaccagtataatttgttcaattacgagctgtgtttgtccggcgccaatgacacgancttctcgtgtatgtggacccgacatgcgaacacgattctatctgagatatctcaccgattatagcaccacgactgcagtactgcatctaacgccattagatacacgccgaccgtgcgattattcccgccgcgacatatattccgtcagaggtaaaagccgacattaagaagaatagatacgcagctcagccggagattcgcgcgcgcagaataagcgcgacgtgagtagtatatgtaacagtcactgcgcgcagcgtccgtcccatatatacacaggtagagcacgcgccacgtctgaggcgacgatcacgacgagcacaataattatccgccacagatatattatcgtagcggattcgcgtaatacattgtcgaccgcgcgagtttcctcngtaatcgagccgccaggtancgacgcgcgtgaatcatgtgccgcgacgtagccngcgagacggatgttgagatccacgtgttgtgcgaggataatgacgcagtacggtagcgcgacattttattacggcacgtagtcattatcattttggatgttcgccagcgctattacgcgcgagccgagttcgcggccgcgcgtcatgacgtagacgctgacgccacacagcnganatatcggcacatttcntggttcatcatagtacgctgatacctatagttgatagcatcgtataacagcgagttgtgatgtagtgacagcgagangatgtgtgtcgtgcgtgtgtgtgtctcacacagcgagcgcgcgaggtgatgtggagtnagacagatgacgacggcngctattttagcgtgattatgatcnacacacacagtcaatgccgtattcatcgatgcagagatatanatgcaccgtatgttttatactntcacgcgctgctaataaagcgacatgtctatccgg

SEQ ID NO: 12958 - DNA, 176 bp, Homo sapiens
ctggtctttggacttagtctaagactatactactggctctcctgggtctccagcttgcctactgcagataacgggacttctcagactccattagtgcatgagacaattccttaaaataaatctgtgtgtatgttattgtatcaataaaatatatatgtatcccaaaaaaaaaaaaa

SEQ ID NO: 12959 - DNA, 244 bp, Homo sapiens
cctaggtgtgacgcagcaaggaggctcttgcaagacgctggtccctcaatcttggacttcctagcttccagaaccatgagccaatgaacttctcttcattgtgaaatacccagtctgtggtattctgttacagcagcatattcagtgtaagacaagaataataatgccccctctcctttgacaaactttaacttcagatgttaataaaaatataagaaattttaacagcataaaaaaaaaaaaa

SEQ ID NO: 12960 - DNA, 585 bp, Homo sapiens
ctactgttgcctactttctattcctttgttgtaatgctgccagcattctccttcctccctcctcattaagaagaatgaattgaacaagctacatggagagatttacactgcaagggctgtcagagggaattccaacacaatgatttacttcggtatcaaattcaaaacgaggatcagaaatcctgcattatcatctataatgaatctatttcatcaactaatttaaaatcatgcataattcattacgtgcattattcatttatatttagcatgtatttccctagatgtggtctctatgctaactttgcctcactattttttctgcataaaatgattatacgtttctttattggtgaaaacagaatgactttttgtcaaattgggtcactaattttcctatataacacaataatacttcctgccttttattttcaaaaccctttcctttacattgtcattttatccttctagtaatcatgtttttatcaatcttgtgttattttattttaaaagtaagtaatccatcattccaaaagaatgagaaagttgctcaaataaaatgtaatgtcagatttgaatctaaaa

SEQ ID NO: 12961 - DNA, 734 bp, Homo sapiens
  misc_feature (1)...(734): n = A,T,C or G
agtgtaaggtccagattcataggaattaaagctaatcaaaatatataatgtgggggtgggagattcacactgtcgatgtatgggggtgtaacactctctttatggcttattgntcccaaactccctcgcatattagattaaagagtgggtcttatgtttaaaggagaacctgagtcacataaaatatcacgttatactgtcattccctttaaactacaatgtcataatatctcttagcattctatatcatattagtcattatgctataatttctttcatgttttggtgggatggatttcttttttaagtagtagcatttttctttgaaaaaagtcctacgactgctacgtttcttgaatttttttgtgcttgagaatatcttcagttgcctccatgcataaattaaagttagaaatactgacagatcacacttttgttacttcagataagtaaagacatatgaaaaaatggaaggccaggctgattttatcccttttctgcccggatgcctttggatttaccaacaactgaagcccaatagtttgatcaggataatttttgttactaatcattctgtaccaatttttcgtggaacctaatgtcatcctatagatttagttcttcattacagagaaattttcttctatcatattttgaatattattttggttatacttggacgccttttaagtaaaacatgaatgactcatattgaaccaaaaaaaaaaaaaaaa

SEQ ID NO: 12962 - DNA, 429 bp, Homo sapiens
taggggcctgggaagttcaagatccaggcctcagaagattggggtttggtgagggccatcttctctctgtaccttacatgggggaagagttcatggaccattgttgttgcctctaataagaggcatgtgttttctccatcagttcatggaaccattgtcgttgactctaaaaagaagagaaaagtgctcaagtatcttcacaggaaggccatttagatggtgggtctttgagtcatggatctctctttaaaaattctaccaagaaacacaggcaccaaatttcgcatgcaatttcagggacttatggaccccagcttgacttgtcagcctcacaggaaaactagtggtgggatttcatttccattctaccaaatgaatttcagttgattaaaaaatgaccaattgttacactccataaaaaaaaaaaaa

SEQ ID NO: 12963 - DNA, 693 bp, Homo sapiens
ttactcactggataaatgtattgatgaacatctaatagtcttaataaacaattgattaatggatatatagaaggacagacaatggacattctgtcaagtgactgcttatgagggaagccacaactctctatgactgtatgtcctggtgactttcaatcaataatttaaaactcatccctcttcaacctaggcagggatctctgcgtattagtgtccctgccatgtgtcccagattcatggaaaggatcaaagtcaaaaacaacttctatcatcatgacatttacttgataattcaacataaaggggaattccggaaaacaggcatgaaacaaatttgtattccttaagtgggagcattgaactaagagatcattgaatatctccttagtttttggaactcagccctggcaattaaagaagagatgcctgatgtcctctttatgggttatgtgattcctacacagctgcagatgcttttatgacctatgaaaattgcgactcaactggctaattgccaaacattcatgggctcttaataaactaatttcctttcccgtgttctggtagtactctttgacccgccgaacactcgaacccttatggggaactaccccctttactccttggaaagcttattttatttctattataattcccaatttactcacgccccttaactcaactgactctatg

SEQ ID NO: 12964 - DNA, 1175 bp, Homo sapiens
  misc_feature (1)...(1175): n = A,T,C or G
cgatcgccgctggttgccccgttaggctgctttgtatatacatacgtgttactccaatcgatgagtgtcttcgcctcttcatcttattttcgtcacgcgtgctgtcatcctgtatatctttcacatcgccgcggtcccgatatatttcttctctggtgggtgcatacgagtcaacgctaccgtttagtgtgtcttgtatacttcggcgatgatggggggtactattcattccgcgggtgtcgtatcgttgtcacgcaaccatatgggaattgtactgcgttcggacgactttgcacggctctgcttgacgcatcctgcgttgccacgggcagttcacatattttgacgttatgcgtttcgctgccctataatgcgcgtgtctttgttgttggcgtatgttccggctatccggccttggggcggtgtgatacatcccgcggggttgctgccgggcggggactcaatggctggcaacngggcagtccgcgcggggcaccattcggtattcttaccagttcgctcggcgttacgccgttcggctccatctgcgcatgtgtcagcgtggtggccgctgtatctcccactgcggctggctccgcttttgttggtggcggccggcggtattctcggcgcatcgggtggcgcgtttgtctattgcatctctcatatcggtgcgtcgggggtcgctgtattgatctgggggtctggcccggtgcatcgcgctcacccggtctcgccgcggcggccatcaactggagcgcgtacgtgtggcgggtatcctctctctctcttcatcgctctgcggggcgcggattgggtgctagaatgtggggtggtcgtcgggtgcaccggttgcgtcaactcacatgccgcgtgcgtcggttgttcgcggttctcgctgtgctacccctaccactgttagaggcttttccttgttattgttgtcggtgcgcccctttttccgtgaccctccttgctctccgtcttcttttcttccgtggcttggttgtctttgctttatgaagaaacgttctcggcgtcttcggcgttccgattagccgggagtggtcttcgctgcgtctaaagctcggtgggcgcttttgcccctctgaagcccgtttcatttctgcgttctgtttgggtctctcactctccccccgtccgcctctctctct

SEQ ID NO: 12965 - DNA, 1222 bp, Homo sapiens
  misc_feature (1)...(1222): n = A,T,C or G
acgactgtctgtcacgaaagatcttatagtagtgngacgatgactcgtcgctgtctcattgatgtngtagtaatatcattgaacactagtactatcgtatgtgtggttcgctgagangctatgccgctactgatgtcgagtggcgtgtccgcgtctctnggcctgcacagcgcgctctgtagcgtgtccggngcctctacaccggtgccgggtactgtcgggggttggcgctcttctatgagtcggcgtgnagtagagtccgatttctnaaccttccatggcattcattccttcgngccgttagcgggagngcgcgtcgaaataaaatgactgnacttcatggggccgtttctatcgttacgctgtcccgtcttaanntaattctaaacggcgtagagttactcccaggncgctagtgtggngcacatattatgcaggactaatttacaccgcgncagagtagtnanactcttgaacgtcttagngcactttaaccttgaggctgtctgtgtgangtacgcaccgcatctctcnnnnnnncgcgcgtggccccgcatatggctgttagacgatccagngccacggggncaacgtcaacaagacagtgtcaagtagtggctccgnaccactcanggaagcctatanacgctgaattgnagagatcctacctcccatccgataanagccggacacgtaacctttgcctctcttcttaatactatgtcaatgggctagataaatgataaatggagaatcatnggacagagaaatttaggatgacgccggcgcggggggnngtgggtctccataacacatcttcaaacctcacgcccttcgcgggttanganacgaactcgctctgcacgtgagnnnattctatctcacatgggccgtggacatgtggccgcggcgtacgttgggnagttttcatctggcttttttgtatcttaaacttcgtggcgcttgacactaatanggcggtggacatcaaaacattatacaattttatatattcaataatcaagtctcaacttacacacatctntacctcttctntnatacctcattctaataatacgtnnnataataactcgcttcctctgttgtgcttactaccgtnntcttatcttttnnccgctnccgtttttccctttcttnnctccccttcttcctttncttttcctttctctnnncccttnnnccttnctcttncccctttccc

SEQ ID NO: 12966 - DNA, 922 bp, Homo sapiens
  misc_feature (1)...(922): n = A,T,C or G
ttcatcagacaaatacaggcaccaataaatagaacaaagaaaggccttagcgtatacagtactctggctgngagaggaagactctttaagaaaatagtttaaacaattcgttaaaaaattttccgtcttatttcatgtgctgtaacagttgatatctggctgtcctttttataatgcagagagaactctcaaaaaaacaaacaaaaaaaaaacaaaactgaaaaagaaaaaatagtactaaaaaataaaccaaacaaacacaaacaacaaaaccctttttttttgaaaacggctgagcccataaaaaaactcctgtagcacggagctgacacaccccgcaggatagatcctggacaccaacgcccactaacaccatcggagcccgatgcactcgcgcccccaaaaacaattaagtaccacgcaaaacccgcaacacccaagacaacacatcctacatcccccataagcgaccaaataacaggcatccacaagaacacccaatcatcaccaacacaaaacgcctgaccaatctatccgcatcatcacaatacccccacataaaataggaaaaccaacacacacagaaccgcaccacaccaacccacacattcaccctatcacgattagcctgtaacaatcctcctactaatattccggaccaagattaacagccgccccacaccacccaccatcccacacccccacaccaaccacaaataccacaaaaccgaccataccgcagcaccgcccgaccccattcattctccaccacaccgatataaaaaaatacaccgcataataactcccgataatccacaattaacacccaacataactaacaaatcacacacaaactctatatttataattctaacatccacacggaataaacccgccacaccacgcgcccacctctaaccac

SEQ ID NO: 12967 - DNA, 1079 bp, Homo sapiens
  misc_feature (1)...(1079): n = A,T,C or G
gaagtggaggagaggtatggtgtagagagatggttttatatnntnnnnnggggggngngggnaggaggnnngnggttgttgttnntatttgtttnntnnnntnnnnnnnnnnnnnnnnatnngnntnnnnnnnnnnnnnngnnnnnnnnnnnnnnnggnnnnnngggaggngaggnnnnnggtgatgagaggggggnnngtggaggggggaggtnnnnaataatgtntggnaagagaggtgaggagtgttattnataagagtggnnccaggaagagtgccgctgcatctccntacacacccgacaatcacgacggcataaggttgtccngtggtatatatagantataaatgtaaagaagtaggtgtgactgagggtggaggttattgttgtgttagctctcgggcgggggtagggncnagaatagcagtcagtttttagggagagtatagctgcagtgtagtagaaacaataaattatgccgaacgaaggcacacaagcctggcggcggaggaggtaattaatgatagtctcatatgtagacaaagagcgggagtagacgctgccntctcccttggcccggtccgcgtgggctntcggaaacgactacagtgctctctctctgtttagctccggtggtccacggcggacagttgactagttagggaggctgtgtcccagcgacgccggatggagaagaggggaaggagcaagggtcaacgcgaggcatcgagagggatattgcttnccagcgtgggggacggagaggtttataggttaaggggtggggcagagagtttgttcgtgcccgcgacccgcggccgcccccgagcaggaggcgttcgagggcagaccccatccgcagtgtgaatccgtcgaggggggggcaccccgggggccggtggttaaggtgttggagggtgttaagggagtcatgtggtgcgttcgctgagttcctcaacgcgttagtgctatattcaggacataaggtgtcaggggcggctaggtgttcctcggcggtatagatcgagggcgaggactctggtggtggaggactggatggaataagggttcgagaag

SEQ ID NO: 12968 - DNA, 128 bp, Homo sapiens
ggacacagaaaggtggaaggaggacaacaacaagtactctgctcaaccctcattccagtcttccaaaaataccttggaaataaaggtgaataaaattcctgttaaaacacttctgaaaaaaaaaaaaa

SEQ ID NO: 12969 - DNA, 887 bp, Homo sapiens
  misc_feature (1)...(887): n = A,T,C or G
atagcgtactttctatgccccgttannnnnnntncccctcaggagacaacttggaacttctttccctgatcttgccaacagtattcagcccggactccaccaattagaggcacttgcatgagatttggttgggaagaaaaggagaagccattgttttcttgaggcagcagcagatggctgacatggaattttgcctaaaacttttgggtgttctcctgaaaatactccaactggctctacaggcagctgagagcaatggcagtggcttccttgtgattcctgcactaccagatttcctgaaagaggtgtcccgatcactatcactcttgcagctttcctagagttatttaagcctctaattccctgtataagcctccttctatctgagatacctagaggggtatctgtttttctgaccgtaccatagcagataaaggacctagtttggaagctgtcactggaaattctaggagagtgaaacttgaggtagaggtcccctaagttcccttaaagcatttgccaagggacctttcggaattgtagggttcttgacttttagggattgggaagcttattcccaagtactcaccccagacttgtggctgtttggatccaaagagaaataggagttatgttttgaactgaaaacccattgacccttggcacctacaaaaatctgttatatcttactgtggagccaaggaaattggaatataaaaacttctaccgtctgatctaacacctatctacctgcnctaaaaagctttctttgacaccacaccgccaaactagtcgtctgaaccctatcaccttgactggggtgtattgtgttgnataagtgttcccccctccaaaattcccagatgagaacctgcacgttaactcgg

SEQ ID NO: 12970 - DNA, 842 bp, Homo sapiens
  misc_feature (1)...(842): n = A,T,C or G
gtgaagagagaagaaagctgaacaattttagaaaaacaaaaaaaaagagtttttaagaanaccaagcngcagncctcnanaagngnncacgancacacnacaanancaanngcaacccaacacttacgcgaggcgccaaagaccncnaananaancnagacacccanacgncnacggggaggancaaggcagcngagaagaaggaagcgngaaaggcagaaagcaacagaaaaaaggaaacggaaccccncggcaccccagcaaaaaacgaaacagcgctttttgtagaagccctgctggcaagattacgagctctataagtttttttggttaccaaaaaaaatgattaagccaaacataaggccatgctctaaactataacacttgagaaaattgcttttatgtaagtgactttatataggcttaaacgatgatatatatcagaaaaatccagccaaacatatgaatgcactgctttctctatgtactgcaggacatggcacatacaacaccgcaccgggctccacaccttactttcttcctctgactccacgaaccctacacctctctagtcggcggttcaacgagacatatcgcgtaacaaagcccgtacgcgccccccgcgcacgccacgggcgccctcacaaaaaacccaccttcccaacccactcgaatcctcaccgacgcttcacaacccgaatggaagaccggccacacacataagactcgagaaagccccaagcaaccaccccaacccaagacaagccccacctctccccaatgcgaaccccagacgacccggcgacctacaaccgacacaacaacacccggagagatagaac

SEQ ID NO: 12971 - DNA, 225 bp, Homo sapiens
tctgaagaaactttactcctggtttgggtcagccactctgcatttacctataagaatctacatataagcttgtctatccatcctgcatagagcacaagtcacagaagaaaagctcctctccataaattgcttaacatagtaatcaatatctcttcacattttcagagtaaactatatcacttgaataaacaaaatgccaaagggttcacagtaaaaaaaaaaaaa

SEQ ID NO: 12972 - DNA, 210 bp, Homo sapiens
ctaggtatcattttataaaccagttaggaaatcgtctccattaacgctgaatattggtgccactgaagttataataccctgttgctgatgccactgtagaaggctatgttgttaactttttaaaaaagtgcatttattgcttgtattttgctgtatccaaataaaattatttgtgtggttgaactcacaccacatataaaaaaaaaaaaa

SEQ ID NO: 12973 - DNA, 1960 bp, Homo sapiens
  misc_feature (1)...(1960): n = A,T,C or G
gtatagtgatatgtantaatatcatagagaagattaatgatatagntgatngagtatgtatatagaagagnaggtagagtgtatagattgtgacgtaganggaagaccttcgttattagaggagtacggaccanaganagagatagtagtggtgatggtttgtttgngangngngtagtgtggtatataaacctnnagtgntgatnatgtgattgantntgttatgatgatgtgtatgatanatanataatgtnantatntnttgtagtattgatagttgntatattgtatgtgtataatgntagttanattaatgtgagctcgttnatatgtagtagtaagtgatatatagtgttgtgattgtcgtatagtgtagaagtggctagtagagnagcatggacaatgtaagtgaagatgagatgcangaattcgctagagcgatgtactgagtgacatcgtactgtggaggagtgaattgattgacgngagtatagtgtngagagtgantgtgtagcgtngaggacgaagagngtaagatactgntgtgtactcacctagtgctagcgttgttgagagcgagcgagatgttgatanatgtgagagtataatatgatgattgcagatgcgtggctggcatcgtggacacgnantgatgaganagatgttatgtggatatgatgacggatgacatntgtgctgtgagtagtagtgatgaatgtctgatgtgagtagagtntatacatagtgataatgtgtgtagatagtgcttagtngtngcgcgtaagtntntatatgtactgataagantgagtngatgaggatgtagcgtgcaattatgtagtnatgatagtgatatgttaaattgtaagcgcagtctctnagtgggtgatctatnanatattctagtnagagtaacatgntatgtacgtgtanttgnagttatggtgtatggtctgatgcatagntgtgcgatagcgtgtacgtgcgcagtgagtgtggtgatatgtagtgagagagataggcgcgtgtgttatgtgtcgtgtgtctantgtgcgtggtgtagtgatggatgtgtgcgtacgctgtcgtgctcatgagtgataatgtacactatacagaaaggtacaatactatacagatgatgtaaagcgtatcgattatnagcaatgagaaganaggagtgagcgagttcgagtacacangttacgagacgtgtagtatgatgtatgatatgtgttcatgatngttagagttgtagganaggcagngagatagatgagtgtagtagaaatgtgtatgactaggaatgattgtgatcggtgtgcnagaggtaaatgatactggtgaaacgagcagtaagagtaggagtataatnatcgatgactangatgtattatagtgaagtaacgtacacatgtgagtttgtatgctgctagcaatagacatgtacgaatctactgtagagattgtagtgatgtatgttgttgaaggagataggtgaatgttatggtctgatgagngagtggtgcggtgatgctagtcgcgagagtgctaggtaagatgagataggatntagtagtgaatgatgatgacgtatagtagataggaagnatgcgagtagaagtcgagaggnagtagcgaatagangatagagagatantcacgtagtcgnagacgtgagagagagcatgttagagagagagttgtactagatgtatcgtagagtgagtnagagntgagatgtcgcatgagtgacgtgatgatatgtgagtgatantggntgtgagtatgctagtgtgtaataatatgaaatatatcgtgcacatgtacgcnatncgtatgtgagatatacatactaatacttcattatanattgataatgatgctggagatgcgggacgagtatcgtgtagatgaaaggcgaggagtgatgagtgatctcagtatcgcagagttatcg

SEQ ID NO: 12974 - DNA, 933 bp, Homo sapiens
  misc_feature (1)...(933): n = A,T,C or G
ggggggnnnnnnnnnnnnnnnnnnnnnnnggaggaggaaggagaggnngtggagaataaaganncaaccgatttttacagcccnctgactaccanacatataggttaattaggaactatgtttatttattttcttccatcaggacctctcctcattaattttgctataattgaaaaatacnatcgaataaaaatgtcttctatcgcctacgttcctcccccagccaaagcgtgctctccctggccaaagcgccaccgcaggccgccgccagcgcanaaggatcccccggataaaatcaaaaagcaaccaaacttccaccccctacaacctcagaccggttcccacacctgctacccccccacattatcccccacgacctggggctgccggggccagacacaatatgggtgaagcgggccacgcagattgtgggtttacggcataccagccactgtgagagaccacaagcccggactaccaccttaatcaacaactaaatcaaaaaataaaaatactagttctctttatcgcctcgttttccggtatacgggaagcatcgggacatagggtggcggtggacaactcagcccttacccaatcaagtgtgatgtgcatccatctcataacaaagtaagtaccgggggcttgcgcgccagatgaacgctagtccacagaacgacgaaaagtgaccgcacaaccctaagagacaccccaagcagcgagaaatcaacgccagacaggacccgacatgccctgtaatgaagaaaagatgtagaaaaaagagcgcgtgccaacgttgtaaacagaatgctggatgattacgatactaacgacttgtccacaattaatctcacagttggaccgtagtccagagaggatacgcgctggttcttcaagtaagtccacccccagccccacaaataaaaagacaac

SEQ ID NO: 12975 - DNA, 1616 bp, Homo sapiens
  misc_feature (1)...(1616): n = A,T,C or G
ggggnnnnnnnnnnnnnnnnnnnnnnnnnnnnnnnnnnnnnnnnnnnnnnnnaaaannaaaaannaatannnnnnangagaatgnngggnngnnnntnnnnttnnnnnnnntatcctgctgtntnntttannatanntattanattattattactgtcgtgtctttcttattgttnannnnananatagaatnttntantctatgattcgcgcgncacgacaacttcnactgaagngcnntgtgagtagcgctcactcctcacgctatcctcctcttactctctactacctcngacncgtgtatgtatgnngtgnnnncncgcgagcanntcgtatagctgaaatatnntctatantcntcacnctncncncactcaacacgntnacagttgtgagcctcgacactctcctgcgtcttgtggagtgctgctggtggtgtgagcatgactcactcagcgtgctcctcgctctggcatgtgtgcgntccgctcgtgtccgcatgtgtacgtctgntgcnatctgctgtcgtgtnnnnctcctctctttatcgacanntctattatgtgtnntcgcagcgntctctctctgttgtnttcntgcgaagtgtatcgattctcgtctcctctcatggtctttcatagtcttnnnatctaaggtatctgtactatcactattcgcgcgangtccgctnacaaatacacnacgacgtgcagaggatagcgtggtantgnnctcgatggcgatgtgcgncnccacttactattcgatgcgncgtacgtatccantacatctcaccntgctgcgcaccgccgacacngacgtcacgagcaagtgnatatnaaacacattaaccttattatatataatatatttgtatactattcttcgctgctctctctagtcgcgcccttccgtgcgtggcgtcccttacgcgtcatacgtcattgctagtctacatgcatacnataatgccgtgagatgtattcttcaatctatttatcttacaattggttcgtactgtttgtgtgtctcttagcactcttcacgtcacttaccatacgtatctatgcagcgttgctcgtgacgtcatgagagatcttcgtncacgatcatanccacactcagtccattcacgatattccactgtctctgtgcttaatctcggcgtggtgtttgtgctcgtgcgtgccactcatgtacccatgatacacaccttttctcgctcgccacgtatctcgccgtcgantcacaacagcctaccatggttagtgtgaccttactggcgtaaattatgagagagtgacccacggcgcggcgagagagcgtcatccgattacnncatatacttcctgtgtttgtctccgctatctccgctgtgcgtacgcgacggaacatgctgtcgtagagactncnaacaaataatacggtatcacgtattgagacgttactggcgccgtgcctattgtatgtgccctcgattcgattatatngtatacgtgtatatgcttccctatattgcgncttgcgaggacagacctcccctgcgcgtgttcatcatcactatggctggtantgtcnagttgcagccacctaccaggttcttactatatgtccat

SEQ ID NO: 12976 - DNA, 479 bp, Homo sapiens
ctagaagcagcaaccatcatggacctggtgtgcagttgctgacgccactgggaaaggggagagagagattcaaccaacagaccacggcaatgactctcagggtgaagactatagagacttcacaaggcacagaaatgggatctgacatgagttacaaccacaggttcatcactgtccctggtgtgaaccatggttgctccaagcaaagccatggaactttccaaactaagaatttaagatctcagaacttctcttgacaggttggataacactgttctatacaagtatttctcacaaaagatatcactgttaattttggttctttatatgtaaaaggaaaaataaaaatgttgcatttattgagagattaaaaagacagacaaaagttttcctttccctttgaaactgatgaattttgctgtaatcttcaaagtcaaagcaacagtaaaatctacatttgtcaatgaaaaaaaaaaaaa

SEQ ID NO: 12977 - DNA, 180 bp, Homo sapiens
cctaatagcaatagagcacatcctttatggagaaacataagatcaaagaagcatgcaacactgagctatcacacggagaacacctgtctgggaagccacctaaactgacagtggacttctcaagagaaagaaataaactttcttgttttaggacaaaaaaaaaaaacaaaaaaaaaaaaa

SEQ ID NO: 12978 - DNA, 845 bp, Homo sapiens
  misc_feature (1)...(845): n = A,T,C or G
gagagagaataataaaggttgaccaaacaaaatgaaaaaaaaagaaaaatttgtgngnnacaccnggcaacctanngcgcngnacnngccaacagnanncagcccggaccccaccaattttaggcacgngcaagacccccggnngggaagaaaaggagaagccanngnnnncnngaggcagcagcagaaggcngacacggaaccncgcccaaaacccacgggcgcaccccagaaaacaccccaaccggccccacaggcagcngagagcaaaggctttttctnccttgtgattcctgcactaccagatttcctgaaagaggtgtcccgatcactatcactcttgcagctttcctagagctatttaagcctcctaattccctgtctaagcctccttctatctgagatacctagaggggtatctgcctttctgactgtaccatagcagataaaaggacctagtctgcaagcttccactggaaatcctaggagagtgaaacttgacggacaggccccccaagtcccctacagcagctgcaatggcaccttcggaatcgatggcccctgacctttagggatcgcgaactttctcccaagtgtcaccccaacctgggcttggctcgccccaaagaacacccactttcatgtctcacctgcaaaccactcaccaccgaccccaaacaccctgataaatctaccgcacaccacaagaaccggcgccacaacacctccactgcctctccacccccccccccaccccccacacgatcgccccctcgcccaccccaccatcactccaaccacgccaccagacaacctacgncgccggcatccggtcaaaacaacga

SEQ ID NO: 12979 - DNA, 851 bp, Homo sapiens
  misc_feature (1)...(851): n = A,T,C or G
catattggaagggccctgtgttgtaataaagcacagggacaggcggccgtgcgctgcttgtcttcaaggatacacacgttgccgtgacccggacctctctaaatacagtatgatagagccggaatgaaacgggtatgtacagggataaagggggagcagacacgcgtcgagtaaacgcgcccaaacagggctgtgttgggtctagcatagatagggctccgggaacagagagcacggcggaaacacaatgcggtagggaaagggggaataataagcagcgacgggcgagccaagataggaccgtgggatggtttacccggggcaaacgggagcgccaataccggatcttgcatagcgcgcacaagggtaaaatcgggagggtcacggacgtaaacggtggttatagtctgaaacacggtggtcccgacccgtgggcgggggccgcctggtccctatcgtggtgacttggggggggcggggacaatgagggggtggtcaggtacagaagggttcttccctcatgaatggggttgaggtctttataacacaggcttcacaatgagcttgaccctttttagaaaatctgtgtatgtctcccacgagggacacactgttcctcctctccagaggatgcagcaacaaggctctagcttggaagcagagatcaaacccttatccaatgccaaacctgcttatgccttgatttgggacttcccagcctccagaaccatgaggaaaaaatttctattgtttgtgaaacaaaaaaagnaatgttcctcgttggccacagcggggaggttccgcccacttcctcttcatattttaataccgcacagctggctgtctcctcc

SEQ ID NO: 12980 - DNA, 730 bp, Homo sapiens
  misc_feature (1)...(730): n = A,T,C or G
agagccacttgtgaattcatggtgtgtcaacaaacaaatatggttgcaataccaatctagaaggtcccagctggcgaagttattaagctgtttaaagatcacccatggcatgggncagtggttcacacctgtaatcccagcactttgggaggcctagccagccagactgagctcaggagctttagacaagcttgggcacacatgtcaaaaaaccacctctacaaaaagtacaaaaattagtcgggcgtgatggcaggcatctgtagtcccagctacttgggaggctgaagtgggaggatcacctgagctctggaggtggaggctgccatgagccatgatcgtgccactacactccagcctgggtgacagagtgagatcctgtctcaaaaaaaaaaacaaaaaaaatcacccttaaagcaacaaaaagacctcatgctcatgcagtggacatttcttggcctgttttcctgtgggttttcttcagcatgatatgaagcaactgttggcatagccagtgggataaataagaaatggaatcatttggctgcctcgtcacttgtgctaatggtcagttgtacacacatgacatgtggaagtgacctgtagcagcggtcactcattttaacaattgaactctgctgggttgggtatttacctttgtctagaaaagaaatatgatatattttctctaaataaatctattttcatcattccaaaaaaaaaaaaaaaa

SEQ ID NO: 12981 - DNA, 1211 bp, Homo sapiens
  misc_feature (1)...(1211): n = A,T,C or G
gggggggggnnnnntggggnnaagagnngangnnnannannnnnnnnnnnnnnnnnnnnnnnttnnnnnnantnngnnnttttgtttnnngntgggngganntnntanaaagggtaatattnnnnanttagangnntnnnnangncnntganatgngntatttnntnntttaaggtgtgttattngtagttttgggtgatatatttggaggttgatagaggataaaattgaaggagtatagatagaaagtagtatgtttcggatagtgtagngtaataatgtataagantaaagttaagagagtatggaanttcaaatgtgtttaggttgtaaggggtagtaagnatatagaattgaaganatattngataggtaatgntcattgaatttanncatactaaaaaccgcgacagatcaacacacagatccctcgcttatggatgactggtaccgcgtaatcggcgagcagccatcagcaacaccagcaccagacacacattaaaaacacacaagactacgttcccctccccccctttcactctcaacacacccacactacactaccatactcatttatcctagtcaatacactctcacgagtataacaccgtaatacgataacgccaacagtagtaatatacctaatatcatacttaatatatcatctagaccccncctatagacgagcacatatcattacattactactcgacacataacgtgcgcattccgagagggcagaaatacgcggtaacaggngaccacactagtatctgacacgcaccaactatccccgacaacgagagaacaacatagctctgcaagtaccacagtcacaccacgactctaccactcagtacatactaactanagcttatctattctcacaagcgccgatcaccccgagcacgancacaacatcatatcgacgccacgtactttaatcacaatgagccgccgcgcatgcacatcactgcacgctcactacacaatacgtatacttgtgtatacactagataagaacaagtttagtagtaagttcacataaatgatatctgaatgagcgcgatacaagctctatttctcgctctacacnatgtagtacactcgagccacacgcacgtcatagaatattaatcgaactctctccgtcgcagagatcagcccagagtagagtagactagactacgcgagcctcgagacgacaatgt

SEQ ID NO: 12982 - DNA, 1559 bp, Homo sapiens
  misc_feature (1)...(1559): n = A,T,C or G
catcactcgactctctcaatctactcattgatgatcggtcatggcactaatatgagtgtcgacgcacaacgtcaccgcctgcctatagctactcgtactcctctttctaagtcactgttcatcgtgcgttactttaccaactccttctatctatatattatctagtaatctataatcgagcgtcacacagtcctaccaacagctgcaccgcgtgtacagcgtcatccctgacgcagcagactcctactgaccgtcggcggtctcgttgtctcgcgtacgaacagtgtgttactgtgcncagatcgcgnctcgatacgacctattnctatccacatccgcataacagtacctccnncnagcgagatgcaattcccaacgaacatatcgatcgatgcttcacccgagtantccatcgagacacntagtagcatctnacattgagttantcgtagcatgcagagacaatcgacagtgcnaagagagggtactctggcgccaccactgtcantnccaactgtanccgagcgcgctcgagcgtgcgancgcggtgcgtcgttcagtatcactagtatcaggtntaagataattcttaagtgaatnctacatgtggttatgtgtgttctcatgattagtgactagtacgatattctaactgatagccgtttgatgtgtcttagctaggctgcgcgctagtcgccccnncncccattctcttctactcacgcacgctagctagtacaagagtatgagcacagtactaactactcagtgtgatcactactgcgtgtctaatcagtatccgtctcctcgcctcacacnctgccgcgacctcctacgtctagctnnctnattatatagccagagaanagcgcnnnccanacagctgctcatcacacagtgacgcgcactccgcttcgcgctatcgtctctcgacgcgtcgcncgcaggacacgtgacgcgcgcacgacagcaggcgcacagcgagnactnacgagagangctctatatagacgtgtacatgacgtagactgctatctctcagtgatgccatctgtgatgatcaacgcgatgatcganagactgtcgatgtggtagacctnacancgctcgagagatatggggaatctanannntaaacgaagctgttactacgctacatcaatgtgctgtnatcaacacacgctaagtacanctactaacgtgtaagatgatctaccaggagtgcagacatagacataacctcgagcagggtccgtctgtgtagccatctagttatagttatgctatatcaacacaataatacactctatatcgtactcatctctncttcttgantagtatgatgtnattaatgagcatatcnaatagtgaggaagatagaacgataggacacgaaggatgaagagcatatgnttctcagaggagtgaataggtcagtgtgtagtgatcacagtgagtgcgtccatgtgttctctgtgtgtcnnagtcgaagaganaacatacagtgtacatatgagatcgttanccgtctgagcnctagagagataggataggagaat

SEQ ID NO: 12983 - DNA, 1263 bp, Homo sapiens
  misc_feature (1)...(1263): n = A,T,C or G
acacgagcccacaaaacacaccccccaacgccccctcaaagggcccaccccaaacaaccccaacaaaacaccctccacgggcgacaaccaagcagggcttgacgggaggggaaccgcccgctgcacgcgtccacactcccaggcagcacgcgcgttatcggcgcggaaccccgcacaacacgcagcggggcaacacgaacaacaagtaaaaccgcgccccccgacacaaagccacggaagcgacgcaagaagcaaatgctggcgctctcaacgatgcggccgcacagaaccgaccccgccccccccaccgacagccacggcgccccgcgcgacgcaggccgaagacaagcacaccgacaccacagccagaccgggcgccatcttctgccggagaaacacgaccacccacacccacccgggcaccgccaccggcccaacaaccccccgcccagcccgcgccgcaacctcccaccacacaacccggacccaccccaccaccccgccgccacccccatcctccggtaccaacgacacccgccagacacacacgccacgacagcggcgcccaccgacaaacagaaccgccgacatcggaggaattgggaaggagagcacgaagaacgacaggaagngtcggcgagggaggcacactctccgcaggtaccaaccgaccgaccgcgcccgaaacccccatatccgccagagcgccggacgccgccggcgacaccaagaccgcgcaccacccaccaccgcggccgtcaccccgcacacccccacccgccggagcgaacgaaaggcaccctgcgagacactggacacccgtcgcggtcgcctcgcccgacaacacgaccacgcacagcgcagaaaagagacgacgcatgaaccgacccgacataggacaaccggacccgcgccgacaccccatccgcacaccacgccgaccaaagagggantccgacgcgttataggacgcccacaggaacacccccgcgggatccgcgatggcgagatccgncatcaggacggacgcgcngcacgcgccgccgcgagtacgccgagccgcccgcgaggtcgcgccgcccgcganaanaggactacgacccgcgcaaagcccgcgccgagtgacgctataatcccgcccgagagaaagaacacgcagcacagcgacatggagcgagtgttaccgctagccgcgttgccagttacacgcgacgcggacaagtccacacgcgagagagcagagggacnaacacaacacccaca

SEQ ID NO: 12984 - DNA, 1804 bp, Homo sapiens
  misc_feature (1)...(1804): n = A,T,C or G
agactacgataatggcctgtgtcatatgtcgtgcatcaatgaattatgtatttagagtgactgaatctataatataacaggaattagatcctctaacacgatcacttactaaacatacctctagatagcaacgtaatgagcagtaaggtggtgacactatcancaagaagcgcataacgtacgacggnacagatgccggatgtagtagatcgggtgaggatngatgtagcaggngaggatagatgtagtnaagntagtatgcaaagagtcgacatagtacggcntggancagaggagcgtcatnatacagacatatgacgagcnggcttgtnatagtatctatcatctagcactgcgtncgactcgtcatagatcttccacgatcgactntgatgtctgtgtatactgcatnttgcagtagcctgcagcgctcngacatacggtcnacatgcggacagagtcgtactcgcacgacgatagtcgantgagtatgcgcatttacgcgtgtataagagacgtcgacactcaagtgtacgtgtagtgagagagtagatgtcgtatgcatgcatacggcgntatactaccatctagctcttctgcgcgtcgtttcgagctganatatactgcatagttgtactcattctacgcactggngactagagcagtgggctgctaaagtgtctctgcgtgtgcagccgcgtaccacgtgcacggcatactgaactatagtctcgagtctagtctcgctggtatgatgttatattgtgtctggctcgtcgcgtcgtatctgagtctatgttaatagtatatattattggtaggaggttacagcatagccagcacaggagtatcttagtaatactgagtggcggcgtagtgtgtccctctcgatacgtctaaccatctcgctggcatgcatcgtacttctgaaccaactactgtcaccagtgcaatatatgtctgctgtctatagtagaggcgtcagtggtctcttangtcgtgtgcgagcgtgagtngcgtagagacttttcnctactctactacttgtcgtntnatntctgatgagctctgaaaataanattgtgtctcatcaggntctctcnctctctcagnagcttgtntctgtgtgtcgtgtcgagcggacgtgtgcgtcgcgatgtgcgtgtgtgttgatgctagctctgtntagcggccacgacgantgcgctcacgcgcgcgcagtcccattcgcagtcgagagacgngacggtcagagagtagtacgcgggtcgctcgagtatgcacgtgcancacagagtgagcagntntatcagntncgacgatcacgaatncncacgatctactgttctcacatcatatacttagnaatatgncacatnactacacaacaaccatacttaggcctgcagtacantgcgtagccgnacgtctgctactancatctcgttcttcgnacgtgatcgtgtggatagtgcgtatctgtcgcactnatgtcgtcagtctncntcnantggtnacgcacgctcatatgngntatagnagtaggtgtgtgtacancatgtcgtgcagtgagtgagtgaatgctcagtntcttngtttatgctgcgctcttgctcgttctgtcatcgtctcagctcantgtagcatgcagcactactgcgatcgtantctatatatctgtcatangtatctgtctgtgtagtgagcagtcgcatgtgatatcctaaagcagagcacacgtcgaagcggctcngacgtgtgagttgagtagtatcatgcatacatgtatagntctgtataagtt

SEQ ID NO: 12985 - DNA, 2028 bp, Homo sapiens
  misc_feature (1)...(2028): n = A,T,C or G
gtggtgatgtgttagagtcacgggagtngcgtngagtgtgtccgcgaccgatatagtgtgtatatacgatctagtacagcacgcagccgcgactctattgcttgacgatacgcgagtgattatagtattaagtattagcgatatatatcgctgtgtgatatagtacgagngcatcaatacttacatgtcacgttncttcncgtctgctcgagcgtcgaggctcagacngcagtcgtagtgcacgtcncncncactccatagatagtactagtntagcagtgtgatgagtcagagagatgcgagagtgtgtcgacgacggctactatgtnatatcncgtagcgcgttagacttactggcgacgtacgnagagcaagagtgggngtgancagngaggtggagaaagtgatgtgcgtagtgtattgcttaatgtaatctgacantagntagatgtctagtacnacnacgtgagtgatctaggcngcgtacgtcantagtatatagagcatgtctgctgattctcatttgtgctgtcntgcatgtgtatcggtcgctactgtcgttgtgttcgtagtgatatgnttcactaatagagtagtgagagaagtgcncgcactgcgcaggtcgcttcgtacgtgtcgantcgtcgtacgtantcncgaaaggtgaagtagtatgactncgctggtcgctcggtgacgtnatctacttcatactgtcgtctcgataacngntgtcanccgtagntgcgtagantagatgagtactcatntcgagtggctcgtatattantctntgactgtgtgtctnacatgagtagagtcnagaagtaggagtcactntcgactagagttacgacatgtcgcgctcgatagactactgtcacatcatgtgtctactcagtgatgacgatacttcgtcncntctcacccagtcgttcaatcgcggcttgcttaacatctattatgtttgttgtgctcgtgctcctctcctttatatctatcgtctcataactcatctactgaatgtatctgctcctcttctaatctctacgttcgtgggtcacgtcggtgctcacgttcntcattgactcatatantagtcgtgtgtgccntgacgagactgaagatcggtggcagtagtcttgccntanctatgcgtatacgagggncatgaagtgtgcagacgcagactgagagtgacngnacgatagtgacacatcactcgagacggtagtacgtcgtngagagatgantatgtgcgcgtgctngtcagactattcactgtctgtcgtcactctcaacatcaaaacagcccatctgcgacgtgnctgtcgccactactcgnncatcnactcacacttcatatgagatgnacctnngtcgcgtcgnntcgcgctcttcgctgcgtgaatgtgacgtgagtgatgcggtgcgcgagagacntanagacnnanagatgaagtagcgacgatacgctgtcgtgatagagngcgtccgacacgaatgtcgcgagccaccgantcatcctctctggtatgcacacgtcgtgtcggcgactaccgtacgactacatcaccacgtcacacacatgcaccacgttnacgctagcntncgtgtgaactttcgtgtactgcncagttagtatgagcttagtcgctgatgcatgagcgcngctcagccngtgtntcgtcgtagccatcgctgactgcgnncgntacgcgtcgtntgtcgtcgntgngcgntcgatacgctncggcggntcgtggacgacngnggacgagtantgagcgtcgcntanactgcgatgacgtnncaagcagataatgatctcantcattgcacgacnaatagtatatatactgacacnggcaagtgagcgcgtatgtcntgagatgngtgagtnagntncgatgagttgcccgcntantctgagcgtnattatcggggagatggtancantctatcaactgtgacatactctgcacgatcanttcacgaaacgctaggctgtgtacgtatgagtatagg

SEQ ID NO: 12986 - DNA, 792 bp, Homo sapiens
  misc_feature (1)...(792): n = A,T,C or G
tagtcagatgatcctgatggctctcaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgtaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctntaaaccgtgaacaaggaattgttggagattttgacttcaccaaatctgtgagtcagcgagcctcggtgaacatgatggttggtgacttgagtttgatgtcacctgagttgaaaatgggaaaacctgcttctncagggtcagacttatatgcttatgggctgcctcttt

SEQ ID NO: 12987 - DNA, 1119 bp, Homo sapiens
  misc_feature (1)...(1119): n = A,T,C or G
gagacaacagggaacacacgcccacaacaaaacaacaccacaacacacaacacaaacaccaagtctaagcggggcaccaaccacaaaaaccttaacaaggagaaaaaccaccacggccaggagcgcgcacccccccacaagacacttctcaagggcgacgcagaacccccacgccacacccagagaacccaccacagccgccacggacgcaagaacaccaccaccggaaggaaaccgaggccgaggacgcagccggcaagcccaccaaaggccagccaggaagccggaggaaacacggacccagccagacgcaacagcaccccagcccagccaacgcgaaaaccacaccaagacacaaaagggcgagccaaacaaccagccccgcaggacacgagacccgcacggacagcgaaccgaaggaacagccgacacgccaccccagcccacgccaccgcaccacgccccacacccaccgccacacccaaccacacacagagaacgccagcccgagacaagcacaacgaccacaccgcggccagcacggcgccccagcgaccgcagccgccgccggacgcacagccccaagaacaacggagggaccacccagccacgcgcagcagccgaaagccggacacaacgccagaggaagggggaggcgacggcaccggaccccccacccagaaacggacaaaaccggaagaggagcaccgcacagcacgccgcgcgcgcggagggacccgcaacgacacagagacgcaagaaaacacaaaacgacggcgccggcccanagagaccgccgcgccgcagaaaggacgcgcagcaccaccaggacccgcccccacgaacgcgacacgaccgcccagacgagagacacccggccgaccgggacgccgcaccgnaccacccgcgacagagcccccgcacacgcgacggccacggcaagagacgacgcgcgcacgccgaccaccacagcaccacaaccccaaggcnacgagacccggcgagagcacaacgaggagcagagggaagacgcacgcgggcagacccgcacgcccncacngagcgcaccaccacaaancngagcgaacacgacacaagcgacgaaccagaaagaggaaa

SEQ ID NO: 12988 - DNA, 1350 bp, Homo sapiens
  misc_feature (1)...(1350): n = A,T,C or G
cgagacggtcggggtgcggggccgtgctggtcgtcttctgctcggtttcgctgtctgcgcgtctctctgtcgcgctcgtttgagcctgcgtccttctctgtgtctggtgctgagccgntcctcgtctcgcggctagcgttgtgtcccgtcttgtgtcgtncgccctcgtctagtgttggcgagtggcggctgcccgcngtcgccgtgccttgtcagtcgtgggagtttgtcattcctgcggcgctgccgcggcgtcgccgatctcgctctgtggtgcgtgggcgacggtgtgtatgggtctcggcgtgctcttgagggtctntttgttggtgcgttctgctgcgtccttcggtggggtcggtcgtgcggttgtgctgcctgcttcgcgcgctggcgtgcgtcccgtccgtgtatgtgcgggtggggcgcgggtgccggaggggcgctctatctagttcgtgtgtgcntgcgncggttggtgccggcaggctgggtcaggctagcgtgcgcnctattgcgcggcgtcgcgctcttgtgtccgcggtgggctctgttcggtggcgcgcgggttgtgtgctccccggggttgtcgggtgcatctggcgcgtctgtgcgctgattgcgcggtggttgtgcgtggcgcgtcatcggtttgttgtctgtggtgcggggcgcgtcggtctcttcgtgctcctctctgcggccgccgtctatccctgcttggtcggttgtgccggctttgttggggtgggtggcgcgcctcgggtgcttcgtgtgtgtgctgtgggtctagcgtcccccctctcggcggggtgaggcgggcgctcgcttcggggtgttggggggcggtgtctgggtcctcggtcttggggttggtggcatcctcgtgctggtgtgcctctggtcgcggtctgctctgactgcggcggtgtcgcgcgtgcgcgcgcgggcgcgggggtgctccgttggtgggggggtggggttttgcgctggcgtgtgtcgctcttttctctcgccgggtggcgtcggttggtttcgtgtcgtgntcggggtggtgccgcgtgtacctctgccttcgctgcggtctgggtgcgggtcngccgtgctcctttggtgcttgtccttccctggctctgcgcggcctctcggcttcgtctgtcttcgttccggtcgttttcgtgctgtttctggctgtcgtgcttgtctcgcgccggtccctgtctctcgtggtcgtgtggttttccgttcccgtctaaggcctctttcttctcgtcntccccctgtgaggttgttttttcttttgctctgctctcttgtcgcgcggcgtccttggttcctgttctttctttt

SEQ ID NO: 12989 - DNA, 1345 bp, Homo sapiens
  misc_feature (1)...(1345): n = A,T,C or G
atctcgtgttgttgtttgtcgtttgtcctttcctcgggctgggtgtttttgcgccgcgcctcccccgctttctcctttcgcgttcgttgttgacggtctgtttgttgtcgtgttcttttttctttctctcttctctctgtgcggtctccccccgtctccccccttctgcgttccgagccgcccctgccggttcccgcgctgccgccctgggcggcgggggggcttgtcttgggggctttctctctctctctgctgcttcctttcacacgccggcctcacgcgggctcgtgggtccgtatctcgaccgccgcccccgctctcgtctccgctgtgtctcgttttccttgcccgcntctctcgttttgatgttcgtgtcttgctgtgcgcctttctcgcgtgcggttccggtggcgcgtcggctggtgctgtcgtcggtccggcggtcgtgttgtttccggggctgtatttgtttgtgtttgttggctgtatgattgtgtttttttcttagctcgtgtcgcctccccgttccttccccctcttcttcttctcgttttcctctntcctctcgtctccgctccgtcacttctgtcgcctccttgctgttgtcgtccgcgtgcgtgcgcgcgtcagctagtcgatgctctggtctttgcttctttcttcctgcttctgtgtctcgcatttnctctctatctatttggttggtgtcggccnctgtgcttgtgtgttttgtcctgcctcctctcacactcgcgtgtttctgtgcgatcgtgtgtctgcctctcttcctcgccctcgcgtctcttctgtctcgtctccgctctcttccgtcttcgttgtgttcgcgttcttctgcgtgcttcttcctccgctctctgtgttgtgcgctgttcctctgccgatcgatgctagcctacgatccgctcgtgcggttgtctatctctntcgtgtcgtgatctttcggcctccgccctgcgtcncctctctctgctcgatgcttgtagcgctgatggctcgcgccgctgtggcgctttgcgtctgcgtctccttctatagacgttgtctcttccgcccaccangcgccacggcagcctctgctgcgtcgcctgcgctgtgtttatctctacgcntcgagttgctnctnctaagtgtctccatatgtttgtctctgtntcgtttctgtttctgcgagaccgtactgtcggntagtcactctggctctcctgcttcccgccgccgcgtcgttgcacttctcttgatcgctcgcgtctgcgctcgtcctcgctggagtggtatttgcggcggctccgcggcgctagtgagtgcttcatgtttctcacgtcta

SEQ ID NO: 12990 - DNA, 271 bp, Homo sapiens
cttcagggcctttgcacaagctgctccctcacctgagaccctcttctcacttctccacgtggtcaatgtcactcatcctgaaatgccagcacctgggagaaccctgccctggcctggatgccattcctcttagcactgtacataatttggcttctatgtatttgtttaacatctgtctggagtacactgaatgctcttttgttcctgactgtactcttagctcctaatgcagtggcgggcacataatacatgctcaaccaaaaaaagaaaa

SEQ ID NO: 12991 - DNA, 1017 bp, Homo sapiens
  misc_feature (1)...(1017): n = A,T,C or G
agaacgacgacggacgaacgaaagagaccgaaaaaaaaacgaaagaccttgcacggcacgacaaaaaactttcagagaagcaggagcgcggggcacaccgaaaaagaaagtttgacaaccagcaaagggcagagagagagaggggaaaggagacacgcaaggaggagagacacaaagagggagacaaggcaaagaggagaaaccaaagaaagcacaccgcacaaaggccgaaaagagaacagaagcagcgaccacagcaccggaacagcggcgcaacccgccgccacccgcccgaaagaagggaccacgcaaacaacacaacaaagacgcggagcgcgaagccgcccaaagaccccaccgaaaagcgacgggccgcccgagggacaaccgccaagaccaaaagggccgcacacgccccacccaacaccgaacgcgccaccacaatagaacgccccgccggacgtgcatgacacacacagacaagcagcgactcacggggacagctgaaccacgtacacgcgaagaacagacgcgagcacaagacaaaggacgcaaaatagcgcaagcgcccagcgcctgcgtcccgccgggcgcgcactctcgatcaagaccgcantcggcgcgcagaatctccaaccacacacgacaagaagacgcgaaccccaactcaccgtcaccacgagcggccacaggagaagagcgcgagaggtgacactctcgagcgcncgacgcaaagggagggacgcacagacacaccgacgcgagcgggngcagcgcggcgcgaccaacgcagcagaaacacgcggccaggcactacgcgacgaggacgacgaccaatcgcgcacccacgcaccggaacgaggccgcgcgcgagacggacgacgccgccaacacccaccagaagcacggcacgacggcgaagaggccgcgcgccgacacgtacacgaacacaaacacacaccncacaccgcgcgtaaccgatgacggccgacgcacgccggagccaaagaacagcag

SEQ ID NO: 12992 - DNA, 307 bp, Homo sapiens
ccctaggcagcacgtcttgggagtgttgctggagtttgcatcatattccatgcgcccgtggctccaaatgcccatcattcctcagtaccgggcaaaggttgttcagcctcaggtgaagtgagacaaagaaggacgtcaagaggttttgctgggtttgatgggtttcatctgggacgggttacaatgcattttgtgtaatcatctcttttcattaagtggcaggcattgtagatacagttcagtcattcttttttatggcatgtttagttggcaaaataaaatgttagtaaaaagaaaaaaaaaaaaa

SEQ ID NO: 12993 - DNA, 202 bp, Homo sapiens
ctaggtctataagcatgaacttattcaataacggaagtaacaggtaaagaaggaaaagcacacgtggcaagaagaaccacgtctccaggaagaggcaacactactgattgaaggacagtggggacaaagtcctgctgccatgcctgtatttccaaacaaagacgaaaattaaacatttgcttttcaaccaaaaaaaaaaaaa

SEQ ID NO: 12994 - DNA, 536 bp, Homo sapiens
cctaggtggacgctctgtacacattgattaagacttattcctgggtaaggatattagtgaatctgattttggaattgtagttttataatcttatttatttgtgttttactttttaaaaactaaatatgatttttgaatgagaaattggagaaattgaagtctagtcatggcctagtctagtcatctatctattagctgtgaaactttgggtaaatagtaacctttatagacctgttattttcccccaaaattgttctagtaatacatgtttattccactacttctttttaatgtagatgaaacaagaaaaggaattccaaatgctttgaaaattataaactgcaatgtattaaatattatctgagctgtttaaaatttaaagttggtaagcctttataagtagtatgttaaagattacaagtaaaatgatatgtaaagagcagcagcagtattgaaggacatgtgtttattttgtgctaaattgaactttgcagcaggccttaataaacctaaaccagaaaagaaaaaaaaaaaaa

SEQ ID NO: 12995 - DNA, 359 bp, Homo sapiens
ctaggcgtgacgtgcaaaggcgcgtactcggctcaccgcaacctccgccttgccattagctgggattatagtcctggaaatggcttcaaaacatgactgaaatctccttgaggagcataatgtggagggtgggcccaatacaatctgtcattataagaagagggaaatttggacacaaaaagagacaccaggggcgtatgtacacagagaaaagatcacgtgaggacatttttaggtctgcaaaccaagaagagaagcctcagaagaaacaaaaccagccatccccttgatcttggacttgtagcttccagaattgtgaggaaataaatttctgttttaaagccagaaaaaaaaaaaaa

SEQ ID NO: 12996 - DNA, 375 bp, Homo sapiens
ctaggtttagacttccatcttttgcccccttaggcatttgtcagaatgaggaacaagggtgttcataatactcatgaaactcaatcacttcgcagaagcggaaagaagaatgggaagactgatcactgggagttttatcattcaatttatccatttccatatctgtgtgaatttttaatatttgcaaatatcacttttatttttaatgtatttttaaatcctcataaggaaaactcccccaactttcattcatttctaatatcattccttgggtcttttatgcctttcataaaaaatgaccaccagaatggcacataatatcctaaaagtacatatgataattttaataaaagaaatctagcaaaaaaaaaaaaa

SEQ ID NO: 12997 - DNA, 676 bp, Homo sapiens
agcctcctgtaacaattctggagatgagaaagtagctacaatgcccagggaagctgccatctccactgctccttagttccaggcagaacagaatacagttcagttggcggggaggagccaagatggccgaataggaacagctccggtctacagctcccagcgtgagcaacgcagaagacgggtgatttctgcatttccatctgaggtgatccactgtgtgatacataagacaagtgtccttcataagaaaattgacacagaactttatgatggataaaccaagggaaagaggagaacagacaccagaaactggccatgggaagagttctcaatagggctgatgctaacaagctcagtgatacttggtccctgcaccaagaccttggctgacaagaaaaacccccatgcaatggtgatgggtatctcattcaacccagcattcgctttatctttgccagatagttccagtgttggtttataaataagacccccaaactttactctttatttggtatagtgccagtaaacatactaacttagagcgtagaatattcttggtctacaattaaaaccacatttaaatttatttggtgaactgtagtcatatttcatacataatggaattgagaaattacttaataaacttttaatttgactttgggtaaaaaaaaaaaaa

SEQ ID NO: 12998 - DNA, 713 bp, Homo sapiens
ctaggagactgagataaggttctgagtggactctttgtttgatggctttctaatatggagacagttccaagagagccaggattaaattggccaacttcatgcacatgtgtgacccaacccaaattacagtccaggtggctggtggtgaaagccaactcattaacctacagtgacacctgttcatctgacacacctttcctgagctcaaaaggtctatttcttttgaaatatttatggctctgaaactaaaggtcattccattcttgtctttaacttcacatgatggttaaaacagacacttaaaataataaaatcacctttaaaggcagagaagaaacatacaaagaagtgtcctttctgtcaggacagaaagaaaataaaatgtgcatatagcatcctgaaagaaaaatcttaacccaattttaagtgggagttttattcaaatatccaaatgacagtttctatggcacatcttcaatttgttcatagtaaccaaattgaacatattgccttattctgttatgtgtatgtatgtcctcttggctgccaaactctggagagctcaaaacaagtgtgcaagcaaaactgaaagaggttaatatcacgagagaacctgccacttataaaggtcttctctgtgttgattctcagagacatgttaatggtcaatttaataaaaataatttagtaattaaaaaacaaaaaaaaaaaaa

SEQ ID NO: 12999 - DNA, 643 bp, Homo sapiens
  misc_feature (1)...(643): n = A,T,C or G
cctagatgataccataagactgcattgcatgcaatcacaaagtttaattcacagatctcggccacagaagctaagagaatagaagaaatgatttttcttcccctacatctaccacaggacatcttttgagatagactcaggaaattttgaattcatggaagccagactgaaactaatttatagcttgcaaccaaatgaagaggagatttcatattttttttccttttcactaatcatgactgactccaggttctactctccataatcaatgaccatgtaaccctttctcttcctttggaccatagaaattaacctatgcttcccatcttgctaactccctatggacaacttcatcttttatttttacccttttcctatcttagcaacttcagtacctaataaaacaatgctccattagacctttccagtagttgtaattatctaaataggtaatcttaaaattgatttagctaataaatgtagatgactaaaagtaaccttttcagttttatgaaaactgaaacttgaaaagctaaaatttttacattttgagaacgaatgtctgtattctatgatcaaattaaaactatatgcattctaaanaaaaaaaannaaaaaaacaaaaatgggctcgttggcctta

SEQ ID NO: 13000 - DNA, 872 bp, Homo sapiens
tttcttattctttttaactaaaattatttacctcacaccaaaaagcttcaggtgaaccttgctaccttattagaggcctgtcacaaagactaattaaaattgatcttaaaaccttccagaaatcttgtagcctgaataaaagtaaagaagaaactgatttcatggtagtacaacaaccaacactaactagtgaatgtggaaaagatgatttcttatttggtagctgcactggtaaagatatggccacctgtgatatcaacagtgaaagatgaaattggtaaaaataaaaaaatggcctctctggcctcatcggtggatctatgcggccgtttccctttattgaggggtaattgatgatcctagttcactttattcgctgctctcggtctttctgctgcgcccagcgggtataagctcactctatttgcaggcttacaggtatttcacagaccctcggtctggctcattaaagaccacgcgcccaaaatgcctctttctccgacaatatctccgacataggccggggtagtagcggggtctttcctatggttgtcgataccgcggcccccgagcacggccgcgcatactctagagccggtgttgtccatcgctcaactccctttattagttctgctgggcggagtccctctgtatgttatcctctgagcccactactcatcatagtcctgtctctccactgaacaaccccgctctgtattaccttatttgaacaccctttcgtttcatcatacgcacgctgtaggaggaacagtgaccctgacatgagtaagatatattctcgacttcttattcgctcggcgtgggtgtcacacactgcgtagtatcagtagtaggagtagcagttgatgtag

SEQ ID NO: 13001 - DNA, 641 bp, Homo sapiens
gatgctgggacaattcaagtatcagtgaaaatcactgaaatgtttaatacacatctcaacccactgcttacaattatacttaaaaacaaacatgttaaaaagcaaaacaaaaatataacaatggcacctttggaggacataaaaattactccttttattaaccagtaaagagtgaaaaataatttttcctgtatcaactattgtcctaggcaatcaaatagaaggtgagaagaagatatcctttatatatttctactaaattattaatactttctttacttctcataaatgaaaagtgattattagttctaaaatactaccattttgtaacccctattacataggtacttagtttcaacagcttgttaaaatacagacactatgtacttcctaagaacacactatgacttttcaataggctttctttaccaagaaaagaagataaaggctcgaaactcaatctgaagaggtctctagatccaacaaccagtttgcaagaaataaattatgatattgagataatgaaactttgacatctattgggtatctattattaagaaattactgttttattttttaagtgtgacaaagtgacctgtgtgtttgaggagcattatcttgaactacatgatgaaatttta

SEQ ID NO: 13002 - DNA, 653 bp, Homo sapiens
  misc_feature (1)...(653): n = A,T,C or G
tgtgtggcacatcctttttcngtggctagaacaaacgatgacagaatggataatttataaagaatagaaatttggcccatagttctggaggctgggacactcttcttctcctacccttggacatcagaattccaggctcttcgcttgtggactctgggacttacagttgcccgcatcaccccccacaggttcttaggccttcagctccaggctgagaattacaccatctgcttctctggttctgaaacttttggacatggacagagccatgctacgagcatcctttggtctccagcttgcagatgacatgtcatgggacttcttaaccaccataatcacatgagccaactcctctaataaatcccttcttatatatctatgtctatgtctttacctatctatagctatattatctatctcctattagttctgtttctctgtagaactctggctaatacaggaaaatatagaaaaagtatacttggttatatatttatacaaaaataaacttcattagaaaagcactgacctgagatatagaaaataaaatttatctgatataaaaataacaaattgcaaatttagaggtggtacctatacctggcagaatcaatgaaaataaaccttaaacatataaattaaaaaaaaaaaaa

SEQ ID NO: 13003 - DNA, 453 bp, Homo sapiens
cttgaagggactcttgctctgtctccaggctggaccggcagtggcgtgatctccgctcattgcaagccaagctccacctcccgggttcacgccattctcctgcctctgcctcccgtgtagctgggactacaggcccctgccactgcacctggctaagtttttgtatttttagtagcgacggggtttcaccgtggtagccaggatggtctctatgtgctgacctcgtgatctgcctgcctcggcctcccaaagtgctgggattacaagcgtgagccatcgcacccggccaacagctcatttattttatcattgaatgatattcaattgcctggatgcaccacagcccggtaattgacctactgaaggaaatcttgcttgtctccaagtttttgcaattatgaataatgcttccataaaccaaaaaaaaataccaatggcctcgctcggcctcaa

SEQ ID NO: 13004 - DNA, 196 bp, Homo sapiens
cctaggagagagcgtatcatctcatgtcatcccacagagcaagaagagttattgtctgaattcgtcatacctagggctgtttattttcatttctaaatgtaccttccaatttgaatgtgagaatatctctttatttcaatgaacaattattttgtttttaatgaatagaataattttaattccaaaaaaaaaaaaa

SEQ ID NO: 13005 - DNA, 768 bp, Homo sapiens
ctcctttttctgttgctataacagaagatgacagaatggataatttataaagaatagaaatttggcccatagttcgggagggtgagaagtccaagagcatggcactggcatctgctgggacactcttcttctcctacccttggacatcagaattccaggctcttcgcttgtggactctgggacttacagttgcccgcatcaccccccacaggttcttaggccttcaggggcaggctgagaattacaccatcagcttctctggttctgaaacttttggacatggacagagccatgctacgagcatcctttggtctccagcttgcagatgacatgtcatgggacttcttaaccaccataatcacatgagccaactcctctaataaatcccttcttatatatctatgtctatggctttacctatctataggtatattatctatctcctattagttctggctctctgtagaactctggctaatacaggaaaacatagaaaaaggatacttgcttatgtatttatccaaaaataaacttcattagaagagcactgacctgagatctagaaagtagcatggatctgatagaaaaataacaaagtcgcatattgagaggggggccctatgcctgggggaatcactgaaaataggcctctagcgtaggcacgacaagaagcgcaacccaggcctcctctgggctaagcgggggggactctgagccgcttccctatacggaggggtaatgaccatcccccgtaactcggtcaccggc

SEQ ID NO: 13006 - DNA, 151 bp, Homo sapiens
cctaggtatgtcgggtttctttctttccacagttgaagctcaccggaagcagcaatgactatacaatgaagccagtaaaatataaataaaaatggaaaactaggattgaggaaaataaatatgccaacattatggcccaaaaaaaaaaaaa

SEQ ID NO: 13007 - DNA, 367 bp, Homo sapiens
cctaagaaactcgccctgtgctggggccccctaacctgctcagatcctagatataggctctgttgggtgagactgatcaccctggcaaactacccttgcatgagtcccatgactatgatctaggaacaggcaaatctctgatgaagatacctgctatctgtatgccttgatgaatcaacttgcacaatgatcctgtgttagtactcaaatacattatcataatgctgaactgatatgcctatgcactttgtggacttgtggaaggaactgagcggccattcccctatattgagggctagttcgtgccccatcatcactgactccctgtttttgatcatcacagttgtagtgagccattttaattctg

SEQ ID NO: 13008 - DNA, 1594 bp, Homo sapiens
  misc_feature (1)...(1594): n = A,T,C or G
tcgggcgattangacagactgtgttctgtnatagtatatatatatattngaatttnntannttantnnnnannnnnnnnnnnatttnnttgggattatnggggaagagatggttagagtgtngnnnnaggatgnngnnannnnnatnnnagaanttattnnnnnnnnnnnnnnnnnnnnannnnnnnnnnnnnnnnnnnnnnnnnnnnnnaggnnnnnnagnannnnaggnnnaaggggngganggnnnnannagggngngnnagggggaggntgnaggaagagtagtagacgagtaagaggatagtatatgatagtgcatacaactaaacaananncnctngttatcttcccngcgttggctctgtgcgtgtgacgctgcaaatatcatcacataaacaccgccctcgacacgntcacagcgcgtgcattatacctcctctctcaccgagcgcgcgtaatatccccgcatcacggcgcgacgcaccaccacaagacgtccacgacccaccgcgcaccgccagcaccgcccncanangcagcgnccaccgctctcntccatccactacagccacacgcacctgacggcatcagaaaccacagcgcccacagtgtcnccgctgtgctctctccctctcttcagataataccgcacagcgcgcgcaggcgtcatcacatagtatatcggtccgacgcgcactctacgacacatgtgtctcctcgtcgcgagatcgcgtgccacngtaagggactctccgcgacctcacactcacgtcgaacccaccacacggtgagcggcgtgtgctgcttccgtccctctgtttctagtcgtgatcattgctgcgcgcggagtgcgtcggcaaacggtgaacgncgagtatacagagcagtgagcgtgatcgcagcgtcgtatgaggtgagcgtagacgtgtgtgcttgcgacgccgagtggantanatgctgcgatgctctcgacgtccgtacactcactcgcctcgcgtgctgtggtgactaccacagatcacgatcgctccacagcacagcagtatcactccgaccgcnccaacacgcgcnctcaactancgcgacgctcagatgtgtccacacgtcatcaagccgtggccgacagattgatagttgcctccagagaatgtnacgcggcgccntcagtatggcagttagttatctctgcgtcgcngagatggcgcgtgatacctgcatgtcatattacagtcctgcgcaccggcgcgatctnctagtgtgcacactgtacgatgcgcggtcgatatgactataataagtggtgnaggtagacntntctaagggagagngcgcagagtataggatgcgagtantccttacgagagctgtgagtagagaggtagtagtactntaggtagatctcgcgtgtgcgcggantgttcggcggcgagagagatcnctcaggcatagaaccgcataacagaacgcctcnanctgacagagtagacngcagtcgagcctactgagcagacgactacgtgttgtgccgcacgtctctcgtgttcggtgnaagtagacgcgctntcgactacgtaacactcagcataacatag

SEQ ID NO: 13009 - DNA, 530 bp, Homo sapiens
  misc_feature (1)...(530): n = A,T,C or G
tcttttctaacctatccaacttttcttcctcatnaaaancatacgaatggccgacaacactctnctttnttcccctacccaaggaaatccctcttgagatttaaattatcctgctggcctngtaacctaacttttcactgggggcaacccccttaagaatncnataccctctggaatctaaagattatgggatatatcatttcagattggccaataaaaaaaaaatactaaaatttctcagaatctttctcccaaagaatatttactcattcaaactcttaaatatacttcatttctgctgtttcctcgataccaaatttggacacaaattaagggctaaaaaatttaatggtctctctcaaaactaaaatgccccttatgaacctaattacaaagtaacaatgcctcgcttcgaccttcgattatacacccatattccacaatactctttaatccgatcaccccttctctcacccctccttcacattgcttaacaccccactcaccgccaaatattaaaaaaaaaaaaa

SEQ ID NO: 13010 - DNA, 1758 bp, Homo sapiens
  misc_feature (1)...(1758): n = A,T,C or G
gcgtgttgagctangnatctgacaanatatnatctataattatgtgtttttactnnacntttttcttttnnctnctagggnnnnntnnnngaggggtgngtnngnnatgagaaatnanaanagaagtatttangnngatgngatnagataagnanngnnnnnnnatantnagattattatnnnnnnnnnnnnnnnnnnntgnnnnnnnnnnnnnnnnnnnagtnnnnnnnnnnnnannnnnttannannnnnnnnaanacgnnnntggnnnaggaggnnnnnnangannnngnnnnnnggagtngnnnagagagtgagttgattnnnntaannaatnatnanataatagatgatggagtcgcggaggagtcgtggnntcgcgtggaatcaacaaacacgcgcacccgcgccgattcacggngagcgcgggagatgtctcgagtaacgagcaaagcagacgactcantagcttatgtctngtccgcccaagcaaagtacagcgagagaagatagcaagaggggaggtgcgcgtncantcctacattcttcctgttattcggtagaggtgagtatacggngccgcgctcggccgcggcggctcncactcacacacatntaccccatgacaacacgacgctcntncnagcactcccatggcgcggcagtgagcgtggagagacgcccacgcccgtccgacgcgaagcgcgcccacgantntctcacacgcgcttggtcgcccctcggcgcgctctcancgcttcatcgacacccgtctcgcgataatagctcgcttgccttaattngtatatagccggacgcgcacagggaggcgtgcggcctcgtggatcgtgtagatcgtcgtgtggcgcaacccatctacgtacagaagtcgcaggcacctagtcgtacgctccacgcgcnacacgtgcgacaatagtgggcggngncggataggggtggatatgcgtgcgaggggtnacgtgagacggcgtcgcgcggagcgtggaaccggtgtctgcgatggtccggagagagtcttaatgagtgccacgcctcagcgtcgccgctgatggcgcgtgcgcgcgcatgtgagcgatgtagatnctaactnacgcgagcggtcgtgcnctacgcgcgtgagcgaagctgttatgagangtcancgcgccgacgagtggtgatcgcggagcgcactcgtcgctgtatgtagtanacgatgtcnacgtcaagagagcacacnctgagacacgcactacgagatcatacatggtgatatgatgctgatcgcagaacgtagatcgtgtggtcgnttcatcagatgtacgntgttgtatggtctcatagagctatcaccacacagcancncaccgaagcagcagaggagcctaccacacagcgcgcgtgtttactgagtagtgcgtgntcgcgtgtncgtcgaagagagtggtgtgtgtactatacacgtatgagtcggancaccagcgtcagaggcgcgtctctacgcacagtcgacagtgtcgtgtganacactaggatgatctcacngcgctcagaaantatacgcgcacggcagagtgtgnctatgtcgagcagacggtacgcacntcagtggagagcgagcgtcagtgcgtcatacgcgcaagggcgtggatgcgcggtgctgtccggtagcgcgcgcgcgcgtaatcactcatcatctgtgcgtggtgctantctctcgcgagcagtgtacatctgtgtggggtntagatgtactgt

SEQ ID NO: 13011 - DNA, 800 bp, Homo sapiens
  misc_feature (1)...(800): n = A,T,C or G
tagattttgttccttaagaaatgaacacanagacagactctgatacaagaagttttgggaggagttcttcaagggtcaacaaatgtgagtgaatgactataagaaatacaacacaattgggcacaggaagacagtgaacttccacagagtcgatcaacagcctcagccaattccacaggtatctttgtacctgagaagtctcttcagagatacaccaaatggagagaggaaacccaaaactgtggcaatcaggaatcacagattgaataaaccacataatgacaaagaaataacaaaaaacataacagcaactattttcatacaaaaaattgtcacccaaatttggcacaagtgattttggaaaactgaatatgtttttataaaactgccttcccttaagatatatttctccattaaataacatagaattattttcattgaatccatggaggaatggaggtatgacttttgcatcttcattgtcttttgctggaattgtatttaaataatgttcaagtaatatattaatttttaattagacatttagaatgcagtaaaggcgaaggcagaagagggtaataaaaatatatactgtattggtattattattatattattaccataccattacagtattggtattgttattacattatgtgaattgtattacatgatgtatagtttttatttgggccattcaggaggcccctaggggcctataacaaattggttagtgggaacgaaaactggtgttggattcagaataaaaaaaactaagtggcgcgcgttggccctagccg

SEQ ID NO: 13012 - DNA, 694 bp, Homo sapiens
cctggacatacacatctcccacataggtctgcaatgagtagtaaaactgacagaaaagaggctggtgtttgatggtccccgtctcttctctctccaccctctccctgcggtcatcgtgacaccaaccctgcaaagaagcccaagaaacaaccaaaagatggaaacatgccagaggggagatgtggtagatcgggcaaccaatacggagctcagtcatttgggcaaccctcaaagtgacaggctccgcctcaaacatcactttcaacctgcagcacaagactctgagacaggaaatgttatgtgactgtttcggagctagagagcaaggaggactcaacgtgctgttcaacctgtattgtcatggtatcaaagacgctgagaggtgggcacatatctgccaatctcccggagagaaagcacactccaagcctctggcgtcagcttgccagcttcactcgctctatcagggagcctggcccacagcggctgtgctggccacagatcccatgccattctggtggagaagcccatgtagccacctccttgcagaagtctgtgtccctgtcctcctgctcagcccaactctggatttccttcatgtcaacacagatgatttcttcccttgtagcttcaatgaggccgtgtctacttccaaatacattggtatagtggatgacttgcaaaaaaaaaaaaa

SEQ ID NO: 13013 - DNA, 109 bp, Homo sapiens
  misc_feature (1)...(109): n = A,T,C or G
ctaggggtctaaacatttggaaggtgggttcctgatcccattcctcctccaggacggactacctgcatatatatacgaagattgggcgtacaattnaaaaaaaaaaaaa

SEQ ID NO: 13014 - DNA, 300 bp, Homo sapiens
ctaggaagacttggagctgctctccctgaagtgaaagatgggacccggagcccttaaccccagaggttcctttgcatctgtcctctgactgcatagaacacagtgttttaagtcattggattggatgacttccagggtcacttttactcatacattttatgattccagggtccaagaatgacggtattatatgtaagaactctgaagactcaaagagaagaacaactagaattcttctttctttcctattgttcataaacatggtattaaaatgaccactaaagagcaaaaaaaaaaaaa

SEQ ID NO: 13015 - DNA, 423 bp, Homo sapiens
ccttaggggaacgataaggaacttctgaatgaagcttagaactcaagcagccaactgtcaacctatgacacagagaagacatgaatcaaaatctctccgggtggcattttctaaatatcctgaggaccaaggaggagagaatacattttccagcaaagaagaataaagtagatgcccaaagagaagcagattcaagggatgcagggagattcctggcagcttcctggccctgttctccatctgccggtggttcctgcttcatccctgtcctggggctccatgagacacatccctttcctgttactgcatttctcttcactgaagctaaggacttctgttccttataactccagcaattatgtctaatacagatagtaaatatgcttaaaaaagattattccatgccctgcaaaaaaaaaaaaa

SEQ ID NO: 13016 - DNA, 846 bp, Homo sapiens
atattaatcttaaatttgtttcattgttctctcctataggtccttacctatcagtagatgtagacaaagtaaatttgagtgattttcccattcaagttcaaagtaagtcataaagcagcagtgtcaactcacaacatcaacaatgcatttggctcagaaactgctaatgaacatacagtgcagtggtggtttaagaagttttgcaaaagagatgagagccttgaagatgaagagcatgatggccagccaacagaagttgacaatgaccaattgagagcaatcattaatactcttacagctaaatgaggagttgccaaggaactgaatgttcagcattctacagttgttcagcatgagaagaaaattggaaaggtgaaaaagctcaatcagtgggtgcttcatgagctgagtaaaaataaaaaatttatctttttgcagtgctgtcttctcttattctatgaatgataataaaccatttctctgctggattgccacatgagatgaatagtggattttatacaacacctggtgacaaccagcttattgggttggactgagaagaaggtcccaacccataaaaaatgctaacttgcactataaaaagaacttggcactggtcggtagtttgcttgcctgcttgaccccatcccagctccctggatcctcgcacaaccccctcctctgtgaagtttgctcaccaacctcaatgaaatgactgtaaactgttatgttcgccttaacattggataaaaacaatgggatcattcctaaccatggacctgccctgccttacccctaaccaccaccgttaacatccaacactctctcttacactctttccttcct

SEQ ID NO: 13017 - DNA, 601 bp, Homo sapiens
  misc_feature (1)...(601): n = A,T,C or G
cctagaacaaggcaatgacccacatgagtaacacagtgagaagacagctatctgcaagccaggaagagagccctcacctgcaactgaattggcaggccccttgatcttagacttcagcctctggaactactgagatttctggtattcttgacttccccatctcctctgaaaagcacccttcagctatcagcacgggagccatggaaatgagcatgtggattctaagaagccttcaatatatgctcaaaggaaactcaaacagagaaaaacagcctcaatgaacaaaaaaaaatatgaagcttttggagaagaatgctctttctctacttctgagatgcagtgcggcacaaggaattttattttgatcagtgattctcanactttggaaggtgtcattatcccttggggagctcatttgtaatttagatacctgctcctcacatccttggatgttctgattcagtaggtttggataaaacctggtctcactccctgtttccaggattctctatgcccttctcagctntactttccttcacagtacctgtcactttctaagatattagacatataaattatctaatgtgtaaaaaaaaaaaaa

SEQ ID NO: 13018 - DNA, 771 bp, Homo sapiens
  misc_feature (1)...(771): n = A,T,C or G
cgctaggcgctgccatacaaattaccatatttgtacaattctggaagccagaagtccaaagtcattgtatcagcaaggccttgctccctccaaagactctagcggagaaaacttccttgcctcttccagcttctggtggccccaggagcttggcttgtggccacattactccagttcctgtctccatcttcgcatagccatcttctgtctgtctttgtgtctgcttttcttaaaaggacacgagtcactggagtaaggacccaccctaacccaggatgtccccacctctgcaaagactgttttcaaatcagatcccattctgaagttctaggtggacaggaatttgcggcgagacatgattcaacccaggacacccatgcatgtggcaatctctgccctttgtgagatcagcgccagataactcagtagagaaaggtggtgatttgaagggcaaatgtgtccctaggaggcttcactactcccttcaagggatgtcccaaagctgtaatcctggaagactgtgcgccaggagaaccgttactcaagaagggatggaactgggattcggagactgaggaactcggctgccaagcgtnctatttttcagccccaggaagtttattcccgagctccccagtcacagctgtggcctcataggctctcagctaaggatgtgcacagattttcagggccacttgtctgacctccggacagaggctgtccccaccttgggggtgggagaggcaaggtttatttagaaacatgcctaag

SEQ ID NO: 13019 - DNA, 873 bp, Homo sapiens
  misc_feature (1)...(873): n = A,T,C or G
cattttttatgtagagtgatgatgttaagtgcgaagcaacaaaaagctaggaggnacttcgctcttgtttcccagctggaccgcagtggcgcgagcctggctcactgcaaactctgccttccggtttcaagcgattctcctgcctcagcctccggagtagctgggactacaggcacacaccacgcccagagaaaaacagatcttcaacagttttttgatggaaataaacaatttcaagttgagacaacacatcaggttcatgcattccttcagcttgaagtcaactgggcctgggttgaatttggctctgttcagctgttgctttaattttgctttttcggattcgaccaggtgcaggatctattcagaagtctagagtggttaatttatgtatcaaagcattccttgacacccactagccccgcccgtttatgtagggaatggacgcagttcaaacgattaccattttgcataacggcaatctagcatgtttctgtcctgtttcttggtttaggcaccgcgatgcacgggggacggaggatgaccaatcattacctacgttcttatgaattagatattatgtttatttttcttcgattgttaatataaatagcatcttaataaagcgccatcactcgtgtggtgtgctcttagatgtatcatggctcatagattcacaacaagccatgtaattaccccgcgcgagggctaatagaggatacagatgtctctatggggtgtgttttccttacgtttgatggcagtgcgtaatattttttcatgtacaaatacttcgaacaacccaatattaccatgtagtttgtaggggttgatatgtgtatttagtattggtgatttattcgctatttgagt

SEQ ID NO: 13020 - DNA, 790 bp, Homo sapiens
cctagataaatacaatgctacgggaattcgtcaccaccagacctgccttaaagtggtccttgcaggagtgctaaccatggaaataaagactgatcagagccatcataaaaacacacttaagtacatcgacactataaagtaactacacaatcaattctacataccaaccagctgacaacacagtgacaggatcaaatgcacacacatcaatattcactgtgaatgtaaacatgctaaacacctcatttaaaaggcacagagtggcaattggataaagaagcaagacctaactgtatgctgtcttcaagatgcccattccacatgcaatgacactcataggctcaaagtatgggttggggaaagatctatcaaccaaatggaaaacaacaacaacaaaaaagagcaggggttgctattcttatttcaaaccaaaaaggcttcaaaccaacaactatcagaaaggacaaagaggggcattacataatgataaagagttctattcaagaagaagacttaactatcctaagtatgtatgcatccaacactggaacacccagattcacaaaacaattcatagagacctatgaagaacttagaataccccacaataatagtgggaaacttcaccagcccactgataatactaggtggcatgtcaaggcagaaaattactaaaatattccgggactaaacaattgagcaaatcggccctactgacatctaccgaccattaccccaaacaaacagatatacattcttcttatctcgacatggcacatacttcatatgg

SEQ ID NO: 13021 - DNA, 1110 bp, Homo sapiens
  misc_feature (1)...(1110): n = A,T,C or G
caataatcaactattatagaantatcaatcgtcacctaagcatgcgtgcccgtcaacaatcattgnacaactnaaggccataccacaattgtcgtganaccgcgcatctgacagtgggtatacgacaccgtggaacacagtgngtcgtgagtggatgacgcgttgaggcctcttatatctccgtggtgctgcctcgccatgtcctctcgataaanacctctcgaacctcgttataggtcactcacacacccgtacccttngatcagtcctctcgangagttgaccccacacgtgcgtctacataaagatgagaactagagagcctcggcggatgaacgattgatcgcactacatatactccccgttcacaatagcacgttgcaatgctactcttggcgaggctggnggtggatacagacagaatggaacacgttacgatggcatcaacgcacatgccgaggcaaccgtatagatgcgtgacaatgcatgttactgtgtattgcaatacttggccgtgtgcatacatcagctctaccctgctacatcgacaacactcactancacactggtgttgctaaatctaggatagtgaacagggtgacagtactgggggtatatcactcctatagnacgcgcgaactactaatatccctgatgatcttgtgagcgtgctgggagtgcgtcactatcgnggcactaggagcggtctccaacatagtgctgcggactgttcgggcgtggtcctcctcactntcgcanaccacacacacgactcccattcctctttatctgagcaataatcagcctaaacccatttgttcgccatatgattcgttacnttataatatgcaatacgaagtgaggtactcattgctggtagtatcgtatctgctgcatctcctangctcactagagagtatactatctacttacctgtactctatantatgaatncctttactgacaataaccaaaaaacaagtgtttattttctctctcgaatgaaactataaatacctgtgctctacgttgngtcaaacatgtcgtgtgtgnngcttgttngccgtgaacgaggngtttcctttnnttnnnccgtcctcttttnccctc

SEQ ID NO: 13022 - DNA, 316 bp, Homo sapiens
tagaccccctggcctgcccactccgcatcgtgtgcccacaaaaacctgaagatcctagcgggcctacacacaagcggctggatgccgagaggatcagaggagaagaggagcacaccgacagacaccagcagacgctggcaggccattgatgacaggacattttggaattcggtgggggggcggttggaagagtccagccaactggaagacaggggacaggggaagacagccttcccacgccatctccctccaggcctccccatccatctcgctgagggctacttccaccacttaataaaaaactttgcacccaaaa

SEQ ID NO: 13023 - DNA, 736 bp, Homo sapiens
atggctgttaaattccacaggaaaaaaacaggagtgtttttttcagaaactggaaaccttagtttgcaaatggaaattcagtgcgcaccctgggtataatatcgccgtgtggtcttgggattgttgtttgtctacaaacttttgtaccatcaaatgcttttcaaagaagcagagccataaacaaaataccccaagtacaatcaataatgacgccaattaaacaaagataatatcgagaaatcagtggtcttctttggccacttaagaatctttgtattaggcgggagcggtgtcttggtaacttttttgttttcaagcatatgattcgttctataaactcatgtcaagaattttctagctatcaccagtcttcaattcttcacccccatgttatcaattaaagaatcagctggatgcctgtgtttaagaatcaagcccctgaaacctgttatttgtacgttactcacaccctctagtcctattagcaagagatgctgggagaacttcttggtcatcaatttgatgagttccaaggggaatgtgggaataggttgtgatgttcatacacatagaaatctggctgaacacacgtacctaagagtcctccatctttccttgcttgctctacagaaaataaagacagagggtgtgtataatatcatgtatatattatacaaagacctcttgaaaaggtaataaattaaagtgattcggggcacaaaaaaaaaaaaaaaaa

SEQ ID NO: 13024 - DNA, 314 bp, Homo sapiens
cctagagttcactatcatgaaatgatgatgaattttgacaaacgcttcttctgcacctgttgaattatcatacaattttttctccttaaatgaatatgtaaataacattgtttgattttaatgttaaaccaaaaatgtattattctttttctgtattgctgtatttgatatgtttataattcgttgagaattgtgtatatgtttataagaaatattaatttgtaatttttcttttgtcgtaatgtctttagttcttttggtatcagagttatacaaactataaaattaggtgaaaaacattaaaaaaaaaaaaa

SEQ ID NO: 13025 - DNA, 862 bp, Homo sapiens
atactcaaccatatatatcgtcgcgccatagcaccgcaacaagaaacagaaaacttagcatttactaaggaaaacttctcctgataaccttatgtagctgatggaattccacccccatttccacggatgatcactaggtggattaagacagtcaataaattctactcacctggccttgaatggggattgattcaaaggctacctgccacttaacttggccacccggagtaaaactttggattctcgcctggaatgcggcaaacgaaatgatataacctttttgactacacagatgtgaaacccggaactgcatgaaacatcttgcacccctcaaccacgtccgcctctcggatgaatccgacaccatagaccgtcacacaaaaaaacacaacgaacctccactcatagataacgccatcaacgtactatcatcacactaattttcggactagcacatatatgacccacataaatctactttaattacaaccaaatacaacttcgaacctctctgaacaagtttatttacacctcacacacacccttctgatcataatatactcgcccagacgcacatgtcactgcatacccgcgacagaacgaacccccaatccgacgcctttgtgtaatctatagaagtgattacccacttcttagcttaatcaataaattcagtacactataagccaccccactaactccttaaatcacgcaaacgctgacgaaaaaccaaaataaagagcacaacctaaagacacaaaatttcgcaccacgatgcacaaaaaatagaaacatcacgttaccaacattactaaatgcaaacgatagtatatatacccgaccgaaccgtccagcaaaaacc

SEQ ID NO: 13026 - DNA, 813 bp, Homo sapiens
  misc_feature (1)...(813): n = A,T,C or G
acttccctacattaataccactccccctcacacccaaaaaaaaaanaagcttactctaactctaacaaaaattgactccccatctctaacatccctatcnacacacccacatcataattattccctctgcacccgccttcaaataaaatactccctatcaccaccataaaatcactctcaaccaatccccattacactccatctcaatccaacatctatatcacctcctattaaccttctcccaaaacattcctacattcttttttttcatcccttacccaccctcacaaacatttctaataaaatattatactctaaactaccttaattccccttctcacctaaaaaacctctctttcacccttccattccccacttcttcattaatatatactctttaaataaattaccttaccccatttcccacttcccaccacctcctacccctcttccctcaaaaccacacaaaatcttatcccccccctataactctccaacccccacccccacctccaaaccaataaccccacctccccccccactatcctataaaatactcatctaccaccccattcactccacaaccctactttaaacaaaacccacccacaacaacccactaaaatatcatcacaatatcccctcccacctacaacataacacctaatacaccaacttccatctacccactattacatctcccaacccaaatactacatccaccttctcctaatcccctctcctccccctcaccattaatccaattatactcacctcctccctaaacacacatttaaaccaatcacatcaccg

SEQ ID NO: 13027 - DNA, 1091 bp, Homo sapiens
  misc_feature (1)...(1091): n = A,T,C or G
aagaganaaagtgaagagnnnaaggggnaaaaaagggnaaaannaagagaagaagaggagganaagnnnagaaaaaaagaaaaggnaggnaagaggaaagaagaggagaaagaaggnnagagaatatggaagagaaagtaagaaggnagataggggtggaagggaagtgggaggggaganaagagaggggcatggcgcagaagctgcacttcgttcatctgagatgttaggtggagtaagaatgccaggnncagttagatatatggaagatctcgggtcctggtttggttgatcgttgtccaattatccctcagtctcctaacgctgtccgannccatccggtgtagcatgaggagnggtaggtnnattgataagtgnataggtgtggtaatggtaagttcaaagagaagtattattnnttcactatttttgatgccagaccgnancaaatggtcgtgtgtggactgtaataaatgtgttgtgggcagtgtccgcgggtccccgaataaggatggtcncaggtgtgcgtagcgncagggggaggtgtgctgccgccctggtgaggcncttccctgcatccgcaggttcgattcgctcatagcttagagttcttctccattccttatgttgccacctccgcgtttaatattttccttccttacctctcgtcgtgctcggtgcancagccgccgccggagagctaagaggacgcgcagacagggnnacctgtagtcaatactgcgggtgatgcncnaattaggtcctgagtgtatttgcattagggaccaggtggagtanctcgtgggtttatcctagagccnccgaagttgctcctcaagtgttaccccgcgacttcccgaccattgtnctttgctgtctaggctagtagtttnaacccgatagacgcctgtgagatggacgagtagaggagcgagaggcgtccgggagagacacgcagcccctgtatgctagccgtgagncccatcgtatatatgccagttcatattaatgtgcgtattcatgcagagtggcgnccccaagaacgttcatgctgtagtgagtgnccagatggncccatggagctgactaag

SEQ ID NO: 13028 - DNA, 756 bp, Homo sapiens
cctggctcagagaagatggaagctgagctggaaacaagctgaggctgcggaacaatccagaggacactgaaaagaggataaatgttggctgagagcttcctgcttcattgacacaagaagatgcgaaacactgaggtcactttgctagaagtcagtgcaaattcctgagtccctttgctataccaatcagctctcacactattgtttccccacctgggagaggacttacctgtaaatcctttcccagtgtttgatggcagttattggccaagttagtcctctgtgcatgggcgccaggttattatcccaaatgtctctaaagatagcttatttaatatcgaagctccatgcagcattccttgcttctatataattatcttctaattttgaaatccaaatattttaaactctaaacacaccaagaggaatcctcaaccttcacggtcaaactttaaacactgtacagtggtattgccccaccatttcacctaggaaacacagctttatggaattcttgttttctttttatgagaagagaaatgcacctatctgcagaaattaaaaaacaattatcaatagtcaaagtacaatttgaaaataaattgatctaatattcttttttcttcatataaatttaattagctttttcaaaagtatgtttaccaagaataatatcagaataattttaataaaacttggttgccctgtcaaaaaaacaaaaacaagcaagtaagccctagcaaagaaaaacggcct

SEQ ID NO: 13029 - DNA, 234 bp, Homo sapiens
aggtgatgtgaagaccacggggagaatacatgtaacgggaggcagacattggagtgatgcagctactagtcaagaaacatcaaagcttgaccaccaccaaggaagctaggagggggcatggagggattctcccctgtaggtttctgaggaagcatgaccctgctgatactgttttttagtacagctagactccagaattgtgagacaataaatctctgctgttttgagacaaaa

SEQ ID NO: 13030 - DNA, 419 bp, Homo sapiens
agcgcacatattcatgcatggtctctttagcgcatgctaccgtctgagacgtgacggacaaaggcctgttcagaggggctagaaaccatgtatcaccaaagccagcatgtttcccagatttcagaatctgctggttcaactgcaaaagtatgaaggcaatgagtaatatctgctctgcgggacaagattaccattaactaccatcatgacttcagaagatgctgccacgatgaaattcatttctgctgcctaaccccataataaggctggctgttctctttaagcaaaaagactaagctattgatcttttcactgcagaatcccctttattttgttatgatcaaaaccatgtgggagcttttcatattttgccttggaaagaaaatgaatttcacagctgcaagtcaaaaaaaaaaaaa

SEQ ID NO: 13031 - DNA, 379 bp, Homo sapiens
agtgtgaagacatagcatgcttctcctccagaagaccatcttagaagcagacagaagccctcaccagacgactgaacctgctggcactttgatcttggacttagcagtctccagaactgtgagaaagaaatttcttttctttataaattacccagtgtcaggtattttgttacagcagcacaaacagataaagacacatccattttatggcctagaaagacgtgtccagcttaatcaacagcagtgacccagaggcaccggagatgcttgcacaggaaatacagatatgcacatttatatgaatgaaaaatatgcaaaggatgcactgaggtgatcataaatttttcaaactgtgaataaatcaaatatgtatgcaaaa

SEQ ID NO: 13032 - DNA, 353 bp, Homo sapiens
ctagagctgccaatcaagagaacttttttttcctgctatccttaaagctggagctcaaagattatcttctgtctataagatcctaaaccctgatggcaaggtgcggtgatgtgttggtgagactgaggtaggaggaccaatgaccacataggtccaagttgtccaataggcgtgtctgaactgaactatggttttcaggaagcactactgggagtcaatgagatttacttacatcttggaggaaactcactgtttctctgcttcatgtaggggggtaaaaatcccctgagcaagtcccagggagattgcctatgaataaaatattctcactttagtatgtaaaaaaaaaaaaa

SEQ ID NO: 13033 - DNA, 655 bp, Homo sapiens
ctagagacaagttgcaatgttccctcagctgatctcaaatacctggcctcaagttatccccccacctcagcctcccaggttgggattgcaggtacacaccagcacgtctgtctttgtgaacctattggaagaatcatatgatactccttgacttatggtggagttacatcgcagaaacccatcgtaagttgaaaatactatcctcgcagtcctgaagaggctgactgatagtctaacacctgaaaaagtgagaatagaaaacatttgccatctattatttctaagggtggccacctatgatatttcatctacataataagaactttgatcttaaagaccccttatcttaacccagaaattcctttctattgattgaagttttaaataataacttgttcaaccaattgccaataagaaaatctttgaatccactgatgatctctaagcctcctcaacccaccctgacttcgagttgtcccaccttcccagaccaaaccaatgtatacctcccatgtattgattgatgtcttaggtttccctaaaacatatacaaccaaactgccacccaaccaccttgcgcacatgttctcagagactctgcctcatgccatggtcacttatgtttagctcagaataaatctcttcaaatattaaa

SEQ ID NO: 13034 - DNA, 300 bp, Homo sapiens
tgggtgacgtctgattaccctgtcctgtcttcagaaagaatcctacccctgatgcttcctcttggtaattttccaaccaccggcctcctatgctgctccttggctgtaaatttccacttgtctatgctgcattcggaggtgagcccaatctctcatctccactgtaagagactccattgcagtggtgcctgtaactattgtgatggtgctgaaaaaaactcttactgtgctttaacaagcatcactgaatatgatttttcttcaataaaaactcacaaagaaggtaaaaatcaggagaaa

SEQ ID NO: 13035 - DNA, 447 bp, Homo sapiens
tctgatttttatttggatagtcattctcctgatataccttatgtagctggtggaattccacccccatttccacggatgatcactagttggattaagtcagtcaataaattctactcacctggccttgaatggggattgattcaagggttagctgccacttaagttgtccaaccggagtaaatctttggattcttgcctggaatgcgggaaaagaaatgctttcacctttttgactacacaaatgtgaagcctggaactgctgcagccatcttgccaccctgaagcaagtcagcctttggatgaagctgacaccatagaagggcaaacagaagaacagaaagaagctaagttcatgataatgtcatcaaggtactagatcaccctagttttggacatgcagttatatgagctcataaatctcctttatggaagacaaaaaaaaaaaaa

SEQ ID NO: 13036 - DNA, 307 bp, Homo sapiens
ttctcatcttttttattaattttatagaaacagtttattttgtacgtgtgttgggtagttttagggactaattacttatttttatgctatgccttcaagggattcagatatcctcatttgatacatgatggtgatgaactgtatctaaagatttacccaagtgatttctaaaatcaagaacatcaagtgaacagctgtttgaaacgaatgccccatcctggagaggttgcatggcaccgtggaattgaaccctccttcaagagcctttagaacaataaagcatgatggtctaatgcaaaccagaaaa

SEQ ID NO: 13037 - DNA, 847 bp, Homo sapiens
  misc_feature (1)...(847): n = A,T,C or G
tccacaaaaagaagaaggtatacgccctcaaagaacaaanaaaaaaacttgnggggnacgnnccgaaagagttaggaggggaaagcanaaagccagagccngaaaggaaagaagcagacttccagaagcggaaaaaagccancactcaangggaggcaaagcacaaggaagcaaaggcaagaaacgcacaannatngaaaacgccacaggaaggcgaaacgaaagacaaggcagaaagacccccgcaagccgaggaaccacaaagaaccaagaacgatctttctattcaggcgacttcacttcatgctgcattagaacaagattatctcaagtgaaagtattacaagcagagttagccaaataccacggtggcagaaaagggaaaagaaactctgaatccgaccagcgcacgcgattacattagcctttgaagtcaacacaaagtctaaaactcccagcattttccaaagttgcatatatctaatgctgcgcaactgctaaactatgcccaccttggtgaagcgaactaaaagcccctccctccctaatgggccatcactcctacccctctctggctcacagcgccacaccacaaatcgagactcccagccgaacccccccgcccgccttactatcccgactccctcccactgcaactcaccaccggcccacaaccataaacccacccacgcaaaaaaaaaaagtcagccccaaaccagaccacaggagcgggactctacggctgattacactaaccgaggttagatacatgctcttcgcccacccacctcactgagccacgcaaccacagatgcccgccccccgctacaagtcataaatcagccgg

SEQ ID NO: 13038 - DNA, 864 bp, Homo sapiens
  misc_feature (1)...(864): n = A,T,C or G
agaggaaattaaagnnaatggaagtaatgnagnaagattggttattagannannaantttcagaagtggttctgaaagaggaagaattgaaagactaaagttagagcttgaaaggaaagatgctgaaattcagaagctgaaaaatgtaatcactcaatgggaggcatagtataaggaagtaaaggcaagaaatgcacaattattgaaaatgcttgaggaaggtgtaatgaaagatatgtgttaaatacttttgcaagttgatgaattacattccatcatgaatgagctcactatctnctgttactgcacgttcatgatgaattagaacaagatagatttaaattttaagtattacttgtagaattagtcaaataccagcccattttagagatggtcaagttcntatgttaattgcctttgcaaaatcaataaagtagtctatttaaaatcctcacgatttatttgtatattatttctttttttctttccttcctccctcctactttctttatcttttattcnttcactttttatgtgcttgttcccctcccccgttatgaatgcttctattatagtnaattttgtgttatttatattggcagtgatttagttttagtttattatgtancaattcttccttatattatctacatcccattattgtctatagatacacatatccacttatatttaccatttaatttaataaactaaatgttagtttatatataaagtgttatttataggaactatcagttcgtgttcttctctctgttacgtccatatatagtacccgtaaatcgatttttgacacgcttttctcctaatttccattattttgtgcaatgtgcctagttgtgagtt

SEQ ID NO: 13039 - DNA, 820 bp, Homo sapiens
agcgatgaagtgttgacctaaagttctggtactctcggctaccgattctagcaccacaagagtagactgtcgattatcgcgaaggcacatttaactgaaggtgaaagcaacagatagaagaacctgaatacagacgtgacacctgaactgatctcccgcacgtacgttcctccatatctactgtcttctatggaagacaaatctactttggactatgccatgtggatacaatggatcctatacacaccatccgaattgacactcactagcacatgataccatggttacatgaagcacacttacttatcttcccttaccctagaaagaaaggagtaaaaccatctgttactcggctgcaagaaaccatgtctacctaaccagaaatatctacagcacaccttaaaaactctcatacaacattttttttaagaaaaccaatgaatcagccccacattgaccccagcgggtggaaaactgccgacagttacctcttcgagacgtgagactcaagcaagcatacctggctatggtatcatacattttaaccccgagtacttcccgtaccaccgctaacatattctccgaatggcatccctcacatatagctcatactgagaacgatccaaacaacccataatcacacgcccaaacaaacaagcaataaataacaaattgttaaaacatccgcctccccagtatggcccacacgcaatacccgccatgtaaaacctcccgacgaaacgacagcgatgtattattgcactaccgcagttgactacactatccgacagcgacgccgaggaaacacataccctaaaag

SEQ ID NO: 13040 - DNA, 1143 bp, Homo sapiens
  misc_feature (1)...(1143): n = A,T,C or G
agggtgaattttnaaagnnaagtgngtagatattgnnagnnnngatatgatttagagtgannaannnnnanattattgatggnngtgnatatttattagtaagtgttattttgtnnaaatatggttcactggttgttctctgtngattagtatgtttaaatggaaatagaagtttgtnnccgtcattttccgaggaaccagaggggtctatacggtcaacccttatttttttaggatttcattgattnaaaggncgtagaaaataactatccatgtaattgtncgaattactgttatgtttgttctattcttccttacttcttcttcgccaccactccgtccncaccccaggttgtcaattcatttggatgtttatnnatttattttttccntttgattgtttttttagatatctcctaatgtattttgagtaatttttttctttatatgcacgtctnntattttttctgtatatctttctttttctctatactaatgnnaagtttnctatttttgattgccccttatctctagatttcccacaccatcatatgtccctctcccctaccttaggcccaattgagttgataccctgacgtgcgtccgagcaacaacacctgtgtgtccctttccgtttccttctattatactcactagtcttcttcatcgnccatatgaatttattgagtgtccagtgatgtccntgtactggctaatcttgcttacgtgtacgatnagataattntnncattttgtatgtatatgattataattgacttnnactgctagtgcncnttgtcttcatatcaccctgtcggatnncaagtagcgggncncaggtgcggtcctaactaactctcctcatctattcgtcctctttatagtcgcatacgcgacacagttatgaaggcnccttcttgttctatatcgtagtatctcctccaaacatacggccgccgtgatcaccgatgctggtagtatctccgtccttgtctgactatagacgcacccgatctctcatatgtggnnctatgttgcttgattcacacggagatactattgtttgtcactcacttcgtttcnnaccgtttgtgattaacaacgatgttagtacttccataagtnccatttagtatttatagt

SEQ ID NO: 13041 - DNA, 253 bp, Homo sapiens
tcagattgtccttttctgcgacattactgatctgaattgcaagagacacaagtacacacgcaagtcacagccaactgaaagcaaagcaagggttaaggacactgagtaattgctcctggacaaggctaagaggactatgggtcatccaggacagcccagttctactgtgccaccttaatgaagagtaaggttgtggaatctcattggtgctcatggattaaaggagattgttaatgcttaaaaaaaaaacaaa

SEQ ID NO: 13042 - DNA, 148 bp, Homo sapiens
agctcccagaagctgggtaggagctgaaaccacccccagagagaagactttatgttcccgtggttgtttcattggtgggcctccactgacagctgttcagcagcaggagttgtcatttctaatagctattaaatacgcattacctaaa

SEQ ID NO: 13043 - DNA, 1369 bp, Homo sapiens
  misc_feature (1)...(1369): n = A,T,C or G
gagagtggggngagagaagagtgnnnannnnannnnnnnnnnnnaaatnnntttgnaataatggaaagaggnnacaagnannnannnnaccgccctnnnntttctttcttcnnngccggnaggacagaatcactaccngccattgttttaatcgatggacatagaacctgcatattctttctgtctnttcatgcatccatcagtcnattaagtctatgttgtgtctcttgagtggcttcctatgcctcgtgactacagagttggtacgagtatgtttagaacgacgcacgacgaccgctcatctctatttgtggtcgcctgtcatagtagctcgactgcncagaccgagcgagccccgtgaggcacnnccnntctcncacccnctcctcctcnctcagatgcnacctcgattggnnnnacacgtctnttctgtatataatatatatagagagnccctccacccctaanagatacgcgngnctgacacacancctactcctttgtctctatcacactaagaatttcacncactatgtgtaagagcccatcccgatgtgacggcgctgtgtccnntctaagcctccaatacngacccacncccacagtgatcagtncccattatactataactcaacatatggctcctgtggatcagcgcagccncacgtcgcccncccgtagtgatcctacatatgcagtcatcggccatatctatagcatacacgctcagttcaaaacatactaacacaacctgcactgatatcaaaanagaatataataaatgagtaggtatataaacgaatttatcacaccgaccacccactggaacaggctcgatagtagcaatcgtatatccagatacacacactctataaaaaatgcgccatccgataacaacgatacatcataagaccgtgctatgattcgtataccacccgcttcacgtgacgctacactcgcagggaaactatataccacattcatcgagactatatgtatcncntccgcgagaggnacccacatagtgacacgacacangactaagcggacgaatgtgcnccgcgtactagctagagacacgaaagtggataccaactacatgaatgagacgtcgacgtaagacagcgtgtcacgtgtgcgagatgnncacgagtcagtgcgctagcagaggaatcagataattncatgtgctgctctgaagatggacatttacttattgaacacacatccaancaatagtaacngccgaatcacacctgactcactcgtagaactcattatagtatgacattctcacanaccagatcgatggtcctcgcacatccgcgtattagcctactcacnctataggtgtaaatgtggcagcacg

SEQ ID NO: 13044 - DNA, 434 bp, Homo sapiens
atggtaaggatattaagatatcaaaggacgtaacacacgcgcatatacctagtacaccacactcgacagtattttattgctctgccccaaggacaaacaagatggctgctgcgttctctctgtgaagaatttgatggcctttgaaagaaacgatcagtagaagatccactgggatagtcgaaattctcttgtgcctggggatgtgtacagtccggcttttcctgctgcaccaggaaaagaactgtccagtggtcttatttacattctggagctttatgaaacttttactctgtactttaattttggcaaccttgaactgatggggctctgttatagtatgtagcaaatcgccatctattcacgctcacatgctttccattccatacctctttcaaatcccaatcaaaaaatccgacgccttggccctcactggc

SEQ ID NO: 13045 - DNA, 1118 bp, Homo sapiens; identical to SEQ ID NO: 5981
  misc_feature (1)...(1118): n = A,T,C or G

SEQ ID NO: 13046 - DNA, 488 bp, Homo sapiens
gctgatggagtctcgcactgtcactccaggctgaagtgcaatggcacgatctcagctcactgcaacttccacttcccagattcaaatgactctcctgcctcagctcctgagtagcaggaccaggtggattacctgagtggcgacagtgtttcaccatgttagcccaggatggtctcaatctcctgacctcgtgatctgcccgcctcggcctcccaaagtgctgggattacaggcatgagccactgtgcccggcccggttgttttgttcgaacttagaaaccaattatttggcttttgactggtctggttaattttgagagttctctgaaaggtacatctctaaaaatctgaaagaagagcctggagtgagaagagcatactccatcagtatccccaaattattaccctaaaatgtgcctattcattttctataatcaatcccatataatgcatcaataaaattcagtttaatcctaaaaaaaaaaaaa

SEQ ID NO: 13047 - DNA, 1011 bp, Homo sapiens
  misc_feature (1)...(1011): n = A,T,C or G
taagaacacatagacgtagaaagtgcaccttngatatatactagcttcgcatngtanacnatgtcacattacacntnngaaaacggacaccagtagggacacatgtctcttntatatagatatctctccatatacactacgaagtgtgaatcanttcacacgtgacagacttagtgtanagcnatcaattcngngagtcantntnangaancatngtcagtgcacatctcttcatacttggngatcctctngtaangcaacangctcncnngcgaaaacatctagtcgcttgtatctatagagtaacncncatagagtatggngaatagtagatntgangcgctcatcgtatggacacctactcttttgcaagagaaacaactcaaacgcaatcatagagaaaaagacatattcttacacgcataacgtgacctatgatagacagctatagatgtagatcgatcgagaatgcagcaacaaagaaaattgtgtcgcacgagtggtagcttctctctcgtagtgctcacnctacttctgcgccttgcacccaggngtagctagtatcagtcgatgcattagatagagtcaaatgctgctgcacatctgaagccatcactcatccctatgtgtaatcagaagaccactgcgtcccaggcctgtgtacactctgtcagtggttgctggactgcctacctgacttattatcacaggattcgggagcctatgatttcatcttgcattctgagagctgtgactttgacgacgaatgtcgaggacgtcttaggtacgagcattgcgttggcggttatttaaatagaatctgggaaaacggtgaccatatataggaagttgagacagattcctctatctaccacatctgtgagatcatttcacttataagagggggatacattgacacctattaactgactcgctgagatgagattttatctgtaagagcggcatttttggctgcaggcggtgatcggctatacactgatagatggatac

SEQ ID NO: 13048 - DNA, 1498 bp, Homo sapiens
  misc_feature (1)...(1498): n = A,T,C or G
ganttttctttgacaggnagaaacgngaagaatngcgtctngngtatatataacagactgtagcatngananancgatgtcagcatgnncagcatggaacagacagacacagtnagggnacacaggttcgctggtatattgnatgtccgtgcatgagcatcacgacagtgagtaatctncnctctgcgtgccaagatctcgcncatgacatagattcaggtgtctattattgtacaatggcatgcacacgcgtcatnacataggnatcgcctcgagagttactagttccaatccaccattcgcctgctctctccatataactactctcatcaagcaatcgtgcaanctacatagtacgcgtcgcgatcgttatggnncccctagacagtagctcacagagcagacttgtngatacagtactcncncactatcatcatagattncactctcacgactcagacacaatggtactgatcgcnnaataagagcanctgggatgatgannntgataatagttaaatnttgtactcgatctacacttnanaacactntattgtgttgatctgcctgtgatctcntagctncttacttccactatgtcacgctcgtcaccccctcttccncgtacgacgctaagcaatgtcncacaatagtacgactatgatcncccagattcgacctgatatgttccatgtagacagttctcatctgtcctcgcgcntggctcctactgcgtgacagctcggctactctcgacctgctatactgttgttcnacaantcactgtcatatacattttgctcgagncgtctcgtaggtcgatgtcncncctcgcgcgatgtatacgtcctgctggtctgtgttcncnnacttccttcccnanacgtcatctgtcagtgatatatatcccgtcgctgatattcnnnacactatgatgtggtactagtgtgtctctatgatacgagtatccacatgctcttactncgcgtatgcacactgtgttnncactgtagagtagtnnnccgtatacacgactacncnanatagtgtatcattgttcgtcgctgtatcanccaccttctagtcgctattntncgactagattgttcgactcactagctctctctgcacaccgntcatctctcgncncgantgtgatntctcgctctacgatatgattcttcnccgctncnnanatctatgtgcnancgagcagtgtcgccntngtagnangtcgcgcnagtaagnagagtntancncatgtgtgangcacgctcgnaggacgantcncacccgcggtgtngaggtctgattcggcnnnantcgtatgtatattacgtattnctcgcgcgagtntatactctatgtgtcagtactctctnntgcncnctacgtgatatgncnnccgacacgttctcgctatgncanctacgtttagtacattgctctgatcnatctcatatggtnntnncatacgtgatntctatgttntgatatg

SEQ ID NO: 13049 - DNA, 256 bp, Homo sapiens
ggaccttaaccatctttcttctttaaattatcaagaggagaccactagatgaggaatacttccttgcaggtggtgatatgaacactgacaagtagtttataaactagccctaccccattgcttggagaagctttataactgattgttttaataccaaagtgacaccaaagggggtcaagtaaataaatatgcaagcctctccagttcaaaataataaaattccaatgtgtgcaaaaaaaaaagaaaaaaaaaaaaa

SEQ ID NO: 13050 - DNA, 562 bp, Homo sapiens
ttagaaatgcttttctcttatgaacacataagaaaatgataatttgaattttcttgttgtttagatatcagacatttctgaaacattctcagcatttataagagataacagacacatttgattctaagagttttgtgaataattgttcacagtcatttaattgttctatgactactaaaatcagctcaatgtttcatcataatagaggccaaaaatggataatccgaaaactattattttccctgaaacatatttttaatagttggatttgaataaatgcatctgctgttataataactcatctgaaaccgaatgatgttcaaccatgaagacatgattctggaagtcttcctatttcccatcccagcttagcagctccttataaacctgcccttgctggaaaatatctttactttctagaactagagcagttttctatttcaaacattccctggagcagtactttctcccagtggctgaggggttgggttattaaaggacttttctgtatggcaagaaaacaaaaacattagcataagatcaaagcctttatccagctagt

SEQ ID NO: 13051 - DNA, 686 bp, Homo sapiens
  misc_feature (1)...(686): n = A,T,C or G
ctaggaatttattcttcattgcctgttgaagttcctttgaatnacaaacggtttgtttgtgatctaactcaggctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtccttatatccaagaatgttcacataaccaagaaatcatatactgaggtgattcgagatgtgataaatgtgcacttggaagaactcagcaatcattggcaagaagagcgagagaaggcagaggatgatgccgaaaagaatgaagaaaggcgatcagcttctgtagattcacggcagtctggtggaagctatttggatgctgagtgttcacgacatagaagggataggagtagaagcccacataaaagaaaaagaaacaaagataaggataaaaactgtgagtcgagaagaaggaaaaagagggatggggaaagacaccatagtcataaaagaagaaagcaaaaaatataaatgaagtacttgtacctatattaatcatgcttacgccatgataaccaatatacagatatattaattgga

SEQ ID NO: 13052 - DNA, 770 bp, Homo sapiens
  misc_feature (1)...(770): n = A,T,C or G
aaccttttgtaagagaggatcatggaatgaatacgggcattgagtcaagcagtctgtgttccactggctggtgtgacctggggcaggccatttcacctcactgagccttagtttcctcacctgtaaaatgtgaaaaatgtcaccttccttaccaggcttttctgaggatttaatgacatcatgttcagtgcccagtatgggtggataatacccaggagtttcctcctcttctcctcctaagttgacttgatgccccccgctgaagatcatggctgaactggctcaattcggatccaggactcctggctttgtctcttccctagttgcccaccacacccatggacacccttaggtagtttatccttttgggacaactggatttattagaaaagggtattctggggtggaataaggcccttttcagtcctcatggagcctttttggaagatgaagttctcaaacccacaagagaattcataagacgagcacaccacccacagttaggtttccctctcaagtgctttatctccacgtggggcaaatagctctttgtctgcatatgttattggagcttttggagtccagccttcagaagagctctaatttttggattcatatcagtntattagagaagcctagttctaaggattagcaaatgggtaggtgctcagccagcccagaacaagcagagccatgacagaaggttctggaatctcacagagtcggtgtcttcatggactcagggggcctaaatccaatagcctggaatt

SEQ ID NO: 13053 - DNA, 518 bp, Homo sapiens
cagacaaaggaactgaggcaccaagaggttatggaatttaaccaaggtcacacaatcagagtggaggagctgggatttgaactcaagcaggctagttccagagtccatgctcttatcactacgcttcctctgaagtcatacttacaggaaaagagcaactggcaatccgatttgtgtgagagaatggaatatgtcgactctacctcagaagacagccaagactctctgtagactgtccatggcttctgctgctgggatgcactaccttcaatctttcctcccactggttctatggctgctgaactaggaactctttgagaacagtgacatatcctatacctctcgtacatacctccaccactgcatgtatcaccctgacctgtaagttatcccctctgtcattcttgaagtcaggtacttgttcttatctgtctgtgtaaccaaagcatttatgacagcatctggcacgatgcatagttggtcaataaatacgtgttgaatattcaaaaaaaaaaaaa

SEQ ID NO: 13054 - DNA, 775 bp, Homo sapiens
  misc_feature (1)...(775): n = A,T,C or G
cagactttgagtaaaagccacaaaggccactccatgctctttctgtttttggtatttggggcagaccaggatggcatcctacaagataatggagtctcaatatggaaggaggttggatccctgaattgctgcatggaagagagctgcctaccaccctgaacatctactttggattactacagtagtgtgcaacgacatactacatgctgaaccctggaaggtggactgagttgctcacccagtgacagatagtgctaggcaaccttaggccttccccttcggggacagagtcttctcctgtaaacgttatgacatgaggaaagaaagaagaatccatgcttctacaagatgtagataagaagagagagaaggagggaggaaggaactgggctgaccacactcatcccatgcaatagaagcactgaagtattgccatgggacagaagacttgatttttgactgggaacatgagggtcagtaaaagcaactgtgaaaactatcagatagggagaggcaagcaccaagaaatagaanataatatatagctaaaaataaaacccgcaacttgagattatcctgttgaccaaaagtataaagcacataaagaaagccaaagctaatgaagatagccaacaaaaagaaaaatcagggcatgtgttctgtccacataaaattgatggtcttaaagcagttttccaagatattaaagcaaatgcattttaaatttctcaaagagaacaccaaagaaataaattctattaaataaagaaaaaat

SEQ ID NO: 13055 - DNA, 803 bp, Homo sapiens
cagatccgttcctccatgtgagtggtcctgtcttgcccaccccacgaatgggcacctgacgaacctggacaattattaacacatccttcccccgcagtgaagctgtgggttggggggcacgtgacccccttcagcaatgctcctgtctctggaattactctctgtctggtgatgttgcaggattatctctgtctcctccctagaaggattctgcctaagaatgaagtcgatgaagggaagtaagaactgagagatggaaggagagatctgtttttgctcccctagagtcccaggttctagctatgtgagaagccagcaccaccccctgacacattctcattatgggagccaataagtcctcttttcagctaaagttaccttaagttagatttttgtctctgacctccagaaagccctgtctaatgcataccatcccccaacacagagtggagaccatgaataagggtgcgcaccaatgacaatgggcgataatcaaccctgttatgtacccaaatcacctgtaggcctcttaaaaggacagtctaggtcccatccccagagattctgattctgtacaactggagagcatctggccctccttccattttagtccatagaggatggggaaccaggcaccccacaggaaacccaaagcatcccagttactgtagcgagaaagatgctcggtgctattatggctacaaacaagacaagctccctcccatcctcagagaaagagctcaatttcgtcacctgtgtgcaactgggaagtacagggctgtgtttgatatacctcccacctt

SEQ ID NO: 13056 - DNA, 1334 bp, Homo sapiens
  misc_feature (1)...(1334): n = A,T,C or G
cgagaataatagaattaggtggatggggtatgagagatatttataaataaatctaataattatgtgtattctatgtatagtcatattataaataataatacatagatacacttcacgaaacatactatacaatctcatgatcccttctgattgttcctccacatgctacaatgctctaccatatccatcgcaccttatctcaacctctatagatagcaacctacatacatgaacacatcttcatacgcacgtatcctccagatccatgcgcgtattactcacacgtccgtctgcatgctgctggcgttacctgcagcctcgcgctacacgccacgcgtctatgttaggacacacacgaaatgaatccacgccgcatcgctcggtttggccactcttcgccacccaatgctcagaccgacgctctgacaacagaattatatcaatgtcatgagactgccattctgcaacaccactgatggtgatatggcgcgaatgtgggagttgctcgaaacgatgcgcaatatgataaggagtacacatagcgctgcgaccgatatggatgttcgagccgagnggaggctgaagcgtgtagcgcgtcgaggnatcgtctgacaagtgtagccgcaatcgcggcncacgacattgaatgatgtattaagtgtgcgacgttatgcgcaatcacaaatattattagcttgtcctcctcacccattacnatncgagcgaganatccgcacttatatgtcatacatgctaagatggcgccacccatgcacgaggatagagcccgaccacaggacacgagcacttacccaggatcagcgtctggatcatacgagcacgagcagtcgtagcagcangacatccgagcgacgtagagcccgtcgtgtacaactacgactagcacgtctcatcaatngcgcaggcgcatntcactattacaatatgcacgcgcgcgcgtggatgtgtgatgcccgacgaacaagagcaactcgcagcactntgtatcgcatcgtcgantncgaacgaacacatggatactgatacgacgacgggatgacgtggatgacaataggcgccgcgtgtctgcagcgagtgcatagcgagggggccatggagatcatccagtgtcagaacgcgcatctctgtgttacgttcagcactgcatgcgcgcgttatataggaggacataaccttatgtggccgtcgaggccagctatgccatatgttttcatgacaatatgtcgtgtagatgcatcggcgccctcgatcacagttctacgtcatatagcgcggtcggtccagtggcacacanatgtccgcgaacagcagcg

SEQ ID NO: 13057 - DNA, 1899 bp, Homo sapiens
  misc_feature (1)...(1899): n = A,T,C or G
tcggcgggggagaggncagcggagcttagaggagggatgaaatggaggccggggctatgggtaagaggtgtggtgtagtttgggttgngaggttgtgttggtactggggatnttaaaagaaaagaaagtgatttttcngccacagcgggttcataagaagggcccctcccgactgagcaggcccgcccctcggtttcacgccgcgaaggcagggggcatttgaacgcccagggcgttgcgcgtccgccggtgaggtcaatataataagataaaacagtgcaatgaacgtagaaaagaaacgccaaaaggcagataggtgcggggggtatcttggccggtcgcgaatattaacatgcaccacgacggacgcgatataaaatcgaccccacccctcaaacacaaccaccaacgccatataataaaccacagtatgtaccacgccaccgatacccgactactacaatttgacacaatacaanatgtttcacgtcggcgttgtgttgagtagcgaacgtaggccgagatttcgacctggctgttgctagatagatgtaactgtattgtataggtaaacaaaagtaaatntagaggaggatgtatcaacaacgtgagttatatacgatttttatccacgaccacggtgntataatagtcgtccgcgccgtggtttatacgtgtcgtccgctgcgcgacccggtgctcatataatacgaggtcgcagtttcgtatcatgttggaaccactacatgacacgtagtatggacagtgagaaggagagaatgtatgagcgcacnaacatatagagcaaactatcgacgacgacagcccgcngtatacgtcgtccgtgtttacgctcagccgcgcctcgcgtgtatatatttcgccgcgacgcgaccgcacgtcggtatttgtcaccgcaggttagtcgcgtgcggcgaatatatgatgtatgattgagtgcgcattatctgagtcagttatacgatcgctcgccangtgcgttcagacacgcggtcgcgatgtcagcgntcgntgagntgtgtgtcggantaccacagtgagtgtgtattctctgcagttcactcagcgcgtgagtgtgcgaccgcagtcactccagngttatccaggacgcggcacaccgcgcacgtgtgatgtacgataccgacatgatactaagcagtgccgcacgattacactattctcaacacgacatacctgtcgtgtgcgttcacgcacgcgcgctccgtnctgtgatgtatttatcagtacacangcgcgccngcacgcacgtntgcgtgtattacgaccgcgatatnttttcttgatgcgcctacagctagatatattccggcgcgatctgagtagcgaccacgcgtgtatatatagattgcgcgcgcanagtatactgcctacccagctcgtgagtattaactacagcgcacnagcgtctcgcanagattantgttgtcgccagcacnctcgcacgaccgcgcgtacaagcactagcganagattgttattagcanatcatctgttagtataagctctgaacagacggcacnagcgacnntatatctacgcggtgtcacggcgagtgccnagacgtagtttantntagtgactctcagatgtntctctcgacgagaccgcggcgctgcgtcacaatatanntacgaacgacctccgtangacggtaagagcgcacgcattacactgcttncatgtcgttatatagntgtctttacatacacgagaacatcaggtgcngcgagtgtgtagcggaagtgcggacgaagacgacaacagcaaantntatcaatgcgagcgccgcctcgtcctcgtaatacatattcgcantacgacagcacntacactctcattgagcgcactctaagtcaa

SEQ ID NO: 13058 - DNA, 519 bp, Homo sapiens
  misc_feature (1)...(519): n = A,T,C or G
atggtgagagacccaccgaccctgtggggctggcccctacactaacaacctaagaagaaaattcttctgggctggtttgaagaccaacaggatcaccaatcgtgtttctttctctgttttggtagcaaaaaactgcagagccaaacctgtggaatcacttcgattcacaactatgtatatacgtgagttgatcagcagaacgtctgattttactgcccttcagggatgcgttcctaccttcagcttttcattttgtgtagtgacctcctcaaagtcttgccgaagtttctccagctcacagagacggttctgagccaactctttgttctcctcaagctctgcattcatttcctcaaactgcagagaagcagaaaaatagagaataaataagtattcttcttaaaaaaaaaagagaaanaaaggnaaagagagaaaaagggataaaggggaagaaaaatgagaggaggatntttgagngtggaggggggagaaaaatttttaaaaataaaaaaaaaaaaa

SEQ ID NO: 13059 - DNA, 1328 bp, Homo sapiens
  misc_feature (1)...(1328): n = A,T,C or G
gagatgtatagagagaaatgtttgcacgagtgggcgattnggaacgcgaggcggcgagatgactgacccagatcgcgcgccgggagcgatcgtacaccatccgacactcgtagatcgcntcgatcnctgtctcgcgtaggcaccggagtagaggctatagagaacgatagcaataataatacgataaacagtcatgcgcagatancgcaccacactcttagagccgcacgtatatatatctaagagcgagcagacctacctatcatagcgcgntgcgagacaacatcccataagacccacngctcgcaatataatcaattcgagcggtcatgatggtattatgccggtgttctcgctcgcgcgctagtccacacgatccgcgccgacgcgcgcaccctcgtggcngtgtgatagcggtaccgacacgaatagngaagttntggggcgaantcgatgaggactgagagactaagcacgacgacataatctgacagtatcgcggnaggatgatcactacaagcgatagagctgtcatcggtcgctattagtcgaccacaagagaagtggcatggtgtccagcgtgtattgggcaccccgggcgctcatctccgcggaggtcgccgggcaagcaatgcatggttacgctcgcgtgtgactagtaacgtgtatcagtcgcatattgtgtggtgaatgttcgcgctggtggacgtagtattgcgcagcgcagccccgtatcagcncaagcgtcgcgtacgccgcttccgccgcatcgggtctggcagatgaagcatgcgtctcgtggttgcgagcgaattggtacgtaaggagtggaggcgggatatgattataattcacgacgtcggtcggacgtcgtgagagcgagctgcgcgcgcaatgtgtggccgcagcagatctattggtttatagcgcacgtcncgcttactagaggtacggccgacagaccaatttgaggctttgtcgttgntaactcgcgaacacatgtccacacgcaatctggaccatctggtgcgtaggacgcgctcacgcgccgaacccacgatccggctcagcggtggcgtctgagcacattgtggaacactcgcgtctatgggagtgcaagacgcggaagtcagtatctgaggaggacnctgagtatgggtggcagtgtgcgacgagcagtgttgcagtcggttatacgtgtggttcgacgccgccgtctctgcctcgtgtcgacatctcngttctgtgtgtgggcgcaggcgccncgactccggacatcctggtacgtgtgcgtgaggccgtgcgcgcccagtacctgcctaagctcg

SEQ ID NO: 13060 - DNA, 1255 bp, Homo sapiens
  misc_feature (1)...(1255): n = A,T,C or G
tgtaagttactctctgtgatcacacaacataatccacacacaccctccccacaactaccgatctagccttcacgacgagccaaaccacacacacgctcacaagagacaaaccacaacaccaccccgcattcttcatacactactagtaccacttcgcctatccctcgtgcacggctagccgtatatgcacggagctccgcatgtcgacctctcctgagtgacacacacctctactgcccatcgactatcgcaggtactcatcttcactgcaagcacacactaagtgtatatcttacaaaccaacgaaaataaacatatactatcttcatccctcgcaccaatcaactataattcattaccccaatgcacacaaccaccccccaccctcacgatctacctcccatattttttaccgtcacacaccacaccacgaatatacagaaacaccgatatataacccccacacgtaacatatagtccaactctacacatatagcaactatccatattaaattcaaaaaaccacccccaggtagtggcgcctccaccctgcgcacccatatccacctccctcacccctccccctctccccctacaagtaaattccccccccaccttagtgaccacacagtatctaactacaataacccaccattcagctccgcacacgaagaaattcatcccactccgggaccgacagtgcttgcaccctcccacgctgcgtcggcctcttttgacctngatccatcagcctggattcaatacttcttcacacctacccctcgcgagcaacgaaaccctctcaacccactcattcccccatccacccacccaacgcaccccgcatgtgcctcacccgcgccctctaccacatccgtagttgtgcctcgctccaatatgcctacacacccacatgtcgcaactcccncagctgcacctcgcctcggcgctgtctctatgtagagttagcacgctctcatgtcatcacatcacacacacccgtgtcccagggacatgacctcacccctaganagagagtactctaacgcaagcatccatgtaccgctacactcgtcgcttatagaggccnctcatgcgctactccaggacgagatacgcctctagccagagacgacaactcactcataagtcttnacgtaagatagcggcagactcgacactccnctcatttactcatctncaaaagacactacacccctctccatgtcgtatgacctcgcactcacgcgcacct

SEQ ID NO: 13061 - DNA, 787 bp, Homo sapiens
  misc_feature (1)...(787): n = A,T,C or G
ctgagaagggtctctgtcatgcgggctagagtgcagtggtataattatagctccgctccaactatcacatgactaaactgttccaaagcttaccaatccagggaactcttgactggcccagcagaaaggggtgaaccgatatcctccagctcctgtaagcaaaagtctgtgctaatccaggtttcccgtcatctccagcacaactctaactacggctggcttctggcaaattgtttcttcatggaaatatcaaatgagtggaaaaactccaagtagcatgaccatctgctctgccacaacaggcctgtgacaaaagtcatctatcaaggcaaaatgtcaagcacatggcatggatcttgcattttctgttctgatcaggaaaacgcaaattctttctcctccaggattaaaataataataatttttcaaattaataggcttcccaacttggtgaacatttcagtatcttagctagatgtacttttcactttttttgtatgtcaaaaatgctaccatacaatactggaagcanacaagtgctccattatcagctctacaagtgtcctgctgtataaccttgggaaaaatcccttgggttttctgtatttataaaatgaacaagataaaatacgtaaagtgtataaaatatataaaataaacataggtgctttgggctactaagttcctttttttaatttctaaattaaaaatttcacctaagttaacaaaacaaaacgcttggactgggtgtggggctcatgcctgaatcccagcactttgggaggcg

SEQ ID NO: 13062 - DNA, 726 bp, Homo sapiens
cctaggaagagagaaagattatcttctcggactgagcatgagaatcaataagcctcatcttttaaactgcactgtgttcatgattcctgacagtgagggcaaagagtggcagattgcactcctatcaataatgacagttgagagcttatagaagaagagaataaaagtcaatgaaaagtctgctctactctgaagacggagttttaaaattgtggtgtactctgatgagtccagtcactctgacattacaagaggggttcttaaaaatagaacgtacaaggtatacaaacacataaagacctaatatatttatggactagaagaatccatgtacattttatttaaaaggtatgtagggccaactgaagcaggttacatttgacaaaggaatgcatttatgtagtaattcagatagctgcaggagcaggcttgttgtcttccctatagaaatatccttatttgaattctcattaagccctgtaaaacttcacattttctaataacatgtattctagaaataaaggctattaacttttcagcggcaatggaaagactataatttatatcatagatgacgagtcttctgatgtctagaaaactgattgcattaacatttttaacttaataatttctgttagcattacaaaatgatactgcattgttgtatacttaaaaagctattctttctgacttatgaaaaataaaaatagtagtagaaagtgaaaa

SEQ ID NO: 13063 - DNA, 833 bp, Homo sapiens
  misc_feature (1)...(833): n = A,T,C or G
gacaaaacccacaccagggcacacccgacccgaagcagcgggngaaaagctcngaggaaccgccgaanacctgaacggcncaacacagaaaagagccagnncaaaaacggagggaaaatacacgcccaacacagagaacgagaaaaagaccccgcacgacccccagccaggcgacgaaggaaacgaagaaaccaaagaaggccacgggaaccccacggaggaaaacccaaagaaaggcccgccgagcgaaacgaaaaaaaaagggagagcccnctttgtttccaaggagaccctaccaccaccaacagaagacccaaagaccaatgagagcggacaagcccagagcgaccgcagaaaacaacagcccgcaaacccgaaaaatgaggacagagcagaacggacccgctaaggcccacggacgcgaagcccacaccaccaggctggccactgaacggtcgaaagccccaccgctagaacagaagacgagccgggccgaaaaccaggccccacccgagcgacccgcgcgcgaccaccaggaggcccccctaggacccaggggacacagaccacgacccccctcccatggcggacgcaacggcaccaccaccacccgcgcgccaccaccacccacaaaaggccacccagcaacgggaccaccatgaggagagcccacacaacaaaccaaagcgcccatgccaggcgcgcacccgcagacgagaacaaaggcccacgccgacacgacaacacgcagggcgcaccccccaacgcggccgccacgcaggaccccacccccggagcagaggaacccccgcgggcaacgcgcgaacgacccc

SEQ ID NO: 13064 - DNA, 1488 bp, Homo sapiens
  misc_feature (1)...(1488): n = A,T,C or G
gataggtggnaaagnggnnnnnaangtnnnnngnggnnnngnnnaagtgngtggtgnnnnnannnnnnnatgaggaagtaagtgngggaaagatnnnnnnnnnnnnnnngangnnnattttgggnnaagagnnnnnaggnnnnaagattagcganagatatgtgtagtgatatgcaagcagtgtnnnaaagtatatgatgtgtgnnncggagcagtagatgacacacgatagcgtganngtgtagagggtgatgagaagaggggnaagtgagagcangaaatggtgccgcagcgaagagtatgtactcgctcactcatgcagtgtagtnatacgtacaacancgacgcaccanacacacgatggcacataccnataatcanctagcaccngcatactgccacaacagcgncacaatcgtttgaacagagcgtatgctgcgacgantgccacagacgnnccncgagtggccacacacatgcagatgtcgcntcaacnatctgcatacgntctctctntactgcgtactgtcgtatcatcgctcgtactgnncntcgttccacactgtgtcgtgtcgtccacgtatgagcgnccccagcctgtcnncctgtgatgtgcgccgangnntagcatgagaagngatngcgtatcgtggtagtggncnnncatgtgcaagtctagtgttgtcactagagatttgtagatatgtgtggccccggagactgtnatacgttatnttgtacagagctataccgccgcagttatcgctatcgcgacatgagcgtccgtgagcancgccgcacgcncacatngtcatgtagtaagagtcangatactacgagcagtagtngccacagtggcgcgcgtgtatgnccgtgagagagcgcacagcagagcncacatcgacgccantgctgcgtgtctgtgagtccgtgcatcatcatcantctccattgnctctgtcngccgtccctaggagtgactggcatgagtgttgtatcatatgctcncatgtgactagttgcgctacgaatgnccagcgtcncncctcacgcacancaagcatggatccgtaagtacacacacgtgtgnnnncacacatgatgtctctagatactgagtgagttgnnncagtagacagattcagtcaagtatggtacgcatctatgtgancaagatagcgtgtctcatgtcacgctttcctaccgtcgccctctgcgagtatcantattacgtccgccgtgcggtccccgagccccgtactncccacagatatcagtagagagtgtcacgcnnctcgtaagtactgtagacccatgacgcagactccgaaccgcctcgagagtagatgtcatcggcccctggtatcggtgaggtgnccgtgtgagataggcgtgcggntagtggatgcgggccgtcgcctacgacacgcnccctgtgtagtgtcttcgtgatggatggccncgatgttgnccgtagatgtgacagtt

SEQ ID NO: 13065 - DNA, 891 bp, Homo sapiens
gtggatatgtattgtccttggcttccgtctcgtcgtcgcgtcccatactttatatggtatcacgttcggcggcatcgctggcatacgggcatgtgggtaaattcacggactatccttactggggggttcggttgccgtggcttcggcccagtcgtaccgccgctcctgattccgtcctttttctcgtctctcccgcctgcctgttacacataatcgctcctatgtgttgtttctacttctgtctcggggccttggcttcctcatgttctcgttaaatatatggcatggcgcgggggggcgggcgattcgtcctgtgcgcggtatgtagcctatttgccgagttgaccaccgaaataattgcagccgcggtggcaccacctccaccccgcctcgcgaatagcggcaatttggcgggggggggcgggtctgtgcggggtggtcgcggattctcggggcggcgcgtatacgttgctcctgcggcctagggttctcttgctcgcggctctataatcatgcggcgcgtacagccgggaactctaggcggttaccttttccgcccgacgtcatcggggccgccgcggcctctgactggacgcgctactttcttatttccggaggttggagtactcatctctccgtctctcgcctccggccttgacccatcggctagtcggcgaaacatcgttggtgcgcggctttccagcaaccttggcgtccctcggtcaccctactcgtctgcagcgtttccaaacgcaacaaaatgttacaccatcacattaagaattccataaaacgatgtaaaaacaaaaaaattggcctcgttggcaacaccgtggagtttccgcccaacccctccctttttcctcacattcatcgtttcgtttttgtccc

SEQ ID NO: 13066 - DNA, 749 bp, Homo sapiens
  misc_feature (1)...(749): n = A,T,C or G
ttgatgtaaagcccacatatttaaatattcnctttttaaatgagcaatgcataggggaaatgcagtgtcagtacctggcctattttaaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttttaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttacatgaactacaaatacctttcatcaacattaaagaagcttaaattgaaaaaaaaaaaaaaaaa

SEQ ID NO: 13067 - DNA, 1693 bp, Homo sapiens
  misc_feature (1)...(1693): n = A,T,C or G
atgaagtgttttaatnttatanataatgttttnataanttaatanatatatgaagagatgtgggtataatagagaagatgtgagtgagatataaattaatataaatttaantgantaatgaaaaataaaatattnattgttatatttatgtttattatantatgtagtgttgtgttatatatgatatttatttattgatgtanttgtgatgatttgtgtattgttntatttataatagtaatagatgtaatgaataagtaggtgatagataggataggtnagagatagtagtatagttgtgattaggtgtttatgacataccnttatgtgatacacaatcgtatatataacctatctcctnttcattttntatatcgcgcagcccgntgngtgtccgcgacgctgagccccacgatcgaaccacncnggtacaacgacggcctagcacttccgcacaccacaagcacgcgtnatnntgtaccgccgntgcacagcngcgtatgccatcantaccaacttgtgtccatcccacctccnctgcgccccgctcccgcnncttttatccaatngntatnatnttnnnnttacctcgccggcatcncacaaccacggcccacctccacgtctcgcgcgacgccgcntccgagcctcntccctgtgcgcgcgagccgtcgcacatccgccgcgcttaagatccactccagtntctctggtacgctcctccaccttctccgcgccccactcctcgtggtgcgcctccgttctcaccgtgctttcttcttaccacccccgccgccgctacacactctctcactcgcacacncgttcttcttcctgccccacctcgtctctcatcangtctcctctacctcgtgcacacgtgcacngcgcgtcgctgnacacgcatcacnangnactcacgtctactgcgtgagcagagcacgcgcggcgtcacagcacgctcgtagctacgatatcagccactccccntctccgtcgaacgtccgcactcttcactccgtctcctcagtcacgcgcgcgtcgctcatgcgcgactctcgcgaccggctactccctngctcgccncacccacgcgaccgctccgtctgtgcgccacgcacgcacggcacagtgatacgcgtagcgactccgnagggaggctctcagcgagcgccgcatcacggctaacgccgtcctgacctacgacgatcacngccgcgagtctgacccgctcgtcatctcacctcgcacacatcgcgcaactgcccncggcgtcagaggaaagtgaagtacncccaccttgcgcgacctctaccgcgaacgagacgctngtgcgcgcgcgtcgncgcgtgtacgctgtatgtgacatacaccacattactcgctcaggncgctgcgcgacagcgtganacacgagtgcctgtcacgatgagcggcctgtatctgcgctacccacctccgtactacacggtgattngtgattagtatcctccgtctagcatcccntgcatcgctgccctctcgctcactcgatagctcatatacgcactcgtgagatctcgcacgctccgctcactctcgctcctgtctttcgacactgtncccagacgccacgctgagcctacgcacctccttcgtcaccctcaactattcagcttgatctcatagagtctcgatcgattacgcctcgcat

SEQ ID NO: 13068 - DNA, 400 bp, Homo sapiens
  misc_feature (1)...(400): n = A,T,C or G
ccctganatgaactcagcacagaagatatgagcgtgtgtactactttccaaaaggggaagtggattcagaaaactacttattttgatgggaacactctgctggtaacggaggaacctcaagtgatcatgagcacagcttcaataaacacactgcacgtgcagcccctcccaggtgctggcaggccaccgggcacacggacagcccaccccaagggaagaatcaggagagaagtaatgcaaccccctggaagcatgccaatgtatacaaccccaagtcaaagatcaaatcgtcatgcacttgaatctctcaagtcgcccacttggctctcttccaagtgtactttacttcgttttgttcctgctgtaaactttttagtaaacttccactcctgctctcaaa

SEQ ID NO: 13069 - DNA, 808 bp, Homo sapiens
  misc_feature (1)...(808): n = A,T,C or G
atcccggatgcctcatgggctcccagnngcgacagcgtgaagagacacaacaaacgaaatctcattgtaggagaaacattaacaaagacattctctagcctttgccaacagtgccatgactttcattttaaagactgatggaacctccctctatcatccaggctggagtgcagtggcgcaatcgtggcttccaagtcctgccttcttgggccttttatggagactttattggataggcatgattgaccactgtgtggaaatgtgattggacagaaagagcacgatcttacactaatggactgagtggggaaacccagcaagtcctgtctgttccgattcttcttggtctctgtgcattgttccttcctctagggtatggggcaggaccccttctgaaatgggggtcttatggcccacgatcagacaaggtgggtcagataatttctttatggcagctccaagatggaaaggtaagggaagattcctgccatggggagaaaaagaaacaggtgaaaagagagtgggagatggtcagggagagagattctgttttctaaggcttanaattccccaacattatagaaagcgctgtaagagctatgaggcatgaatcattaacaaatacccagattctctatgtctatgtctatattataatatcaaaacatctgtacattntcctttaaataaaggaacatatctatatgcttaatatgtgccttttaccatttatctgcataattccttctaccataaataatgttttcctaattcatatccctgccgaaaattaaaagaaaaacaatgg

SEQ ID NO: 13070 - DNA, 777 bp, Homo sapiens
  misc_feature (1)...(777): n = A,T,C or G
ccttgantgtgtcaatggaatgactattggcatcttagaagttagagatgaaagatctcctatcagcctgattcttcagagacttacttggaacagaacctctgctgtggatcttaaaccactcactctggggaatggtatgaccagaaacaaaagtccaacagagttaggaaggctggcagaaagcaggtaatcgagggtgagggctctggaagacaacacaggccggaaaaatcagatattttcagcataaatagggtcttacatcaattgatagatacttactgtctaatattccagttgagtaaaccaattcctgaaataaattgcctatgattagaagatgaattgtttttcaagaaatgagaatacaataaccttttttggcaatgataccctaaaaacaggaaacttgtcttctcaaagtgttggagacaggacctggtgtgaggtttttggatcgataggagggctcatcatgaatgtgtcggtgctaccctgaagataatgagcgaattcttgtcatattagttaccatgagaattgatcgttgaaaagatcctggaacctccactctttctctccctcttttctttcccttgcttctctgtcatcatgtgatctctatacatctgctccacttcacctttctccatgagtggaagctgcctgaagccctcccatggcacccagatgctggtgctacccttcttgtatagcctgcagaaccatgagctaaataaacttcttttctttataaattaaaaaaaaaaaatc

SEQ ID NO: 13071 - DNA, 367 bp, Homo sapiens
caggaggcaaggcagagaccagagcaaggagaaggggggagccgaaccgcacccaggggaggaagcagccggacgcgcaggggggcccggacaagcggcgaccagcgcgccccggagcggccgcggcgacgagcgggcgggaggccccgaaaccgccagccccgaggccgcccaagcgaccacggaggcgaacgccgaggcgcagggcagggcgaccgacggcgagccccacgaaacggacacggccggccggaacggaacccaccggaacccagaccaaccgggcacacaaccgaaaccgaccgcaaccacacggcaagacacaggcgaagcacagcgcagcagggaggccaggaacgaaaagcgg

SEQ ID NO: 13072 - DNA, 340 bp, Homo sapiens
atgcattgtgtccgaccaccatagtttgggtttgggatgcatccgaattgctccccagagaggaggaagattaacgcaccagagtgccctgctatcgggttatccttacttaattacacctatatttattccactggtggtcatatgttttttattacgactgtgtggtgttctatagccagctaaagggcattatagctaatgtcgcagtgttgagttgacataattcactagacgacatatcaaatccgcaatccaatgtcccgtgatggtccccatctgaagtgtagtatagaaggctcctggtgtcgtagataaatggcgactttaaaattttttg

SEQ ID NO: 13073 - DNA, 786 bp, Homo sapiens
cctgatttggccagtatgtctttgtctcaagcatccaaacatctgacctcagtgacagtgttcaagcagttgtaatctgagcaaactgccatccatcttatctgatttctcaaacaagtcacctcttgcccaaggagcatcaccagtagaagctgaagagggatttgcgctgtgtgctgtgaagtgtcatctgaggtcaatgtgttgtcattgatggcttgtgcaggaatgtcaagattcagcatgtgacttgagccctgcagcctacacgctctataaggctcgtggctcaagagatgattcctcagagggctgataatgaaaaaagcaatcctccatttgcgtaaaaaaaacacgtaaatctgcactctacttttaattacactttctcttactttttttgcccaatgatagtttaaaaatttatagcataattttttgcctttaccaccaatttttctaaatgcaatattgtatcattttctgtattttaaagggataaagcaaaaatacaaaaacaaaaaaaaacatatattccccaaatgattaaggtcctatgctgggtttttttttttttttttttaactctgattcgttgaagagagtcaagtccttctcacctgtattattttagcaccctgtgttactttctggaagtatttatcacaacagtaatggatttgggttaaaaatctgcaaccctgctagaacaaagacaacataagaccagggaaagacagcatctatctagaccagcttgacctccccagagcatagcacaggttc

SEQ ID NO: 13074 - DNA, 782 bp, Homo sapiens
  misc_feature (1)...(782): n = A,T,C or G
ctgaaagagatctggatggctttaggaaccagctacggaactgcatcaatgctgctatgattgagaggtgatcgtatcattgtgaatctttgtgctttcagactcttgggagactgactacttaagacactggagctttccagagtatgagtaggaaccccaaagaaccagaaccaacaagaaatgagacaacacacagagaaactagctaaccagaaacttgttctggagggttctaataaactcacgaggaaatgacagtttgcaattagtccatgatccaggatctgcaggctgagcagaagtgggaaattaagcaactccacctgcaactcttgtcacccaacttgtttccttggctggctctcactgtcctttccatctcagcttagatgtcaccccctcagataagattccctgcctacactatctgctgtctttgcagcctgataccttctaccccttcacttgtttgcttcgtgcactgtacttatcgccatatttactttacatcacccatatcccacactagatcttaagccccatggctttgcccactattgctgcatcctcagcacctaagaagtatttggccaagacagatgttcaacacacatttataaaatcagggaattaacaaggaatcactaaaagaatgaacanactagacctcgaaagatccattaggatctcaaaattggataattgccaaatagcttggaattctgacaaagtcctttctaccaatgtcacagagaaatagacaaaattaggcctccctt

SEQ ID NO: 13075 - DNA, 784 bp, Homo sapiens
  misc_feature (1)...(784): n = A,T,C or G
ccctaggagctacttctagagcacacttgcaatgatttactacagactatgcatgggagcagaattacacaacagttgacatttttcaaagaaatggaaaattaaaagccaagaaaagtaacaacagggaattttatcccccaagatgataatcatctctaaatgaaggattgaggccatcaagctacagatggtcttacaaatggaactccaaatgagctcagctaacattttttaccgaggacccctggaccgacctactggtcctttcactggcctaaaaagttctgctctggaggcgctacaactgcagggcctcttcttcacccctatccagcaggaagtagctagagcggtcattgcccaattcctgacagcagttggggtgtcctgttaagagtggggattgagaggtgaagccagttgggcttctgggtcgggtggcaacttggagaacttttctgtctagctaaagaattgtaaacacactaatcagcgctctgtgtctagctaaaggtttgtaaacacaccaatcagcattctgtaaatatgtaccaatcagcgctctgtgtctagctaaaggtttataaacgcaccaatcagcactctgtaaaatggaccaatcaataggatgtgggcagggccaaataacggaataaaagctggccacctgagccagcagcggcaacccgctcaggtccctttccacactgtggaagatttgttctttgtctcttcacaataaatcttgctgctgctcactctttgngtccacactacctta

SEQ ID NO: 13076 - DNA, 637 bp, Homo sapiens
  misc_feature (1)...(637): n = A,T,C or G
cctgagaggaaccgcctgcccatttaggagaatctacagacgaagactggctacagcagctttgccaagctgtggtggggtgcagctgcggaccctctgaagagagcgccgtaggatcccaattacaagagtcaagatcacgcattttctccttctaaatcttccagtctaagtgcacctatgtatggagaggagatggacccttttatataggaaagtgattggtgtattttgtaaatgtgtggaaatgctaatcttacctccaagaaaccagactgcatcaataatggatcttcaacagttacacagagatattccactgctatattttgttttattttaatatattttagctccacaattttacaaagactgactttatttggaagacttttgtttaatatattttttaaaatatcaagagttcccagattggtttcttaaatatatcaataaacttaattgttttagggactagtaaaagaaaaaatagatcgatataaaaaaagtacaggaaatccttacatatcacttatgttttattaatgaaaaatgcttgcacaactcanaccaaaggcaacccctttaataataaaaatagcaatgtatggaatctagttcagcaatgaaaccaaaa

SEQ ID NO: 13077 - DNA, 809 bp, Homo sapiens
  misc_feature (1)...(809): n = A,T,C or G
agcttggcgttgaagaatgaatggttggaaatctcaccagaaagagctctgtgacatggaagatgaacaagctgagagacccccaagctcagtggcagctttgtactatcctatccccaacaccacactctccctcggaagccaaaactcctcctggcagagaagggcactcaggaagccacgtcggatgggctggggaactcctagatatggatgctgcacatgctattactttatcatatataatctactaattatcaataacagtgtgtaacatatacaatccactagttattagtaactgtagtctgttaataataacatcatcgttgtcatcatggctgtgacaatggggcagtctgccctctccctccccatcgccacgatcatctatatttatggaacatacatctaaatgcattattattttcattctgaacatcagtatgtggggtatgtattccattgcctccctatctatgtaccaggtgctgggcattgaggggtatacagaccttggttctaccctttatgatctaaaacagctgaaagtattgacataaggatactaaaaactaaatagaggctgggtgtggtggctcacgcctgtaatccancactttgggaggccgagacagacggatcacctgaagtcaggagtcaagaccagctgggcaacatggcaaactccatctctactgaaaatccaaaattagcccggcggtggggccggggcgctttatcccagctactcttgaggctgaggatgaggaatggcttgaccccggaagcggagggctcagggagcc

SEQ ID NO: 13078 - DNA, 786 bp, Homo sapiens
aaaagagctgcctgggaatggagcctgcctgaagttggaggccatgaatttatagtggcacttgccagtgcagacctgtgactacctccaggagtgcccagaagtccaattgtaagcctggagaaatgggacggtttggctgacttggagttttgcaggcaggagaaatgaaagcacagtggaggtgaggaatttggcactggataaacatcagtgatggacaatgacatgtaatgtttgtgaataagatattgaaaagaggaagctactaatagaaaaaaaagtcaaattcctggaagtgagacccgggggtacactgctgtgcttctcagcggtctctggagagtcacagcgtctctgagtggacaggaaactgggccaaaacagggatttatttctattgctgagccccctcctgtcatgagcatctcttcaggtcgtgttggtttttgtctggcacatctttttgtgttggtgaatggcagcttcaccaagatatcatcaaatatcatcagactataaatcacaatgcccacctggctcccggtcacactggagcattggattttgagcactgtagcatgcatttacatgctaccatatgctcatgcaaggaatgagcacatagcttacacaattccaatcgagcccttccacaggactgacatgtgggcaaggggagagaaaaacccctttttcctgtgtattgcgccttatcgaattggattggattctactgtattgatttctactggattgcactgtattgtatccccttggcctgag

SEQ ID NO: 13079 - DNA, 786 bp, Homo sapiens
gctcctgcaagaagccagctaccaaagaatgcaggttctcagatgctgtttagacatatgtcaagtggaaaagaagctgcatatgaattgctatgttcttcttttgaaaatgccatggttaatttttaattgctggtagcaaggtagacctgatgaccacagcattccactcagatagagtttgtgctggctcatcagattattgctgcctctcaactaatttatatgactttgagcccaacagtaagcagagagtactgttaaagagcttctggcacctgtggtgttgtgttaaagaacctgttctcatttactgctctcagcatttcattgaacaacagggaggtgtggcttcagaaaatacaaattaccataagtagaaatcaggttctttcttttaagttcttccacatctcttttctagtcttactcttggcaaccctcttccaccattgttaaaaagattttagagtctacaacaagaggattgggagccagttgtttctgtgattttcatgaggcctctctgttccctccaatctattacaaggcctgaaactgtgggcaatccctgctgctttattcagaatgcctcacctggcgacattcttgagcttttctacgccagggaacaaaatgttcattccttactgaaggtggggagaaaattcttgtccagcaatggctgcttaaaagaaccgtcgaatggtctcacagatgctattcctggcgccaattggtgagcccaaacccttttcccatgggaatggttgtttccaactaaag

SEQ ID NO: 13080 - DNA, 773 bp, Homo sapiens
tagggagagctcatggaagctatcagagtggtcttttggccaggagatgcagtcatcctcatggaagctatcagagtggccttttggctgggagacgcagtcatcctcatgaaagctatcagagtggtcttctggccggcagatgtagtcatccaccgatctcttcttgttttagccatctctctatcctccgtgggctctctgaggaaaatacatgcataggctaaactggcgaaggaaagcaacgcaacattttattattaattggggctttggttccaagtcgccaaacagaattccattaaactaggttggactcaataggaaattcttcatgagaatttatgagaatatgcataaggcagctcagagcttagaaccaagtgctgggcagtatattcctttttatgcactcacaatcagaccttaagcttaactccatcaaccagaccagagaattcctacaatagcaggaggaaatggagtcacagcacaagggaccctgcttgtctgaagtgctcagtgcggaaccagccaagcctggttgctgtattaggaaaagagaactttcagagagaaagcctgtctggcccttggcacttctcgttgcagtcactggagaggtaagagagaaaaggggccactctgtcatgtgcgttctctgaaaacaaacccaggacaatatgactaaccattgaccgagagcttggaatttcctgtccttgatgccacaagcaataccaaactttggcatgtaaaatagcaactgtttt

SEQ ID NO: 13081 - DNA, 722 bp, Homo sapiens
aacgttcccaagtagactgtatttgtgaatcacaaaacaagacctagtaaattaaacctgatgggaattattcaagactcagctcacctgcacccaggtgaaataaacagctttattgctcacacaaagcctgtttggtggtctcttcacatggacgcacatgaaatttggtgccgtgactcggatcgggggacctcccttgggagatcaatcccctgtcctcctgctctttgctccgtgagaaaggtccacctacgacctcaagtcctcagaccgaccagcccaagaaacatctcactaatttcaaatccagttttagctattttatgatttagatctggccagaggaatgacaggaaaatgctcaacatctatttactgaataggaatacaactgtaatcagctgttggtccctgctatcatttacttgctgatgatactcttctctaggcatgacctgtggggtcttccccatagcacatctccctggcaggaagaataccaacattttgtgcatactcaagttcttgcagtccctgcggtgtgccctgtggaactcaaggacacgaaaaggtcagccctccatgtttggaggttttgcttcccactaatcctgtattttcattttgtttgagttggcggaggggaacctgctgttaagacggctgactgcttttatgaaaaaactcccatttaagcagggtgagagttcacaccctgg

SEQ ID NO: 13082 - DNA, 807 bp, Homo sapiens
ctggcaggatgggctccacctctctcctatcatgtgactcagaggttgccaccacctccttccctgaacaggacacggcatcgtgtctacaacacccaccacctgccacgggaagtgcagccaatcggctgcacggatcctacagtatgtggcatgcgacttcttatggggacatgaaacacctcggctgatacccctcttcctcacagcatcaaggaaatgaaggaaacacggtgccacgtctgtctccagaggaggaatgaggtcttcctaggctccaggcaccaccacattcacccctttgggatttgcaaattgtgtcctccacctatttttggctcttctgcatttgttttattacaggcagggaacacaagctttatagatgagggggtgtaaaatctattctctaaaatcccggtttcttgatgaaaagtgaatgaatgaaatgagtcaatgggtttatcaggatcccaccccagcctgcattacaggtaacattccaatgaaaccacatcttagtcagcaagcctttgactcaaaaaaaattaggtgtgcccaaaactccttgaaaacactaaccaaactaatatgcactgaagtacagaaaaatagcctttaaagattagcagactaggttctaatcctggctcctccattgatagactctaaaccaccctccagcaggttaatgtatttttaggagctcagtaagatgtagaaacaatatttacctccaaagactccagaggggagtacccatatattgaccataagcctctgccaaatggtagcctatgtgggtat

SEQ ID NO: 13083 - DNA, 764 bp, Homo sapiens
ggatccttcagtcctatttgtgttcccagcaacagagaagagaggagaaataatttaagggaatgacagaagagactgagagttggcgattccttgggacactccaagaagctcagtcggagcaggattgaggtgcttacctccaaatgcctttgaagaagacaggcttttctgtatgcttccagatcacggagtgagattgctgttcttcccattgggaacggtctcatgtcagtagcacatcgcattgcagcttactctcagaatcaaactatctacccagaagaaatggataaatccttgcaattctcttgggttcagaaaaagattttagccagaagctccttttctagtaagtagttgtatagtgttattgcccagtaaatgagtggtacaatttctggctgacaattgctgaattcaatcaaaatgtagtgacccagaaattgtcttaactcaatgctcataaatacaaacattgccccagaattataccagtattggtgaattttcctgaatgaaaaagacattatttctctgggagaattaagccattttaattcttggaccaattttctatttagtagtattttaatcatctttatttctatcttactaaaattatttttcatgaacatccactgttttccatgtacatttatttttgatacagctttcattcattctttttgcccccatcaaattaaatgagaaaagtttctgtctttgtaaaaaaaaaaattcggctccgttggcctcagcgg

SEQ ID NO: 13084 - DNA, 782 bp, Homo sapiens
ggactattttcttccccgtctgccatgattcatagatgggaccttcaaaaagtgcttctaggcgaagaaaaatcaccactgaatttgaaacaaatagaatctacacctgttgaaggagaaacttcaagtataagaaacttctctgagagggtctctccaggatgtaaccctgatgtctgctggctgcatactcacctggagacttgattagggaggagtcccgccaggaacccctgggaagcatccctgttaactgccatgctcacactggagctcagccctgggcctcttttgctgacaactccactcttccaaggaggccagaatctggtggggtctgtggactcaccctgagctgctgggatcacaggaaagaccctgcagccttcaccacaggatctggtccagggaccctttggagacttcaaaaagatattcacccttctttgtcaactgaggagagttaattttcattccctggagacatacacaaaatctgttcactggacagctctgcccaatgcaaccagggggtttccttcttcaatgtctctctatctgcagtgccaccccttgtgcatgaagatgatcatggttttcccgacaacactgcttcagaactcagattcttctgttatggtgatggtctcttacaagagccttttagtgatgaaaacaacttccaacatagaactgtttctacgctgcgattaaatgcaggcatttgatatagagccaaaccctgaggaagacaaagtgactgggcctggtttagaactacg

SEQ ID NO: 13085 - DNA, 815 bp, Homo sapiens
ctagcacaggggccttccccacgactaacctacctgagtgttgccgatgcggatctactcaaccggacttggtcccggggaggcgatgaacaatgtctccggtacatcgccaacctcatctcctgcttccccagtgtgtgtgtccgggatgagaagggaaacccggtttcctggtccatcacagaccagtttgccaccatgtgccatggctacaccctgccagaacatcgcaggaaaggatacagccggctggtggccctcacgctggccaggaagttgcaaagccggggattcccctctcaggggaacgtcctggatgacaacacggcgtctataagcctcctgaagagtctccatgctgagttcttgccttgtcgcttccacaggcttattctcacccctgcgactttctctggcctgcctcacctctagcccagtaaaaaactgcagtggttttattactttccctgagcatacacacactcttggctgccaacgaggggagagttaaaatgggaatcaggggactcttgagttgttggaaagggtctggagaatatatacaggatccacttgagaagccttaatttttcgtatctcaaggcttctccagtaaatagcctgtgggggtgaaacagtatcttggggttgaagactgaggacaattggcctcctgtaggatccaatggtggagaatagggtctaaagcccccagttttagtgtactttggaaatttattgcttgagaaccaatgatcaaccgaggaccacctgggtactggtttctgaatgctgatcggactctcggttgaatt

SEQ ID NO: 13086 - DNA, 724 bp, Homo sapiens
  misc_feature (1)...(724): n = A,T,C or G
ctacttaatgcagttaagtaacatatcttggaagacaagtgttgaaggtgaaagaggcacaagttagaagaaacctgggtgggtagatccttgcttggaggaaaaccacctgccaatccagaacatcattttggacttcatccttgaaaccaactctctgcagagcaattcctgtttccacaaagggtgcatcaggatgcatgggacccccggatcacaggccccacgtgtgaacgaagcaacacagaccatggataacagagacctctctaggacggagtctcgctttgtcgcccagtctggagtgcaatggcgcgatcccggctcactgcaacctctgcccaccaggttcaagtgattctcctgcctcagcctcctcagtagctgggactacaggcatgcgccaccacgcctggctaatttttgtatttttagtagagacagggtttcgccatgttgggcaggctgatctcaaactcctgacctcaagtgatccgcccacctcggcctcccaaagtgctgggattacacatgagagccaccgcacctggcctatgttcactatctgggtaacaagtacactagaagcccattcccactgttatgcaatatacccatgcctatggacgtgtaccccctgaaaacatgcatatgtacccccgaatctaaaataaaataaaagagatgcagaaaagaaaaanaaaaatcgggcttcttggcctca

SEQ ID NO: 13087 - DNA, 810 bp, Homo sapiens
  misc_feature (1)...(810): n = A,T,C or G
cctggagcatcactgagttacacctggtcctatttgccatccatttcttctttttgccacaaatagagcattaaaatagattgttcattagaaggaacacgtccaagctattgccaacatatgttggcacctaaagacattatatgtggtttcctcttaacaaaaaaagaaaaagaagaaggttaagaaactaaaagcccagaatctctgaaataagtctacacaacacccagttttttccagttactctgtatgaaatgttattgtaaatataagttccagtaatgcataaccttaaattattgttctgaaagatcagcccaaagaatattaaaagtgttttcaacatactccattaaaaaaataaaaataaataaaagtgctagaatttctctttcttctgacttcaagtgttcaagagaaccacatcgatgggacaatggaagcagttatttggatgcatgttgcaaatcccccatctccgactntatgatggatgtcagtgaagtttgtggctggaaacagtagtcctacatcaaggagatttatggagaggatgcatttagtattattcatgagccacttaacangcgtcagcanaggaaacaatatggcctttgtttatagtcccaggagttctttagagggcttttgaaaattgaagagattntctgataaatggtagaggatctttaggtggccctgaaagctgtaagtgtattttcctgttaccttgaagaagtactacattcatcctaacttcctggttcctcaataaaaatatcagataaaaaaaaaattcggctggtg

SEQ ID NO: 13088 - DNA, 445 bp, Homo sapiens
  misc_feature (1)...(445): n = A,T,C or G
agagcaaaaagaacaaaactataacaatagagttaatcgaaagatagaagggccacncccttgattagactaccaaaatgaagccttaaatgaagtattcaaccaacaaaattttcacagcaaagtcggaagaacacagcaagcggggccttgtgtttcaagctgggaacattgtctatttcagaaaaaatgagattcaccaaatgaaacttcagcaagcaactaactgttcaagaagtgttcaagaatgttaacatcacatgtaggaatgctacattttccaggatttgacattttcagcgatcaagaattactatattttatcaatgaaaataccactactaaaaacataaatagaatgatgtcttttgtttccaaagttgatatactacagagatgtaaaaataataataaaagctagattctttcgtgaaaaaaaaaaaaa

SEQ ID NO: 13089 - DNA, 819 bp, Homo sapiens
ctggagatgagcttcttcatatgctgccaaggaagtcccgtgatgttcacagatcatcttacattgctgatgttcccacttcccagggcctccgccgggacgtggggatgcaggggatcagcagctgttctgctgggctgctggcaagggagtggctctagcacagacacccctttcttcttcctcggagggagcaggaagttgctgagtgaagcgttgtttctcaacctctccaccccccagttatcagaggcaaggctctgtgtggccgtctgtctcctgttcctgggcagggctgggccagaggacaacaccaagataaataaccccagcatactagggccctcttttactgcttgtggacttaggcaacctggcagtgctagccagattccaaggctagaggctggcttaagcgaaaggggcaatttggggagtggtcttgctctgatgccccagagctgtttgtttttgtgcctctagttagtagaatatttggagccataattgccaaatgtgtacaaccacaccgttttttgggttaaagagagacagacgagagaaagagacagacccaaaaggcatctttaatataccttaaaatatgtgtatatgcataataataattggccctttttttcttttgttttcctaaaatcagaacaggacagcacactctctctggccacccatcaaagttatcatctgtggataactgtattaatcattggaaaaatataccccaccccctaaaattgcagagcaccattctaaatattctgcttgaataaactcattaattcctacattacccctatg

SEQ ID NO: 13090 - DNA, 237 bp, Homo sapiens
ggcctcccaaagtgctgggattacaggcgtgagccaccgcgcctggctggcactgtattttatcttttaaaataggcggttccccatcagaatatgaactcatttaagggcaaggactatatcttaaatatcttttgtacctttgcacggtgaccaagacatagtaaatgctcaaaaaacatttaatgaatgaatgaattaattaataaactcttgtgtgatggaaaaaaaaaaaaa

SEQ ID NO: 13091 - DNA, 293 bp, Homo sapiens
cagacctcagcctgcagaagcagaatctccgtggtgggatccagagcttgtatcttggccaagccctcccagaagtttctagcatacactgaaggttctcctgcttcaagagccaagatcctcaggcacaaaatcaggcaacaggagtcctgggctctgcccttgcttgtggagttctggaaacgaatgcatttggagtaggtgatgtttaatgatcctttctgttctcaattcctgtaatacaaataaacaataaaatacttacatctttattatttacaaaaaaaaaaaaa

SEQ ID NO: 13092 - DNA, 520 bp, Homo sapiens
gtttgatgaaacaaactaagcttcataaacgtcaaataaactgcctgatgtcatcatacagctgataaggagcaaagccacaatttgaacacctgccctttggacctcacagccatggcttttaaccatcactctgtattctatgctataatgccccacagtgtacaccagcttgggctttctgtgagattatagttttatcaaataaaaacacattaagtttatggcccatagctcgttttaaattatctgggagacctagaagaagctactgatgtgcctcatttgccaagatcattcatcattatctaaactacatctctggaagaaagaaatctgcttgcagtttatttattcattcatgaattatttattaagttcctacaatgtgccaagcattctttcaaaaactgactacacaacaatgaacaaaacagataaaaatccctgccgtcatgagacttatgttcccatgaatagaaaaaagagacaataaacaaaataaataaaaaaaaaaaaa

SEQ ID NO: 13093 - DNA, 366 bp, Homo sapiens
tgtcatgatcccctacgcttgaagatccatatacgaactatgaaattctcatgaagaatcagactactcctccaactgacactggtgtgggcatctgactaacccgatccaagcataaagcttccttctagactcaataatttagcaagagatagacacttgtgccaaactgggccaagcagcattctgtttattaatttttttagtcaaaacgtttggatagaggttttgcatttgccacaattgatatttaatcgccaagaggcagatcaccatatcttccctcacgtgaaacactggtctgacagaatgaagttgacacataaagagaattaaaatagaagtgagaaagcaaaaaaaaaaaaa

SEQ ID NO: 13094 - DNA, 104 bp, Homo sapiens
cttcaggactaccatcactagaagttacagaactttaaccccagatgaaagttttggaatcaactggagttaatccgaaaaatttggaaagaaaaaaaaaaaaa

SEQ ID NO: 13095 - DNA, 688 bp, Homo sapiens
  misc_feature (1)...(688): n = A,T,C or G
cctgtaggacactaatggtaaagctttccaagacagaacaaagaacaactacaatcgatgttataccaatagagatcatgcaaactgaagaacagagagaaaaataatgaagaaaaatagagccccaggaaaatttggataccattaagttcacccatatatgcataagggaaggaccagcaggagaagacagaaaggagaggaaatatttttcaaagaaataatggcttatctttccctattttattgaaaaaacaacaatctacccattcagaaaattcaacaaactacaagacacaaagagattcacaaatagacacatgatggtaaaaatattgaaagtcaaagaccaggagaaaatctgaaatgcaacaagaaaacaataacttgtttcttacaagtaaacctctataagattaacagctgattcttcagtagaaacattgaagagagaagaaaggaaaaggagtaaagaaaatgccatcaatagaattaaaagcaacgaagaaggagaagaagaagaaggaggaggaggagaaggaggaganaaatcaattagaaagtttggataaaaagaaagcatatatataacatgttttataaaattcaaatatttaatattcatataattatatcagttacagtagaaattaaaataaaaatggttttctaatgaaaaaaaaaaaaa

SEQ ID NO: 13096 - DNA, 841 bp, Homo sapiens
  misc_feature (1)...(841): n = A,T,C or G
atctgacggctcaggttcctttttaacgctagggaaacaagaccgcgagcccttgatggcaacggaaacaagccctcagctcggataccttagctggactgataccataccgaacgactggggacaccaatgcgaggctggtgcagatggaggccctcatgaataaagtgccatgccccgcgggaacctgggacagcacactgacactacatcacgcacatgggcccactatgctggggtttttggatcagtttctgttgtgttctgataaggtttcttttttatgtaattaagtacacgcatatactaatttatgatttgttacaaacaacacaacatacatgtcctcgccgacctcatcggcgggagccctgtgtacgctactctttacagacgccacatccctgaccaccccctaatgcctatgatgagatcaacaaccaagacaggaaaagcgaacagatctaacaaaaagtatactctatgaaataaatccgaaaacgacgacaacaaaagaaccaacacgatcggtcaatttcaacaaggtgcgatagaccaaaggagcgccactaacaatatttcaatatcaattgctatccgcccctggtatagtcatcataaacatgatctccctactgataaacctcggaatccacctgtatgaccatatccatccacacgaacatccctcatctataaattccccgggcactactcccagactttcctaacacctccgacaacacagcccgccctgcacttgagtctcgagcgagctatataaacatcactcgcgtgcatcgaattgacgtgaccgctgcaaagaacatcacgngatatc

SEQ ID NO: 13097 - DNA, 1593 bp, Homo sapiens
  misc_feature (1)...(1593): n = A,T,C or G
tataattataatgtgtgtggtggagatatnnaatatgagtgtgtgagtgtgttggntnnttntgttntnaagtnnncaaggantgttgtagagagtnngggagaggggggtgttgtaantatantaatgatgtaaanagagagtaaagataatnnnnannnntannnnnagaaannannnnnaaagtannnnnnnnnaaaagaaaaaannananagaaananaagntgaagntnnaaaagaaaaagaggagatgagagagaaggagagaggnanggagattatagtgcatatgttgtgtgcnnntagaagatgttcccacatatacatatacctacactctatatcacggaagcgacgtanacacgagagngtaggagaaagtacgctgcgngcagagtgtgtgtgtatgtaatctcctctattaatgttanaatcttacctagcggtcatcacncagtgtcttcggcgtacttatatatgagaagtatgcagttctcatggtctggccggcggacgctagacggacgaattcntctgatctattgaatggcgcgcatcgctgcgttcgtagtgtgcgccntcagatcgactcctcgactcgcctctcgtctctcataatagtggaccggtgcatccgtctgtgagaggtgtccacgcagctatagatgtcttgctntcttgcgccgcacgcgcaggagacgagtgctacaacctagacgtgcgacgccaccgcgccncacgcagtcgtctcacccaacacagctaattctcgtatgatagtgacgtcgtcaaccgtcngtgtattgtgatganncatgaggaggacacngaagcatgcgagagaagattaggagacacatagtagagtataggcttgttgtgttgtgtgtactagagtgatcgtaatcgaatggttgagtganagtttatgagcaggctcactaggttcaagtatacgatccntncngtagggcacaagtcagcaggagcagacggacgcagaatcnncatcaccgcgtcagcgcgcttnctccgtcaggactagtcatcgcatatttgcatctacgtgttactcgtctgacaacatagatcnctcttgagtcaagtgtcttcgccacccgcgcttcgtgcagttctcagtcgtaccacgtagcgtgcgcatgctacgtcggccgtgcgtggagtaggcacgtacgcggttgcctaangatagagtcttgcagntgtcattacanactgaaatcactgcgagcgacgctntcctctaatctgagtctcactantctatcgtactacgcaaacgcagtccacatgtatgatgatcggtcacatccggagatcgataacgtcaaataagatgctctgcgccgctcgatctaccntctacgtgtttaagctctncncactcgtcagtcatcatctcgaggcancantagtgacgtagtattcncacaggagtagaagtatatccgtagatctctcatgtaggattangcaatgtcaccncatagcagtcacacggcgcgtgtcagcacgggtctgtagtgtgcncgcgttcgagagcgcncatacacgtgcaccgacttcagagg

SEQ ID NO: 13098 - DNA, 201 bp, Homo sapiens
cctagaatgatctaccttattttggtattaagaaacacttgaagattattctcagaaatgccataagggatatttaaaaatcttggagcacacaagaagtacaagagggatgaaaatgtcatgtcttaattttccaaaaaagagaatattttagtttttagaatattaaggcagattaacaaaccttcaaaaaaaaaaaaa

SEQ ID NO: 13099 - DNA, 251 bp, Homo sapiens
cctacccggacgagggcaggctgtcagccagcaggcccatgcgcagatcccaccatactcacagccaggtcctgtccagtggatgggacaaagaaggccctgccctggtggagctgacattccagtgggtgctgggtgatgaaggcagagaaacagtggggctgaggtgggggctttccccagggaggatgtcttagtccattctggctgttgtgacaaaataaaaacatgaactgggaaaaaaaaaaaaa

SEQ ID NO: 13100 - DNA, 237 bp, Homo sapiens
ggcctcccaaagtgctgggattacaggcgtgagccaccgcgcctggctggcactgtattttatcttttaaaataggcggttccccatcagaatatgaactcatttaagggcaaggacggtgtcttaaatatcttttgtacctttgcacaaaaaccaatacatattaaatgctcaaaaaacatttaatgaatgaatcaattaattaataaactcttcgctcatggaaaaaaaaaaaaa

SEQ ID NO: 13101 - DNA, 1776 bp, Homo sapiens
  misc_feature (1)...(1776): n = A,T,C or G
tatttaaanattaaatataanaatnaantagaattannttagtaattagatatntnttaagtagagaatatagtgatatnananatantntaagtatagtanagttgttagtgagtgagnnannnanngtgtagnnnangganannnnngngtgaggtttgttatnnntannnnnnnnaatgagagnnnnngnnannntnanagnnangaggtnntntatnnnnnnnnnnnnnnnnnnnnanannnnnnnnnnnnnnnnnnnnnnnnnnnnnnnnnnnnnnnnnnannnntnnnnnaangnnnnnnnnnnnnnnnnnnnntnnnnnnnnnnnnnnnnnngnnnnnanaannnnnnnnaaannnnnnnnnnaannaggaaaagggaaangnnnanangaganaggngagaganatagagtggaatgcagaatntntanntcgatgaaaanntgcnnntnatagtgtgtggatntnatctcntgtgtncgtgannatcanannatgaactacgagagtatagnacagcattagagatgaacggancgatagagnagntngagcgtagccggagtgtgacgatcagntcgtgataagatgattgatgagacttganctagacgtgtgttctcgtnacncntnattatatataactgtcaattcagttcgcagcggangcgctgggtgtacacnaccntgtagagcacnacagacaccgcgacagctagaagattgcactccacgcagaccgagcaanananaacaagcggttatattactantacatncgtggttgctattcctntattattattgacacatagcgtatcgacgagacatactgtgagagaatatacgtatgcgtgaggagacgtaatacggtaggcacagcccacagaacgtaagggaagtcggggaggcgtgtcgactgcttaacagcgcgtcgtgcagagggtagtgcgaggaggtagcgatgtctgatagttaggagtgagaggncgtctggttgagtgtcggagagcgcgagtagaaggagcgcggatggtgcgagcgagcgcgnaccgagcgggcccgcgacgccgcgaacggtgatggaagagtgaaggccaacacacgcgaacacgaacgactgacgacctgcgtgttatatcgaggcggccgtagagcatgctcgcatcggagccgtcggcgccccttcgcgcgaggtacgtgcgtgcgcctacaagatgcgccaccatcacgaggacggataaattaagtacacagcgtcggcgaatcctgcgcgcgtgtatggtcggtcaggcnaggtgaggaggtcngtcgtgagatacgagtngtgctcgcgnctgtgatcagcgcgcactcgcttcagcgtcacagtagcacggacancgtcgaggacatgtagcaggcggcgcagatgncacatgtaggagacactgtcgaggtgagtctgcgtatgccgaggcatatcgtagtagagagtagatgtanttcgatagagcagagatatagagacgaagatagagagacagganatgatgagncantgnagtacatagagtaagtgcatgtccagcgagtgcactcggaggtgtagagcggcagaagattggcgatgacggngatagtggagcagagagcgngcatattgagtgcctcacgacgagangtancacatcggctntaactacgagtcgatgtaggtcgtanccgagcgacgaggagacggctgntgaacgtagagcaaagacacgcacgagcgcgagagcatccgag

SEQ ID NO: 13102 - DNA, 2056 bp, Homo sapiens
  misc_feature (1)...(2056): n = A,T,C or G
gttttagtgtgagtatgtatggagtgnntgtagnangtattaaggatgagatgatagnaananaatagatatatatgtaaactgatagggaggtaganagagtagaaggtatagtaatanntnnnntatntnagngaagatangnngnnnaataggagaagattagntnnntagnantnagangatagataanannanannatnantatnnanatantatattannnnnnanannnnnannnnnnanannatntnnnnnnnnnaaannnanatnnannnnnnnnanannntnnaanananannnntnnnnnnnnnnnnnnnannanntnnannnnnannnnnnnnnnannnnnannnannnntanannnnnnnnnanannanggagagtgnnnngnnnngannanagtaanngnnnnantgtgatngtatgagagnaggcngngcctatnatgntgntagtacgagtaatatatatgatatctanagaacagcaagataancatcntcannctctcatatataactaccgtananagtctacacaagcactntcagatactnananaattagtactaattngactaccacaatatatttgctatatatagantatangagtcgtacncgttcactcggtactacgactgcacggncgatcactccgtgcgagntacgcttcgagagagagcacgcagnccactcngccccagcgcccaccngcagtccggcngagcgccgntgacgcgcagangtcagcagncactacgtctgagcgtcgagagaacggccgcagagcacgtagtcgagagctgtactacgtctgtgcgtgagtcgtagtangtggctgtgatagtgatatgtcntnacgaggacgcacgcagancgcatntgccatgacagcaccgatgagagctangccagcgtgctgcgtaggcgatgaatagaagtgncganctcgtgacgagacgcacgggtgtgtgagtcggatagaaagtgtgtgagactgctatcgcgagnactcagacatgccagangaanatacgcgagagagtgtagtngatttngtagtngcangtatctcacctantctaatacatatacatagatgatccactatatatgcagtganggtcactgcacaacgatcgcagcgagtgtgtcagcgtctggaaatgtgaatggcattgatntcatcnangtgaaccacacacatgtgagcatgttgtaatacgncatcacngcctacgatngctcgtgntctcgtatagcgtctcganacgaagcgttgacacgtcctgccgtgangtatagcgagatgatgcacgtctngtgcgagctagcntcactagtacgatcaggcncacgtgtcacntncgngagtgatgtagtgcnatagagcgtgtaatctgcgtaaaantcctattctagtgcacaggcctgcaactantnntatgtcactgacgtctcgatgcgtcgagtgcncatatnacgtatctgtagatgtantgtgactgtcgantgcgnaatagngagtgtntgtagacagatcgagtgacagggtacgacgttgtctncgcagtcgtcatctaccgtacgcgacacatcttacgctagcgtanacgatctgcgtgcgcgcgtantcgactgntagtagtgtcgacgcgagtggtgatctgtgcgcgtgcgtgatctacgtagctatgagtatatgagtgtatgtagantcgtctcgtcatgagatnactgctgacatattctgagancgtgctantggcgcaagagagacgccgcttaacatttacgtagtagtntaccgtgtacactntgacgacgctaggtgacgcactgctgcgcagcacgacacagcgggacgcatntcncnctgcgcgatagttcgcangactgtgcgctctatcgncattctcgtgtattacatcactnagtttantatcacttagtaacatcgtaagagatggttcncgacgacagtaaacacagagaatgaacagatcggaacgacacacgtnatagcgatagatcaaacatnaagacat

SEQ ID NO: 13103 - DNA, 146 bp, Homo sapiens
gctcataggacttaatgttgctatcatgacaccaccaagagtgtcgactcgtaaacaaaaatgacatcttaaaaggaggcggcacgcttaaacaaaaaaaaagcccatggcctgcgtggcctaccttaagaagctatgcaaggcga

SEQ ID NO: 13104 - DNA, 1317 bp, Homo sapiens
  misc_feature (1)...(1317): n = A,T,C or G
gtttaagtgtatagggagaggggnntaattttaaatnnttttataagtatntnntaaggggggggggaatcttgggaaataaattgaaattnaaaaaatttataagannagtgtaanaanataaaanatgnaannnnnaaaatnatannnaaaaanaaatngnaaannaagaaannnaaagaannagaagaggacaaaggggaaggatagaataggatttaatatataacattatgaaatcgaaatgcaggagttgcgttgttgtctgtaaatgaacgtgaccattttacgttccagtataagatgaaatgaccaaatacgatactgttatgtcacgtatttagctcgttctaaactcccctccccctcattactttacttactccctcatcgtcctccatttacaacttatatcaaccgaacantnntctacaatatacactatgaggtcatgtgaacgcaagaaagtagacaaacgatttatctcctttatatcgtccatcattacgagattacnttcgggtatgtggggccgggacgaggtgccgtcctatcgaatgctgtatcggtcggatgtaacgtcgtctgactgagctaagctgtctcacacaccgaacacgcaacgangagcaacagagtagcacagacgcacccgcatcttcgccgcacacatcatacgagtacacatgttgtgccagcacncccacgtgntctacacgcgtctctccctcgacgatacaacgaatccgtcgtctatagttctgagtcnccgaaccgcggatgctccctccctcgacgtcagatatacagcgnccaatcatgtacgagaaagctgcagagtgtattgtaatcacgtcgtcctcgccgagatccgttgcatgtcacttgctgaccacatgaagacatgcctacatcgcgcacgtcgaanctaccacgacaggnggtgtagtagagatgtacacacaccgataagcgcacacgccacgcacaacgtcgatacagacactggcaacagataataaattnacgcantcgaacanggcgagtgagcgtgatgatatgttnanctacgtatgatagcgagttgcacgcagcagaaccnagagagtagagacggtacgtagaagagagaagaactcgagaatcaggcgcagtcacacgagtacacgtatgatcaaagacacaccagtacgaactacacctacacagactcgctagccgctgcctcaggcgcactcgtagtcgtctcccgtctcgctccgcgaacgcaagacgcaanccatatgatgcatagtcccacaggctctcatatcctat

SEQ ID NO: 13105 - DNA, 290 bp, Homo sapiens
  misc_feature (1)...(290): n = A,T,C or G
ttagacaatgacactccctgaagatgccgtgagtgagacagaggcccatgaagctattatcatttanaattctacgctnaggggatcaaatcaatcttatnttcaatccaaacttctgagagaagagacaacgaccaggacgcagcgagcacctattctcttcctgcctttacatcttaactgaagtgccatctcctctgacaacccttctaaagcgggggtcttctctgagggggggtccttcataacaggttttacaattatagttttggcttttaaaaaaaaaaaaa

SEQ ID NO: 13106 - DNA, 807 bp, Homo sapiens
tggcgcagagtgaggcagtgaggaaataaaaatagagtccgcgctttcaagtgtttcctgatctgctggggaaaatggtcatattaacacatggagtcatggcacagtgtgtgctaaggatcatggtaaaggtgtacacagtgatttgctaacaagagggatagaaggtgtggctcagggaatgacacagctgtctgaaagagtcaaaatgtaccacagagaacgtgacagagatctggatctcaaagaagtgagaggttgcctagggagcaacaacaaggagggcattcctggcagaggaaatggcatgtgcaaagagacatcaagaggatgaagcattagaaatataactaaattatggttatagcttgggtgcctattaatagatctgctcaatattaggcaaaaacaataacaattgagaatttgtatatcatctttggtgtcttctttgataacttattttgtgtatgtgtgtttttctttcctgctactactctggagacttgctccactggtgacctttatgcattctaaacaatcgctatttcacagagtaagttgttctcttctcccctatgcgtttgtcactagccatttgttttaaacgagcttgcttggttttttgattgcctcttgggaaagcctacaagcccttgggctttcataccaacggcgcatgccaaatccatttctctctggaaaggtactaaagtgtgaatagttctaacctatttggcattagtttgcgattacgcgtaatagtgcattgcccttcgtggctcggcggatgcatattttcgttta

SEQ ID NO: 13107 - DNA, 795 bp, Homo sapiens
cctggatactgcaatctcttatctgcatctagtagaaagaactgcatgttactcagtgattgtgaacacttggctgcaaatagatgaatggtgtccttataagaagaggaagaagagccatggatgtactcataggggaatacctgtgtgaagacaatgagaaagtgaccatctgaaagccaaaaagagaggccccaggagaaactaaacctgcagacaccttgaccttggacttcctgtttccaaaactataagaaaataatttatattgtttaagctacccagtctgtagcattttgtcttaggaaacctagaaaaacaatacatgttttttttttaatgtccaaagggtttcaattttgatgaaatacaactatctggttttttttcttttattgcttaattttgttggtcttatagctaaagaattcattgacaaatctaaggtcatttggatttaatcatgttttcttctatggctttcatggttttagtgcttatatttatgccaatgatccatgttcagttaattttttatatggtgtgaggtaggattccagttttattcttttgcatgtagatattcagttgtctaaacattatttttgaagagactttccttttcccatttagtcatttggccctcttgatttttgaatcagctgaccataaacatatggaattattcctggactcccaattctattacattggtatgtctgtccttaggccaacactacattgctttgattactatagttttatagtaagttttgaacagggaagtgtgagcct

SEQ ID NO: 13108 - DNA, 951 bp, Homo sapiens
  misc_feature (1)...(951): n = A,T,C or G
cagtcatcccccccccccaatattttgttttttaaagaaaaaaaaacttcaaaactcacgaatcaagcccttctctgattacctttgctggaataataccatacccaacctcctgggaacaccaatacaaggacggggggcgaaaaaacatcctcatcaattcactgccatcctttccgggagtctcggtcagcacactctcaatacatcaagcacatgggcccactacgctcggggttctaggtttatttctagtcggttttcgtttcgtttctctatctatcccggggggggaaccccaataaatgtgttctctaaaaaaacacaacccgtcccgggccgccccagtgcgcccccctcggtgagccccaccccccagagctcccccaccccccccccccccaccacacgggccaaccacctacacccctctctagctcgacttcgatgcggccacggncccgccccccctccaccatcgaccagcgcccaacctcatctcaaaccgctgggtgcccgccgcgaacccctcacgactctcgtaggtcccccgcgccaagcacaacatcccccagccaatccgcccgcccacgacacgccccgacgacgcttccgccaccgaccaccccgcggcaacgattactgttaccccacagctatcccccccccccaccgcctgaattatacacacacaaacgcgcacgccccgaacacgaccggcgcacacccacggctgaccgctcgagagtcgcataccccgcccgccatcccgcgaaccgccagccccccccgcctcaacaccattccaacgccccccgcgcctcgtcccgcggacgcgcgccggaacctatagtcgaggtcgatagaataacgacactacccagctaccccatcacccacccgcagacacgccgcacactgagaccccccaaccctgcaccgcgtcctacg

SEQ ID NO: 13109 - DNA, 1196 bp, Homo sapiens
  misc_feature (1)...(1196): n = A,T,C or G
ttatttaaatgtgatagataaatttgagtatgntagagatgagtgtatgatagagaatatgttatagaatatnnngtntaaaagaagaaaggggtaggagnaatataattaataataaagtaagatnattnnnaannntttatnnaannnnnnnataaaannnnnatntnnnnnnnannnannannnannnnnnatnnanntaanantnaanatntnnatnaataaganaaataatgaaaggaaagtggtntgcgtaatgctgcttcatatattcgcgtgcctgaatgaggacggaaagagtaacgagagagaggcgagtccgggagttgacngaatctaggtatattgtagctctaggacgagaggcgcngggagggccggaggcagaagagggctagggaaccaaccgaggcgcgtgcgatgcactgatggctgatgtagggcgaggggcacggaacgaaatgttgttcatacatgtgtatcatatatattacaaacaatgagccaagagaagatgagatgtgtgatcgcgagtatttaacttataacatttctaagaaggcgcggggtnaaaaataatagagagtatattgnagagaagatataagatcagggtgaaaataaagagaagagacgtgtgaggggatcaacttcggatcttctcatgcgtcgaggcgcctcggtcgcctagataagcgtaaaaaagattacacaagcaaggcgtgaatacattagtagattgtatccaacggagaagagagtagggcgcggactccggggcgccggtgcgggtcccagaggacgcaaaaacgcgaaaaacacccccgacacacagcgggcgagatacacacacccgagccatgacgggaactggacgcaggccatgaacacgagaagccagacaggcaaactcacagcatcgtggcaaaacatatacatacaagtgtcaattggtcccacgagtggggctacacagcacgcggaagtccggtgggtctgattganaccgcgagcgtcagatctcggaacaacaacaacaggagaatgaggtgggaccgcatcgaggaggctctagggatatgaggtgtctcacgctgataaaggcgagagatccatgtagtggtcggcggatgtgaggcctccgagccccgctgcacacacagccacaacaaatatatgtcgagaccgagacaag

SEQ ID NO: 13110 - DNA, 795 bp, Homo sapiens
cccttggtgccaccgtcaagataaagtttgactgaccaacttttaacaaagcaaattcaattgaccagatgttagataagtgaaaaagcaaatggagatcatagagcaagtagctatgaccccgagggtggggagaacaaatggaagaagatggaagacaagggaacaccacagagctgagactcagccctggaagagggggatctggtaggctggactagtgtctcagaatctcagaaacgtacccccatcaaggtggacctcaaacctctaagcaagacatgctgatatgtctgaagcagcagtaagggaccagttctgtattgtggaagaacaacaaactggaatcagccactgatacagaaaccagccaccacagccaggatgaagagcagtttctggggtgacacaaacaggagcaagtttgtttgtcatttccagtcttacagattcgatctggctttccttgttggtcgagcctaacagcaagccagcccacaaaggagaaatgtaattttcacagtcccaggcccagtatcacagagcacggtataaaagggtgggtttttattttaaaaaaagaggcactaccttggcaatcaccaaacatcgaaaaattaaaataatcccaatatccaaataaattgcaggtgttaccaaaacacaagaataagggactaaattacgggattagctcaaaacttactggatgcaggaatagattcccatattaacgtatagagaaaactttgttattcttcatgctagcccaactaagaataaattaattatgtg

SEQ ID NO: 13111 - DNA, 378 bp, Homo sapiens
  misc_feature (1)...(378): n = A,T,C or G
cctggcgcgacgaanataaaagattanatggctgacgcttgaggcctcctggctaggactgctggcgaccccaggccacacttgatgtccaagagagaggaatcagtatcttcaccttcctgaagctccagttccagctcagtcagaactgccttttccacagccatttaggattaactgcaataatactcagtgctctcagcaattgttactttcaaatctaggctcttttaaacacaagctaggtgcctagcctctggcaaataacttcaatttaccttaataaagtatgggaaaactaacaaaaaaaaaataccgaaaaaaataacccccacaaaaaaaaacaaaaaaaaaaacaaaatggcctcattggcctca

SEQ ID NO: 13112 - DNA, 786 bp, Homo sapiens
  misc_feature (1)...(786): n = A,T,C or G
acggtcaagatgctgggatgagtggtagtagataatagaatgggcaagatgttagcgcaaggaaggattccataggaacataggagaaagtgtttttagagaggaatggaatgagtggtgcgttcaattattgacttcggtgtatagagatgaatggaagaggggttaagggtgagtatagacgtagtgggatgcattcggatgggtaaagatgcgtactagttaggtggtgaggtgacagaatgtatcggtaaataaataggggggtagtgtggagagaaggctgaggttgtttgagatagagatatgttcgactgaaggaacattcttatatcntagaaagagtttcaagatttatagaatgaaagagttgaaagggagggggcgtggaagaatagaagtgagagtttcgtagggcgatggggagtgatggtatgtaaaagaaggaagctggaggatcgatgagagggaagtggtataggggataattataaattcttaagataaggaagactatattatagttagagaatggaaatgtcataataataaaatgatatggtgaaatatatagttgattatatgaagtatatatgatagtggtagagggaacagatggatgttataagagtgtaagtggatgctggtgatattagaaggtggtattatcacgaagtctgcgcagaatttcggtagtttgtagtaagtgaagctaggggaggtagtataatataatagtgatgagttatagagtagacgtagtgaggatactaaataagaaaatag

SEQ ID NO: 13113 - DNA, 1352 bp, Homo sapiens
  misc_feature (1)...(1352): n = A,T,C or G
gcgcggaggggagaggcagacagcagacagaatcggaggagcacgaccagaagaaagaaaggagactactggtgatgaccagagagtccgcccaccagcggagtgtacgacgcggaaggccgaaaaagacgacatagggagcacaagaggaggaggaaaacaccacggagaaaaagggaggaagagcagcaccggggggccggaagagagcgcaacgaaggggaaacgaaggccgaagcgacgaagcaggagagggatgccagaagacagagaggtgaagagagaagaggaacgagaacggaacgatgacgcgagagaaagagacacgaagagagagcagagccgaggcgaagcagcagaggacgacaggcgcgcancgcgcacaccgcggggagaaacgcgcaacacaatcggcatgacacatgtagaaggcagacacggcgagagagcgacggagcgaaggagccgacgagcgcggcgccgcagccgcgaggagggaagagagcgagaaagagagcgggaaggaggggaagggaaagaggacgaagacgacgacgaggggcgacgggtgcaagcaggcgggggcgatagaacgagcgcagcagaagcgggagcacgagcaacgaagcaacgagagacggggagacggagtggagccatccgaacacgacgagacgagaggagtcgagcgacggaggcgccgcgagaagaggagagagaaagggcgaacagaagcgancagaggagagagacgccgagaccgacacacatcacgagagagagaagagcgagagaacagaacagagagagcgcaggcgacaacgacagggagcgagggaggacgacagcgagagggaagaagcacgagagagacacagaagagncggaatgagggaggacgcggcgcgcgcagcgagacacgacgagacagaagagcagcgtcggacgaccaacacaggaaacggcgcagcacaaaaagaggagagaaagagggagcgagacgagagggacgaacagcaacgcacgaggagcgagggagggaagcggagggagaggaaagaccggagaggaggcgagaggcggagaggaagggggagagcgacagacgaagcaaaagagaggaggactcgaagcgagaaccgccaaccaacgacgaacgacatactagaagagcaagagacaagcgaggaggtggacacgaacggaagagaagaggggccaagacgagacagcgcacacagagagaagcagatcggggagagcagcacngcaagcacgtagagacgaggccggagcgagagacgcaggaacagaatacgnagaagagagtagaaccgaggatagagagcgaa

SEQ ID NO: 13114 - DNA, 235 bp, Homo sapiens
  misc_feature (1)...(235): n = A,T,C or G
ccnttttaatnccaacnnngcgaaaangggggtatnttatttccnaaggcnatattaaagttgggggtanancgnccagggttttttntcncagtcccagnntgttgtaanacnngaccgacccnagtaaatttgttaannannnnntcnccntttnggannnanttngggtacggggncccccccntataggntnggacgggtttctnnnnagctnananggccataaaggccc

SEQ ID NO: 13115 - DNA, 1396 bp, Homo sapiens
  misc_feature (1)...(1396): n = A,T,C or G
gggcgcgagaggaggcagagccgcgcagcgcgtcgagcaacacgccaagaaatagaaaggaggaaggactctttgtagtgtgccaacccatccggcaagcangagacctttntcggacgcgnngcgcacacgaaccgccacacgggcgcgcggcacgggcgcgacggacgcaggagagaagacgcgagagcgacggcacacgaaccgaacccgagaccgcggcgacccgcgagcacgcgcgccgtacggaagagcggacgggagacaggaagcgcggcgaacacaacgaaccggacgagacgaccggggcagccacacccccgtcgtgccggcgacgacacgggcaacaacgccaccacggcagcaaagacacggccaacgcgaatgcgcgcaagccaggcgcggacgaggagcgagcgacacgcacgacgcagacgacgtaccacagacaacggccgcacgccgcgccgacgcgcggccgagagagggacaagcggccgggcgcgccgcgcgcccgcgcgacaccgaccgacgcgcacaagcgccgacgccccacacacacatacggcacacgacgcgcgccgcgaacggcagcaacaacgcnaggagccgcacagcgagtctccgcaccagcgcacgagctcgagcgaccaccgcacgcagtgcgacgcccacgcaggcgagcgcgccggcggagcgacagaccgcgcgcggcgcaccgcgcgcacacaaacggccgaacgcacacccggcggaccgcatccaacgaagcaacgaaggccgacgccgacgagcacgaccgcgcgccgcacgagagaccacgcagcgaagaggcacagaatgcagagacagcgcacaccacacggcgccgcaggncggcagccggaccgcggaggacggagcgcnaggcgcgggcgacacggcgcacgcgcgangcaganacacgngctataacgcgcgcacgagtacatacgaggcagcgagtggcgaagagagaagaacagcaccacacacctgagcgaggcacgagtcatctgcgccgcggcgctcgacgcacggcggcaagtcaggcanccgagcgtacgcgtgagacacgaggcagcggaggagagaccgcacgcaacgacgcgcaacgaggacggaggagacgccgcgagagagatgactcgagacnacacgaccacgagacctcgcaggagcgcgcgacagcgcgtaacaacggcagcagagcgagactacgnaggtccgacacaccggagaagcgagcaaccagcgcaccagcaacagacacgcggtacgacgctcgcgcgacgcngccagagacaagcgcacgacgatagtagcgagtgcacatcgacagacgcagtctcacgacggctagagaatgcagacgagg

SEQ ID NO: 13116 - DNA, 1031 bp, Homo sapiens
  misc_feature (1)...(1031): n = A,T,C or G
ctcttttaaatttaaatcncancacngcnnntacacgatgtagcgcgtcgnacngtcncccngctcngatnngtgagaataagcntaaccgagtatcctgngnagagagcttctacncngcattaagctcacgccagggaggacctcacatcctcagccaggattccaagagttgtacttaaacacctgaatacacgagaacacgccctgtgaaagggcgcggagcagcttggaatgtggtcactgcctcctactccatttcaacttcgtctgttttttttgacctggtggcttggacacaataagcgtagcgtccatgcgaggtgggaatgtgcgtgtggcctgacatcgcatgcttcattttaagcttactcgcgaacgatcctaaaaatgacgtcgcatggctgncaaagcatcgtatgtcatctctttgtacttgagcacggcatacactccaatcgcctgccacagctcagtaatttcgcacttctctcgcatacagtaacgacactagaaaagggcntattcgtattccacataccagccgccttcatctcaccacagccanagcgacttgcgtagnccaaccagctggtgttgaattagccccgtcaccatcactcctacatgtacacgtcatgtgcaattatgtagcgtacactcagcgnacactcaggcagaatgacntaacgatccgacgcatgatacaccctcgactcgcattatgcggtacgtgccctcgcatatgattcagccncgattctcctacctcgacatacgcagacatccaccgagttccctatgtatcagtaattcgacacactcnccagctcaagagntcgtatgtagagcaagacatctccgtcgnnccctcggatctggcgctagagcgacctaccagacgatgtgtntaatatgaatctcgcactgtnttctctancgtcacagaacgcttatcactacnnccatccacaagtatcactctaacnagnnacagcatgacgagctcacgtatcaggcgctactcatat

SEQ ID NO: 13117 - DNA, 580 bp, Homo sapiens
caggcttgtatcttagccaaggagtgcatattgaggcgaaatcctcatcttaagaagcgtcgtggaagaagctataggtaaactaaaagcgtgctggtgaaaagatgttggtctctttctcaaaagatacatcagttcctagtttgagaatatatttcggtaaccctgcgaattccattattgcgaataccgaaggtttggcatcacgcgtgcatcagtacacatcatcatgaatgccacaagtgatttgtgaccggtactaatcgttggtgccaatgcagatagatctcttagcaatggtagctgctgagacgagggacataaatgaatccccgcattacggtagatcatgtttatattgcctagtgctagataatgtacatgcaagggtttataaggaactttcaaagtgcttcgaaatccggtagaatacacatacaggcggtcgtgttttagagtgggttcggttgactgtgcacattatataatcgccgtactgcaacaacaatatattggatgttctagcaaaagagtacgaagctggaagtacgtggagagatatataataactaatttcagg

SEQ ID NO: 13118 - DNA, 125 bp, Homo sapiens
  misc_feature (1)...(125): n = A,T,C or G
cgggaggaggggcctgcttaggggccgaaacgaaaaaagtctttgagaaggggnctggtgtatgggtaaccgggtcccccctncgngagtcnacggtntcgnaaanctctctggccatagnagcc

SEQ ID NO: 13119 - DNA, 557 bp, Homo sapiens
  misc_feature (1)...(557): n = A,T,C or G
cttnaanggggatcnaganttnnccccaanncaaaaggggnnncnttaacaatttttngtnaaaagnangnggncaaaaacnagntngaatnaaggannccnttttgatttggcctgccantattaagngcnataaattantttaagaagcttcaaagtcttgaaactggtgaaagtacnnccagggcaaaaagtagaatttgtttgtttantaatcaattattatcacaatatgtttnacaacatccagatgtgtagaaaaggcataatcctgagcaatggtgcacaaataaaaaatagattatgttaattctggtgaaagctttttaacgtaggccatgaagttgtggacnccatttgatgcagtatttataaacgtttcaataacaatctcaataatactgaactctgaaaaccattctgaaatacatttctatttatgatacctgggtgagtgcacacataatttcttttttaaaaaatttcaacttttaccatttcttatgtaactataataaaagcatttcaaatctgtgctaaaatggngactccaaaat

SEQ ID NO: 13120 - DNA, 1623 bp, Homo sapiens
  misc_feature (1)...(1623): n = A,T,C or G
gtcgcaccgcagtgggtctccgctcgcgcggaccttcgaccgcgaccacgccgcacacgaacagcgcgacgaatcgccacatcatagatccggccccacgccacacggtaaggccatcgttgatatatccgccaagacaccgcggcacgcgtcacttggcgatcgacgacgtagaatgagtgcgccgcatctatacacactactatagcacagaaccctatacggcatacggcgccagcagactgtacacggaatatcgtntccgacgcggagaggcagtaacatcgcttgacgcgatctcgacgctgtcggcgcactgctcagagtagcgtatgatatcacacnttggacgagaaggagcagacgagacgacagctgcgaggcgatgtagatgcacaatatcgagacgtagagtgtgaataagctatagtgcgcgcatcgaccagacagtggtgcctagtcgtgcgagtgactcatgtcaatacagccgatgtcgacggagcgtaggctnacgattcggcgagatgtcgcacatccgtatnatacatgtgggtggcgttcgaaccgattcagtcgcgtcgtgaacgtggtggcagcgatatggactgttagcttgtctatgcacacgcgattgaagacctatcgtatatccgcgcgcgtagaaactgcggtagatcatttgagtagtggcgcgctctactcgacagcgcatacttgatcaattgcttatgtaagcatactcgtcgacatcgcggattcgcatatcaattggtcgcaagctgggttcactaccgcgttatgcgtgtngaggcgcgcccttgcgaggcgataaanagactcagagcagcacgcgttgaacattcatgcacacgatctaccacacgcacgccaagactcgtgaagcgtgacataacagcactatcgagatggagaagtatgcgtcgacgatacaatacgcatggcactaatgatagcacgcgagcacctgcgtacanaatagtcgantgtaatgcacgaacgggcacatgccgtgtaggcgctcgcgcncgcgcggccgtctagcatctatcgcgcgctgatgacatagctangcacacgtctccgcatcgcaacggtgcagtctcccgcacctgtataggcgataacacagaatgcaccgacacgagacgccgtagtatacgtattggagatgtagcagatgtgtgntggctgtagatcatgtcgcgtatcgagagaccgagacgagacttcgcgagagaatgatgaggcacgcgtccagactaatcgatgacagtnanacagcgcgagcccgccagacaatagccagctgatacgtaccgantcggacgtatgtgctcccgagaaggtggtagcagacaactagaaggcaacgcgtcgcgatatccacgcgcgcagtagcgttacgcgatcgacgcagtgagacgattnatcactctcgagcgcgcangacgacatagagcagcgaagcatacaatcatcgtggtanctgacacactancgacacacgctaatataacacggcacgacgcacgactacagaatacaacatcgcgcgagcacagaccagtcacactccatgtgagtcgcgatcacaatactgtg

SEQ ID NO: 13121 - DNA, 1421 bp, Homo sapiens
  misc_feature (1)...(1421): n = A,T,C or G
cgggagggcaaaggaggcgaccacacagaaaaaaaaagaggccctccggggcacgacccccacgggctacgacggaaaacanaaccccaacgcgcacgaaagcgcaagcccgcacaaccgagccggagcgaaagcgcagacgacggacagagccacgaaacagcccggggagcacgacgacaagacgaacaccgcggaccaggcacaggcgcgagccggcgggggaggagacaaggaaaacgcagggggccgcagagcggccggagagcgagacgaaaacagaggcagcaaagcacgcacggcggcaagtgtttgagagacggatacggcggaacgccgaggaccgccacgctcagcgcgcgaccgcaacgaccacacagcgcgaggacaccaggccccaacgagcagagaatagacgagcgagcgccaagcgagcgaacgcgacgagaggaagacgacacgcacatgccaaccaaacacaacacgaagagcgnacgagacgacggcatagcgcgcgacggccaccggcaccgcgggaccgcgaacacagacgcngagagaggcagagcgcaggcgcatgacgaggaagacgatacagagcgcggcgcgcacacgncgntgaccagcacagcacgcacgccacacacgacaccggcgcgcacgacgctgatactgtgacgcgagaccgacggacgcnagcagtgcatctgcacgtacacgacgagcgtgcgagaagaagcgagatgcgatcgcgggcagacacagcgatcatagacactacagcacacaagaacgaccgaaccgcggcagacaacgcgacataataacaaagccagcgacgagcacgtcaggcacacgcacgagcnccgacgagacacggagacgcgcgacagcgcacgacatcggaggagagcagaccgcgnacatgcgcgcatcaagacacaacagcagagcanacgcgcagcggaacgaggacgtgagagctgacgcaggcanaggncgcgcgcggcagaagaggcagngntcgntaccgagcgacagagncacngancgagacaacacgacgcacagcgcgggacgcggacgacgcagatcgagcgcacagctagcagcgcgtgcgcgctagcacatngcagatgcacgaagagcgcacnacgcagactggagcgacgcgatcnacactnacacncgancgacgcagcagagacgacaggcncgcactagacgtcaacgactacacgacgcacggancggacgcantgagcgcacgacgacgacgcacanactatcagagccgantcgcgcgangngcacagataaactgacagcggcagcgcacgcacgccngaagagtgacacgacacgacgggagacgacgcgcnacgcggtcgcgcggcacacagcgaagaacancgcagagg

SEQ ID NO: 13122 - DNA, 1633 bp, Homo sapiens
  misc_feature (1)...(1633): n = A,T,C or G
cgcggcagcaagaggcgacgggctgccgcagcaacgcgccgacgaacacagaacacaacaangaaagaaagagaaagaaagagagagncccttcncgctnatggancgcgagcgcacacaccacaacgcagagncccctccnaaggagcgggagnaaaagcacggagagaacngcgcanagagagagagagaccagcggagcgcggcagaacgnaggccacgcagcgacaacggacgacacagcgagcaccgacggcggcgcgcaaccgagcgcaagagaaccagacacgcaaagacgagacaaccgcacccaagccggacganccgcgacacgccagcacacagcaacgacacaggagcagaagcagcacagcccagacgacgccacacgggcgcgcgcggcgcagagcagagcaancggacagacacgaagacaaccacaagagcacgagcagcacgaacgacacagacgagagccacacgcacacacacaaacgaggcaaacgccgcagccacacaacgagacgagcgcgcctccttcagacaggagcncagacagaggagagccacaacagncagcacagacaaggagacaagagcagagngacaacgcgcgagaggacgnaanacaacgaaaacgaggcgagacatagagacgtagacgcgaacgagccggagccggcacatcgaaggaaagacgaagtacgcagagaacgaggacgcgagcatagaaacaacgacagacagacgcggcgaggcagaaccgcggagagcgaaacgagcggagcggacagcgagacgagggaccgaccgagcacacgaaccgcaggcagaggccgacgacgccgacagagagagcacgacagcacacgacacaacgcggcgaggcaccagcgcnagcccgccacagcaacgcacgagcagacagcgcacagacgatagacggcagcgagcggtagcgcacagcacagancacgcaacaagacgagcngcgagagagcnagcgcgtgcgagagctgagacacgacaccgcgcacacgcgagcatacacgaggcagtctgcgcgcacgacagcacgacgagaggacacgacgagagcagacaagnagacacgaagtcacaagcagacgcagcgngtccacacagcgagagagcagagacacgcaagcacacgtcgacgaggcgagacagacnaacaggnacaggagacaccacacagacgagnacgcaagcgaacaccgacacagcccgagacaagagagactccctactgcgcagcgacgcgacacgcgcggaanagagaagaggagatagcgcgcaaaggagcagcacgcgtaccaggcgacgacgcacgacgcactcacgcactcggaagcgcatgaagaggagagcaagacgccgcgcacgacacgacagcacagacgatacaccagacgcgcacanagagagaccagcgcgcaccgagtagacataagacgganagcgacgcgaaaacacgccgagccagacgcgcagacgagcgggagccagcagcagagacaagcaccaccgcgaaacaagagagcaggggagaagcgagaccgccgagacgaagagagacacagagaggacagaccgaagaagaagaggagag

SEQ ID NO: 13123 - DNA, 1407 bp, Homo sapiens
  misc_feature (1)...(1407): n = A,T,C or G
ggcgggcgagaggacgcagacggcgcagcgacaagacgacanaagagaaaaaaaaaangagnganncccctcctcttgttcggacggcacccacaccaagccctttctgaaggggggagaaccccacaagcnncagggagggggggaggagcgaggcggggacgcacgacggaacaagcgagcaccgcggggacagcgagacagccggagggaggaacagccgcgcgccaagcgacagcggagcccgcacgcgcccgacccgagccgacagaccgacgcggcacncagacacgcgcaggccgnaggcacacgcccccgacgcgaagaccgaaccaagagacacgcagcggagagagaaagnacggaccacacaacggcgagaaggcgcggncacgccgagacgagaggagacgagaccggagacagcgacctccctctctttctgagggcgncggcgcgcgcgacagaggcgggacacagcagccaacggcccgaccgcagagagagggcagaacgccgcgcgcggcggcggcagagcagggaacgaggagagagccgcagacgcgcaacgcacgcgaccacaagcagccccgacgcaccagcgaaacggaaaaggaagaaccgcagcagaggagcngacagcncagccggcgacgagacgacgcgacacacggccnacccgcccgccacagcggcgcgacggaggcacgacgacgcgacacgacgaccccaacgaacgaaggcggcaccaacgcgcgcgacgaggagaacgacgagcgaagagacaagccgaagcgaggaagcagaaaccgcgacagcacaacgaaacgaccnagaggagcgcgcagacgaagaagaggagagacagggacggagcgaagcgacgacgcacacgcgccaccgcggcggccagcaggagagcgcgggaacgcgagcacgaggcgcacgaagcgcgcagcgcggagcgcgagagccacagaggnagagagaagacgagcgccgacgcacacacacacagccgcccacgaacgcgacggggcgcccaagagccacggacagcacnacaccgcggccagagaacgagagccggcagcggacgaggagagacacgcaggacaacagcgccncggagaggacacgaggcgcgncagcagacgaggagcgggcgcgccgagacgcggaacgagcgcgnggagacgcggacggcgagcacacagcccgcgcnacgagacgcgcacagcgncgagnacgcncgcagcggagcgccccggcgcgcagcaccaccacgngncgaaccnacgangagcgcacgcacgcacnaaggaacnagacaacgccgagcgacgcgcgcgcacacgacncncacgagcgcacgcgacagacagacggacacagccagcacganag

SEQ ID NO: 13124 - DNA, 925 bp, Homo sapiens
  misc_feature (1)...(925): n = A,T,C or G
gtgtgagtctagtcggtgttacagcgaacaagagagacaccacaaaaaggctggacttcggcgtgcacacaccccaagcacagcacccaccaccgccgaattatcgacctcgattcttttaaataggcggcaaggagagagcggacgacgcgcacgtcgtacgtagtctgataccgtcaccgatgatcttagcacgacgttcgtgccacaggaccagaaaactggagatgtggtaagaaccaccagagctacgaattatcagcacgaccgccgcactagcaaacttttctttttgtagctgtgggcgcgaccaggcagacgcctggacgcgagctgctactgtaacgatctcagcaagtccacgtaacgaacggcgcagatactttctctctacttattgcgagtacatagagacaccgtctgagtattggcacaacatgcatcggaacccacgaagtctctgccagtagcgatatcaacacatcggacacgcagcagatcaatgagatcaagaatacctagctaagtgagagaaatgtgctccgtcagacgagcagaaagaatagaagtaacagcactacaagtcgcgacaancgaagcgagctcaacggaatagtatgcaatcacatacgcgcaccacccggaacccgcgacgcgtcagatctgggcaatctgacgtgataatacgagtctatcgtatcagccgttacgagaagtcccggtatcagtctgcctcatcacgttgctagttaacctacatcaagaattagtgctcagtaaaataataatagaaagaagaacagctctaaaaccgagagccacaaggagagacccgtacagaggcttgtgtgaaacaagatataactatgtcagtcagacacgtgacacactcacgccacaagaagtgtagcagatgccaagtgct

SEQ ID NO: 13125 - DNA, 1660 bp, Homo sapiens
  misc_feature (1)...(1660): n = A,T,C or G
cgcgcgctagagattgccgaatctctncncgctgtgctactgtaagtatattatatatcacagcaacagcatagagcagcacccaatcngtgtgtatactcaatatatactccacgtaacgtaggacactgangctgncaagagnagacacccgaagttgaggcgatccgtttctagttggaacatacaccatacgatactctcgtctatacatctccatatgctacgttgaatcgtgtgcatcntatcactatatatatatatgaagtatacgtactctacagtcacgcagcgtacgagacatctcagcgcgacatantctcgtcatacaacattaatataggtactncacaataagcactatctacatcatagagataatactactcgcgcntctcantgcgtccgcgcatactattagctcttacattgatgtctgtgtcatacagtatatcagatatatgtaactactcatgagctatgagagtatcttactgtantnactgacgtgctaccgtcgagcgatgtacgcatnacgcatataactaccatccagtcacaaccacaatagncagtcatcatgcctcgtcgtgtgacgcatagtccgatatactgatgatagttagcgntatcacgagtatctctacgcatcgcatgntacaataccacacgcacactgtacatgcgtcacaagcgacgactaaggtatacatgcagacgtatctacatacaantgtcaatgatcacaagttgaatatactaatagagatatgcctcgcatgtagagctatagctgtgatcgtcacaatcatgatgatgatagactattgcggtctgcttgatgtgagatccacatanangctatctgtcgangtcgctaaagagcgcagctcatactaaagatcncntcagttacgaacacatcacntcaactnccactcctccgatgaatacaatacagagtagcgacagtcaatacgcactaatcagcagccgatacacatatcgtagtgatatactacgtggttagtcgagcacgtacacgcgccacgttctgcgtgatgncatcacgcgtgagcanctcgccaactgtcacatactagatatatagcggtnatctagacgcatgcactactccgtacaacgctctgaagctgacataacgtctnttaanttacagacaattatgtaaanantctacacataaatagatatatgtngtaatatgatgtcgtcatactcgtagattgctacgacgcgnagtcagcctgctatcgtgcgcgcgatgttacgctcttagaacgtacgagttgtatcagaccgtntcagatntcagctcanaccgcgcatcttctctacagtnagcgacgtactctnatagagtacgagatatagcatagtctgagtagataaatatgtgtgacatgtacgtctcatcgncncatcantgagctgntgactgtgagcactgtgaatgttctgtgatcataaacggcgtngtcacctgtcnagtaagatgtctctggttgctcntattctagagntagttatgtatgtactattactctctctatgcacatactcgctaactcactagcngtgtatacantatatactantcgtattcactgagctacaacgaacatacnacacatagcta

SEQ ID NO: 13126 - DNA, 1288 bp, Homo sapiens
  misc_feature (1)...(1288): n = A,T,C or G
tcgtactacctggcgcttcccacgcgtgagagcgagcgcgnctacaggcacgttttcgtgtgtacttgtgctcgctggcgccggcccgatggtcgtagttgtgtaggtatggcgaagatggcgatgtgtttttctcgatgttatatcctcatatgatgtagtgttatttgtgtgtcgctgtcgtatctctcctcctaccctcgtccgcntgcacacgattgttatatgtngtatttgataatagtatatatctctagtcnanctctctatatccactcagacacatctaagagaatagaatagctttgaccnacgccgatctctgagggacgtactatgaccgtncactctgtgcgcnaccacgctgcctatatattgtattgctgggacgctgtatactgtagacgtatatagcgcatcncacgttnctcgctcggtgcgacattctttccaggctagtctgaatatgaggtagtcacgctccatnatgtgnctccaccacgagagtantctataggctcacaccactgtacagtacgcagagtgatcgttacnnnnccacngncgcgatgttgatactccactcatatcacgtatagtcacattgtaacgctgtctcgttgtctacntgatcatcctcgtacaccaagcactcgtcgtctctcgnccacaggcacacggatgcgcggcgcaactccagcacgtcagatacacanctgcgatcatatcaccgatgatatcactcgctgcacctctcgtgactctcggttcaactgtgttctatgcactcttctcataattaggtgtatctgacgtgcacactgtattatgaccgctccgagntcagtgatctgtctccgtctctgaactcntgcgcctacgcctcgctntcgtagtagttacgtggtgttttactgaggtgctgtgtcatcgctacttcaccagtcacttacgtacgaaggaatacgtgattgctctccattctntaccctcnatctactctacgtagtgtacgtcgcctgtggtcgacatgatctcgttctcgcgtctcactcgattctnacgctgcgcctccacgctcgcttccatgcagcgaacagattcttgtgttactgttntcttcatgtcgtgaatacngatttgcgtcgtcatgtgtgttncgtcgctagtgacgctncgcgctcagcaccacgncacctctattcttctgcactgccancgtcgcctatctcactcccctcagtccataccgtctccgagatntacntatactgactcnccgcactcg

SEQ ID NO: 13127 - DNA, 707 bp, Homo sapiens
atttacaatgacttttatgatgctaagactaaaagaaaaattttagtatttaaaataatatttaattcatatatatcggaaaatcatacgtaatattacaaaattatatttaaagattcagttattttaaaattaagaataacttgttttttgttgaataaatatttgaatattaagagttattttattgtaagtatttacatactatttgagatatgtttcataattcttataatttataatgaatacattaaattatagtcatattttcatcatataataataaataagtatattttactcatttatatcttaatttaataactaatttattattctatacaatagaaatagactaattgatattaaacagagttacagggttggaccaaatttcagtgatgaaaggtatgctatgagaaataaataaataatataaattgtaagagctaaaaaatctttatgtgttttattggatgatatagtattaataaattctatttagaactaataattaatcattataatttatatattagatccaaatttgtaattaacatttatgatctattagattatccttagtaactattctacgtccttgtatgtattgaattctaataataattatatatagataattctgaatataaaacttattatattatatataattattcttatgagtatgtatgttatatatatat

SEQ ID NO: 13128 - DNA, 544 bp, Homo sapiens
  misc_feature (1)...(544): n = A,T,C or G
cngaaatgggtttcctcaaaaggggnagaagttnttgtattactaancagtaaggttagggngggccaaaattcaaagatgaaggaatgttagagaaaagattcatgtgttggagtgtntgggctagaaaaccttcaaaggtctcagtataatgactttgtacatagaagtccttcttgttaatgctattggccaactaataatgaaatggggtaagagcccaaaagaagtttacagaatagatgaattttacatcatgttatagtggcacatactgtaaattacaaatagctagatggcaatgaagtaagggaagcttacactaaatatgaagacaaattaccagcaaatacaaccattttccaagggaaggacagaaaatccaacttaaatctaacaaggaaagacactctttgattcattcgatatggtcagaaaagcttgagacagtctataactctcaatgttatctacagttctgaaataaaaaactgtctacagtaaacattatgtgacaacatcaatacaaagtctcaataaaaat

SEQ ID NO: 13129 - DNA, 885 bp, Homo sapiens
  misc_feature (1)...(885): n = A,T,C or G
acagaatcaacccaccggaacagagagagcacgacgctgaagcgggcagtaaacgaaaagcgccggaagagaaaaaaccggcgacgggaggacaggcaggaggggggacgcagacatgcngatggaacggagagaaggcaggagatggagggcgagcgagaagagacaggaggcgcagacaagcagaagacagaagagaggcacgcacgggacaagaggacgaacgcgagacaaagagcgccacgaagaagcagggcaacgcgaagcgaggcgagacgcgagcacgcgcagagcaaacgagacggagcgcacgaacacgacagcagagcggaagaacaaaccagaaggcgaacaagcacgcaaccagcagcgaacgagaacgcaagcagacggggagcccgcgaacaggagcaagacggcaggagggagcgcggacgcgagacacgaagacacgagatagaacgaagaaagcggggaagggggaacaagacgaggcgagaaagcgacaggacagcgcaacgagacgagagcgacgagagacacaaggcagaacgaaaactcaagaaagaaggggagagggaagacggcggacagagacgcgggcgaagaggaagaggagcgaggaagaggaacgaggcggaggagaaagaacgaacgaaacccgcaggccgacgacaaggcaccatagacgcacgcacggtcgaggagagggcgaacatgacagacgaaagagcgcaccgagaggacgaagcgagacagaacaggaacgaggacgcggacacaggacaggacggaggcgcaggggcgcgagccaaagaaangagaggaacgggagcgggaacacgccaagcaacgcaaggagcggacgcagcgcggggcagacag

SEQ ID NO: 13130 - DNA, 317 bp, Homo sapiens
cgatatccaattgttccagcaccatctgttgaaaaggcagccccttctccaatgaattactttgcacgtttgttgaaaattaactaaccatataagtatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcgttactgataatcaacaat

SEQ ID NO: 13131 - DNA, 1279 bp, Homo sapiens
  misc_feature (1)...(1279): n = A,T,C or G
cggttgagctattcaagctcatactagattaatgagacaaagataccattttatgagtctagatacgggaaggtcgtgttaccatgcgggcgctaactgcgacctccagtcacgattaagtcacgagtagacaggacacgcggtataggtctcacgcatgtctggcttgctcgcatcgcgcgcacataatgtggacgcgtgttgagcgtaggtggcccacacgtacgagagcgtatgtataatacgatatatactacaatagattacattataggcgagaatacactgtcatacctgttancatatgggcaggcgaacggcacgcgatgtctcaccgcagcagantgtgactgtaacatcgcgtgaccgcacgatacacctgcgatccgccaacacaaacacacctaacacctgangacgaaccgccacaaactctcatccgtacactttcctcacctgagccgctgtagtagcttatgaacacattactcgtcgtgcggtgagaccgttaagatcagcgtgcngcgaacacgactatgactttcgttagtaggcacactacagcgcgatcatatatgaagaggctagaatattcatgaagcgcgtgctatccgaacagggttagaattctacaacaaccggcgtgagctgctgtctaatgttataccgaccatgtgttggtcgtgcgtacatgaatggtaggtcatcaggcgacgatgaatagtttctagatcaagcttatagagttctcgaccgcggtgtcgggtatgaagccacgatagacagcgatgagtagtcgatcgccctcgagagcgcacttcatcacgactcacgagtatactccgcgcaacagcgcggtagagaagataataatatgtnaangcgaaatacaagataataagatatataagaatagacgtgatgaatgaggatgtggttggcncgtccgcgccctgttcatgtcctgtatatcctcactatacttaatgttcgagaccctttcaacacttatacaatttgattacacgtacgatacgactatttgtgtgtgaacgttcacactcaacgagaaagagtaagcgtgacgaataacgagcatagagccaggtggatgtggaacnactatgaacggaccacggatataggaagattcatatatataagaaatgcgcctgtacacgcagaacagtgcagggttgcactcgagactcatcataatattaggtctctcgagagtcgtgcatgcgantaataccatacatgcgattcacatattctg

SEQ ID NO: 13132 - DNA, 835 bp, Homo sapiens
gatagcaaagtaaattaaaaatatacaccctacaccacccctagggcatcggcatggtggttttccaacaagacgaagagagactgggatacacacccagcccccttgccatgtgaggggtgtgcgtccatcaggactctgcagaaagtccccacaagcaaggaggctcttaccagatgcagcccctcaaccttggacttctaagccttcttgactataagaaataaattcattttctttgtaaactaacgagtttcaggtatggctcacgcctgtagggcgagcactttgggaggctgaggatggcacatcatgagatcaggagattgagaacatctggctcaacatggtaaaaatcccggctctactaaaaatacaaaaattacctgggcatggcggcagacagctgtagtccccaactactccggggctgaaggatgagaatcacttgaacctgggaggcggaggtctgcccgagcacaactcgggccatgcactccagcctggaggccaccaagacttgcgtccacacacggcaacctcgagcactcagcaggccacctaatcgggacctttacgccgaaaaactaaatgcatgccgttttccgaagctccaattgacaatccttagattgtaaccgaaaagaattgacgggcatagagtacggcgctctccaaggggacactccacgtcgagggtgccgctcgcagggggggcaactgaagctgtgcgtgggcgagcctccctgcccgccgggggcggcctcactgcgacggcccctctaccccccaaattacctgccccgcccctccacgcccccaaccgatcccaact

SEQ ID NO: 13133 - DNA, 819 bp, Homo sapiens
  misc_feature (1)...(819): n = A,T,C or G
cttactaaccccctaggggagggtaggggggccagcccctccgggtggccctcttactggagagcttccgcccccctaaactgcccttggtacanaanctaaaacttaccctganccgccacccccagggggcccaagggaccgcgccncccaaacctgtnatcctgggaaagaaaaaagatggggcaaggagccccagagananaaaagaaaaaaccaatttccctaaactgtgaaaaaaagggggggacaanaccngccaggaccannnaagaaaaatanaataagnagacctcttatggaccgggcttttccttagttccttttcttcgctgaactcttaagctggctctagaagatgggttattgggtttaaaccaattgggatcgggggactggctagaaaaaccggttcaaatggtttcatggaactatgtaaaaagctctaagctctagagtctaaataccctccctgactctgtctaggggtcacacaggatttatctaaggtattattttaataaagaactgtggacttcttaatcgtatattcttccctcctaacaatatcggtttcgggacgctgagtaatggttaaaggggatgcaactggtggaacttttaactgagggggcccagaggcctcctgggagaaatcggttttgcctttctttggcacaccccgaaacccctgtggggggccttcggttataaggagctgcgtatctaaggggaaatcccccccaccgtgacccgcgctcgggtcttaactcggcgccgtgctcttgggggggggggcagactgggcagggggcccac

SEQ ID NO: 13134 - DNA, 1607 bp, Homo sapiens
  misc_feature (1)...(1607): n = A,T,C or G
ttttttttaatatanntatatgtnaaaaaaatanggtgagaaggtgtatagaaagtagtatgatatgnngnataataattanatgagaggaaaaaaagtaatgtatttgtaatataaaaatatatnttaataatagtaaganaagtnnnanaatnnnaaannannanagannnnnannnnnnnnnnnnnannnanaaannnntannnnnannnnannnaaannnnannnnnnnagaantagnnaataagnnnnnnanaagggagagnnngggagagaggannnatgagagatgagatgagtagctggtattaacaatattatatagacatagaggttggtaggaatggtagactggatatcantcataganatcaggcggcgaggagtagacatgaggaattatgagggcgcggagtcgagtgtagtgtacagantgcgcgcggcagggtggcagttgtgtgtacngagtggcgtggatgttngacagagaagcacacatantatacacctcgttttgtctagtgcgtgatacatgtgtctctgtgtagnagagacaatgaattatgtatcgcanaccgtcgattcaatagtagtatcgaattaagtgagtganatagaatataaaattggttcgtggtgagatgcacacagntgatatagcgatagngatataatgaacacagagtgaggatatcatgagtaagaattctaaaccgacgtggttcgtcgatcctatctacactcagtatgtagatatatgctcngcctagttgtgagtcgggcgcagcagaatataataatagtagagtgtgtcgtaagagtgaggaaagtgagaacgatagaacggcggagcntctctgcggtgcggggcacagcactggcttcttgtacctccgacacaccaacgcgaaccaccaaccaacacacaacacaagacgagaaccaggagatgcggaacgccgcgatgctcgtctgataccatcttacgtgcggacgtccgcgtacctcacggtagcacgcgtcgtgcgcnccgcacatacgcgagcagggctgccccaatatcacgctgttnagcacttcgtcatatgtatcgttcgtaattacgatgcgtagtgtntgagaatatatatttccacagtgcaggtcgcagacgagcacacgactgcatacaagtcaagcaatcgnaggtgttcggtagatgcgatagcagntactatagancgtactaacggcgcatcttatatgtctgctgagtgagagggcgggatggtcttaacatatgagagacgatacacatacatcgaccnctacgagatcgacagaagngtcggtgtgtntctcgcacgtagtgtctgacggtacgagagagttagctacctataatcatcatcattgtagataatgatctagctagcgcactantcacctccatcgagaagcatcagatcagcgcgcgatgccacaggaggcgcggcgccgtaatggagaagttctcagagtggtgacgacaagtggtccgcagtggcncntcgtgactataatcacgcacgcntcactgtanagccctacgatatagcgttcaatagaataaggtaaagaggatagg

SEQ ID NO: 13135 - DNA, 1473 bp, Homo sapiens
  misc_feature (1)...(1473): n = A,T,C or G
tattttttgggtggagttttttttattgnnnnnaagagaagaaggtggagagntatgggtgnggtgtggaacggagnggaagggannntngttttgtagaggagaggtgctatttgtgngtnnatnatatttttattgtgnnnnnnnntttcanngtntannnnnnnatanagngnnnntngagttnnnntnnnnnnattatnnnnnntnnntnnnnananttntnnttnattnngnnaagnggggagggnntgggagttgnnanctgttgtaatgttttcggatgctttgtgatgttatatagtattatttataagaagatagtcgtggcgtgatgtcgcggtgggtgacgcgaggggtacccgcagcagtattttacctctttcaacttatgataggatcacatccaggatatgtggctctaagcataacatgaggtgtttatcgatggcgtgtagtacgctgagggcanggtgtgctttggtctagtggaggtgtgatggttgcggtcggctactcgaatgggactgttctcgcacgcgcgcggtgcanangagcggactattgcgtgggcgtggggaggattatggtggagtgttgtagaggctgagtttatggaaaggttagttggtgttgtgtgtgtggagtttataaggcacgagcgggcctggcgggcccactcaagaggcgtcagaaatcaggagcacgagatgagagagtaaaagtgcggggccattcgctacggtgtcgtcggcggccgnggtagtatcggggaggcgctcggctcggtacgtgtgaagggtgagggtgccgcgggcgcggcgcacgccgttgtctgggctgtactcacgcgctagacatcgtcggctactatgtagtctgtnccacgtcggtatgtacgtcgaagtcgagttttggtcgtggagtgcggaggtcgttgntagggagtactttctcgatgttgtgtgtacttccactcgctgtctctgatatgataagattcccttacatcgagtacagtgacgatccatgcaccgcgtcacactactcantcttcccctccgcttcgtgtactgatacttantaccttcctactctcgctcgcctgtgtgtggcgtgtgagtggcggtgggcatgatgatgctgtgtagttagtggtgtaggtgcacgtgcgtcgtgtnncccggcgtgatgtgcccggcgtctgcggacatcgtgtccgcggtgcggagtgtagtnttctactgtgcgatgcgcgagtaagctatggcggtgcgatatcgatcagatcgtcgcgcagcgtcggtagttactcactatattgtgcgttgactcgatgctgtggtgttctnnttggtggcgtttgcgcgagagtgtgcggagtagtggacttgangagatagtncttatgtgttatagatcgtgacttacgagcgtggcgaatgtagagtgagttgtcgcgctgggtgagcg

SEQ ID NO: 13136 - DNA, 934 bp, Homo sapiens
  misc_feature (1)...(934): n = A,T,C or G
ggaaagggagatgcaggggaaacaaattcaggagcaacaccaacaaaannccttgntnggtgactgcaggaggannggtaagaaggagccacannccganncaaccggccgccgaggggcacgaagagacggaaaacaagggcaaagagcacaccacacccagggcaaggagcgcacggccgcccagcgagacagaggacaangaccgaccgcagcgccggaggacgnggacggcccaggcggcnccacgagccccgagaagccagcgcaaacggccatttttgtatgccgctggcccaccagggaagaaaacagaggccgcatgactggacatcaaaggtgcgaatgggaaaagggaaagccctccggagcaaagggcttgagagtggcatgttgagtcacagagagagtcccagaaaagagtaacaagcggctcacagcaaaaaagaaccacaagcacagtgatgatcctcagctcaaaagacgaaaaaggcctcttgctcgaaccagagatggggcactccatacacaaagcgccgaaccggacggagaatctctctcgctcgacagctacccgccgggacccacaccagaacaaaccccccaacgcgaattttcaacaccgggaggcaatcttccagacacgctccagcgaacttaaaccctcagacatacgtaccagagagacgccctacacaccccgaactcgggaacctacaaacccagcgagaaaccccggagggctactaaggaacaaagtcacacatccccctcggggtttacaagtgagacatcttagagaaaaggctccaaacaagatgacgcggaacaagggctgattagggcacacaaatgagttcaggctgaggcctacaacaacacgcgctctctagggaaaacgcagccgccgagcacactgtatccggggagattg

SEQ ID NO: 13137 - DNA, 1608 bp, Homo sapiens
  misc_feature (1)...(1608): n = A,T,C or G
atagagagaggtgagtgagagagnggngagggaggganngaggnagaggtnngagagggatggggtgngtgtnannggtgtgagtggtgnggtannggggtngnaagtatggtangttgttataatgtgtgtgtaatgtagnttgagntgtgggagtgaanaannanagagagtnnannagngntatnnnntnnnnnnnnannnttnnnananannnnnnnnnanannnatnnnnnnnnnnnannnnnnnnnnnnnnnnnnnnnnnnnnnnngnncaannnnnannnnnnnnananannnnnnnnnnnnnnnaannnnannnnnagacggngtggangagggnanggannnannatgtgcgaagaggttacatncagagacttctactntctcanttaaaatgtctgatctngntgtacgagagaatatatcgcgtgctaatgtagttgctctatagacgcgcacggagcgacgagaggcagcatggcttggagacacatagaacacgcaagagagaatcagcagagacgacagcttcacacactggcacggtctgtgcgccntcntatctgtctcctcacgggttgtcttatcggtgtggtcgatgntcnccnactcttgttcctcaccaagtacatnatcgaactggagaggtgaacacgcacacaagagtctactgaacctcnagtgtntaggtatagagcaccacgagacgagtcgctatcgctcacgactatcgcaccgatctcgncnacctgctntncacatcgatcactggtgtctctccacatctngtgcatgcccgtcgagtttattcgcgttagtatgtcgcgagttcgttatngatgtgtgttntagggtggcggtaggcggatgtgacatngntattgaggttaggatgtgggtgagtgtgaggntggtaggtggtgtgaggtagtggggttgtcggcggtgcgttcgtagtgagaggagaacacaagaganaccgctcagagcgatgcacacangccaccgggcgcagcgcagcgacacgagcgcggaggtcagtgtgccgcacggcccntcgcactgtagtacgcgagcttgtggagcgagcgtcgtgcgcggcgtccgcgcgtgcttgtgtgtctcccgagacactctcgttgccntctatcctgaggtgctcagtgtgtcgtgcgagagagtgagcgntgttggccgatgtgaggcagttatagttgtaacggtcacagnggagagcagntatatcatcatctgatgttcactatagcgatggtcgacagagcgcatccatggtcgtccgtcgctcgcggccgctccaccgcgacagatcgtatagtctgccctagagacactgccgcgatcttacaacgagaagaggagagacaatggaagtgggaaatggggtgagagagtacacgtgtggtcggcggcaaggagcaccgggtacgagattggaggtgcactacaaagcagagacatggctggatgtgggcggcacagatggagatggtgtgatgtatcaggatgtgcccttagcaatcgagtggattagtgatgcaagggtgatggtcgntgactgtgcggtcgccattctgactcggc

SEQ ID NO: 13138 - DNA, 830 bp, Homo sapiens
  misc_feature (1)...(830): n = A,T,C or G
caccaaaagagtacattaagcactaaaaaancctgttgtgacgcagccagctgcagcgggaacatcttcctagctttccctcccacgagaattatgttcacttgacttggcacagaacagacctgaagtaaaaccctgacatggccctaacacctttgaaatttagaagctttaagatatactaacctgagttactaaagatcctaaagaaatttagctcaattgagccctattgatagatgtaataattgttttttcttctaaacattgagccattatttctagaaagttattttgaactttgcaattttttttgttaaatgatttatagaggtcaacttaattaacctctagactgtgttcattgatgtacacaatctttagtccaggagaacttaaatgtgaataccattatagataagtggcttaaaaatttttctaccatgttactggtacaaaaacagacacttagatcaatggatcagaatgaaaaactcagaaataaagccccctacctatagccagctgatctttaacaaagtcaacataacattcactgggaaaaagggcatcctgttcaataaaagggggctgaaaaaatgggtcggcacatgcagaaaataaacctggacttctctgcaagggaggttcttagaaattctcttcataatggggataaacggaccctgacccatatccctcacctactcaaaaaaatacccccgaatggataaagacttaaagcgcaaaccggaacctcaaacggccacagtccgatacgctaacgtaccgataacgaagcatctccaagaaaacggctcaaactctta

SEQ ID NO: 13139 - DNA, 105 bp, Homo sapiens
gggggagaatgatggggggggtattataatatatagaagaaaggtatagatatttaatatatttaattttttgggtgggaccgagagaaaaagtttttaggggat

SEQ ID NO: 13140 - DNA, 795 bp, Homo sapiens
  misc_feature (1)...(795): n = A,T,C or G
cctagatggactcttgctctgtcgtccaggctggagtgcagtggcgccatctcgactcattacaagctccgcctcccgggttcatgccattctcctgcctcagcctccggagtggctgggactacagtttatcctcttttttcttaggacagaagacagtgacatccacttcagtttttggtcctgtactgcagggactggagaataacctcagcaaaaaaacaaacaaacaaacaaaaacgactaactgtataaatgtgagttttgtcaaatatagtgcatttttctcaagggccaggctagtttcttatttttcagcccgtatttggtcactattcagtgtcttacatagttattctttatattttatgttgagcttataattgttatctataaaaggctcactctgataacagaaagtcatcctctactagaattaatactatgtgaatatataaaaagtttcttatatactgcttgtgaggtgaataatttgatatatgtacatgatttatatacatactatttagttattacttaattatggtaattaaattcttatcctttttatttttgttacctgttttttagatggagaattatgaaatctattttgggtnttttccagttctctttttattttttctggctcttttcttttcttgctttggataatttattgctatattactgagtgcgtaaaggtacttagttggtgggatccccgttctcataaaccagcttcttttggtcatataatcttttgaatttaaactaaccataaggattggccct

SEQ ID NO: 13141 - DNA, 805 bp, Homo sapiens
cctagggaaagtgaagaaagaaaatggagaagaagaagaatcttccagatgtgtttcagccactgcagaggagaatcttccagatgcgtttcagccactgcattacagggaacaccacttctacttgaaagaacaactgacagaaatgaagtttcaccacatttgggcatttggcagacttcctcaaaaatgaatgaagtgagccagtcacttcgggaaaacaacggacagtagctattgccagtagcaaactcaagctttcaaggattaagtagaaatttggaaaacttatctatcaagcaaagtttcacagtttccgaatacttgaacgtgatatgtcttatattagataataaattatgccaatgtttggaagatttatatgtcagaaaatcaatattccccaaatgaccaatgcatgatgctataaaatcattggtgagtaaaatatttattcgaagtgcaagataaattagtgccttttcattaaaaaagagtacaaaagtgtattcatatcgtttcagattacacatcacaagaaactttaaaaatccatttgtaaagctttcgggtcgtatgaagaacaaggatatccatagttatctgcaaaggctttttcaaccattatccatatctctgtgaggcttgccatttttttcatatacccttaaacaaaacaatgaattgtgatatcttgaatgaaaaagcttacatgagaataaagccttattttattagggtgagtcattaaagagataggcaaaactattaagcaccgccctttttttctcacctgcttttaggg

SEQ ID NO: 13142 - DNA, 762 bp, Homo sapiens
  misc_feature (1)...(762): n = A,T,C or G
tttcggctctcatatnggccgagtggactccagtgggtagaaaaggagtcctcagaacaaaactgttggagacgaaagcacgtcaatgtcagagtagggatggaaatgtgcacatacgaaataatcaataaataagtgctaagaagagatgtgaagggatctgagcagaatggtggttattctctccactattttatttttattctccatttcttcctaactagccatagtgtaaaatgatctaccttgggagctgaggggcttgataaggactttctttaagagataggttcttcctcttgttgcccaggctggagtgctgtagtgtgataatagcttactgcagcctgtaacttctggacttaagtgattctcccacctcggcctcccaggtagctgggactacaggcatgcaccaccatgcaagacttttaaattcaatcccatattagggaaatccatccaaatgtggtaaataattaggtattttacactatccaaatgtatattgaatatttggatatttaccatatccaacccgtaattattagaagattgggggcctacccttatgtcatggatttcaaatcccccaccccatggtgggattagatttttctaaatggggggacggaacttgggtattcttttgacagggcactttggggggtccccaccacaatcttcggggcacaccaccctgagggattgagtaaagattccttgccaatcgttcacgtttctttcttccacctctaattg

SEQ ID NO: 13143 - DNA, 394 bp, Homo sapiens
cagagcttccatttcaatatgggaacaacatcttgatttctacaataaatccaaatcacagaaagaatggaattaattgaagatctcctttggcctttgcccaagttggctgtgggagagtttggcagggtacaggaacatctcttggagaaatcagctgacacaaaaaaatccatgcagcagagctccctagggaaggagattaaatgaattcagaacttgatttaggccagacgtggtggctcatgcctgtaatcccaacactttgagacactgaggaaggaggatcgcttgaacccaggagtttaagaccaatctggaaaacatagcaagaccctgtctctattaaataaagataacaaaataaaacatttttaaaagaaaaaaaaaaaaa

SEQ ID NO: 13144 - DNA, 836 bp, Homo sapiens
  misc_feature (1)...(836): n = A,T,C or G
tagataccagtgattcttactatatatactgtggagctggatacctgcataataggaacagaatgaaggtgtgcttctaccgctgaagcttgcaactgacacttgtgaagagagtctatggttcatcaactagatgtatgtgctgggattacgcaccatcattccaacacagatgtgtctattgtaaaaatcatacccattgccctaattaagtaatagagaaccctgttctactgtgttccctactacaaatgttctcacctctcatgcctcagaaaccaagacatctaatccatcagagcctaagatttcagaggaaggaagcataaattcctcacaggtgactggcagtggtggtgagaaaggccgttcttctttcatcaatgaacttgtatgttctaccatttgattcaaatttcatatttcaggaaatcatttcaatgcatacactgtattcttgcagaccacactgcaaccctgacgagcgttggacatgggaccatagttgagtctttaataagaacgcccttataccattagcctggtaattttggattatatgacctgggatagaattagaggatctcataatcatggtcctatttgccccctgtctttaatataaaatggattcttttaaactgaaaaaaaaaaaatgtgccctcgcttggcctaatcggtggaagctgtggcggcgttttccttttagggaagggtaattcatgatcctttgttacctggcgtgtttgggctagggacggtgcggtttgcgccaacacgcaatacgagttcactgcaagaggtggggtatatccgtttctccacacataatnacg

SEQ ID NO: 13145 - DNA, 549 bp, Homo sapiens
cttggaaagtaaatataatcttatagattgatcagaaagtggaaaaagattgattcaccattttgaagaacagaagagtctaacatttgaagggaatgagaatgaagatacccacgcaaacccttccaaagctttcatgtgtttcaagttaaaaaacaggattttgtgcgtgcaaaggtgctgcaagcggaggctgctaatggctcataactgcccccttctccagagatttcctcttggacatttgcctgggaggttacctcgccacccccagcccaggggcagcccacctgcaagggctaatggacatgaagaatacaaaagaccagccaaccacatcaagtgtggaacagttggagatgctttaatcatgggcggagcttcagctcaggccttggctgaaaatcacttttctactaaaaacgatgaggagtttccagggagggcttgtaaactagttatctctgttgatgatcacatctgtgtgcacatctgtggtacagaaacacgccatacaataaagtgtttcttgtgttaaaaaaaaaaaaa

SEQ ID NO: 13146 - DNA, 1102 bp, Homo sapiens
tctccgcatgtttgctccctctttcccctaccccaccttaagagacggggcttcgagtgttgcgtaacgtgaccatttacatgtgattcctatctgtgtatctgcccttctcccttgggatactatggaataaagaagggggttcattgtgctacctttggaaagcatttgccgggtaaaaaccgttattccttgtcccggaaagatttctcggttcattctttcagaattaacttcctttggttcaattgggccccggcttattgaaaaagaataaagtattctcccaacaatcctgggtggttcacctttggagagcggaaatttggttattggaaccacaattggggcaaacctagaaccttgctctttaagtaaattcttctggacaagtttaaaccaaggtaaggttcatggcactcttcctatactctgggagagcggaaacacacaaacccccttccatatggtcttacttctagcaaacaggccggtccttgacagtctcctggaaaaatttttcggatgggccaaaggaatcaacaaatccgctcctcgctgaccttactgaaagaaaacttgtatggcttttttcttttatcgacaaccaaactctatttggttaaaaccgctaacttaatctaaaatgtcttaatgcctcttggcacacccaaagtcttcttttttctagaaataacaaagtatggtcatcactccaccctgccaaaagaaaaaaaattcgggccttcttcggcccctcagccggtgggagcttctggcggccccttttcccctttatatgaaggggtttatttcaatgagttctttcgttcatttgaacctcctttccactcgggacctattcgaggtcgctggcggtcctgttttttattttacacccataaggccagcaacgtccggtcttttctacagatattacggggtataacccgctttatattaccattgttgaccacatacggcacgcccaaaggccccatgaactccctatacacgctcggcacacttgaccgtgtttgacataacccttcctccccccctagacaacctctaatagcagtggccgccatgaatattggcg

SEQ ID NO: 13147 - DNA, 1508 bp, Homo sapiens
  misc_feature (1)...(1508): n = A,T,C or G
agagagagaaaagtagaaaaaagaaagaaaaagaagaaagaagaaaganaaggngggaanaagataaaggaaggagatgnagagggnnnaagagaattttgggagaggaggaaaacaggagaactggtagcacattggagggataggagaaggtnctnatggtgagagntnnagttgaaagtctaagtcgctacggggaatatctgaaggataatggaaagagagagagagaaacaatatgaaacttatgtcacggtgagagacaaatattgtgaaagagatatattatttcacggtagtgtctatgtaagagacgaagagaagngagagagnnatgaggagggaaagtagtagagaaagcgactagtnccagacgcaaaaaaggtaagtatagaacaaatactatgtacattaaacaatatacattcagtcacaaggagtnnacgtccgttgacggtggaatgaggataagcnnggcgagacgnnnctcagtcccatacagccactactcgacacgttatataagataatgtcncccggaagcanacatgattaatagccccatgaatactacgattaatgtggcacggtagcnactgcttcgtcttaaagcaggcacagacgcgccntacaccagaccacacgatgcgcaacaccnccaaacacgtcccgccacatacacaaccgcaggacaacaacctcaggcgcagtaggtntatatacttactgcgcgtcctcngtatggtatcatcaattagcgcncgtgcgctggtgaatgtgtctgtcgtgactcgcgcctgtcgcatgaatagacaagactatacgantntcattaatatatactatattatgtattacgttctactgtttcactatctcactacgccactcttccgtgtctccgctcgagcgcgcgccgagctgncntcgtgtgcgatagcagaagtgaagttntattgaatcacaggtacgagaagatncnataagatcgatagcgacanagagttcaatgttgatagttgantctaatatatgaggatgcagtgttagtaatgagacgtagatgtgtgtactacacgagagagaacgcgncgcgtgagagccgaacgcacactgtgcgcaccagtgcgagtcactcactcaatacgagttatcacagcaacatatccatcacggntatagatatgactccctatgatgttngtaagacatactagtaattnctattactatacgatctccacacaaagactntctagaaanatagatcnatcgactaagtcacctgccacanaanacgcccgactcgtcgcttcnctgcatgacgantcgngtgtgagantcnancgagagatagtagtgcgcgcacgatctgaacngtnacgagtatcgatgttagcanacaccacagcatgagtgnntncgtactgatcatgttagacgacagacatagtatactgtatgagacagcagtagtcgcncncgcagacagatagtntactcatatg

SEQ ID NO: 13148 - DNA, 200 bp, Homo sapiens
ctttaggttaataccctaacaagtgaaatttgctggatcgaagcacatggacaagaagtatctgtggcacttattgcagaaagtttgcattggtggaacctcgagtgtctgctttcccacatccttaccagcactgagaattttctttttcatgttttccacctctctgaaataaaattaatacctgaaaaaaaaaaaaa

SEQ ID NO: 13149 - DNA, 841 bp, Homo sapiens
  misc_feature (1)...(841): n = A,T,C or G
caacacctctactttccttcatcatcaccacccagagagcagcgcctcccggggaacaccggcccagcgttgggagagacaacagaagatgggcgncgaggaaggcgaccgcacgtttcgggacctactttgtggcggccagacacttcccagcggggaatgttgtccatgagggcttcttcgaatataacgtcctgccgccgaagaattaacttgctaaacgtaacgcgataggtggtagacttattcatccttggatatgaagcgtctataaccaccattacctggctgtgcgtctgacccctgcgggtcgcatgttctttgtgtgcgcgatgcattgtgtcgtatccggcacccacactctgaccaactcctccgttcgccctcactctcaccccctctctttatccttgtatcattcacccgcgtgggcccctagaccactattatttatattagtttgtacggccctatcggttgcacgttttcaacaaaccctctttcccgacattactctcaccgcacccacgcctcacactttaatcatactcagacaattttcaactcttctcaccctgatcagactacgccgttatccctcttccacccctccgctttcccatactactattcttctctgtctatcctatacctccttcccccccattcctcacataaaccacaccgcccgctccccccgttcatcttctttcccctcctcctccttcttcccactctctccttaccccctctcccttcacgcctcactccgtactacacaaccacccttgtcaccacaaccaaggaatcagctcggtgctgccggcccgcaataccccgc

SEQ ID NO: 13150 - DNA, 1272 bp, Homo sapiens
  misc_feature (1)...(1272): n = A,T,C or G
aaaaggaagtgaaaaaagannaaaaatggaagtataataaagaagtataaagataataatagagagatgaaaaaganaaatatatttcttagagtacacagaacggagtcttgtttttggtaatataaacaccctaaataaaatatgaacaatagtagaacaggacgtaacgtttatatattcatgtttaactaactacattatgtatagaatgatgatccctattcacctatgctcactaatgatagtcctatataaagtgcaattaaatagttcatagatataaatccttttatatattttattaaaaactgacaataaaatatactcagatgattgttatgtttagcctttcgtctttcgtaatatttttgttctcattctttgtattatcttgttttcttgttatcttattgtctgtcatatatcagcattaggtgtcatataattttattgtttcgtcctcctgtttgacttataactttacttatttcatattttgtctattattcttttccttcacttctctcaacaatatagttatcttttatatattctatatacaatatgtccatatattcctattttatttatattttcagctctctctccagtttcacccgatcgggaccatatcaaactagctacacgcgacctcacattctcgattctacgaacttcgaagcgcgccatctcgtcctcatatgatccacctctacatcacccattatgtgctcttatttgattttcgcttccacctcgctatctcatagatatctctactacgtccaccaatcagcactctttagttattatgtgactgtcaccagatcttctcatagtctgtgtttattcgttcatatatgtagatcncagatgtaacanccgttgtttgattncntcgtatttatcgtcatatatcagccctcctatcatatatctcttatctccatcgccgctatatatttctgtatttgataaaccgctcatcgtacctatgttatctataatatntctattatttattcttgtataatgcccatcctatgatagatnctatatcgtgctctagtatactcatatatcgtgttatcggatatatatattgtattcagangcggatttgtcttcattttgatatctcgttttcttattatacccgcatgtgctatatacactgatatatttaactcatattatgtnnctgataagtatacagacatatattataattatatatccatatgtagcaaaacactaagtaggtccgtt

SEQ ID NO: 13151 - DNA, 466 bp, Homo sapiens
cgaacatacaggtagatgatagactgaaaagtgggttctctatctgatgacataggtcgttctctctggatggcctggtaaaaaatgcttcctagagtcatgtgcctaattaacaacagttgtctccttaaaagtctatctttgatttgttgatatgataatccgacacaatttcttgttatggatgcatgctgctctacctcttcaataaccccactatatattttcaccatgtcatgtataggcacttatttctacaatgataacattgccagcttcattgccactattagaccaaaatcaccttggttcagaattatttcggctatctcacacatcagtcaaggaatgaacaactgctgcctcattactgatgttaaaaacttcaatatctacttattctagctcactgagtaaagccatattgatgaaaataaaaaaagactgtcggactcgttgacctcat

SEQ ID NO: 13152 - DNA, 871 bp, Homo sapiens
  misc_feature (1)...(871): n = A,T,C or G
atgcctgcaccatngatgntcattagtagccntaaatataactaacagggttggtctgcctttcaaaacgtactaatcattatagattcttgttcgcatatgtaataatgcactgagcagaaatattacattgttaatggaagtgcaatgcctgcctctacgctcacttcacataacgcgccacgtaataatactttgtgcactcattgtacagtgctaatatgcgcagcattatttctcgtaccaactgattgaacaaattgcgcatgcatatcgacttgcacaacatatctgtatccaaataatccactctagtggtttgcatgacacttgattttgtcggcctattcntcgagcactatcatggtcgaagggaactcgaatcaaactagataacactactattacatagatcgtttagaaaaacatatcaactgatctttcttgttcttcgtagacttcatcgtgatgtagaagctcatgattgtttcgaataatgaaaaacaagacatgtggggctctcagtgtgggccgttagacggatggatacttacttgcggcacggcttgacacttctagatggagggttgaattgcactggatcctggactcacctgacctcgactgtcactactgaacgattactaatgacggataaatcggaaattatactcactacgacggacaataaatacctagaatccatcataattcctgatgaatcctactatgatggtagcttgtttgttcataatgaccttgtgtatccgctactttacttgctaatgaggcgtgcgaatgctgcatgattttgccgaagtcttcatcacactggtcaggtgaatgacactaatgtctctaattgattaag

SEQ ID NO: 13153 - DNA, 254 bp, Homo sapiens
cttagattttactactctgtaagagatggatatggtcttgtttgctgatcatctccggagcctagcacagtgtccggtacagagttggtgctcaaaaagtctgaccagatggatggatgaattcatacctaaccctgccagactacccctaaaggctggtgttttcaaaaaaatacaaatgacagctaataaattatctgttatctaccgtcaatcagctggggtttcccagaatagtctcaaaaaaaaaaaaa

SEQ ID NO: 13154 - DNA, 638 bp, Homo sapiens
acaggctccctggtcactgggttcactaacgcctaatgcttctctaattatagacatgtctcattcctggctatttaacggcctcaccgcagggagtgactccacatcctggctggaagcctaccttcattagcttaaactgtacatcataaccctctagttttgcaataacccaagggaccctccctcccaggatgatggcactgtgacaatgctggtattttaacatggaggcagatgataagatttatgacttccagctttaaaatgaaaaaggtaaaactctatatgatattttcaaaagaagtcgtctatgccgataatggagaagatacagggagtttgttctgcccattttcttcttaaaagtgtcctttcggccgggcgcggtggctcacgcctgtagtcccaacactttgggaggccgaggcgggcggatcacaaggtcaggatatcgagaccatcccgggtaaaacggggaaaccccgtctctactaaaaaaatacaaaaaaattggcccggcccgtggtggcgggcccctgtaatcccaacttactgggaagctgaagctgaagcaggagaatggcctggaccccggaaggcggaccttgcattgaagccaaattcccgcccttgcc

SEQ ID NO: 13155 - DNA, 219 bp, Homo sapiens
aggttctgtatgtgttacaggatggcaggaaatgtttgaggcctgggaccactaagcacacatgctgatgcatacattgtgacctcatggaatatgaacagactggagtgaggaagccttcattaactctgtctctggacaagcagcttcagtcctctggaattctgtcttctcctatgtaaaatgtggattaaaatgtcttttctgaatttaaataaa

SEQ ID NO: 13156 - DNA, 810 bp, Homo sapiens
  misc_feature (1)...(810): n = A,T,C or G
ctagtggggacctagaactcactgtgagtgcagcttctcagggctcaagaacggcacacagcagtattcatatttggctttaaaaagagagagagagagatggcaacatgaagagattgattcaaattctcaacagttcttaaattttctcgtcatcatttcaactccaatgcaaggctccttcactgcacaaggatatctgaagatgcctaaaagcctcagaatatcaggtccaaataagattaggactgctaagagccatcatggatatttctctagcaatttcagcatctacactggacaaaggaggagcaaaagttgaacaaaaccagagggctttttctttttaagaaggaaatgaatgagcataactctccatctcctccttgctcccatccttaactcttattaggccataaactattgcctaaggactcattatcccaggcttcagcggcccttctccaatggtgggaagaagaactccacccactacatcatcttaatcagcaacttagaaaacagtgccacataaaacagcagcagacctgaaaaagtgcagtaattgcaatagaactgctaactaaccattcagctccacttctgcataattaagaaggtgggttatgacaagcatttgtggcatttaaaacattaaaaggaaaggtagcagaacgagccacaccagagccttgcagtcactgaaggnagaggaggtnganaggaatcaggctgaacctaaagaaacacagacccttttcttattagagtctctatccccccaggnggtttttttttctttcccttttg

SEQ ID NO: 13157 - DNA, 536 bp, Homo sapiens
cttagtgcatactgagagcgccgtttgtgtgtagaacacctcaacaaatattcgttgaatgaagagaaattatggaaacttgcttggcagtgatatcagctcctgaactttgggaagattccctccagggagggacagcgggaaaaggggtggagcagggctttagtttagtagcatcttctaaacctaggtagtgggtaagagtggggccgttttaaatttacgtttgaggctgggtgcggtgtctcacacgtgtaatcccagcactttgggaggcccacgcaggtggatcacttgaggtcaggagtttgagacccagcctggtcaacatggtgaaaccctatctctactaaaaatacaaaaattagtggggtgtggtggcgcgtgcctgtagtcccagctacttgggaggctgaggcaggacagtcacttgaatctgggaggcagaggttctagtgaaccgagatcaagccattgcactccatcctgggtgacagaacaagacttcgtctcaaataaataaataaataccaaaa

SEQ ID NO: 13158 - DNA, 366 bp, Homo sapiens
  misc_feature (1)...(366): n = A,T,C or G
gctaggagagcaaaccaaatacccttgttctcacttataagtggagctgaacaaggagaacacatggacacaggngaggggaacaacacacactgggtcctgtcaggagagttttcatcaaggtgcatacagtgatattccatctcagcaacggaggatgttggagattatctggttccaccccttcattttgccagtaggaaaattgctccaaagaagaaagggaatttccccaaggtcacacagctcctgagaagcaagctgaggctggaactcttgtgtcctgctcccaagttaattctctttcctctgtattttatatcaaaatagagaaaatgtgaaaacattaaataggagaactcaaaa

SEQ ID NO: 13159 - DNA, 171 bp, Homo sapiens
ggaaacgggaaggaaagaggaaaagaagaagaaggaagaccatctaattgaagcagaaacattgaagtcagtgattatttgatgtaaaacaaatctagcagcacagttaaaactatttattagactaataaaggtactttttgtttctttctactttcaaaaaaaaaaaaa

SEQ ID NO: 13160 - DNA, 362 bp, Homo sapiens
  misc_feature (1)...(362): n = A,T,C or G
tttcaaataaaacgataaaaaacattgcgcagcaatattaccaccagcctcaggtnagaagggcagcctgctaggtgaagctagatccacatgccagaggctggccttcagaagggaagccaagatgatcagcagtgctaagaagcaaagctactcttgtggtatctggagcttttgcaagcccccaaaggcctgggaggcagatggatacaagccaaaataaggatgtgcactacagtgtatgagaatagctacttcctctccactctcacccatgctgacatattgtcaacattataataaagtgttgcctttgctaacattataataaaaagtatacatagttattaaaaaaaaaaaaa

SEQ ID NO: 13161 - DNA, 230 bp, Homo sapiens
gtactactgatagaataaacagtagcatcgtgcgagtgccaatctccttgtacctgctcttcgccagtagcttacacaaatgatgactctgagagtgagcgatctccttgtggatgtatactcactgactgtcaagctgactacatcagcttatttataccctcaggagatcggatagctatggacccttagtacttactgttgatactttattaaaagcaaatcgggct

SEQ ID NO: 13162 - DNA, 1602 bp, Homo sapiens
  misc_feature (1)...(1602): n = A,T,C or G
aattttnnnnnnnnnnnnnnnnnnnnttttnntttgggnnnnnnnnnnnnnnngtttnnnnnnnnnnntnntnnngnnnnnnnnnnntnnnnnnnnnnnnnttnttnntnatttngnnnnnnnannnnnnnnnnnnnnnnnacnggacnnctgttcgtggnggcggtnnnagcnagtgctgtgtnnnnnntcatgaggcggatgggtgnnctcgatgagtggtgatgntacagcgcacggcgtncatnanagatgggagtgttgagagaagttngatacgataganagcaagtgtnaggcgcaggagtgttngtcgtgctcccgcgtaagcgcatcgtaggacangacagagacagggagcggcatgaagacgtcgggctagcagaagcgagacgagnagcgagtaggcncgcgctgcnctttgtgttgatttattgtgttcgcggtcgtgggcgccgagaggctagtgataggtgtgagtgatatgatgggaatcgcncatatacaagcctaggtgcagacgtcaggtgcgcgcgggccagcgctgcagtatggctcgcntcgcggagagatgtagttcgantcgtacgtctaagncagacgtgagagccnagttacagtgtcgatgaagagaagcgagagaanagaagagaaataaangaaaggaagngatagcagagggggatgtggtaggangaagggggtgctagtaagagagggagaagagagtnntaagagatattgcgcggatgagcgcgggagcacaggacgagagggagaggaggaggggagcgaagaccgcgagcgcccngcgcaacgagagcagacagacacaagaagagagagtgagatgtccgacgacgcgagagtcatgcgtcagtatgtgatcactgtatgcctctacgcctcgttatgtgttcactgggtgcagntatgtgcagcgtgcttaaccacgagtcgcactcaccacaaccacgactaatgagccgtgacctgatctggcgtagtactatcgcnaaccagctgattgatagagtgtagtgcctgtgctacgcactaagagagcgctcgcagagagggtgatgtagtggagatgggacgtgtaggtcnctagtagtaatagccgagagacgtggaaatcgtgaggtntatatagatgtgtctactggagagtgtggcgcgcgatagtagtgcgcnataagatantgtcncccgaatatggaaaacgattacgagtgagcgcgtgtaagaagtgtgaagatggaatatagatangacaggagagagacgtacacgagaagaggaanggnccgaatgacgtacgagagacacacatgaactcacgactagtacatacagcaatactggatgactatgtgcatgatagtgggagacgtatcagttgaggagtatgcgtaattacgantgcgggcacgattggtagttacgtctctctangctgtataggatggctagacgctcttactgtactggtgatagtgtanantctctggatacgtgagctcgatatagaacaagctactcgtgtgatagagtgagatgtacacnanagacgctcacatgatggagtaggcggtgtgt

SEQ ID NO: 13163 - DNA, 391 bp, Homo sapiens
gctaggtgctaccctcgctatcattacccaagttggatgttgctgccacagatcctgtgggctgaggcgtgccctggactctcacgggacaggcgctggcaaaccaggggagggtctcacatgaaaggaccacagcagactcgtcccttcgtcagaggaaagaaatagaatactgtttggattacagatactagtaaaatatgatcttgaaaaaacatttgataaattacagcaggaatttataatttaaaaaaaatcgccaggtgtggtggctcacgcctgtaatcccagcactttggaaggctgaggcaggtagatcacctgaggtcaggagttcaagaccagcctgtccaacatgatgaaaccccgcctctatttaaaaaaaaaaaaa

SEQ ID NO: 13164 - DNA, 536 bp, Homo sapiens
cctagattctgggggttcatgcacagatttcttacctgggtatattgtgtgatgctgagctttggagttcaactgatttcatcacccagcaaccagcccaggaagccagcccattatccagaggaaccaaccaaggaagccagcctgctctctagaagctagacttgtaggaagccagaccactgtctctagcaactgatccaggaagacagaaaggaacgcctcaataacaggaccaaagtggccaggacttgactgatgagtaactgacagcttccctaatttttggccctacttccaacagaagaacaaccagagaaagccaagtatgcacctgatgccccacttccagtgagccgcctccagcttcccacgccaacagcttccaatcagcacactttcggagccttcccttttctccactatgaaagcttccccactcctctgactgcctttgagcctccgccaaaactcaagtgatggtagccgactccctgctaccgcaagcttggaataaacagcctttgcttttcaaa

SEQ ID NO: 13165 - DNA, 447 bp, Homo sapiens
ctacctggcgccagagaaattgagaaatgcctctcctgagcattaataatagggcctcaaaagaaccctcaatgaagcaaagaggaatttatggcaaaaggaactgatgcttcaagatgtgtttttagctcattaatgaagattgtctggaggtttctctgatggaacaactcaactgcactatgtacatacgacatcaaaatatagaacccactgtcaactggactactctggatggacattgtctatcatttcaagaaaatgagtaagttagaaaaagtgtgaaaagttataacatatttatttgatatttatttttttcccaaaagcaaaataacaccagcctgaaaaatagaacaatggcaattcatactgaagtcctgagtagaacagaacatttctggtagctctatgtctgatatgtaatagcacatactgtacaaacaa

SEQ ID NO: 13166 - DNA, 349 bp, Homo sapiens
cttaggtgatgcagtatgaagagcctgggggtaacataaggatattaagagaggctgaggaattgacagagacaaaatgatcaagaagagactataaaagacacatgttgtttccaccaaaaatttccaaagaataaacccctctttaacatcctgaacaaagtggccagactctggtaaacccaataaagacagttgaagattctgcaactcactggagaataatttcctggtgcagtcaataaacagtctgttctagggtcaacactgatccttgtacctgataccagatgttgaaaatttggtcaacatttattcaatacttaataatagtcttatttccagaaaa

SEQ ID NO: 13167 - DNA, 514 bp, Homo sapiens
ctgtagagccttggacccactattggatactcacaccagtcgaaggaaaggctggtatgagactggcttctgggaagaattacagcacacgccatcaagaaactgtactttggggtcctatacaactgaatactagtttgaactctagtttcattactaataatctttaagatattgcctaaattatttaatctaagccttaattttcttatctgttaatcagtaacatctattttgaaaggttattttgaggataaaaagagattgtctatgtaaagagtttaatacaatgccagcacatagtaaatgcacaaaacttttactcattcagtaagtacttctatgaatcaatggagtggactccataatttttggggtccagtggaaaataaaaatgtgggctttcttgttcaaaaggcaggacaaattgttataaagggattaaaatataaagctttttctttcttcaacaaaaaaaaaaaatacggcctcgttgggcctcagcgggcggagc

SEQ ID NO: 13168 - DNA, 379 bp, Homo sapiens
gcccctggcaacttcacacgacctaactgaactctctcaagccatcctttcaaaaggaatgaaaattgaggtctcttgttttatgctgaagactctacgatgcctgcagagtcaggaactctggaatcttaggtatcctccatacatatccatctccatcacccttggctgaacatgctgagaaagaatgacccggcatgcatgcagagaagagtcactactttctgtgttcaaacatgttcgggccctgtgtacacactctatgcaccacccagcacggtcctgtttttgtgtagcgtggcttcattcttttgcaattctactcccagcgagccatatgataattttttttaattaaaagaaattttaatagttaaaa

SEQ ID NO: 13169 - DNA, 816 bp, Homo sapiens
ctaggacaacgaaatcacaagtgaattacggcagcatgacaacagtgttaagtggctaaaacaaactggagtaaaccaaaatctaagactgctggaaaggaagacgacgaaaaaccagcctgagaaaaggtttcacaaatctgaactgagaggcggatgctatttgtttaaaaaagagggggtgaggagaacagttagaaaacaaaactcccacagccaaaaagtaaacattcaataaaagaaaaattgagggaactcccctccaaagaacaacaacaacaacaacaacaacagacaagaaaaatggagaaaaagctaagaaaataagtagacggatttaggagttcctatgtccaatgaagaagagcttaagacagaaaaaaaaaaaagaaagaaaatgagaaaatgaaagggaagaaattataaaagtcattttaatagtttttctagaactgaaaaacataagtttatagactgaaaagctctgtggaatgctcagcacatccaaagtagaaaagaacaatcaccagacccaccatggtaaaatgttagtatttaggcaataacacaaaagtcccccaaaagctttcaggggggaaagaaatggcttacaactgcctgggaaactggcggcatgtgacttaacagtaacactgaaaaccggacgaccacggagcaatgcctgcattttccaagaggaaacacacttacacctatgacccccactgacagttcaatgactcttccttgtccccttgcttgcgtcttggaattttggagggacttaggcctggtctggcctatggtgaccagcgg

SEQ ID NO: 13170 - DNA, 784 bp, Homo sapiens
cctgggcgaacaggaaattttgtgccttgaataatgaatccccctggagcccacggtacctgtacttctctttagtgtccacagagaataacgtgttcgacattcaagtgacaacactggaaagcatttcaaagccctggagccccagaacgctgtacaccccgacggctcttctgcctgccctctctttggcttccaaatgcagcaagctctttctttacttaaaatgtgttcatctttcacacgcatcctggatgtaccacagaaagacagtacagataggcaggctcttatttctgaagctgagctggtcccgcccagcacaaagctttaaagctgctgaggctccaggatattatccagtttttaaaaatggaaaaactgggaacagggaggctcaatatcttgtcccaggcccaaacaggcttttctggagtcagtatcattcaactggctcaggctggattttcataagaaaagataataaacatttactaatgtaataaaatagacaccttttaagtcacaagcagtatctaaacctttgggacattctatggtgctgaacagctatttcatagaggctttatgttaaggagccagtgcagaaaaaaatctgaaaatctcagtaagatgagaaaacgaaagctctacaaaatggtagaagaaagtagtctctcatgcctaaacttccaaataagttttggtttgttggttcgggttctaagttgagcattctttctggtcggaaaagaatcagaaggtttttaaaacaaggaatttt

SEQ ID NO: 13171 - DNA, 341 bp, Homo sapiens
gaatttatgccgaatttaaaatcacaccgagaaaaacaaaaaacttaagatgcactccctttctcttactgcaaagaaccaaagacgactcctggcttccagggagacagtttacaccaagggtttgctcagctgagcttgtttatttgctgcacaaaggtatttgtctctgagcaacaaaggaaagccaccacattgaggtcactctaattacttagtctgtatgcaagaaatagtcttctgaaagaaccgtttccaccccttctttaattatgatttgttttctgtcactgaaaggattaaaccgaatgtgccaaatcaaagtagcgatattagcaaaa

SEQ ID NO: 13172 - DNA, 310 bp, Homo sapiens
cctgaggacacggttcaggaggatgcttgaaaaaagatcgtctcagggttgtgaaagaagatacaatcagcaagcctctgagaaatcacagctgatgactaagtccacagtctgctcataaaatgtggagttatagctcttgctctcaccactgtctctgatgagtctgaagaattgtgaatcactaaaagtctctacttctttaaatgtctagaaagactgttctaatcacctggaaagcttgcacttttttttttttaatctagaagacaataaaaagttgcagcatcctctctcaaaaaaaaaaaaa

SEQ ID NO: 13173 - DNA, 477 bp, Homo sapiens
ggctgcatctgtatcccagtgctttgggagaccaaggtggaaggatcacttgagaccaacagttcaagaccagcccaggcaacgtacaagaccccgtttctacaaaaaattgaaaaatcagccaggtgtggtggcctgtgactatagccccagctacttgggaggatgaggcaggaggattgcttgagcccaggagttggaggttatagtaatcgatgattgcaccactgcactccagtctgggccacagagtgagaccctgtctctaaaaaaataaaacaaaatattgttctcatccatgagttcttaatgaaattctaaattttgcaattatacaatgttaatctcatactccttaagatgtaaacatgtatcatttacatgtttcacatattaacgaataagtaaatgaatataaataaagttgcacaatatttcacttgatgaaaaaaaaaaactcgggctcgttggccttac

SEQ ID NO: 13174 - DNA, 158 bp, Homo sapiens
cctagcgcaagacggatgtttgcagtgataaaggttcagttaacataaccctcttgcttctaatttaataactcttctttccaaaacgataacaacaaatgtttctggcatttttttttgcacttcatgtaattaaatatatatgtatactacccaaa

SEQ ID NO: 13175 - DNA, 156 bp, Homo sapiens
  misc_feature (1)...(156): n = A,T,C or G
tcgttggtcattcgagcnngcggtgataaggnntacgttaacataaccctcttgcttctaatttaataactcttctttccaaaacgataacaacaaatgtttctggcatttttttttgcacttcatgtaattaaatatatatgtatactacccaaa

SEQ ID NO: 13176 - DNA, 788 bp, Homo sapiens
  misc_feature (1)...(788): n = A,T,C or G
agatggtttttactctgttgtccaggctggcacgacctcggctcactgcaacctccacctccagggtacaagcgattctcctgcctcagcctctggagtagctgggattacaggaatgaggagagatggccttggtggtcctccttaggttggcaacatccagatgcaattgttcacataccagcttctcatagcgctaccaaaagtcttcaactcttgtggtaattgggcctctcatgccaagaaccaggaagaggcacaaaattcctcactgagatacggtgtgttctacttccatgacttccacacaccattcttagaaataggagcagttttcctaggagcatcacccaagaaaattaagattctcattggccagaactatgtcaaaaggtcaccactggatgaaaggaagcctacaaaattgagactttcagctggacatgtagctaaccaaccaacacgggagtgtccttagaaatgaacggaaagtagtgataaatattgaattgaccaatcacagtgtcttctacagtttttctgtgattagaataagttttctacatggaaaacttctacatttttctatggntgttatatattcatttgttacttaataattggcaataggtgatatggtttggctgtgtccccacccaaatttcatcttgaattgttgctcccataatcctcatgtgtagaaaggaggacccagtggaaggtaattgaatcatgggggttgggtttttcatgctgttcttgtgatagtgaataagcctcacaagatc

SEQ ID NO: 13177 - DNA, 1184 bp, Homo sapiens
  misc_feature (1)...(1184): n = A,T,C or G
ctacagatcttgtctagtcgggcagcagcgttatacctctggctgtatatctctgtgtagactattggnggacacatatgatctatatatgatacacggagntangtgttactataattctngtctacgagcccagtgnnnactcctcgagacaacgcatacatgatccctgtcancctgtactnanccgctcccgtggtgtccttagcatctgccaacctgtggtatatactctcctctgtgctactccgtctgnctctccgtccgcccgatgacgcatggaaagatcaactcctctggnnctctctacttctcgtcgaactactctcttgcgtggagggactacctcctcgagacgtacgagtacattggagcgcctctcgatcggcaccgtgtggatgacccgaagacatcganaggacgtagagaccatgtaatcacctcgcccgaggngngcccggtctatggtgacagaggagagcctacagcttgttaccttggagcgtcgtacgcgtagagcttctgtcgtgaatgtggggctcggcatatgggcgtgggcgcctattgcgctctgccggcctgccgccatgacatatagtgacgccttgaataaataccacctanaggngaactatagaacatgtaaacnacactcgttatacctaactacatcaccttttatcataaccatacacngccgacggccctcctccctcctctccttgtacctacnaactcatactgnactctacccctgttctnnctcatcgttgtgatatctctttttcttgttctaatattttntggctttcttttctgatgntaggggnacttaccatcgacgaggcgaggcacggggacctatgcgtctaggctccgcgcgctgcgagggggcgcgctttcttgttcatttggtctctgtttgggctttctttgnggtggttgcttggctgttcgttgctcctgcggccctcaggaatacagaattggctagcatagaactgccttacccanccactnaccctctccacctcctcctnnctcctttaattcctcataatcattnccctttncttgtcctctncnnnnaaaatnaccatnnnccggttncctnnaaaanccnccttnttnnnactcttnnctcccctctcctcactatnctctcnnnctttcttcctcccccc

SEQ ID NO: 13178 - DNA, 1436 bp, Homo sapiens
  misc_feature (1)...(1436): n = A,T,C or G
attgtcttatgtatggtgtcgngcattctctatcatcctcatctcntccaacacgacgcgaggtcgtgggngagtagctgttgtggtgctctatacgctggatgngggctgacttcagcctatgatgcgttacacctattatggngccatactgcgggantctctatagtggcactgctctgtgtctctattagttnngagaggtcgganactgacaatacaactataatacatatnactangnnnacatgatgcgnanactgcagtggaggagactcgtctccattgttgagcattgagtggctgcgcttcgtcttggnngatgantatcatttgctatgagcacgtgtcatctttgtctaacnnnnnctacttgtcgtgtaagacaactgtgtgagcganggngccatctacgtgtagtcactcagtgnnacactactcgacggaggacgggtcgttaggtgttgtctcatgtattactgggagacactatnggacaataacgcgttctgtacgtgatgnangttcttgtctgtatgctaatctaggtggtggtgtggtgcgtggggttggcatntagngaggaggagnngtgtgttgtgcgtatgagtgggtgtagtgtgttgtttgggtggactgtgtatagtgaaattcatggatgtaagcttatagtaatatatatatgcgtatagganggatctatctatttatgatttaagtnncttcttctcgtgcctctattctctctctcttnnnncatttcgctcggttgggggaatagggacttcctctatttatcttagtaattnctgttcnnaattcttcctatgnnatcttcttgaactctcggcnngccactgtcatagntgnatatcaattaatatcattaatgcatgaaatatcgacnganaagtacaagtacatagactncacatggggactctcagtgtgtgagtgacgagtgaaggatggtgtatacgtatgtatgaaggaagatgtcatagacatatcgcgagctgnagtgttactcattattactcatcgtgntagtttcattgtaagacgtcttttctattgtttnngtgcgctcttcgcccgtattgtctgtgtacctctgtgtttgtncctgtactcgttcgctctatgaacttnnncctgatctttgtatgacattgtgaatgatatnnnnnttctnccnnnccttctctcttcatcttttnttttcttnnnncttcttctttcttntccatctttnttttctttttnccttctctnnnccttctcctctttctntcctnncatcttctnccttcctctncnatttncnnnccctcnncatctccccttcccttctcctnnnnccttttctcttnnntctttcttatttcttctattcttnncttttctttntnttctctttctcctctctctttctt

SEQ ID NO: 13179 - DNA, 166 bp, Homo sapiens
  misc_feature (1)...(166): n = A,T,C or G
atcccacaccataaccatattcaaccacaaacggcaacttntatattctctcgagagacagcatggtgaaacagtatcaatgtcctctagacaaaatatcattacccatcggaattaaaaatgttttcttaattttgctgtgttaataaatggctttatggttaaa

SEQ ID NO: 13180 - DNA, 119 bp, Homo sapiens
tggattgcactgaccaaggttacctgttaagtctggcactttccctagctactgtctgtgtctctatcccagaagaaagggtgaagtaaaatgaataaagtaaagaaaaaacaaataaa

SEQ ID NO: 13181 - DNA, 1458 bp, Homo sapiens
  misc_feature (1)...(1458): n = A,T,C or G
gtagaggtgcangctgcagagtagagtgaggagaagtagtgagagagacgagagtgattcatgccatcagagacgcagagccggaggcgcgggcggacgaagagagagaagcgagaagagaagaangacgaaagaacaaagggacatgagaggagggagagaagagaggttcttctntntttgtgtgtggataaaaacaacaacccaccgcaccncacccagcgctggaccgcgatttgcgagagcgagtgttgtgagaagtgtgttttagagagaggagagagagagaaggagaacacatcttccaggagggtcagaagaaggaagagtaatagagagtgatagagggagcgtgaggagaggagagagcagaccgagctacacagaagggaaggagaagagacagcaganaaagaaagagtacaacgagacaaggagggaatgactctgnacagggagaggagtggtgaaagtgtaggtaggagaacgacgagagactagaagagaggggagagatgaagacagaggaaggctggagagaaggaaagangaggtaagagagaatgagacaacagactcctgctagagccgggtggcaccaggagagatggagtggtgggacncccccacggagaggggagaggggagaggaggcgagagtaaagaaagggagaaggagagagggatggcgatggggccccccgccaagaggaggaggcagacaacaacagggagagaagaaantagaacgaagagcgcncagccgcgagagagggagagaggaggagcgccgcctcgggagtggggggaggagagagatgatagaantattagagccatgtaggaaggaggggaggagggacaaaaaactagcgagcggaggaggagagaggtggaagccgaagaatcggggaggaggcgctaagaaggcgacgaagcgctaaggggcggatgaaaagaaggaccgagaaagaggaaatacggagtaataaggtggagaatagatgaagagggagagccgagtgtgacgcaaacggaggagactcaagagggtgaacgacgcgagcaagtaaggcatgaaagtgaggggacacaccaaggtggaggcggctctgcgccgtaggccgagcacagagagtggaaagtgaagagcagtaggatcgagatgagggaggacagacgcaagaggagagggagtatcagtcagcgagaggtcaaggtgcgggcggtggggagacaggcagggagcgatgcggtagatggaactgctgcagctgtagggagcggcgctgaggaggggatatcccggcttcgtataggagggcgtggcaccgagagaggaggagngcggtgtaagaacgtgtcgagcgtaagcggtagcagagaggggtatgacacaagtcggtactacaggatacacgccgctatcgtgaaggcaggcgcagtgataagaggacc

SEQ ID NO: 13182 - DNA, 1542 bp, Homo sapiens
  misc_feature (1)...(1542): n = A,T,C or G
atntnacatactctacanatataagacanacntagcactantnagtctacttatacgcgtgnangaccgatgaatatgtgagcatcagtnagntngtcagtnatatantancatatcagcactgacnacgatctgtgnnacggctagatcacgaagacgactcanagataatagcgnacgccgcgagcgngntacgatctagngngagagctcgacgnagancgtactactacgnnnangcatacagtntntggagactatttcgtanngtgtctctgttnacatctacgcacttacttgcgcgagnannatatgctttacgnncacgtcattatatatgancagacatgtcaactacatctcagcacggacgtgnnactcactcggtcgactcttcntnagagtgatgtgacatcactctacaggccatttcatctcacgccacatncngngngacatcaaanaagacgagctactaatcagtgcgcgtgtngaagatgctancnangcnagcgactaaattnaggacagcaaagatgacatagagattagtatacnacgatgngncgacgataattatacactagaatacggtgaagacgnggacgatgaagataacacggcgtanagagtcagcgcgtgcatcatagacacaagcacgatgacaantgacgagcgcgctaccgtgtatatntccgtgtgtatgcagagtgatgtntactcgtgacngngagcgctcgacggctgtcatcgtcgcagatgccncataganctgcgtgagctacgatactcgtcagttgcgatcataccgatacaactgtcgacaacaactatangangnaattactattgctcactaancagagcataccacaatcaataacanacatccatancacagataataactgtnanactaccacnaatactatagtgngacgtagngantatcacatcgatctatcacgcgcgatannnacattgagagatatactcatatnntacactcttgctactcatgtcgnnaactcaatatcgtatnnaacaactcattcacataatcacacacacatcaatactagngaattgtgtatcttgatagattgagacggaggaacatactgtaattgtgtaggtgtgcgcagtgtgttaactcgtcattggcgcgcacagaggacagagcggcgacgactgncgcatgcagagcaagagattcttaggtaatgtgatttggacagaattaaccacgnaggggctcggccgtngcacgcgcgccaggacggctggggggcagctcacgagggcatacttatttaggttactatgctgattgaactatgcatcaattttcttaatntnnactgtaaccacttctattctttnnaatatttatatcaagtttttaacactctaatctcttnattagatccgtcgtngnacaaactnccgcgcnnncctgttncctctncaaanctctctttncnnncctccttcttncctctttctcctctctttncctcttnnncctttttccctctttct

SEQ ID NO: 13183 - DNA, 1670 bp, Homo sapiens
  misc_feature (1)...(1670): n = A,T,C or G
acttcactcttcatacacctatcatnncatacactctanacntcntttctctcgagtgcgcgtatactctgcctcctgnatngnntcgactcactctacctgtctcatcttcnccttgcgangntatgnctgtgcgttctctctctcgtatctgtcgatctttacgangnccctcgctcttgtactgctgctgtgcgagtcgncncttgtgngcgctctgtggtagngcgcgcgtgcgcgtgtccgcacgagcctcttctatctcattctgctaacgncgcnccgcgctgancgctgctgtgtanncctcctctactcccctgccgcgtcccctgcgacggcctctctactcgctcntgnctctcgctctcgcgctcctctgctccgtctcctttcgtccggtnnggatctacactggtgtctctgcttcgcttctgtgcgcgcgcgctgtagtcgctgccatgtctctctatctatgctctcagngatcgtgcagcnggactcgctgcgntgcgtgcgactaccgatgccgctttgtctcgtgcggtgcacggtgtcatcgtacgtcatatctgcantnngcgctactccggcgagcgcgacacgcgtcgcgagacgncatnccgatcagcgagccgctcgctacttggcgcgacattgtntagctgnggagtgtttggacgcgtgtgcgcgctgctcgcgtgtcgacgcgtctctcggtggcgttcctcgctntctgcgccttctcgtctgcttcagnctctagcgtcgatcctccttgagatgtgtgtcagtgactgtcgtcaggntttcggncgagttactcgctgtctgatttanacatatagctcatcatctatatncattagnagatctctgttcgtctctgctatctgggagtcgtgtgnggtncgctcatacttctcacttcctgcgtcctgatntacactatcagtgagctactgcgctntatcgtangcctcgtggtatgtctactgatcgttagngctctctatcgctntncgtnannactntncacactacaatcagcgtctctctacntctctgatcatctacctgtnngcgcgatctctgctttgtacgtcgtgntngtacgctgttgnnagactcgaggtgcgcgtgcgctgtggcgaggcgcngngtngnagtataggttgntgtggatagancgacaggcgtggctgcggctngtactgtagtcgcgtctggacgtgtgctcncgtcccgttctccactctctaatctcacgtncnccaccncntnnctcggtcgctgctgtctgtgnngtgttgncntcgcacnttgtctgcntgtgngcgcgtgtgctgctcgcggtgtgtgggncatcattgtgctngtgatgtctctcggcatcgcttgtggcgtcgtggtgtcgtgtgtcatgtctgatcttgtgctantatatanttnagntnttanatngtntnacactctgtctgtgtntgtctctccttcttcgttcttnntnnnctnctactctcgctnctcncncacgtcngtncntnnntttgttggnttnnnnacntctctgctgtnnctcttgggttcctgtntggcntcgnnngncaaatacctnntntnctcgntntntntntntcnctggtcttntcncgctnctnnnncagggg

SEQ ID NO: 13184 - DNA, 826 bp, Homo sapiens
cctaggtacgacggctggatttgcgttgctcaagtctacaaatcaatttagaagcaccctaatcctccccgggatgacaaacaagaagaagcaacacagaacaccagtgagaaaacagccctgaggggtagaaacccagatctcagcagatgagggcgacagatgagatttgttaccacggctgctcctcacttctgactgtgctcccggtacgtcctttccggggatgaggtggccgccatcatggctgaggctccagaaactctgagacggactcctactaattgcctctcagctctggagactgaagagaggaggcccccctgggaaagggctctgttctccattatatcgccctcctccctccatagccgacccttcgatcttcacttacctatctatcccgcggccatgctcttcaccccaaactctcccgtccaatctattgttaggtcgcccgcggtttctgccggctcgtcggtgattggggcgcgcgcgcctcacgtcccgcccagatatgttcgccgctggtacgtctcaataccccttttctcattggtcatgtctgcgctatcctttactctatgtttcttgccccgaatctttctaccctccctctctactcgagtttatctactcggtcactcaccccatacttttctatctcttctttcccgtcgccgcattatgtgcgccccgctctgtttttccacttcccccgcttatcctctcttgtcatcggtcttgtcttcgcccctctctcgacttccccccgcccctgactaataccatcctttttggctgtatctcccaccccatatacctt

SEQ ID NO: 13185 - DNA, 1217 bp, Homo sapiens
  misc_feature (1)...(1217): n = A,T,C or G
atgtgtatcaataacaatatgtgagtgntaatcagaatcaattatatntctgcacatgattactatactcnnnnncttatctcttaacattacatatgactgcggtagattgancatagcagacgacgacaccgcgaccacatgngaacaactgaggaacattggtgtgtaagtcacttgacagagttgctnnccctcttgtgatcatatagatatgtaaattctctcttcancattctattncgactattatatnatcatttagatatgtgaagatatggagaatgatatatagagggagatggcatctgtgttgaacgtgccttgtgtttggngntatttgttggtctattttcatcttggggagtgataatggagttgatgtgtggatatgatggatgaggtagaggtgagtgagcatacacatacatggacagttgggagtattcgctagtctcactgtannacgacttattatatagcattgtgggttgagccgatcttttgttgcacagcagggctgtatgggcagcggggctgaggtcgggcgattatatgcagtagtgagatgtggatgaagttacggagcttgggtgaagagaaatgaggtgtggtcggngtcttagagacggctgtggcgcggatttctgctgaactgatgccttgttctgtaagacacaagaaggccgggcgagtgngagtactatcaacgaataaaggaaattggtgactattttatgnacttgaaattgtgantgcaacttgtggtgngatatttaaatagtaaagaaaatatatttggtggtaagaaaaatgggatctcganatattttctagttgagggtgaaaatctaaaaaatttagagacccgacaatctactacttcanncgctacccactaatttatncattttccaatnatctttctcgcanncgtccttcttctaattctctactattccttttctccctcctctntcttctnttgttnacttaatttaataaattactctaattactctatnncccattcactctatttcttatnnnatatatttattattattaaccatctctnccctactnncacctcacataccttnntacatcttnactttttncttcctnnncctttnaaatnnctttcttcccttnncactccccctncctccccactctcttttccctnccacctcntcccttatttcnatatttat

SEQ ID NO: 13186 - DNA, 753 bp, Homo sapiens
ccattttctattcgttcttctcaaataacctcacggacctttcatcgcacatccacatgccactcgaactttcaacgatcccggaaaaagctaggatcgagtgaatagacgataatcgttgcccacttcaccaccgccccaccgcaagcatattactacaactcaacatacacaacactatatctacttgaccttaccatctatgtaaatatacagcgacacgacactcgccgcatgctagaactaattgacctacaaaacatcaaaggaaaaaaaaatataggcggaacgcactggctcacaacaccacacactctctcccccccgatgacacgtagttaagacaaaagggatagaaccacagactctcttctgtcttcaccttgggattatgtatgggtcgcatatttcatcaaaaaaacattatcaaaatatataattaaatatttaaaatacatagacttacaaaaaaaagtcctgatagataccaacaaattaatatattttttatgtatgaacacgaagataaaagcaaccataccaagtgaatgtattataataatgggttccgtctccaccacacacctttgctatgtagtcccctatctacctatccatcaatcctggtttattttatcatcccagggcaagctaataatggcctatctattttgaacttcaaaacagttttcgacaattctattggccaaggaaatttgaagagtagtaaccattaatttaaaaaaaaaaaaa

SEQ ID NO: 13187 - DNA, 152 bp, Homo sapiens
tcgtctggtgacagttaccccatcttcaggcgaggggacagaagcagtcggacacagttggagctcaaagagaaccacctccagaatgaccctattcaaactgtcactgacagttcttcgcaaaaataaatcaaagtgttctgtagccaaaa

SEQ ID NO: 13188 - DNA, 821 bp, Homo sapiens
caggaaacttactgtcatggtggaaagggaagcaggcatgtatgtcttcgcgagtgcaagcaggggaaattccagacgcttatgtattaaaaccatcagatcttgtgagaactcactcactagcatgagaacagcggggggaaccgcccccgtgatccaataagcctccctccctcacacatgaggggattataattccagatgagatcggtggtggggacactgagtcccaccatataaccctgactttgtctttacctccgcgcgaagaacagttgaaaacaaatcaacccgtacgtagctgacgttcgagattacgattacaacaacatgtattaatttctatatacataatggtttattgcattagagcccatcacccccctgcacaccactcaaccccaaaccaggtgaccgtatctatgttggcaataactcttgcgcgacccctcgccctcggactggatctaagattaacacatccacgccctacatttcaacacacccatgtcgagagactaatccatacacatgattacacatcgctaggacataacccccacacgcgcgacgcgccgccggtcacggcggtcgcaggcgtgtctcatctatatgcacccacccctcgcctgaccccgcgcgcgttactctgttactaaccccggccccgtatttttgcgcccccggcgcgtcttatcccacctccccgtttgcgcggagtgaatgagagggttgcgatttcacactattcgagccgaaccctcctacctcgttttgaccgtcgactgtaatcgcagagtaaaatcggcgcagagtactat

SEQ ID NO: 13189 - DNA, 1111 bp, Homo sapiens
  misc_feature (1)...(1111): n = A,T,C or G
ctctatacactagaacaagtgacttcgaatacatttgaacgagtgcatattatagaggncgattacaagagtccaggttgagcgggcggagagattggacctagatctggtacaactgggctatcttggacttcttatgcaggtcctagccacccaccgactcttaggtcggatctctatttcctttaatggttactttattgccactttttcanaaataactcatactggccactgtacactttattaggngacagccatctattggccgttgaatataatagnggaaaatttgtaatatatgtatttgattgcttttgttctgttgtggagtgtgcccggccggtggggatagggaacagaatgagtaatgagattntgaacataaatctaagcaacagatacttattctgcgaacagtgaggctagtaggatgagagcgcgctgataggaggaagagtactggtgaaatattatccacttacagcgacacgaccaataaacaataacaagacatataaaaaaatgagtagaaagaagaaaagttagctgtgagttcttctgtatgatattaatacctctctgnacctctttatgattagatagagagtaagaatattgtctaataacttggactttgatgtgcaatttctcgagttgagatagtaatacccactactaaagtcaggtacaaagcagaagttatagagaatgtggaaaaaacatctaacttataagataaataaaaggagtggggaggaaagggggaccgggcggggtccttcttaagtaatgaaaatattantctatattattcaccctaatacccaaccccggaacggaggaaacagggagtcgttcggggagtggtatagaatactggatcataccatgaagganatnatttnaactcaattgcgaaacaacactatnnnaaatgagaaataatagttatatatataatataactctagtnccgagcctttaattgtgncaaaaatnnacgtcntnnncggttnnnccttaaaacnntgcttcctntctnnnccctcctttnnncactactcctntcctcattctnctctnttcnnnncttcnttncctcttcctt

SEQ ID NO: 13190 - DNA, 845 bp, Homo sapiens
  misc_feature (1)...(845): n = A,T,C or G
taacttgctcattaattacacatttcatttgtaccaacacagcaacaacaacatcataaaattataaaacgggcacatcagaatcacacgggctctaggaaatagtatatccattgatacctgtggaaccaaacactaacacgaatcatcactaactatcaacaatacatcaacacaaacaattcaatttcaaatgtaccagcagctgaacatacaaagcattaattaacaatatccccactagcaacaacaataaacacggatcgcctaacaatatccaataaatctgtctaataatcaacacaaaaaatctaattaacttaacaccgctagccaacgtcacaattcacctatccccaatccccagggggtccccccaccctccccccgtcttaaactacactactaaccctgaatcgacctcgtcgaccatttccacaaataaaacccaactaacccaacaaaaatagtcagggacacaaccagaatcatgtctactgccaaatcccaccccatgttcctcctaccctcatccatcttcccatgggacacacctgttggatcatagggtcatagcgtagcaaacagggatcctaggtgttgggcattttctgttttgtgccttttccaatggtaacaattctaagtatttatagtctcacttgcaattacattttggagactaaaatgacacaaactacaaatcgaatgtgcaaaaaaaaaatcggtcctcgttggccaacagcggtggagtcgctgcgtgccaaggtatataaaatttttattctaaaatctcnttttnttttaacacccaacaccaatatactaaaataaaaaaaaaatta

SEQ ID NO: 13191 - DNA, 1454 bp, Homo sapiens
  misc_feature (1)...(1454): n = A,T,C or G
aagaaaaaaaaaagagtggtgcgggagagataagggggaaatgggcgcagagaaaaagaaatagaattttagggggtgtgggtggtgnnttnaagaaaagaaagagagaagaaaagaaaagggagggggaaaagggattaagttgtttatatgtatttcgtataagaacgcagcagcgacgcgcgcgccacatggatatgttatatttctaataactatgaaacaaataagcgagcgtgagaacaagcaatacgaaacgcgactgtcccgctagcgcaagagcgagaggcggtaagcgaagcacaggcgcgacggcgggaaagaccaacagcgacaacgcgcgtccagaggcccactacacaaccacaacaaaacacaaacccacacaaagaaggacctcacaaagcgcanaagatagaaagacaacgagcagccaactcccgatccacactagaaatgcagccgcgagcgccgcccaccgtgtccggctacaccccacccgcatattatttacccgaagcgagtcctctcacgacagtcatatagacaaccacacgcgagcattgcgcggcacgaaacgcaagaagaccgctattcccgcacacatgctcgtattccgcaggacacgacacacagaagcgatcccgtcagaccaaactaaacgtaatataatcgcaccacgacaaccagacgtacagatcgcgcgcttcctacttcccgtacacacaggaaccatcataatgacgatcgcgcacacgccgagcacacaacccgcaagtaactcccagcggcaagagagagaatcacgccgccgcggcaccgtaaggaagaatcgcagagcgtgtacgcggttattatacgaacaatgatatgagataaacaagcacgccgacctatggaggtaggcgagacggcatacgattgattgtgtcgcaggacacacaccacgaacaaccgctggcagccacgaccgacagccacagtatagcaaacatatgtgagtaatacatgagaacgacgagacgccaccacgataagcaagaantataagtatacactantccacgccagcgcaccgaatacgcatactccacgctacacacccacgtcagngacatgacaacgtatntccnacagagtgaacacccgcgtccactcgaacgancagagagatagtcttatatcgcactcagccgcgggcgcgcgcatcacgagtatacaatcgganattcgcagtacgcncggattcgcgcaccacgcgatggtgcgcgtncgntccacgcgtatcaatacgccgtctgtataacagcgacgcggcgtacgcggcgcaatcgtacacatacaacaccgcgggccttacgacatacncacgctcgcgacgcacgcgacgcaagagtcggctcttcgcaacnatcgcgcacgacggtagacacaacgaagacaananagcgtcg

SEQ ID NO: 13192 - DNA, 437 bp, Homo sapiens
ctagtgctgagcgaggtttaaactaacaagcactcacacctgcagccaaggaagggcaagaagcagcagccaggtgtgggaacatgaacgccagacactcgggatccagacagtctcccaggagagcccatttccagtgaatactttcttcaggtgctcagtgaagcgcagtcccatggggagcctgggcaactgttggcaagctacttttttaaagcagtaagacttcatttatgacttaccttgagaaagcatcaaaagagaggcatttgcagactctgcatttacagggcatcaggtgtggggtgtcactctattacaccctgttacaagcctggtttcttgctatgggaagactccataggaccttctgttcctatcaccagggtggtggagccagtttcaaataaaattaaacattgcttagtcacacaaaa

SEQ ID NO: 13193 - DNA, 219 bp, Homo sapiens
agatacaggaaaagagagcgagagagaatgaaggggagagagagaaataagaatgacacaaaaaattttgaccaacaactgaaaggatgaagttgccatggccatttggggacaaattatgcttactccctccgcctcaattttctcatctgccaagtggggaaaataaccaaaatgatatggtgattatgacagataaatgagttaatacaagcaaaa

SEQ ID NO: 13194 - DNA, 321 bp, Homo sapiens
ctggaagaagcatatttctcattgagacagcagttatcttacatgatcaccaactgaaggaaagaacttttagagatgtgtgatcattgtatctttcccttggctccacgagtatctatactcactgaactgcttgaagagacttcgtaggcataaagatttcttctctacatccagatagttttgattatttttctttgtgaccaaccatataaatccagtttattcttggtaatttgaaaagtgccataaaagaatggcaataacaataatgataacaataattaaaacatgttaattactcttctaaaaaaaaaaaaa

SEQ ID NO: 13195 - DNA, 200 bp, Homo sapiens
ctcgtggagtaaactgcaggaaagcgtttttggaaggacgacctctgaaaatctttttcttaatatggaactggggaaactaccccaagatttgcaacaatctgaagcattttactcaagaaaatggctgactcttgggacatggatggaactggaggccattatcctgagtaaactaacacagaaacagaaaatcaaaa

SEQ ID NO: 13196 - DNA, 1328 bp, Homo sapiens
  misc_feature (1)...(1328): n = A,T,C or G
ctgtncgtcttcgtcgttatatgtnccctctatatatgctgcagtgctntatccattatatacactcattcactgctcanacgctacaanaacagatcataanctctttcngaaacatatcacatgcgcttgacagatcgatgtcaagatcggtgctctcgcatagcgatctcttgcgtgctctcattcttaatacacttcgtctgtntntacattggaatggcgcacgctggaccgcgancgcctcgctgagattanactacttctgttgcacacatgggangtntactatgacattgcgacactgcgacttaagtatgagtagtccgcgagtggaacaaatgaactatatcgacagtatatgttnatgattcttacatgngngtcagtaacaatcangatgcgtgcgacgtagtntatatactgatntgagcgcaactcatgaggatgactacgagtgtgtggtgtgagggtgctaagggaggcgcttcgtgcgcttgagatgcgctggcatttgaatgacaagtgaaacatgttctctgtcatctatacttatcctttcgtagtgatgttactttacacgtgacgaaccgcngcgacgcagatgngtagtattgcgagattggttacatcgatccgaatttatcggagagatgtcagataggatacagtgatgcaattataataattaacacatccattattntaactgctctttctgtttgggtttgtgtcatcagttagactaatcatgtcacctttggtcccctacctctcataatatactgtgtggagctataatatcgtgagggtttgntcattttatgcgtggttttgtcttagtgaattgggttggccgggtctgtgntctctctctcgtcacaacgtggacacttggggggtggttttgtatagggttggtgttatctgcttatggtttgcgcctgttgttttaattctttgggtgctgctggtccggtgtatccaatgggagaggcctgggaagagggtcgacgaaaggtgggagggacgcaggtggngagaagcatcgtgctgcatgtcccgtcgtcggagtatacgggtcgcttttggtgagacctagaatatgccctcgtatagatannagcgttggggaggtggtgaatgacattataatgataataatagattactgcttgtaggaaggataagtacttncctcgctactcgtatgngccaagacgggattttatatttttttatatattgatgggtgtcaaacnntnnntttcnccnnnnnnataanttnnnnnntccnnnncnnnnnnnnnnnnnnnnnncctcttttt

SEQ ID NO: 13197 - DNA, 205 bp, Homo sapiens
  misc_feature (1)...(205): n = A,T,C or G
cagggtgaagcctccataaaaaccctaaatgatgggactcagagaatttcttctggatcgatgaacacatccacntnctgagggagtgaggcgccccaactccatggaaacataagctcctgcactggggacccttccagacctcaccctatgtgccttttcatctgtatatcctttataataaactggtaatagtaaaaacaaa

SEQ ID NO: 13198 - DNA, 250 bp, Homo sapiens
  misc_feature (1)...(250): n = A,T,C or G
atggtctgtctcctgtcaattgactgtcttaaatatgaactcaaactacagagtaccgacaataatggataggtctgcaattgttcacgttctgacatcttattgagagaaaaaatanaatcaggatcatattttttttattttttctttttatataatagtgtgccagattcattcaactcctggactctaacatcgcattagtaaaggtattttctgtgaaaaaaaaaaatcgggctggggggcctca

SEQ ID NO: 13199 - DNA, 1204 bp, Homo sapiens
  misc_feature (1)...(1204): n = A,T,C or G
gcacgtgggagcacatctactgtacacncacgcngagtactagcttacacagacgacagcacgagangacaancgaagaggagngacgacgcctgnccagcntcggcgcgacaaaagctagacangngcgntctgctaacgacagggttgnnacgtcgtgtggacnancncacggcgctactggcgccgagnaatacactatatcacagcacnctgcgagncncgtctatccncnangtgtgcatatatgtatgcctggcggcgcattcatgaggagctcatacgctcctacgacatatanagggtagaatataccggcgacgaccatagccggcgcgtttttagtnctacgacaanangatgtctntngcaagcgtnatcacaaacatctgtgaagcgcgcacgtgngtantcactaatatagatctacacgcgcgcgtcacatagagctagtattcatcagacaattgtacgacacacacttattgtgcncttgtactataccatggcaaccattgtagtaggatgttgttttgtgtgcaccaggtgctctaacacgcactttggcaatatagcaagtttaacacttcgtcccatttacaattgcgacctagttgtctcacaatgtgattgatatctcaagacacatccttttcattgggaaaaaaaaggtggtagtattcagaaacctcactactgggctgtatcacctcaacattctgaatgtgcttactaacccgaacaccctgaagtgtgtttttgactttcggcaaaaaacctactctcctctgtgcgcccacttattggccttcactttgtttagtgggtgggaaactccttccccaacgggggtgtaaaatggcctcgcccccttcactcgtgcccacttgggctaattgggtcgctttgtttaaaatgatggggcctctcttgccagaggagcgccaatgcctgtggggcggggccgatctcatcgcacataggtgggggataatttatttaccctacggaccgaacccgtagtggatgtgggtgcagagatcaattatccttggtgaatagaccctactccctaggtgtttgtatacacctactgtgtggatagcccacgttcctctatttgttggtatggtacgaagagaagaattgtctatttatacggtaccgaaacttccccccccctctcctttatatttattttttt

SEQ ID NO: 13200 - DNA, 266 bp, Homo sapiens
ccagatcgtcaatgatgaagcatgcagtaaacaaccctccctccctggaagtgaagacagcctgtgggggagaactggctccggtaagggcttcaagccacaggagttgttttctccggagatgatgagcgtgggctggaaaaagagacaagagtcacctacttcgtgcagctttttccccccaaactgctaaaagtcctttaccctcaaataaaatcatcaagagagagctggaaatgggatctcttgccacaaaaaaaaaaaaa

SEQ ID NO: 13201 - DNA, 227 bp, Homo sapiens
ccctggtgtgactcctgtcaatatattgtcttaaatatcgaactcaaactacagagtaccgacaataatggataggtctgcaattcttcactttctgacatcttattgagagaaaaaatagaatcaggatcatattttttttattttttctttttatataatagtgttccagattcattcaactcctggactctaacatcgcattagtaaaggtattttctgtaaaa

SEQ ID NO: 13202 - DNA, 274 bp, Homo sapiens
  misc_feature (1)...(274): n = A,T,C or G
cctacnatttcttcaggaataatgtctaataaaacctctcccccaacccctcagaatgagttgatgattcatcatacctggaggaaaggaggggcccatttactaacaccancggggcatcgaagaatatgggttagaaggaagaggtgatctccaggacagccaactctttgtagcacggatacctgaacaataaaggtcatatgatctcactatttttaataaaagaaataatttagggggggggaaaaaaaaaggaaaaaaaaaaagaaaa

SEQ ID NO: 13203 - DNA, 358 bp, Homo sapiens
cttaggttcacataagaacctcctatttggatgttagccctgtggaagtgataatagccccatcaaattcccaagaggaaacagctagagaaataaaaggaaaacaccacaacaatgtttaaagctaaggaacacaaaaacactggtctgagctttacaaaacggaacaattggccaagcaaaacctaaacttcaggagcaccagaccgtgaaatggagaaacaatgcatactcaagtgggattgaagactcaaaagcagctattaattcaaacaagatcaaaacagaaatcaatctattcatgtgacttccaaaagatcattaaaaactaattaccttctgtctaaaaaaaaaaaaa

SEQ ID NO: 13204 - DNA, 729 bp, Homo sapiens
  misc_feature (1)...(729): n = A,T,C or G
tttnaacagnattttttccatttntggaagtttnggaaccnaactgccncaattcccaanaatgntntcccatccctcatcaagaagcaaggggccccttctccaaggntgggnntgccttcttgcaanaatgtactttnttcccattcnctgggaaaattcaanaggggatttttggttgcccnccnatgccnattgataagagattgcatgnatttcccncnctggcctttttgtggacccacccaaatcccaccagatttttctggtgattttgaacntgtgctgcgcttggcctgtacagacacggtccatgattctgattgaggatgtgatccatgctgtggccattgtattctctgtcctgattattgccctttcttatatcagaatcatcactgtaatcctgaggattccctctgttgaaggccgccagaaggccttttctacctgtgccgcccatcttagtgtctttctgatgttctatggcagtgtatccctcatgtacctgcgtttctctgccactttcccaccgattttggacacagctgttgcactgatgtttgcagttcttgctccctttttcaaccctatcatctatagctttagaaataaggacatgaagattgcaattaaaaagcttttctgccctcagaagatggttaatttatctgtagattaatgctagctcataggcacctttcactgtggatattactctaacacaat

SEQ ID NO: 13205 - DNA, 657 bp, Homo sapiens
  misc_feature (1)...(657): n = A,T,C or G
aaatgagctgtgtctttctatccatagctgttaaggttgctgagaccatgtcagggtggatacccgtctccacaaccccatgtataattttatcagcattttctcatttctggagatctggtacacaactgccacaattcccaagatgctctccatcctcatcagcaggcagaggaccatctccatggttggctgcctcttgcagatgtacttcttccattcactgggaaattcagaggggattttgttgaccaccatggccattgatagagattgcatggatttccacactgcccttctgtggacccaaccaaatccaccagatcttctgtgattttgaacctgtgctgcgcttggcctgtacagacacgtccatgattctgattgaggatgtgatccatgctgtggccattgtattctctgtcctgattattgccctttcttatatcagaatcatcactgtaatcctgaggattccctctgttgaaggccgccagaaggccttttctacctgtgccgcccatcttagtgtctntctgatgttctatggcagtgtattcctcatgtacctgcgtttctctgccacttttccaccgaatttggacacagctgttgcactgatgttggcagttcttgctccctttttcacccttatat

SEQ ID NO: 13206 - DNA, 109 bp, Homo sapiens
  misc_feature (1)...(109): n = A,T,C or G
ttgtggcttgttgagcttgaagtctcaccatcatagttgtgttgtaaagcaagaaccagcaagctcgggttctgcaggccaaatttancccgnctgncttngtttgtaa

SEQ ID NO: 13207 - DNA, 1600 bp, Homo sapiens
  misc_feature (1)...(1600): n = A,T,C or G
gtctccgcgtactctgcgtgatatctactcgcactttcctcgttcgacactcactcacttgaccaggtagcgcactctgtgcctattctctaggcgcagcactgcagatctcacctctcgtgctaatgctcgtagttacaantcactatgttncatttagtgcgctgtcttcgcagcgcgctaatgtaatatagatcgtctcgtgctcctataccttacgatccacgcactccgtcacatatcgcactgtgatcttcgctctcacactacttcgccagactgcgtacctactctccttcggcgacagtgccactgctccgcntgtcctcgacatcatcgngagtgtgcaccattcgcgtgatactctgtagggttctctacaggcaggtacgagtagaagtcgtgcacngtnacagaatgtgtccaggtcgtctgatcagagtaatagagtatggtagtgtatgcagattatgtgagagagctgcgagagagtgtcgtacagatagtgtataagcgcagaggtgactcgtcgcgagatgagattcgtacgtctagatcagaatatgtgttgttaagttggcgggtgtncagtgccgagatgngtgtgtcgtgagtgacgagagccacacgcaanataacactctgacccgatatcgatgattggagtgagtctattgagagtagacaggcagcttangatgtctgacatccgcacgccatctcagacatcgagttatagtcacacacgcgtcacagtgcgatcacttcatcgcttagcacactctacaccctcgctgcctcagttgtatcagagagtgacaccgtcgcgatcgatgtccccagcggcgactatgatgacggattgctctcagntcttgcatcacatccatatagtgaggtatagaaggctattgtgagatggtggtgtatcgatcactgtcagagcctcaggtcattcgagtgtgtcgtgatccgacgatccagcacgtcatgagatcgacaggtctgtgggtagtggtcggaagtgatngatgcgactcacgcgtcacgactgccacacgccgcgcctcgccatcaggcagangcgccgatcgctantgcgatgcgcgtgcatcaacgtnaatacagcacgcactgccgcgcagccgagccgaagcncgatcatccgcgacaggtgcttagtgttacgaggccgctcatcttggttcaatcatactttcgtctctagntgctgtaccgcatgcatcgtgccgctcgcctacacatgctacgcagtaagagttgnagagtgcaggaacgggtaagatagcgtgtagatgcgtacggcgcgcacgcgatggcgtgtattctagtgcgccgaatagagactacatgaacatgagatatgttggaactctgcgtgcnctgtcggtatgatgtcatagacgcatacggatcatggtaggtatcttgtctgtcctctgcggcgcaatcctctctagcgagaaaatatcgcactgtagtcgcntcgagatggggatcagtagtatagagtcgcagtatcttgcgctacactaccgcgtaggtgacgtgtgtcacgcatcgcttaccacttcacttt

SEQ ID NO: 13208 - DNA, 1140 bp, Homo sapiens
tctcttcatcatttaattcgatttttgatccaccacctactttatacgacctgcttaataactcacttcaattatattcattagacctcggcttcctacgtctctctgacttggaaggtccagtctataactactgctatcaagctaatttcggcgcgtcgttgtgctcttaagtggattatctgataagaatctacctcttcaaaatcttaactaacccccatacaagtcatgagggtaccatataaacgccatgcgtgtagtgaactcgattcgattgttttactgcgagaggatgtgcactcgatacgttgttgaccatatctgtaaacagtacccgcacctctgaagagatattcttgcgtccacgcgcgccgtacataattgattctgcttgtacagtcatacctactccactgcgtgtacgattaaggtccatcgcacttctaccgacgctcgtaaccatacgataccttcctacatgtccactcacttacagatatgcgttatggatagagaccacacatcaccacgccaccctcttttgcttactcccttatctgttcctatacgtgtatcatacaggacggccagttgtatacatttctcctttgtatgttatatctccacgcgtcaattcctctctccatcttctacccttagtaattgctatacctcagatatcacttcgctattatcggtcttagaccgtgctccgttacgtgatattgtagatcgaaaatgccagattcctactattcacttgactatattctctatacctcgtttccctttactcttattcgcgaccgtctagtattatcttgtacactctccctgcgcgctacagacctccccgcttccgactattgcccctgataccacaacccgttcctgcctcgaccgttcatcgtctatttcccgccttatctcctactgcgttcttcaacatcttctatactgcaaccctctacctcactatccatattctagtgacgcaattattcacagacatttcttatacatcctccactctttaggtcaatattagaagacaatgtatcaatcccgcagatcatctccgacacagctacctttcctactactactctgctatctgtctactctatttacattacg

SEQ ID NO: 13209 - DNA, 601 bp, Homo sapiens
  misc_feature (1)...(601): n = A,T,C or G
ggaccatccctggggcgtgccttttttaaccggggaacctggtggaagggcgggcactactattttggggaaaaaagatgcgacctttccggacaattaagaagcggtggcgggcgccccccgggggggagctccggcttttggttccttttagtggaggggtaatttcgaggctggccgtattctggggcgtggcgtggttcctgggtggaattgggtatcccgctcaacatttccgcccgaattctaaccgggaacataaagaggtaaagccggggggcgcccatatggggggagcacacttccccttaatgggggttggggccgcctgcgtcgcggttgcggtgccggaaaaccttgcctggcccgcgggcgggnttactcgagnggggcccggcccggacggcctttcccaccgttggtggggccctgaggggggaggggaccacctcctgtaccgggcttaaggccggggggggggggggttctcgcgaggtgtgtcgntttagttgccagggcctcaggcgcggtgcttgtgcgttttggcgttctttggtagcaagtttacgcgctgttcccgcggaattttcaatagggggcg

SEQ ID NO: 13210 - DNA, 209 bp, Homo sapiens
  misc_feature (1)...(209): n = A,T,C or G
ctccagagaaggaagaagctttcccattttttaaggcttaaaaaaaacacccaagtatctttaaagcagtttagatacccatgagttgcttctttctaacaagtgatgtccaccctgcgaataagcaaagagttttcagaaggtggccagattgtcaccagacggacttttgnagaacccagtttccattccccaagggctncntatca

SEQ ID NO: 13211 - DNA, 419 bp, Homo sapiens
  misc_feature (1)...(419): n = A,T,C or G
aaccaatggaacagancagagccctcagaaatacccccacacatntctaacggatctgatcttcgacaaacctgataaaaacaagcaatggaaaaagcattccctgtttaataaatggttctgggaaaactgaatgtatgaatggaaggagaaaggaagtcactgtatcagccctctggtaataagcctcaaacagaagaaccagggcatgagaggtagagttggattgaggcaaatggcagacagtgaacaaaatgtgtccatctttcaacctactttccaaagagcaggccagtagttagaaattcttcctataaactgccacttttattcagtttaggttacagttctctagattttgttcattttgtattttttcttttgtctattaatttttggttcaaaaatgggcattgtaa

SEQ ID NO: 13212 - DNA, 351 bp, Homo sapiens
  misc_feature (1)...(351): n = A,T,C or G
tatttacaagatgctccaggacacagcacgaaggtgtcatctgtgagtcagaaaatgggccctgaccagacattgaatctgccctgatcttggccttcccagcctcggaactgtgagaaatnaatnntattgtttccaagctaccttagcttatggtattttggtcannagnctgaangggactaagacacctccttggacaagctggtacaaaaactgagaatatatagtctctntagctncagtttnctcatctttaaaangggngatngactngtaagtttaaatgaaatactntgcactttagcctnggaacctgactcttagtcncgttcaattanangtggntgc

SEQ ID NO: 13213 - DNA, 143 bp, Homo sapiens
cttttagagtttacggactaaacctcagggttttaccggagtgagacctattcagtgagcccacgtgagctcctataggttttaatctgctcaaattacaccagcttttacggttatgaaaaggggtgtaggccactcgtatg

SEQ ID NO: 13214 - DNA, 849 bp, Homo sapiens
  misc_feature (1)...(849): n = A,T,C or G
tgcactggatctccccgntggggtgggggnggccgacgagcccgggacgggtcttgacctgtcccgctctggggcgctggcgtggggggcgggggttggacgccgcgtctaacgcgggtacttgaggtttgcgctccgtgatactacatctcgacttgcatcgctcctagagcgatggtagtaggaggtcgctacgcatgagtgggcatcagtgccaccgctcattagagcgcgggccatcgcaagtctgtagctcgtgcaaatgagtgtgtcagagcgcagcggaggaaagcgggagttctcacgcgagcgggacaacgagggcagaagtagtgtcatcagcagcgatattttctacctgaggagctggtgttgaagtatacgcgggctggagaatgggggtttattgagtggcatagagacgccacttaacgtctgatattttgccttcatacgcattagcgagcgcggttaggtggggggggggcgggcgggagggcgctatctgtgcacctataggattttgntctttatttttgatccgcagttttctccgatggcattgttcgtggcgaagcattatttggtgtttggtttaccgatgcatacgaccgtttcggcattcacgggcctgttatgacgtcctgtattgcagcacggggggctacggttttcactacgaggcgttcgaacgccatgactatagggttcgaggggcgaggaacaacaggattttatagtgtcagcatcgttgatttcagtgttagagtgggttattgaatgcacgaggctgtccggcntccggcgcgtcgcnaaccagccgatagagggaagtgtagtgtggtggaa

SEQ ID NO: 13215 - DNA, 678 bp, Homo sapiens
  misc_feature (1)...(678): n = A,T,C or G
gtanggtgangagaangaagtnccccttaggtancaaaaaataggagatccntggaatanccagtttagancatggcttanaaaagtcttcctaaaaaaccccagaagtgtcagtttcatctagtgaggntccaagaatgcccaagattcttgactttgtctttagaaaatctagatgcccctctttggacaagaagttgctctcagtcttctttctccagtgnccagatgtcttcctattaaaccatatggagacccnctcagaagattctggcttttcttttaatccctcacataaccgccctcatcaccaaattcatcacaagcatctttattcatttacatttattcatacacttaagagagcttattgtgcacattaatttggagtcatctcactcatagattacaaatgtcttcaaggacaacacaactacttaacacatttcaaccacttatcgaaattggggactccaggagttgacaggtgggaggctaaatacagcttttgggtaggcattccgagccctaagaagattccatggtgctgtgtcatgcaagcaacactacgacagattggaggagttcctcagtgctatggggaaaaccaggaagaggactccctgccctcaaggagtttacaaagaataaataacaattaaaacaaaccaaaacaat

SEQ ID NO: 13216 - DNA, 779 bp, Homo sapiens
  misc_feature (1)...(779): n = A,T,C or G
ccctagactataggaaatcatgttagttaanatcaaattacagcaactttcttattcaagttcaaaatggcccataagtagtggagacacctcacaacatcaactatgcatttggcccaggaactgctaatgaacatacactgtagtggtggttcaagaagttttgcaaaggagacgagagccttgaagatgaggagcatagtggttggccatcagaagtcgacaatgaccaattgggagcaatcatcggatgatccttttacaacaacacgagaagttgccaaagaactcaatgtcaaccattgtatagtcattcggcatttgaagcaaattggaaaggtgaaaaagcttggtaagtgagtgcctcataagctgagtgaaaatcaaaagaactgtcattttgaagggtcgtgttctcttagtctatacaacagcaataaaccatttcttgattagattggcatgtgggatgaagaggggatggtatgtgacagctgatgggtggactgagaagaagctggtgagtcctctgcataggcctcctagcccggctgacagtctatggtgggtgtccgttaatcagctagtggtcctccccactttgcctcgcccccctccgcagctcccctcctccgccgtacttctgttgatgcgcccgttcgtgccttaccactatcatccttttcttcaccttgttcgccaccccactataaggacgtggaagtgctagcacgcgcctgcttttgttagagtccatcatgctagggtcggacttgccc

SEQ ID NO: 13217 - DNA, 823 bp, Homo sapiens
  misc_feature (1)...(823): n = A,T,C or G
ggngcccntttgntttntctcnaaaacnggttgggggnatncttggggcaaaatcccnttncaanttttaaaagcccttgaaggtaggtttttttntgngggccctccnagaaaaaagggctttttttttttnccnttccccccattncnagcaaaanctttggaagccntngaacccttggggtttcaaaattctccccnaaatggggaaggggtccccttccnccnctccttaagaacctggacaaacnattggnaaccccttaagggtaaaacctacccaggaaangtttctccccagaagaagatgggcatccttgatgtaaaactgcttttcccaagatcactaatccaagacttctactattgagagacttatcttttgaatatattttccntgtttatgtctctgaccaatagaaatgaaaagggggtntattatgtgcatttatttatagggtgtatttttatttgtgagggattttgcagccagccttacacatgaattaccatatactttaatagataaaagatgaaggcccaatgtaggtgagaaactttgggggtacatatgttgcctcataatcagtcaaaacacctcttaacccacatcatggattagagagaaccttgccaggaggccttcactcttctagaaggacatcatttgttaggtccttttttcatggtttagaataaaataggcaataattagaaatgtcaccctcacaataagctctagtagaatttacacatcaatacatcaatacacagtgatgcgggccgccaccgcggnggngntgnagctccagctnctgtccgt

SEQ ID NO: 13218 - DNA, 167 bp, Homo sapiens
tgtgcgcttggcgaagagcctaagggcgcgatgctttaggctgagtttcattgctttgtgggcgagttaggtgagttagcccgtggaggcttagataggggggctacgttataaggttgataatatgaaagcctatacggacatcagacccatagaaatttgatggg

SEQ ID NO: 13219 - DNA, 713 bp, Homo sapiens
tcccgcgagacaccaccctcaccaccctccacatttatcaacaataaaaacaaaatacccgccgccccacgcggcggggagctcgcggcttttggttaatttcaaacttcgacagtctttctatggggaggggctgtatcactccgttgaaattcgatatcaaaataaaacatcacacacaacaacaacaaaaaacccacgggtagccctaactgaagtcgactcactcaatttcaacttgcattataccttcactgtaccgcttttccaatcttgaaaaaactccacatacaaaggaaaaataaataataagacactctctaaacactatatctctaccttcacatatcaaaaaagaaactctccactttaacacagcccataacataaccgaacatgatgttaacactaccgatatcccaatcaacctaaaaaacacaattccctactcacctcaatctacacattatccttactaatcctacaaataacaatatcttctacactcatacaacagctagcataatgatagatagttaaaataaaaatactctaactagactactagataaaaatagatgcctatttaatcgtaagaaatggtgtgaataataaaccatacaataacatccgacaccactagtccaacagcactacgtacccaagtcaatatgcacctaattaacaaaatatcatatagagtacatatgatt

SEQ ID NO: 13220 - DNA, 356 bp, Homo sapiens
tgccgcaggggcgcaatccgtatggcgatgggtaacgccctgcgacgatgcacttattaccgtcggttgagtggattccccctagctttgcctctgacctggtgcggggcggaggggcaagcccttggcgttagttgcttaccttagtcaggccgatgtgggagctgaccctgaaagctttaaagaggcgcctcctgtgggagaagggtatgggagagcggtgtgcggtgccgcggagctaggtgtggagatttgttagaggtgtcaatggtcggtaacatggagtagcttgtgcggaggcgccagggctaggcgggggcgcttgtgccgcgtagggccaggggtctttgggggct

SEQ ID NO: 13221 - DNA, 906 bp, Homo sapiens
  misc_feature (1)...(906): n = A,T,C or G
anttanggnatatnttttnnaanactnaaanggggggggnananttttnaaaanccccaaaacggccttttaaggntatcagggcnttttnagggccttttgntnanangtttttttnccaggnntatccncananttttgggnaaancagnttatcccncctttanannaagataaaccncgtttcnccccaancnnanngcccnnaggcnnaannanattcatttattcaaagaaaaggaaaaangcgncaaaaannnaaaancgccctttntccgggggtttnggcaantttantaaataaattggataaangggnanttgttttccaaagaannttaaaattgggaaagnaanggttttnccnagntcaagagnttaaaaaanaaggccagtgtaatttaatataaacnnnnnnntntnggnaanttngggtccgggncccccctataaggntgaanggntntaantannttaantangcnnanaangccntttcccantttaatttnnataaccnannaaaangngttttatnannancaacaanttttnnaaaaatttaagnnnccaagtgannttttttttaatttancncaccnggatacaantangcctattaaanttccncncnggttcnntngtaagaantaaacnttaccggaattaccggggaagggggctttntacccccattcctnngggccccncccaaggtggcntngaccaaatttgaaataancccggcgaaggaacccccaccggcctccaacncggggnctncccnagaatttttnatccaagccnaaattaaaaaccccccnagaattgccggggcncngcncnaccncgccgggtggaggtctacccaagtctttttttgttttccccctttttagtgaggat

SEQ ID NO: 13222 - DNA, 994 bp, Homo sapiens
  misc_feature (1)...(994): n = A,T,C or G
atgtgatgtgttgcttattgtatatttttaccactccaagacaatctatggagtctgactctcctggcacaacatgacctgggtcgtgtaatactactcactatatggcctcctccaaacatggggatgggtatccacgggtcagatttgcgactgcacaggaccatctccctctttccctctaggtgagatttagatctctcacgtattgactctgtggacgtgtagtatgttcacctagaagcgaggccattcattttcttccttcgtactgggtttaactgaaactcgttaacagagaacactgggggggggtgcagnaataccataggtttcctacaaattatcacttacatcacatgtatgaactaaaagactagattcagccctgcatctggtcctntatctggatgagagcttctgctggtcaagcttcccttttactcgcgggattaaatttatagatcgctcgcgctcactgtactcccttagctgcttggatctcttccttttcttgttaagctgttattaacttcactttaaaattcatgcaattcctcattatccccactcaaatcaaggcgggataatcagcacgtagatgatcacatgtcaactcaggtcggtctttcatatgtaggtccattcaccgcttaacaaaagaccaatagatggtgttgctggtgtttttatagacctttggcgctccccatttcctactctttacatataatatatccgtataaagaatgcatggccgtctaaccccccattaggaataatgagaggaactccttgtctgttgcccaatcgaaagcttcaccttttatgactcttattggtgtcaaaccccggcagttaactcgtattcacttcccagctctttctctctttcgagcatgccgtgggtctctttgactgatctcaacctgtccgttttataatcatactgtccgttctttcgctcttattgtgagtgggggcccaaccatcg

SEQ ID NO: 13223 - DNA, 1148 bp, Homo sapiens
  misc_feature (1)...(1148): n = A,T,C or G
cacgggatgactgttcaaacgagtgatcgccaatagtaacaatagagtggctcgtgtttcgtgacgtgtacnattggtcagcacacttgccatatgttcaacttgtgtatccgacgggaatatcgagacaactatgatatcgaagacatgctcactgagtgttggctgaaggtgcgtgtaatgtcacgcgtatggacagtaagatagagagaaatatagcacaactgagaactacgagtaggacaactgagtctcgacagtattggaatacctgcagagacatggtccagcgngtcacgacctgcgaccgcgaaatgaatatcctacgttatcctgtaactacgaactctgtcctctctgccctcgttacaactcacataaatgattcattacgtcataagaaatgcggggtggagagggtgcgtgtagaacactgcatacaggcgtgttagactagacagagnaacgtaggcctggaccaatgagggaaatattgcgtatataagtgataccttccatcctgcatggttaaccgctccgtacaggtaccgaacaacaggactgcgatgngaatgagcgtacagcgcgtataacattagttccgagcaattattccaaaatgaaattggtgtgtatacgatctacttactatcttattaaaaacacctgtcgtcagaacacagttggctacaaggcatcaccagtgacttacttgattgactctagctgagagcgagaaagagccgtcgactgtacgcgtacaactcgtatctgttctcaaacctaccatgccgttagagacatattgctgtgcgtcagtattcgtcggtcgaggccatgtattatgatggagcatggcgtagatgattgtaagaacctgtttaatactgttattttacacacaccaaagtcagcgggcctatccatcccataacgactatatctgaactcgtacaaaccacgatctcgtaggtcacttattcagtggctacacatttcatcgcactgtccggacgtcgactaagatcgtatgcttgcttattctattctcttatctctcgtaatctcatggatcaagaactatcataccacatatagactcttcacatgacaatacactaatctagttcatatatgttaaatacaac

SEQ ID NO: 13224 - DNA, 203 bp, Homo sapiens
gctgtgagatacggcaaacagacttgacaaaaaacaacacaggctgagcgctctcccctccttccttaaccggagctacacagaaggagttgagtgatggtagatatcaggccctggtctgcggcttggaagtttcctgtgaataagaaaaacgtcatcgcttcttgagtcacaaggatgataggatgagaaaaaaaaaaaaa

SEQ ID NO: 13225 - DNA, 244 bp, Homo sapiens
catgcatgtattgaacaaggtgcaaaacaaggtccaaaactctttgctgggggggtcaacaagcacatcacatagctctggctaagctgtgattatcctttgtttttaaaaaatcaacatagacaaaaattccatagcacaacgtccagcaagaatgagtctgtaatgccaattacctgtacctttgcacatgcagaatgaagtcattcttagtttccctggacatagtttaaaaaaaaaaaaa

SEQ ID NO: 13226 - DNA, 760 bp, Homo sapiens
ctggtcgtatttgatattggtggtttatcggttggggagcataccgatataagaggaggaaacacctcttgttgagaaagatagtagggggtggtgtaggagaaaacaggtggggggggggtgtattttttgtcacaaggggtatggctcctactgcaagaatatggggtgttttccccggggttttttgtatttgaaaaacatccgccggtgggtgtagtggctttgggttgcttagccgcatgttaaggggattttttttttagtgggtgtttgagtctgcccccccccatattatttctcctccaatatggaagaaatattgtggacccaaccccccccccccggggggtaagggtaaaggagttggccccaccaccccaggttagatttttttttataaggagaaagtccccccccccccctatatttagcggggagttttgggggagggagttagggggggcccccccttgttttttttagaaaaaaatctcttgcccccccgttttttttgttaagcccatatgccctccgagggggttgttccccccccgcgggggggggaggggccaacaaatgtttgtggcgccctaaaattgttgggtttggggttttttgttgggtaaaacccccactggggggggggggggaaaaaataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13227 - DNA, 832 bp, Homo sapiens
caactctctggcacttcagctctcaactggtttggccaatatagggtggccaaagaagcaaagaagcaattaaaatgtttattcctcaattctctctctactgtctctgatttgataacacttacacgccttgacaaaagaccgtaactcctatcaagtggctaaaccttaaagcgatagttctgacagacttaccgtcactacggcctcctgttcagacccaggagctgtgataggttcacactggtgcaatcctaggggttcccaatatcgttttgatatcgccagtctctccctttgtggccccactctctcttcccctcccttaccgcccttttcccacccactaccccccgtcccgtgtaacctcgataaagccggcagtgttacgttgcctaccattggcgtacccgttccccgtccgctttcccctgccgcccgattcccccccttcctcccttcccttttctattcttcccctttcgcctttcccctatgtaccgtcccccgacctatcccaccccgctcggatccgccgttgcccgcctccttccgcttcgacttgtcgccgtaccatcgcgcgtcctggtcatccaccacccgttaccgctcgatacccgtctacccaaccggcgccgtccgtgtccgcttccggtccgtcccgaggctcccgcccggccgctttccccatctcttctcttcctatgtcttacacccaatgtttaacccatattcaatttacaacacgcccttctcgctcatcccgctttcttttcgcatccaccccaccgtccgaattaaccccctttcaacccccgttaacacatttccc

SEQ ID NO: 13228 - DNA, 1370 bp, Homo sapiens
  misc_feature (1)...(1370): n = A,T,C or G
gtgttgtcctgattagcgattactgcacggaaggagtgacggagtgctagggccttcgtgngggtgtacttgggagagttgcgggcgtctcacccatcggcgttgagccggngggcgtggacggtggtttgctgatgtcgtattcgccgtgtagttcgtccgtctaccttatgtgtatatgtattgcattttctatccgcgcatcgtctggntgtggtgttcatcatgcgtcgtgccgcacccacgtctgcgtatgctaccgtggcgcagctgtcgtgaganttgacagctagatacgcagagaggggngtcgcgcggtgtggcggcgcgtggccgactggtgatgtgagctcgatggtctgattggagcggggtggaagatagggaggagcgattgctggttcattgattttatgagagggagtgcttggattctggcgatgtcatacgctcgcgactggcataatatcgtcatattataccgctcggttgcggccggtgtcaccggtggtttcgtcaccccgcgcgcgtatcattacgtatagactggtcatgtgttgctgcggtttgtgccatgctatcctgtggcggtcgtggtgtggtcgatcattatttccgatccgacgctgcggctttcctatctattgtgatttcgtcactgagactggtcacagaagagtgatggaacgtgccggcgttcgcatgccatcagcagactttgtgctcctccaccgatacttccgttgtgcacgccgtcgggaccgacgccggtcagacaggagatcggtattgaatcgttgctcgcgactgttcggactgcggccattgatcgtgtgtcagcggatgagttagatggtgcgaagtggcacgggccgcgccgcgcggcgccagcgtgtatagcgaaatcgttcgcttatattgtcgtacctgtgattatccgcgcgacggcgccgcgcgaagatagtcggtaatantcgngatgttatgacgacgacacgtgtccattgcgtgcgtcgtctttctctgatggtcgtgttattcgaattgtattagtggcggatgtagagantcggcattcatctgaccgncgtggantatctgtgttgctatggtgaggacgtggtccgcacggcaggtgacgtgcggtgcggatagttcgcgagtattcgagagtgagagtgcgctcgatgtactcatcatactctcgcggantgcgtccgctgcagacgtcttctcgctacagacgtcgcgagacgcggtgatgagctgttgtgtgtgtgtgtggtacagtcagtagcgcgtatgagctccgcgcgactcgttgntgtgcgtgtagtatctataatgcgacgcgcctagatacanaacat

SEQ ID NO: 13229 - DNA, 216 bp, Homo sapiens
  misc_feature (1)...(216): n = A,T,C or G
ttaaccnacataccttggcagagcatgtgagccaacagccagccccagcctgccagccgtgtgagcaagcagtcttggaaggtgattctacagccccagctgaaacactccaactgatgccatgtgagccgagaagagcagccaaactgagcccttctcaaatccctgatcctccaaatgtaggcaaaataaattgctggttttaagccactaaaa

SEQ ID NO: 13230 - DNA, 804 bp, Homo sapiens
ctgggtctactctcttgcccagtcttgcccttcaccactgcaaaacttgaacgctgacactctgcctccactagaagttcagaatagtttgttttcctcagttgtggaatattctttacccctcttgtatttattggtgactgtcattgaaaataataatatatcatatttttaatgggccatatctcagaactaaaattggagatttttaagcaggatatattattaccaatttaagctctcttttaaactatagccctccattgaggtaaaattagctaagatggccgcatttattgcatataccagagcttgtcaactagccaaaaattatctatacagatgacaagtatgtctctcgagaagtacatcaattagagtccacacaatggatgtaacccttatctaaaatggacaacaagttaatggacttttaagtacatgcctactttttagagaggtggccattataaagtttgaggcccaggcaaatccagatgtggacatatggaagctgaaggaaatatagaaaagcattatgccaacgagtagctgtatcaaaggctatgatcctgtcttaatcatcaaaggatatattttggaataattcaagtaagtcattacaagatatcaatagttatttgggttgggaaggaaagatgaaaaatatatatatggttgactcttactcaggtatctctgaccctctgaaatggctgcctggtacacctcaggatttaaatggatattccctaaattcttctaaaactactctcttggatagaccaattgttgtatcttaat

SEQ ID NO: 13231 - DNA, 731 bp, Homo sapiens
gccagaagcggtggctcacgcctgtatcccagccctgtggaggctgaggtgggcgaatcacagggccagagtttgagaacagcctggtcaacatggcaaaactccatctctactaaaaatccaaaaattagctgggagtggtggtgtgcacctgtagttccagctactcaggaggctgaggcacaagaatctcttgaacccgggaggcagagactgctatgagccaagatcgcactactgcattccagcctgggtgacacagcagaactctgtctcaatgaataaataaataaataaatacatagtaaatgtgtagactgaataaagcacattgttctctcttatgtgggtgaacctcattcaatcagttgaaagaaataatagaaaaagaaatgctgaccttctgctgaaaatgagaattcttcctggctgattgccttcaaattgagatatcagctttcttctgactttagacttaatctgaaacatcggcttcttctgagtctcaagcctactggcctttggactggagcaccaccatcaactctcttggatctcagacatttggacttagactgaaactaaaccatttgctctcctgggcctccagcttgctgtctcactccccagatcttggaatttgccaacctttataattatttcatgagactattccttattttatgtgtgtgtgtttgtataatgtaataaaatatattgtgaaatataaa

SEQ ID NO: 13232 - DNA, 781 bp, Homo sapiens
  misc_feature (1)...(781): n = A,T,C or G
cctgagaggatcaaagaaaattagcaatggntaacgtacatgaggcagagcctgggaaaaccatgtgcaagcttccaagggttctctccttagcagagttacacaggattcaggacaaccttaattccatgagcaatgagttttgacagcgcgtgtgaaatgttgtcaaccagggaagttcttaagaaactaagtgcccaggatttttattggtagttgaacatgcaggcaccctgcctggtgcatacctgaattccacacttccacaagacggatattcactatgaaccatattttttgcacagtttacacatatgagccattcatatctgtcttggtggcaaccctcctgatatttactttctcatatgtgtcccagcatccactttccggaccccctcctttatcgaattgctgtactgccctgctgtgctccctttttttttccatcatttaacatcatcttatcttttgtctttttctttctttttgctatgctcctcttcttccctcccccagctctctcctctcattacgcttcttgtcttttcccttggtcgcctgagcgatagcagccactaaacctttcctcgtgtctatatcttacttacgtcctcattctctcctttctctcgcccctcttgccctcttctcttctctcttattctcgacattacccgcaggttttgtgcgtctctatctaattttttctttacacctaccaccaatatagtacatccgatgttttattttcccgctccagtttttctctccgccacgc

SEQ ID NO: 13233 - DNA, 683 bp, Homo sapiens
ttgtttttgtttccctctctgcgtttccgccccctaaacgaagggcgcgggaaaaggcccacaagggcacagaggaaacgcccgcggggggaaaaaaacaccagggggggggaaaaagagcccccaaaaggggcggaaggaagggggcccaaaaaaaaaaccccccagggggaaaggggcccgggggggaggggggggggaacccagggggcgggcgcccggggggttccccccaccaagagggtcacggggaacggggggccccctaaatcccaagacaagagggtttgccggggggggggaaaggggggccccccgggggggttttaaaaaaaaaagggcgcccggggttttatgggggggggaacaagcaggccccccgccgggggggaacccaaaaccccaaccccccgaagggggggagcccccaaaaacccaatttttgggccggggtccccaaaagggcccctcaaactgggaaagggggggccccccccccaaaaccccccccccgggggcacccaaaagggaaattggggacccccccatcccaaggagggaattttggttttttgggttaacccctttcgggccccttttaaaaaagggccggggggggggaacgaaaggcaaaaaatgggacccccccccagggccaaaaaaaaaaaaagagagggcgggcc

SEQ ID NO: 13234 - DNA, 667 bp, Homo sapiens
  misc_feature (1)...(667): n = A,T,C or G
cattttacctgcgactcacgcaccgccgtggtgnacatcagacatgcggaccatcgacacagacctcttccacgcgcgaattcacgccggggggctggcctacngctctcacggtcgcctcaaccgaaaggggcacaaaaatcgtccatgaaattaataccataagacagcggaggcggcgctctatggctcctgcgccggcgggttctctccccaggcacggtcggcggaacgcagcccgcagcgttcctaggaccagttgtcccccccggggcggcgtccgcttagctccacggtcaggttttagtccccaacggtccccggtggttttctggtgtgcttagtaacaggccccctccctttgggaaaccccttatcccactgctcatatccggaggagcccactcctccactttttttgcgccccctaccagatgagacccttaacccttgcttgggggggccccccccctatgttgtcttcgtccccagagtaccaaaagaaagttcttgctcccacgggttcacaaaaaacaaaaaaaggttctgtggtttgcttttttttggactctttcctatttaaagcgcctcagggtgaccctcatgtcaaatcctgaaagccttgtagttggctgcaatgggttgttttaacgagcccccacaaagt

SEQ ID NO: 13235 - DNA, 462 bp, Homo sapiens
ctaggcacacacttgtgaaggaatttgctttaggcttgagacggagaaaaggagaaaaaaaaataacaagaaaatgaccatggaaagtaacaacaactgaaaacggataaaatgaagatgtgtgaaagagcacaagagtgcaaaaccaaaagtatacaaggagtgtttatgcagtaaccactttagaatgcctttcctcatgtttgaagacttctaaactagggcaaggacagatcccagcaactactggaagaataataaaggagaagaatgaggcattttcttctctcatatacagattatatgtaattaggatgctaaggataattttgtaacataaaaacggagatgctaaggagaatggtttcaccctagtttatagaaggagggtatactatggtctatcaaagactgaaaattgtcctctgctaataaagtctcaaatcaggaaaaaaaaaaaaa

SEQ ID NO: 13236 - DNA, 756 bp, Homo sapiens
cctccgtgagatatctccacaatctttcttttcgcaacccgccgccgggacaacagatctggtggattaacccagggattttgttcggccagaggggccctccccgcaattatttttctcgtgcacccctctaattctccccccattatgcacgccctctgttatttgtcccaaatctccgcgatagttccccaggggccacaccaaagcaagggggcgataaatcgggcccaatgaggggggcggccccccattttaagaatatgccctaggggcccgcccggaggaaggggcataaaactttcccaggaaagggccctgggaagaacaccccacctaatccgcatttaaataatattttttgacacccccaaaaagccccaccccagggtttcccggagtgtttattccggaaccccttttaacagcctttcctcttttttcaaacctttttaactaaggcaagggctgtttcccccctatttaggggagaataataaagggacaaaatccggcctttttttttttcaaaaacaatttgtttgttatttgggtcttaagccaattttttgtacataagaacggaggtgttatttaggatggttttccccttgtttttaaaagggggggtttccccggtcttaaaaagaccaaggtttttccttttctaaaaaagtttccaaaaaaaaaaaaaaaaaaaaaaaaaaaaaaaaaaaaaaaaaaaaaaaaaaaaaaaaaaaaaaaaaaaaaaaaaaa

SEQ ID NO: 13237 - DNA, 648 bp, Homo sapiens
ggcctttctccggggtgctctcggccgcgtggcgcctgtggcttctctggcccggggggcctcccggcgtttgtgtttgggcccgccgccgttgctcgggccttgtgcccctcccggtgttttcgccccgcccctgccctctgggccggggcccccccccctccccgggcgtgttgttttggccccctgtgggcgggcggggcgccccctgtgttggtggttgtccccggggcccgccgggggcaagttcgtcgtggacttcccgggggttttgtcccggggggggcccccccctttctacccgtttaaaggattttgcggggggcgcccccggggggcccccccccggttttccgggggtgtttttttcgggaccccttttgccggcccttccccctgtttccgttttttttgccttgggggcgggctgtttccctcccctttctgggggggttcgttgggggggggtttgggccttttttttttttccaccccgcttttttgttttttgggttgttcgccttttttttttccctttggagggggggggtttggggggtggtttcccccccgttttttggggggggggtttctttgggtttttccgggcctgggtttttccttttctttttaagtttcccatccggg

SEQ ID NO: 13238 - DNA, 807 bp, Homo sapiens
ctgaggatgacattgatattttgaatatcgtggttgaagacaaggattgggaagatatttgtaccattcagaatatatgcatgctgtattggtccattctcacactgctataaagatggagtctcgctctgacgcccaggctggaggcaatgggacgatctcagatcactgcaaactccccctcccgagttcaagtaattctctgtctcagcctcccaagtagctgggattacaggcgcccgccactacgcccggctaatttttctgtctttttagtccacaccgggtatcaccatattggccaggctggtattaaactcatgatctactgaccccctcgcttgcccctccccccccgctccatattatcacgctcgacctcccccgccccgccacctcctctcgaacccctgaccataaacatctatcctccataccatcaccacccaacactttccttctccccccctctccccctaccacctcccacttttctctacccccccccttaccacccaccaccccgtttcccctcgttcctttttctcccgaccccccccccaatccaccccccacccccacatccccatccaccttccccatgattctctaattctatccctcatccatcacccgccacctccactatatcatcactctcagctccacacactccctccccaccccagcaccactgccccgtcacctcccctctcctctttcaccccccatccacccacacacccaccatcaaactcacaaaccactccacaattacaccccaccacacctccacatcccgcttcg

SEQ ID NO: 13239 - DNA, 821 bp, Homo sapiens
  misc_feature (1)...(821): n = A,T,C or G
cctaggatcagcaagctgaactgccgttataattcaagcaatgagaaagactgcaagaggcaagaactttctttttctcaagagattgggaaaccatgagaggaaatatactcataaagaaagaaaggcaaaactttatcaaaggataaatgacaacaaatgattctgagatctaaatagtgtctcttgacctcagacttgttgttcttgttgttgctgttgcttggctagtccacagactgatggttaaggccacagaaggaaattatgcctacaaactgaacatctttgccctacctttggattaaaacgcatcattgaccagcgacctcccgcatcacattccttgcagtgggaatgagattctttctcttctcctcctcactctctcatctctagagctccccccccctcccccccctctctttctatcttcatgcgccctagaccctatagccccccctccatcactccactttccgtttgtcctcttcacttgtccctttttgtggtcccttgtccctctcaccccccccctccgcctctctcccttccccccctcccccccccccccctcaccccatctcttcgtccttaccccaatcccccctccctctctcactctcatctttcgcgctcccattacctttttataacccctcacttttaaccctccctccacctcactctctctncccctccctgccacccctccccccccccctcctaactcccgcctcttcctccccacatttcccaccccgtctcctccctctctctccccattctcatcctttcgatttcttctacccccattctcc

SEQ ID NO: 13240 - DNA, 299 bp, Homo sapiens
cctggttttacgcagtggcgaatttcacatcaaagcatacagtgtctgggagaaaggacagttatcaggctacgccaatatcagtcaaacttcaggaaataaattataataaacacgtgcttacagtataatcccttttcttcagataatggactaaaaaaacttgagacgtctgaagaaaaagaaacttcataggaggaagaaaatgttaaaaagtaataaccaaagaaaaagtcagctaactcccacagcctggtcttgctgtgctgaatggcagagaagatcacagaggaagaaga

SEQ ID NO: 13241 - DNA, 824 bp, Homo sapiens
  misc_feature (1)...(824): n = A,T,C or G
cagaagtgaatgacccatgattcagggctgtggtgtctccatctctgcctgctggaccacccctacccccaccctccagaggcttgtatgcactggccaaagaattgcctcagaaggttctccgaagtgaacctctgggagttgagagaaagagataaataacttctcaacctgatgtttaagcaacaagaaaccaccaatttcagaataaaaggctggaaaatattacttatgaaggtgagcattatttttgctttaaattgaagctgaaaccctgcttgacaccgctactctgctaatcctggttgncttttaaaaagaaaatgcttaggatacctaaacaatcttgataaaaagatttctacatcttttaattaaatgagagggcaatctactaagctaacaaaaagaactactttcaggaatgcaacagattctgcctactccattcgggatgaccccttaaaaataaataactacttcatgagttgggcaagtaaaaataagatattgtggggcctaaaaactcttcctcaaggagcattcaagcttgggctcagaaacccactttgcaccaggattaagcccgccctcccgccaccatccatgagggggagtcttctcttcctaacacaggggggaggggcatttatgcacttgactgtagttaacaaggttgaccttgcccttgcatttacatggggcggcagaggccacatttcctggcgtccattacgggtctgcgggttcaaattaaaggccgggtttcctgtgtacaaatcctttaaaacaattgacctcgtggggttttgtataataagtat

SEQ ID NO: 13242 - DNA, 702 bp, Homo sapiens
acaaggcgagaaaaaaggaaatacacgcactcaatgccccgagcgaaagcagaaagcgttaaaagttgccccctccgtcgacaattgaaagtacgtaaagaagcgggagcctccacattccaagcgagcagaaggcaagtaatctctaagagcagagcagatctgaaggagatggagtcacaaaaacccttcaaaaaaatcaatgaatccaggagctggttttctgaaaagatcaacaaaattgatagaccactagcaagactaataaagaagaaaagagagaagaatcaaatagacacaataaaaaatgataaagggtatatcagcaccaatcccacagaaatacaaactaccatcagagaatactacaaacacctctatgcaaataaactagaaaatctagaagaaatggataaattcctcgacacacacaccctcccaagactaaaccaggaagaagctgaatcctgaatagaccaataacaggctctgaaattgaggcaataaattaatagcctaccaaccaaaaacagtccaggaccagacggattcacagccgaattctaccagaggtacaaagaggagctggtaccattgcttctgaaactattccaatcaacagaaaaagagggaatcctccctaactcattttatgaggccagcatcatcctgataccaaagcctggcagagacacaacaaaa

SEQ ID NO: 13243 - DNA, 894 bp, Homo sapiens
  misc_feature (1)...(894): n = A,T,C or G
ggggccggcggcgctaggtgcgcagcgcgacgcggagggacnnnnaaccttagtatgtatgctgcatggggaattgacatacccaatcgattccagtagttctagtttgtcagctcaggtttaatctccaccagtggaatcgtattctccacttagagcttccatccatgtacggaaagttacatgaaggcattgaataaaagtgttggactaccctcaggacatgactgtttcctccaactctttaagtaaaagggcaaagtaaagattttgatgggaaatttttttctgtgggcgagctcttcaacttctttggtcattacaaaatgattttctcctgcatacaacttcaattccaccttgattcaacacaatccagtggtgtctaaccgtggaatgagcaaacgatggcagcccagatcagacaggacttctgatggtatagaagactgcaaagcaaggggcttagtgggaacccaatcatgagacccagaaagggaagcggtgggactttccttctataaaaaggggacgttcaatgggaagcccctctggcctccggtgactcctttatacaccacatacccacaccccctccaacaccaacccgcatgtcgactgagggactccgagggcggaggggcgtccgacgcgcgcttgccgctcctagcgtgcgtgcccgcaaaccccgcccaccacaattaaggcgatctgaacgcggcgccgtacggcaatgtgcacttgttgccggctccacccaaggggggggcgttaactaaatgtccttttaagatggccgcgatgcaaccgtcgggaaattatccaaggacccggtgctccccacctcctcccaagctccctgttttctcagatgtaactgcgtccttgcctgca

SEQ ID NO: 13244 - DNA, 859 bp, Homo sapiens
ataaaattgtatattataaatagcgttttagataaaatgaaatgagacaaataataaaacagatatatggattaaaatgaggtaatagtgagtatatggaatgtatcagtaaaagaagatagaaatttagtatagagagtctaatagatcacaagaaattacatagacatcctacagtatcactaaaagcttgcaaatcgaaagttacacaagccgaactgaattaatacagaggcgattatgtgtatatcagttaccaagtttaaaagtgcataatcgagcatggtagtgggacgttctccctatgcagctgcgcaggaagaaaaattcattctgttccgcagttcatgggcaccccagcattcattaggtgcaacagcatctattttaataaagcatctgtcttcacatgaccatctgacccgtgcatctgtgtcttcaccctctgtgtatccactaatgtgtgtgagcccaaatttccccatttttatacagtagggacagcagtcatgttgtattagggcccaatataatggcctcatcctaacttgatgacatccataaagactctatttccaaatgaagtcaccttccttgattccgggagtaggacttgaacatatcattttaaggcacacaactcaactcttaacaggcagtattgattttatgtagagactgtgctgtaatttttacccagccaagctcatttgcttatctaggtaataaatagataaactgaataaaaaaaaaatcgtcctcgttggcagcagcggtggagtgttaccaacaagcccttttgtcttttttcatccctcagcgacacccccctccgctccctccccctctctctctcccc

SEQ ID NO: 13245 - DNA, 888 bp, Homo sapiens
aggaacatggcaggaataagatattttctataaacccagaaaaaaaagcctagcttgactcctcaccttctcctcctgagccacagaaaggagctgtccaaactgaagatgtgaaagctaaaaagtactgacaacctaggtccactgtttctgcaccgctatttgtgacaaactggcattctacaaatgacttttcaacaataagaaagatggtatccacagattcgaaccttccctcacagccagctttgcttctctctgcgggctcaccatccctcgacacccaaggctgcgctcacccactcgtgtgctcccctactaccccacctccacgcgccggtcgcccccaccacaaccactccgcctcgtccattccacctgcccaacgacggcacctccccccccattcctccgcgcgccgcccctcgtgtcgagccctctcctaccactccgggcgtgccccgccccgttctcccccgccccgccacctccctctctatccccctccccccacgcctcccgccctctccccccatctcctgtctcccgcacctaccccccagatgcatccacttctccccccctccaccccacattacccactccccccccccctcccataccgatgtgcgctgccctccagctccgcccctcgtcctcctcgccctctgcctcccatcctacagatctactcctgctgacaccacatcattccctccccgctcccaatcgtcgctcacgcgtctgcttagtactagagagggccgatccccgcacaccccctaattcaatctcccccatgcttacacatccatcctccacaggccaccaccctcctctctcgtctgcagctatcacatactactatcaacctcaaataccaagcag

SEQ ID NO: 13246 - DNA, 851 bp, Homo sapiens
  misc_feature (1)...(851): n = A,T,C or G
cttatttttcatagttcttctatagcacacccanatgtaggctacctcatggctttttggggatcgcctgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggctgctgctatgggcaactcggtttgggatagtcggacgaggagttgcttttggtctctggagtgcctgtgcttccatggccaacactttccggagcgttcttaacttcttctcgtcttcacttggttatgagtattccttgtctggcgaccctccctgcccaattttctctcgccacctattttttctttccaactcaggagtcctcatatgtaattggctccctcgtgtactgccgcaaacaatatctttcaattaaaacctcactttgatatttttgatttgttggtctgcactggcgactttcttctccccgttttattccatactaatattatctcttgtttaccccatcaccgtctaacagcttctctcccccccctctgccaccgtcgcgatgctctccactcccacttccccgctcgcccttatccctttaaacatcgcgacaacctctggctccctgtgcccctcccccccctcncttgcttagtttagctcgctttctcacttttttctattctctatagcgctacgatggctgtcttatcctttactgacttgcgttcacgtacatttaatatattgacattccttacattctcactcttatctnttactt

SEQ ID NO: 13247 - DNA, 902 bp, Homo sapiens
catgccggtggcataaggaatcacttcaactttcaagctcttattagttaagaaatacatcttgtgtggctatgactgccatagatagggattcttctgatgcatttggacctgagcaaagtacatcgtaaaccttttgaaaagaatttaccattccagatgccactaataacattgtgactcatgggagcacatcaaaatatcagcatttacaggagtttgaaagacgtgcactccagcggcggggcgattgactgggagggggcccccattctcgatgggcgtgctgcatgcgccctgggtcggcccgacgcagcgacatcgcctccccgcgcgcagaggctgccttggctcacggcggcgcgggcgggcgcgcgcgcgcgtcggggggcggcgctagccggcctcggtgcgcccgcctggcgccgcggactactcgcgtgcgcccgtcgctgagtggttcgcccgtccgccgtcacgcgccctcccgtagccgcggctcctccgttcggcgtcgccgcctctcgcgagtactagcatgccgcatggccgggcttgcgagcgcgcgaccgcgctgcgatcgcgcagttcagagctgcgtgacctgatcgcctcgttggcgcgttctcgctgccctggcccccctgccatgcgttcgtcggctcgcgaatcggcgccccggtgtggggtaatgtcgcggtgacatcggtggcacgcagggtgcgtggtcgggggcgtttctctgttcgtcatccacgcttagctagcaagtgctctctcccgctcccatctcgccgacctgcactcacggtcgcgcggcccacctcccgaggagccgcgcgctcgcgctgcaagtgttcgcggcgaaccacaataaaccgagcgtggagcggcgcaggtgg

SEQ ID NO: 13248 - DNA, 731 bp, Homo sapiens
caaatgggtacatgtaaggggttcaaaattttcatgaggaaagtacctgcaaatatggtagaaaatagcaagagacctagcatttaagatcataattaaagacatgctgcaagtgtggagtgaaatcaagactgaacatgggactaaattgcagcaatctaataataaaaactaaagtggacgaggaggtgcttccaataaatgaacaaagaaagtgatctcttgaaatgaaatctgctcctggtaaagatgctgtggacactgttgaaatgacacctcaagatttgtacatacacttaattgataaggcagccacagggcttgaaagaattgactccaattttgaaagaagatctgctgtgagtaaaatgtttttaaacatcatcacatgctatagagaaatttttcatgaaaggaagagtcacttgatgcagcaaacttcactgttgtcttaatttaagcaactgccacagtcaccccaaccttcagcaaccaccacccttatcagtcaacagctatcaacatcaagacaagacactccattagcaaaaagattatgactctccgaaatctcagatgatcattagcatgttttagcaataaaatattggtaattaacaaaagcacatttttttagacataatgctatccacacttaatagactacaaaatagtgtaaacataatgtttaaatgtactaggaaatgaaaacatttatgtaactcacaaaa

SEQ ID NO: 13249 - DNA, 879 bp, Homo sapiens
  misc_feature (1)...(879): n = A,T,C or G
cctagttggagcacacagttggattctattcttgacagagctttattttggagaggagacctatttctaaaggaaaattgaggagaagcttgatgacttcccaagaacaatttggtagaaaagagtgctgatgaagaagagaggacaacacacaagaagacacagaagcaccatgggcaaaccatggaacaagaactggaatgaatatctattccactaccctgaactaaagactgcagacagagaaagggaagacaggggtttaactggcaatttaaagtgaggtgatcacccttctgttacagagtcaactgtgctgtcacgactgccacatctcatgtctacgtgtcgaagtgcacacctgcctagccccagccttctactgctgcctgacctccagctcacaacgcgagctcagccgcccacctctgagttacccgtgttacaatggtaatgctccgttcacatctgactctctattataatgctcggtctgtgtttcttccgctgtggtgaggtggattcacggtgctcaggccaggggtgtctgcctccaccctccacgcggcacacgtctggcaatgatgcggtcattgattgtgccatgacgcatttcagctatttcttccgtgtgatcgcgctccgcccctgtcaccctccctcacctccagcccgccgcccctggcacgttgttgggttgcttcctcgctcgttatcataggtcactcatacgaagcctgtcgatcatgcagagcgatgcgcgttcgtgtgccgcgcttcagcgcactgcgccgatccctccctaggccacgctctgtccttctatctcgctatcttcaatagtctttctcctacgctncaccgactagtaattacact

SEQ ID NO: 13250 - DNA, 727 bp, Homo sapiens
  misc_feature (1)...(727): n = A,T,C or G
atggaatanagttattacatacagttattatctttgtaatatctatagaatctcctgtttattcctgatgtaagttaattttctcttcttaattattctcttgaaaaaaaaatatatgtgtgtgtgtgtatatatatatataaatgttactagcctcccagttttggctttgtcttctctattatatttaattattagtttcatcctcattcatcagtgctctttctttaatggtttcttctttttactttcttttttgctgttcttttgtaatttctcaagacagatgcttaaagcattacttttaagccatcttttcttttgaatgtgtgcttctaaggctatacattttacatgctgtacttttcaaattttaatatgtagtattttcattatcattcagtttagtatactttcttttttctcccatgatttcctttagatgtgtttttataatgtccaaacatatagtaattttctaggtatattttgattgttaatagttgttaaaaacatatacctttttaattaatttatttgtacttgttttatggcataggatactgtccaatttttatatttttgcatttgggggctataatatttattaaatctttctttctctgtatccttcttgaatttatatatgcaaactgccactgactgtgcatttgggttcttcttataattttattattttataaaattatgcattttgaggtcaaaa

SEQ ID NO: 13251 - DNA, 766 bp, Homo sapiens
agaatacacaaagatgaaaactggcaacagcgttggaaaccaaagagaagaccatatgccaaagtccctaggggattttcactaatgccaatgctgaagagacgaacaacacattcttggattctgccataagaatcaaacatgatcccaaagaaagtagaagaagatggatttgctttgcctccatcgaatgatgggactcaggggctatgctaaacaaacaaaaaaaaaaagagtgatgatcttccatgaactgtccttagagaggcaccattgtgcctcctctcaccccgaatgctggctgctttcctctctatgtccacccccacagcaagcagcagactaacatggaagagatcaggcatgagatgtagcttcctggaacatggaaccacctaacaaaacaatctgaaacaacctcagaacactccatattgtgagtgtaggatagaagcccttttatccaaaaggttgggaaattagggaatcaaataatatagcattccttaaacatttagtttgaacttaaaaacatagatacttccaactatgttgtcaattttggaataagtgcaacgtggtgctgagaagaattatattctgttgatttggggtggagagttctgtcgatgtctattacgcccgcttggtccagagtcgacttcaagcctggaatcttatctactttctggccacgcactcgcctacggcgacggggggggcaaaggcttccaatatttacggtgggagccccctctccctatgg

SEQ ID NO: 13252 - DNA, 727 bp, Homo sapiens
gccctttttttttggacaaaaaaaaaactccctttgggggggggcgcagtcgcgccccccccccgggtgggggcctctccaaaaaaaaaaacaccctcccggggggggcggaaaaaaaaaaaaaaatggggggttaaaaaaatttcccccacagggacccccggggtgggggtaaaaaaccccttttttccagggaaaaaacgccccccccggggccccccaaggggggggggttttttttccccttttgggggggggggggctccctccccccggcggggggataaagggggggaccccccgcgcccaaaaaaagggggggggggggggccccccccttgggggttaaaacccccttttggggggcccaaaaaaaaacggggggggggggggcccccccccccaaaaattttttcccccccgggggaaaaaaaaaaaaccggcccccctcctggggggggggaccccccccaaaaccccttggggtttttaaaaaccccccccttttttgggccccaaaaaaataaaaaaaaaaattttggttttttttttttgggaaccccgccccccaaaaaaaaaacccccgcggggggggggggttttttttttccccccccccctttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 13253 - DNA, 1537 bp, Homo sapiens
  misc_feature (1)...(1537): n = A,T,C or G
ctttaacttactactaatagtagaagagacgacgagcgctactagtgagagagtagtacgtgtgcatactgtgngnggttaatacagagcagcatacatatgactacatanagagttagtgagactggccanacgtgtgagcgtctannantaactcgttaanagtctcgcgtgacaatctgcacatantgtctatagtangnnaacagtgatgcgngagtgcgatantacgtatgactagtctgaatagantatattgatgatggatatacgcggggantgaccgctagctcacatgtgtctcacctgtgaatacgttatcgcactcgtganccatatctctcatcncgcgcacgcccatctcacttcagcactntnnnntccctcattatagaggagtataactgtagagatagtaatagcactacaggggcataatgttaagacgaggcgtcggtgatctggtcgtagggacgaagagaggcgtagtgtgtgtggctaagtgtgtaggtggatgtgcgagacggaggagtgcacagagcagctgagagatcatgacgtcgatacgcctcgtgtgtgtcgcacatcgtatganatatgacagtaatcacataaacgaagtatgnnaactacgtattctcgtgagcgaggaggcactgctctatagtttaaatcntacttcgaggcatcggtactgcatactcgtcacaataacattacaaacaaaccatctcattgtattncnacatcaatgtcacatagcgagcacgcgtgatactcatgtaattcctttactatcatcggcatgcatcattaatatcaacgtnacagatctnnaactttcattacgtaggtgtacgcacaatgataatgtctacatgaggncacgtgaggtccggcgttggcgacaggtcggggaactactacatgtacgatcgacgatagaatacacaagcggaggtgcganaatgaggctgtcgcggaacatgggaccacgtcgtgtcgtgcgtgatagagctcatcgcgagactaacagtatgatgagacacataggatctataccacgagtgtnagatntatgctccaatcttncaatgtcnctantatatacanacttctcgacgtcactanctnatggctatgttaatctcgtantctagtttacttatgatctctnatctgcgcgtgcnatcgcagcgtgtgagggggcatgtgccgtcgcngtgcagtctgtgcaggcaccaaggggtaggtgatantnactctcgacggcacctggcggaataacgtntngcagcacatgcgccgcanttatnagantggcgcnacctctntctatatgctgtncngtgctcgctgcggctctgctgncgctaacnaagncngngtcgtgtntgnntctgtcntgccgcctaactgaacccgtttnccttcctcctttctttnnnctctttctctctctnnnctntcctttcccntcntntcttattttnnnncccctcttcctnnncncttcnntnnnnccccctttttatcc

SEQ ID NO: 13254 - DNA, 722 bp, Homo sapiens
taatagtaataccatgcaatatttgatcggagaggcgcataagggcgggaacagaaagaaaaaaaaggcaagcgacacagggacgcaggaggcaaagtgaacaaggattgaaataaagaggcaaagaccatagctaatcacgaacataattaataagactgacaacaaaaaaaaatatgccatactaaattagacatctatcaacagtaatacgaagtcctgtgctaaataattataaagtcaacggtaagatgagaaccacgtttctgcggaagcactgagattgtctaaccctcgagagcgctgtcatgaaatctagaggccactcgaggaggcgcctgccgttctcgatcacagatagtggaaagaactttgactcaagcacctcaactcagcaaaacagctcagcagcctgcaccctggcctcatccaccgctcctgtccagccagcaatcaacctggagaggacccctcatgctttgggaggagcacgtggaagctggttcaagtcacagtgctccacctgggaaggaggtgattttgagcttgggaaaactgccgctaatactccatagtcaccagtttttttcccaaaaaacgaattaaaaccagaaactagcagtaaatattattcttatttatgcctcataaattaggaaaaaccagcacaaagacatgtgaaatattctacctgggatatttgaaataaaattaaatgggaa

SEQ ID NO: 13255 - DNA, 1490 bp, Homo sapiens
  misc_feature (1)...(1490): n = A,T,C or G
cgcagaatcatactgatgaggtgtatggagcatgaactaatatgtaagtgatagtgataacacacgtngnnggcagacatatccaactcataccacatcgtagacacgacaagaactctcaaacatcacaaccatcanngcaactatcatnaaactatttgagcacgcttctctctagtacttgtcgtngaggtctcgacgagcgacattgcgttactgntggctcttatcgtaagtgtctgttattanggatctagtantgtgtagacctctacgaccctcgangcccgctgncgnctcttagtccttatnnggttcggcgatgtacctcggcactcatgtcgctatgtattangngngagcacatatgtgagacttcaccctctactggattcacaactacttgaactaatctcaggatacatctctcagtgagcgcacgaattcagtaggacgacacgaacaaatgtagaggcaagtgntgatcgtcatgagttgcatatatatgagacgatgtcacagtttgnagacgtanatgagaggtagtgatcctgagacgagtcgcatggagcggacggngtgtctgtcagacgccgtagtggcgttcttaagatggaattgagnggatctcgnatcacaaactatatccgcactgatatttgtgcagattcgcagtctcttctggagcagattcacattctcgtctacatacacacgtgactctatcattattctntaacatcagcccacattatngaactaccagacgcgcgcgatgnnacttagcgngctcttacctctactattatatggtacatnaattcgatnaactaatcacatcgnatcacagacaccacgaacgtnnncacatagtatcaatnaaaattcacaatatatatatagtatacataccttctcagtnncctcgtttacaacatacatgtgatnangngtgtnnactacactnttcgctgttcgtggtgactgagatgtgaatggcgagctagctaaggggagatacgtggtatgatatacgacctgnnnactctgaagccataataccgcgagtaatccttatctgcnactgtncactctctatctcatatggtacgttcgattcttgtagtcgctagcgtcgtcatatctatagtatantgcnttccagccgacgancgcgaactctgtatattnnactcaactatagctgncacataaagtcgganatnnnannttaccttnnccccttctctctctcttacttctcttattnnncttactctcttttctttcanctcttntcttccacttntnnactttctttnncacgttacatttctgtctgngncaaatactgncgcgtgcnnnnnccgtcttccnncctcaaaacactnncntttccatctncctnnnncctntctctcctnnctcctctcttctcttnctctcatcctnnctattctctnncccctctncttccactcatatctcct

SEQ ID NO: 13256 - DNA, 727 bp, Homo sapiens
aaagttgtccctggtcatataacgtccggccccaattaagcaaaattaggttatcataggtaagaagcttaagaggcagtaatcgcctccattaatagagatctagccgctattctctgctctcttaagtaattaagcacgctatctcttcctccccagtatatgcgttatgccatgaaccaagcctctgcaaattaaagatgtaggtagacttgcataaccctctcctttccccctcacacctgaaagagcccacgtgttccagctaaatgaactgtagtaatatttagtctccattttttattcttttgccttgaattacagattcttccatgcaacacatgttctgagcctgattttctaagcttagccactccaataaccaagtaagattaatttaatgagtcctcttaaaaaatgtttctttgttttagcatatttccattgcctcttccatttattcatagggatctgttatctcacatatgcttgtgtcaaaggacaaaaaattactgtataagtagccatataaggagaagtttcctttccagaaaacatgtggtggacacagggcatgtgaaaacatacaagataagcatactttcatacttttttctgtcagtcatggctacttattgagtcttgtacacccttttttatttccaactcctaatgtataatttagcttgtaaaataactttaataataaatctgtggtattttgaaa

SEQ ID NO: 13257 - DNA, 825 bp, Homo sapiens
  misc_feature (1)...(825): n = A,T,C or G
ctttgttctttctagattgaaacattatcaaaggccagcagccacatttggaagcacagtgagccttgggggataggagtccctggctgtgctccacgccaaaccctctgggctatgcacagacttgagtcctgcccctatcacctctccaagcagctctccttgccagctcaagtgaccacaggagttgcaggcttcctgcagctaggattccagagctctgtgttacaagcatgccactcctttctccaggaacctcgaggagcaaggaatgagttccagtgatcagcaaccctgtacagagttcctatcttccttccccttcattcgaggatctacatcccccctccatccactgtcagtaccttccctctgaagatgtttacagagtgctggtcttaccaatgttcttgtctctcttgcttgaaggtgttcttcttggctgtgtctagtcatcttggctctaaatcctagacttattattatttgctntatatatataattttactgttgttataccccatttgctgaattgactcatatatcatataattaccttgcctctttntatattttttgaccaaaatctatcttatctgatgcaattataggtactcttgacctcttttagttctaattggataaaaatcctcctttaattccttcactttggctattgatatttttaaaaaggaagtggggtccgtctatgccagcatatttttatatctgggtttcctatccattcatgccatccaagggcttcgggtggataacctagccattacatttatttaatactggaaggaaggcctacccccacc

SEQ ID NO: 13258 - DNA, 794 bp, Homo sapiens
  misc_feature (1)...(794): n = A,T,C or G
ctgagatggctctactatgttgtccaggctggtctccaattcctgaactcaagcaatcttcctgacttggctatccaagtgttgggattacagtgtgtctcagagactgcattccacgtgggagatagaaaacgattaagatatagaccctgccttcaaagaaagtccgccatagaaaacaaggcacataaggacttcacttgagaaaagatatatataaaagacagtcacagcacaaaaaagtattatgctctgctgaggaggaagggattaaaaaacttccaagcaaaaagaacaaggcacatacaactataattggtccattatagataaagaaaaagaaaaaaaccaggcacagcatgtaaatggcggaagttaaatctgaatctagggagtctaggtctagagtctactcccttanatcactgcgctatagtgcccttcacccttcaattcccttatgagctcccacagatctttctagcaccaacttacacgtctccttaactataaagccttttcggaagcagaactgactttcaccctcttttgtactatcattatttttcagcattgcatatatcacaccatattggcatgatttggtgacatggccatcttttattagagtgagaggtctagagacaaaacctcctaataatcttatgtccctttataatcacatgcctggctaacagcattcctaacattacagaatgaataacttcagtagaaagctatttttattaaaacattcaaggttctcccagcccatattaacctctttgaggcct

SEQ ID NO: 13259 - DNA, 825 bp, Homo sapiens
  misc_feature (1)...(825): n = A,T,C or G
ctaattaataaatcccgaaattattgtagtaaccaaccaccctgttaccacaaatacatagccaaaaacaaataacataacactcctcaaccctatataaatcctactttcttttcatacagtgccatagttcacggcctcaaacctaangctatctttctcttgggccatctgtatcttaataggagaatgattttataattacattatagacacttattcaanaaatatgtccctctcatccaatcacgaatcatggccatagccagctgtcgctagacattacataaagaaggattaacttcagtagatatgcataattttagtcgagaacgatttcaagttatgaacacagcccaatgattctcgtactggtgatgcactcagttttagttataaagaattgtatatattcacttgtagaaaatggaaacataacataaacaaatatttaagatgtcctaagaatatctgtcagtgtcctccgtaaaccaatacacaatatctaaaattcagcttagtatggatttcagaatgtaatccttatcataagccaatccctaaaaaatatgtccccggagtacctaccagtggcaacaagtggggtataaaccagaacttggatgaagaactaaggaagaggtcagcaggggaagaaaacaaaataaagattttgattttcataattttgacccattaactttaaataaaactcagtcaaaaaccaaaaaaaaaatcggcctcgtggctacagcggggagcgtgcggccaaancctcttttncttctttccttcctttcctttnnctcttnccttttccttttc

SEQ ID NO: 13260 - DNA, 440 bp, Homo sapiens
actaaagtataaatattatactagggatagtattttgtctttaaaactcgagtatataaaatatttttaagatctttttttttggtggtggttgttagctcaaggtcatcttcaagaacatcactttttagcagctttattgaaatataatttactaacaataaagcctacctgtttaagtatacaattcaatgattttaaatatatttactgagttaaataaccatcattgctgtctaattttagaatacttccattaccccagaaagaaccccatagtcattagcagtcactccttgtacataccacccctacttgtccactgcccttgatctaaggaaggcctaatctgtatttggctctatgaaattgccctgtgtggacattttgtttaaaaggaatcatacaatatgccaccttttggggggaacttctttact

SEQ ID NO: 13261 - DNA, 686 bp, Homo sapiens
aattcctaaaaaaagtgcacagggcagaatcccaaccacatcatatgatattctatatctcaaggtacccaacatcttttctttatttctaacaactttttcaacaaagaggcttaagtttccacgaccgggccaagtttcaaaaattttcaaaccggacaaaaagtttcatcaaaggttaatatgcagggccatttagaagcggtgcccacactgcccaatactctcccacaatgttaggtttttccaaaaacaaaattttaacaatttacaaggtggatttttaaaacccctttgtttgggagccccaaaagcccccacttgttttaaggtcggagttttaattctttctttaccctttggacaagaaaaaaccctgaaaaattttctggcttataccccattcccctttttcattcccttcaaagggagtttattataaaaatgggacccctggtcgggaaactcaaaatcccccccccattgtgaaaaaattagactaaaatcccttttttttttataagaatgaaattaaaaaccccaaacttatctttttgtaccccccccctaaaattattttcaaatttttgggaaattagtaagattatttcctccccctaaataaaaattttttttttaatgcccaaaaaaatatatttaaaactttttaaatggttcccaattcc

SEQ ID NO: 13262 - DNA, 820 bp, Homo sapiens
cgggacacgcctgcgccccatacaaacatcaccgacaaaaaaaacacgtttcagggctactctgtcacccgtctggagtgcagaggcatgatcacaactcactgtcgctcaacttcaagcaatcttcccacctcatccttccaagtaactgggactacaggcatgcatcaccacacctggataattaaaaaaatttttttctacagatctcactatgttgcccaggctggtcccaaactccttggatgaggcaatccacccactttggtctcccatttcttaggatgaggggcatgagccactatggccagtcttgctgatcttttctgatcgatctgagatttggatttatatattcatttatctccgctctgacgcctaattattaacctacttctggtagcctcggaccccggccgtactatctacttgcagtgccaagctcgccgagctcagacatctttctccaaccataaggcaccgccccgcctgccccagcttctattattgacaccgtcggcctgattatataatgcatcccgaccgggtaaccagtattaaacggaccggaagccagggtccgcgcgcggggtgagtgattctggcgctcgttctatgagcacgaaattcactattaaagaccacacgaacgccattactaatcgcggcgtagaaagatcgtactatatattagctcccacccgcgatacgccagcagagcggcgagccgttgttcgtcgaaggcgaaacccaagacgactcagcgatatatgagtccacaacaccaagcgcccatcccccccctctctcctgtccccac

SEQ ID NO: 13263 - DNA, 836 bp, Homo sapiens
  misc_feature (1)...(836): n = A,T,C or G
cgcgagaacccccccccgtcaggagacccccgcgaaaaanaacagccttcaggcctacactgattggtgtagcccaccttccctgagatgcctgctgtcctggaaaatcttctggatctatacagttgggccctggtgcagcatccccattaggaccccaagatcatcaaatcctgaccccggccctttagccctttcctgttcttacagccacacagaaactgaaaagcaaagggaagggtggcaccttttgaggcctcaggaagactctgggctataggcaggggggtgtctgctcatggatagccatggctatcctggctctctgattctgcctgtgcgccaagatgagcataagcgagactgcctactcccggagttatagggggggctaacaggacccagagcctcctgcacttagaagaaactttaatatcctcacgcgccctgtcactgggaaggtacacgcttcttgtactgcgccgtgtgcaactttcctgatgcttttacgccctccccccccagaattacactgccctggtcgcaaaaaataacgcttaccccccgggatccagctaatgggccttccacaacttaaaaattccgccaggacgagagccctgccccacaccctcgaaactacgatacgccccacgaattgggaagcccgccgggatgcactcactaccccactaaaatcaagctgcaagacaaaaatgccgcgccagggcgccgccagagcaagtccccgacgcgccgacgcagcaaccccaaccacctgacacattgccgagatggcgcgggggcccccgccgcacgcgacccgagtagacggc

SEQ ID NO: 13264 - DNA, 794 bp, Homo sapiens
tagactgtgctctaaaatagggatacgagtagcaggagggggacaaaacaatatccacaatgtctccagctcagaaagagcagatcagggccatttcctcaacaacaacaattgccacagcagtaatggagaacagactgagttggaggcaagctgcccttgggtaaagcacaacacggatctctttctgtgggattgctctccatatacttcatgaaacaagcaaaagcaagatctgggggagagaaaaagacccagaagagtaagcaaaagacaaggactgagggggcttctgccctagatgtgctaggtgattcagagaacttccttcagggctcctgcctcagagagcacagtgtatccggaggagaggagacgcacagccacacaaatgtcattaaccctattgggcaccacagagcaagggctgacacccagcccagcactttgggaggccaaggcgggcagatcacctgaggttgggagtttgagaccagcctggccaacatggagaaaccccatctctactaaaaatacaaaattagctggggtgggtggcacatgcctgtaatcccagctactcgggacgctgaggctggataatcacttcgaccccaaaggcataagcagcatggatgccacatttgtgccattgcactccaggctgaacacaagagcgaaactccctctcaaaaaaataaaatacaataacacgattcctgtcgggttgtgcccaaaacttacaacaagtcttctctggttgctcaatatgatcaacatgagcattccacttc

SEQ ID NO: 13265 - DNA, 732 bp, Homo sapiens
  misc_feature (1)...(732): n = A,T,C or G
tagaggcagcacagaccttgcattgacttttacagggaagacggtggacataaactgagaacacataaggagggagctgcccaaaccttcttgcaatcatggtgaaagagcctgtctgagggtgcggagnagatcctcattcagaggatgagggagccgcgctgagagaggaccaggtcctggagatatcgtttgagtgtccgtatcaggctgcatctgaacacagcatgagtcgtgatgaggagtcatcttggaccgtctggatggggtcagtcccctagaactggcagagcaatgaagtggacagagcctggcattgcatgacttcctggagcagagccacaatacctggctggagggctgcatgagagagaaaaatcaattttcatcttggtgcagtcctacctatttaagggtctttgtcttagcagccagcctataacctaaccaggacacatgaagaaatgatctcatttaattacccaatgcctggagagtgagcacagggcaagactgactcaggaacccaggatgctggcccccacattcagcacgattcaggcgtccctaggtggagttcctttcctacatgctggatggagtcatggcccttcatttcctctttgtacctaagtacttttgggactatacccctgtgcgcggcccaggtctgggctggggcttcattctcgatagacattgaccaaataaatgaataataaatggtcaaaa

SEQ ID NO: 13266 - DNA, 833 bp, Homo sapiens
  misc_feature (1)...(833): n = A,T,C or G
gccgtacgccgcccgccgttagcaaagacccccacgggcnacaccccttgntggatacantcagnngggatcaggggaccataccataaggacactcaagccccctgtggagtggtccatgtggtgagggccaaaggctgtctgagtggaccatcctggaaatgaaggtttcagctccagatgatgacagctctggctgtcagcatgactgtcacctcatggaagatgggagcaggaaccacccatctatgccgctcctgattgacccatagattttgtgggagaggggagatatctattgctatgggctactaaattctggggtaatttgccatgtaacactatgattctaacatactcatgatctagccacttgctaaatcctacttactcatcgggtaacgcttacccctcgcctcctccattccatatcatgcccctctcgccacccctttactgataaacaggcccccattttacgggacctctctctcgccgaaccgttactcctttcacccatcacacctggatgatttctcttttcacgcgacaacctgcccatatgcaacggttcccagagggttcctccgccccctttttttaaagcaccccctcagtaccacccccctggctgacaattagagggaagcccgcctagaacattccccctctactttcttcaccggcgtgaccacctcggcggccccaggatcgcccgctctctccagccgccgcacctaatcctccctaagcgattactgacctaccgaacgacagtccattagcgccactctgatgtctccacagactccgtcctccttaccatgccgccg

SEQ ID NO: 13267 - DNA, 870 bp, Homo sapiens
  misc_feature (1)...(870): n = A,T,C or G
ccctgtatgcagtcaaccttggatcgctgccgtactaagaccaagcaggaagcagctctgtaaattgagacttttcatgacaagctcgctagaaagagggagtctcgctctgatgcccaggctggagcgcaaaggtataaactcggctcactgaaaactcccccacgcaccccaggttaacagtgaaggcctgcctacgtctaccagagtcgatggaactacaagcgcgtgccacgcttttttgggtacggggggtgattgcttaggagagagggggggaaaccatcgggagcacagcggcggggttggacatgctggggcgacgcctgccacacatgcctcccagcttgcaaacggagatggtgtattacgaggcgggcgccggcgccgccctggcccggaggacggaggaatatgcttcgtggcggacccgcgcgccgcgcgcgccgcgggtgtgaaacaacgcgaatgcacacgccgcgccgccgaccctcgtggcgcggtttgcgcgtatgcgcccacgccgccggcactcgatctagttaacaccgctgccgcagtgtaggacggcggaaacccgcggcagggccgccgcaagcgcccgngcccgggcgagagatatacggccgtggtcacggaccagccggccgcgacgccccgcgtctccccgcctcgcccaagattagacctgcccgctcaaagaggggagacgggaggtgggcggccgcggggcgccaaggttcacgcgctcgccgacggcaagcgaaagtgagagcccacgaccccaacgcagaggccgcgcgcggccattgtcttcatcgtgcaggaggaatccgcgccgtacgcggttctgtcacggcgcgcgccgcc

SEQ ID NO: 13268 - DNA, 846 bp, Homo sapiens
cgaacacccatccgggaaaaaaatgccaaaaaaaaaaactcgggactggccaaccccgaagtttgtttttccctcccctgcttgtggcaggcctctccaagaggcataaccctttgggggggcctgagaggatcccctaggcttccccaagcctgccaagcgcccagtacttgaagagaagccaggccttatagcactgccatcaggttgtcactctgttgtccaggctggagtgcagtggcacaatcttggctcactgtaacctccgcctccggggggggggtgattctcctgcctcactcagcctcccaagaacctgggactacaggcacccggcaccgccccccactgatttttggattctcattagagatagggtttcatcatgtctggccatgcggatcttgaactcctgacctcaggtgaactgcacaccttggtctgtgcaagtgacgggaatactgtggccggagccactgcgcctggactagatgaaaccatatccacgaacaccttctcgactttcaaagacttgcacacatatccgtgcagttggggctaagataagtcacaatgtgcctcgcgacgagttgttagggggtgataaggggaaacaagaccccggactgccggtccggagcccagcccacgcctggaattatcacccacttcgatgtatcctgcgcggcgaaaggccgcgagaggggagcaggtgaatccagacccgccccccccaacgcatgagaattaaccacgctacgcaaatcagaaagacggagaaccggtgcaaaatagaatataatggcatgagaccacgactccgaattgagctagcgtattacgaac

SEQ ID NO: 13269 - DNA, 715 bp, Homo sapiens
ttttttatagaccccctgtgtgggccccctcggagcccccgtgtgggcccccacaataaatataggcccgaatatggcccctcagaactgggataggacaagggagggtttttccacattagagggttggggggaggaaggggccccaacgcgaaaaaacaacaggggaccccgggggcacaccccaccccccccccaaaagacaaccccggggtttattcttggttttacaaagaggcccctccccctaaacccccggggggggtgaaaaaaaaaattcttttttcaaagaaatcccaatatgttgggggaaaaatttgcaaacccaaatttttggtaaatcccccccggggggggaaaatttttttttttttggcgaaggcacaatttttaaaaaccccattacccttttggggttccaaaagggcccatttttttgaatttttgcccccgggaaaaaagagttttaccaagggccccctccctggaacccccagtttaaaaaggaaagttttttaacccaaaagggaaggaggatttccgggggccctttgggggacccccaaaaggtgggggaaaaacagggaccccgggttggggaaaacacgggggggaaaaaaaaatttttggggaagtttttaaaaaaaaaaaaaaaaaaaaaaaaaaaaaaaaaaaaaaaaaaaaaaaaaaaaaaaaaaaaaaaaaaaaaaaaaaa

SEQ ID NO: 13270 - DNA, 667 bp, Homo sapiens
cgagtgcgctcgctgctggcccgatcccgggagcaccgcgccaccctccttccccgtactgcgcggcgccgctcctcctggtggtggcgcggtcgggcgcgaccccgcgaagccccgtcccgtacgcagccgcggctgcgtccattggctatccacacctctgatatccccctccttctccctgaggtctgtccggctcccacccgagcccatttcctgacagcccccgctccttcgtcgcgtgtttattaactctatttcgttagtccgcgcccttgctcctgctgtgtgttcgttgtttgcttctctggtttatcgggccgtgctgggtgatgttgttggtcttgttgttggtgtgggtgggtgcctctctccccgtcggagggccgctcgcgcgcccccgggcccataccttcccccgcaggtacaccctctcgcgttccccccccgggccacgcccccttcttttggggcccggggggaagggggtgtctcactgggcccctccccctcaaaccaaagtttctaaaggaaagtttttttccttccttggggaaaagaaaaaacgcggggcctttttttgttcccctcattgttggggaaaacccggttcccccttttgggtccaccccggggggggaaaaaaaatttttgggcggattttttt

SEQ ID NO: 13271 - DNA, 734 bp, Homo sapiens
ggttcctcaggctgttgacaccactctactgtaatctattcagccagaatgatctttttgaattacaacccatcgagggacatgaatcatactaaactccggcatatgccacatttctaaatgtgctagtccttgatgttttcatgactctaaagcagtcagcacttaccagcatcgtggttttgcctaaatctttctctctgaaaatattgatttagtttgaatatctgccaagctctcttttctctctcattcatcatcttcttggagtctctacccacatagtatacagaaagatgtcttcagttataaaaatggcacagaattaaaaagaataaataataaggcaaattatctaaatatgtgtttgttcagtatatattcaataatttttgtgccttatataattacttgcatatagtaattgtttgctaatatttatagaataaattattaaacagtccatccttaataaaatataacagtgttttgcctattggtcatgagaatatgtgggaaggagatcaagaaattgctagatgatgaaggcaagaaaggaaaaatacattataatgtgtattttctctaaaacttgcacattagaaaatatactttaaactctatatttttgcatccggactttggtttctgttctgtgtttccatgcatttaagcactgattttgagaagtttatggaataaatttgaaaacttgtttcttaaaaaaaaaaaaa

SEQ ID NO: 13272 - DNA, 670 bp, Homo sapiens
  misc_feature (1)...(670): n = A,T,C or G
ttctttggagatgtattttttggaccattccccaccatgggtgtgggcaggnaagatatacagtgacggggcgtatgagtggcccccaagtggactaggtgccaccatcgggtgggcaccaaaaattaccaggtccccgcgatagttgggcccccattaaaaatttcagagaatttttaagatttgcagaaggaagttcctgtttttcttcactaagggcgcccccccaatatgccccacataagcacctttgggaggcctaaaaaatttttccccccctaagaaatgtgttttttttttatgcgaatcgaggcaaggttttcgatttaaaaaaaaaatattggcatatggcccgaattactgttttccgggaccctcaaaaaaggactgggataattaaatgggggaaattggggccccgggctcccgtcccatgtttcccccctagcaattttcttactcgggaaaaggaatttcagttcggagctccctcttcctttaggaggtaataaaaaaacccctttaagaaatttgccggggggtaaacctttaaagagaggtcccctttactgagaaattttaggggccctagaaaattgttttcccggtgggatttctggtttcaaaaagttaaacccactttttcaagccccaaaccctgaaattttgg

SEQ ID NO: 13273 - DNA, 746 bp, Homo sapiens
ccacagattcttcctgccacttcatggacaaaatcgatcctctgagaccacagcactgcaaaaagagaaagagtttaattgacgccaggccagctcacactggatcggctggagttatcactcaaatcagtctccccaaaggcctggaggttcaagatgatgaacaaatggaacacgagaaggtgccactcaaacctgagtcaaggaacacagctaagtcctcgaggcaggccaagattcatacctgaagatttctccagaaataggacctcaaggcaaagccaaaggcatgagtggaaccatagagcccaaatgggtggttatgggtgggtctttctaaaagattattaattatcatagggaaattatccatgacaaaaattttatcactttaaccagagtacaggttcatggcattaagtgtatcgacagtgctgctttatcattagcaatgtcttcaggactctttcgtttttacatactgaaacgctgtacctattaaacaataacatcccgatctcctcttccaccactatccaattttccgcatccatgcacctgactcctcaaggaatctcacatacgcggaagtgcatttgaccattcttgctttgtttctttgtctagaaaggaatattgctctcgtcgccacgatatagtcgcagtgttgcaatctcatgtaactggcttctttgccttcctggtgcaagaaattctcctgccttacccttcgattaggcgggact

SEQ ID NO: 13274 - DNA, 770 bp, Homo sapiens
  misc_feature (1)...(770): n = A,T,C or G
cccagtaagctgggactacaggtatgtgccanaacgcccagctaatttttgtatttttagtagagacagggtttcgccgtgtggccaggctggtctcgaactcctgacctcaagtgacccacctgccttggcctcccaaagtgctgggattacaggtgtgagccaccatgcctggcctgtatttgcctttttgtgactggcctatttcactcagcataatgtcttcaaagtccatccatgttgtagcaggtgtcagaatctccttcctgtttaaagtttgaatcaatccacgacgccctccacgtgttccactgcctcttctcttctcgcttgggaacgccggtctcacctcggcttgcaatggaccccaactgctcctgcgccgctggaggctcctacgcctgcgccggctcctgcaagtgcaaaaagcgcaaatgcacctcctgcaagaaaagctgctgctcctgttgccccctgggctgtgccaagtgtgcccagggctgcatccgcaaaggggcttcggaatagtgcagctgctgtgcttgatgtcgggactgccctgctctcggatgaaaacagaatgacacgtaaagtccgggatttttttttctacaaccccgacccatttgctacattcctcttttttctgtgatataggtgaataataattaaacacttagacttgaaaagtaaaataaaataaagtttgaataatactccaaaaaaaaaaatcggcctcgtggcatcagcggtggagcgttccggccagg

SEQ ID NO: 13275 - DNA, 1553 bp, Homo sapiens
  misc_feature (1)...(1553): n = A,T,C or G
tagaggagaaggaggnaggagnnnnannnnnnnnnnnnnnnnnnnnnnnnnannaagnnnnnggtgnnnnggtagaaannnnnnaaataacaatttcnttttnncacnagctagcatatgtcnnngnganttgttgttgcggtggtggagggacaagtgctgttatcttcacttagtccaatcacaccacaccacncagcgcgcgtctctcgtggtttcgcgctgtgtgnggtttgagtgtagtattaancaaccacacacacaaacanacaggaccnacacattagctccgccgcccncgnatagctactccacactacntctcctctcgtcgtcgnccgcatatctctcgcacacacctcactgtgtctgtagtgtcgncgtaggacgtngaccgcctctctctcagtcatcttgcncntctcnctatcgantcattctaactatantctcantatatatcctngcacgatncatctgctccgtcctagcgtttcggcgtcgtcnnttntcaccatcgcgcacacgncntgcacggtaatggtntctcacttctcagctncncnctcacacctcccactactgcncgctactgtccctgtccgtccggcgcggnncncttgttgtggcactacacccncacactcagcacttcnccanctncatgtntntcctcgtctnacctcctgtgcgctgccgcgtccgcgtgtgtggtgcgcgtctacgtatgtcatgcgtacgtctctatacgtcctacgcnatagtatggntnnnattctanacnatanagtactnangtagtgtacggtnagatacgctagagatgtactgtgacaccnacagagtgctgaacagcaccgtggtcatgtgacttctgcgtagtgtttgtatgatacgcgtagcgccacatgttgtgatgagctatcgtcagagtagttgatggntgtngtgcacgactgacgtatacgttgcatacagtatatatcagtgtcngctgtcgacngaccnatgagntatgggtactgcttgctgtggagtgtgtatatatctataggtccntctcacgcgtgatgtgtgtatacctactanctccaaacggcgtgagcaccgcgcgacgcgctcgccgagtgtctgtacgagcgnntcatttatatcgcgcgcctgattggcagcggcgtatcnntgcgtgctctagcncngttagtcgcacggactangacgatacgtgacaacgataagtgatcgntatgtagaagatgctattcagtagagtatgagattaanttgntatgcggcgtatggtgctctcacgagcgacgcgcntacagcgcggtgnttnatgttgcctccgcatgcgcaccgcatctagatnaganagatatatgagatgatcgagtgtatcgagggagcgtgagtgcgcctagtctactcgttaaaagcgacagttcnacttatgtgtatgtgtgtgnctgcctgcaaacagtcacatgctctaatctttcacacgcagcgatacatgaatcgcanataagatanatgtagagagcaactat

SEQ ID NO: 13276 - DNA, 302 bp, Homo sapiens
atttgacacaatactccttttgctagaatttttatttcactcgcttgtgatctaagatctttagcattctttaaaagcttctcattatacacttgttttttaaatactcaaaaattctactaggtagattcatactttgaacctaggagaagtaacttctattttacagttctatcctgtgtatgccaatcattgattactgccaaattattttataccatttttaaattaaagactgacacagtgcagttaagtgggaagacaaagaaagcccaaataaagaagaatatgtgtatgcaaaa

SEQ ID NO: 13277 - DNA, 835 bp, Homo sapiens
agatcgcgtataacatattatagggaaaatgccgaagaacctcaaagctccttacctactcccactccccaatgatgaaacagggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaagctaatgcaccgcttattaaacccccagcacacccatctgctatcctcacggtcctgagaaagccaaaccctccaccaccttcttcaaggttgacacctgtgaagtgtgaaaaccccaaaagggtggttccaacagccaatcctgtaaaaaccaatggcacccttctacgaaatggaggcttaccaggtggacctaacaaaattccaaatggcaatatctgcttcatacccaacagtaactttggacaaggcttcagtccagctttttgatgcttaacctaaaaaagacatatgttcccatgcatgtcctccagatccagtttggtttaaatgaatagtacacgtcccttggctatttttcttactgtgatacccgtataacataaaaaacagggaggtccattacgaatgaacctgtcacccaaccggatagattc

SEQ ID NO: 13278 - DNA, 829 bp, Homo sapiens
  misc_feature (1)...(829): n = A,T,C or G
atggtgtttatctatcatcttgtacatttccatttcaatcgtttaagtacatgagggctatacgggtggacttgattaaattatatagtaaaattgtacagtacactcaacagtgttgtgttattgggttcagttctgtcttattagacaaataacnggggaaatactgaattcctcctggcttggccttatagtagtgaggttgggtttaattttataaggcaagtctcaagggctactgtcgcgttagtcaaacccgggtaaatcataaagtacagggaggtcctcttactcagttaacctgtccacccaccgggacagattcctcaccaagggcctcccctccgtcatacaccccatctccctcctttcccactagaaaatgggggaatgggaataagccgcagtaacagctccccccctatcagacctgcaactgtgcctcctcccactgcaccaaaaccacagaagacgatcttgaggaagtcaaccactacaaccgtgtgatgtatgccattaaaaaaattgtttttttaattttatatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaaaaaaaaatcgtcctcgttggcaccagcggtggagtgttcccaacaaggttttttttttttttatacaaccatccaccaacccatccnccccccccccctcc

SEQ ID NO: 13279 - DNA, 654 bp, Homo sapiens
tccctctttccgctttcgccctcccccgccgtccgctcccgctcgtcgtcgcggctgtgtggcctgtggggcccgtcgcgtttgccttcccccagcctgtgcgggctcgttgcggggccgcgggcggctttctgtccgccggcgcctccccgagcctggcctgcgatgcgcccgccgtgtgtgcgcgccgtcgcggcccctccgcccgcgcgcgctgtgagccgcagtctcgggtcggggctccaggcttgttcccccctgtgtgggggcccgccccgggtccccgggggtggttttccgcccgcccccccaccccctgtataccgggtgggttttttctcggggagaggggggggaaccgggggggggggccctgggtgtcccggcgcccggcccccggcttttcgcggcgcggtgttgttcccccgtgggctgggcccccgggggggttgagtggccccctgtaaaaaggggtggggttttcctagaagggggtcctttttccttgggggccccccgcttgtggggggcccaagggactcttgaaaaccctttggccgtataaggggttttcaacaaaaaaaacaaaaaaaaaagaaaagaaataaaaaacaaaaaaaatgcggctcgggcacacgggatgtcccccagatc

SEQ ID NO: 13280 - DNA, 675 bp, Homo sapiens
aagacggtgtggttcggctgcgggggcaaggagccgaactagtgggtcgccagagagaatcggccgttggatcgctcgcttcaattgcgtgggcgtgcagagcaacgacggggacgtcgtggaggtgcgcgtggccgggtccccacaagctgaccaagacccgcacccggcgctgcgggacgccgaacattcgaaacagtggtctataagcagcaagagcgactaccgtaaaacaagcagatacgtaacaaccccgtgacacagacagtacgcggggcggtggcacgaaatacgggcggcaaaacggggcgggtgaggcaggccggggcgacctcaaaagagggggggttgtcatacggggttctttggaaaagggggttctaggggggggggttttcacgcggcccaactaaggggaacacggggggggcaaaaaatttttggaacaaaaccccttagggccttcaaatttttaaaaaggggggttggattccccccgggggttttgggccccccccccgggttccaagggaaccccccgtcaaaaaaaagaaagggtttttttataaaaaggggtttttttttttccccttaaaggccccgaattccttttgggtggttccaaagggaaatttttttaaaaatccttttttgctttaaaaaaaaaaggttttt

SEQ ID NO: 13281 - DNA, 781 bp, Homo sapiens
  misc_feature (1)...(781): n = A,T,C or G
cgtaggcgcaacagaagcatctcagtttcctcaagaaacaacaaaatatgttcatactttcaaaaatanttctttaatatcttaaactggtatttaaaaacagggtaaagggcttttctactttaaaaaagttccagcactgtaatacaactggaagagtcccagccaaaaaggcttgacttttgactatctgggcagcgatagagcatgcactcaaaatgaaaagaagatgacatgatgcttagactatgcttcaaaacccacccccccacaacaaaatgaatgcgggagtggaggagctcggatgatgtaagaacaagtatctcaagggtatgtgaagaaattaatagtgagcaatatccagtagcttccagttggccagcctattttaacccaggaaaataaaaggcattgctaacaaattttggtccccttaacaaatggaacaatattcagaagaagatgaagatacagcagtgacccaagcagacaaaatccttgccctgtggagcttgaaattttgagaatactaaatagggggtcactttggccagagaattcatttctattttcagttccatgaatggccactatattatgagcactgaacagaggggaggattatcataaaggtaatgagcttttagtttcacagccgcttacttttacaggccctttcaaggtttggggtgtccttcggagggatttaaggtatagctggatgcatggagagccaccccagccggagggacatctctacattctcggctggagggaaggt

SEQ ID NO: 13282 - DNA, 270 bp, Homo sapiens
tggcagaggggcttcagcacaacagcgtggaaaagtggaggagaagagagggagagtgtgtgaaaaagcaaccagacattggagagaaccatcttgacttcagaggaatggcttgacagtgagactttggagaagagtttgactgcagactgccgaactccaggaaagaccaccttcgcactccattccccttccagctccccatcccactgagagccttttccactgctcaataaaatcctacacattcgccaaagaaaaaaaaaaaaa

SEQ ID NO: 13283 - DNA, 823 bp, Homo sapiens
  misc_feature (1)...(823): n = A,T,C or G
agagaacgaacaaatccacagagataaaaaattaaaataaacaaaaaaaaagagttaaaaggcacacccgcagncctgccagagaaaacgactgangnngcagatagctagaaaggnnncattactggagcactcaacacacggnacaagcacaaacatgagccgccagcacgganaatagagaaccagagctggagaaggggaaggacagctgaaaacactcatagaaaaggaaggcccacagctgctgagcagtgtggcagaatccagctcaaatattttttcaagactgtcggtgatcgtggtcaggaagaagtgcatgccatgattctttaccgaaatgaaccgcactgtacaaaaccccccacttggcactgatgtggaaacagaagcaacacggaacgaatggtatgactttaacctgatcagccaagaggcctgccggggaaatggaagtcctacctactataaatgacatcgatgaagacaacagattgaagcccgaccatatgcagggacatacattcaaattgagccacctggactaaaaaaggccggacatagataagtgttttaacaccaagacatcagcaacacaagctgacattaaggggggacaaatcattcaaaaaaacccaaaccagaataagtaaccaacatcctacctgggagggataaacactgacaccctaaatgacactcacagaagaatagggtacaaagaaaatactggaataacatcaggctgtgactggggaaaagattggcttacgtgactaaataagaaaaagaaataaagctttgtgaaactaaaggaaccggg

SEQ ID NO: 13284 - DNA, 804 bp, Homo sapiens; identical to SEQ ID NO: 7294

SEQ ID NO: 13285 - DNA, 821 bp, Homo sapiens
  misc_feature (1)...(821): n = A,T,C or G
taatacatataaaaaatgtatagatataactgtttacgataagtaagaaatgcgtgcaaggagaatgttaagtgaggcagtataataatattacaacaaaatatcaattaattgtaggactaacctataacaggagaatgaaaacataattagacaaacctaatccacaatcggctaggccataggtcagtgtccaaggcacaaagtcaagtaagattactaaattatcattagtgatgaacaaaagcatcaataaataaaccagtatggaatgagccaaccatctattaaacctgtaaaggcatatccaactgggatcataagatgcacaatccaagcagaatattggtacgctttgtgcaaatctgccataagataaaggaagtgaatggggaaaaagattgagcttagttttcaatgtgtgggaaaaaagcaaaacaacttaatatgaaacagttttaaaaaaatgtgtgttattttgttttaaagagttgtatgcttggggtaaattttcaatgtcatatgtggaatttaaatanaccataaaaaacaaagaattccacagagttagatatcttaagttaaacgcttaaaataagtgtttgcgtgatatttcgatgacagataaacagagtctaattcccaccccaaattttggtgaggttttcttaatgttgtagagcattttgtagagtggtttaaatagaagaaaataaagttcagagcatcaaaaaaaaaaatgttcctcgttggcagcagcggggaggttaccacaaggnttttttatttaaaaatgcaacaaanacaacttcctttttata

SEQ ID NO: 13286 - DNA, 1401 bp, Homo sapiens
  misc_feature (1)...(1401): n = A,T,C or G
cgcgggcgcggccccgtcggccgtgggtcgctgtggtgcgcggcggcgcgggcgcgcggcgtgcagctcgtggtctggtcgatactctcggtgcggtccgggtncatccgggctcgacgtcgttcggggcgtgcggctgcgcgcctgcgagcgtgcggttgcgcgtagagctcgtgacgcgtgggtcgtcggtgtcaccgcgtcgcctgtgctcctgcgctcgtgcacgtgcgccggangtggtgccctcagcgcgttcccgtcgtgccgcgtcgtcggcgcggtcccgcgcgcgcgcgtcgctcggtcggcgggtgggctggtcgtgggcgagtctggagtgtgcgcggtactcgncgtcgcgtcgtctcgtgcccgcgctccggcgancctgtctcgactcgtcgggcggncgagtggcgcaagcgtcgcgcgcgtgatcgtcgcgaggcgttgcgtgcggtggtgggtgtgtgtgtgcggcctgtgggttangggtgtgctatcgtgtcgagtggcgctgcgcgtgcgcgcgcgacggcggcgagacgccgcgccgcgtggacggggtgtngngngcggtgagtcgagtggtagtgnttcgcgacgcgtcgcgcgcgcggacgggcgtctcgtgtgcctcgcgctcgcacgccggcggcgnacacagtcgngctcgacgctgcgcgcgtcggaggtttangtatatcttaatctctctggttatcgctcttcgctctgcgtgtctctcgtgcgcctctccctctcgtacgtgcgcgcgcgcgggcgctgtantgtgtgcngtcggtctgtggagtcggtaggcggtacagcaggcgctactatgcccggcgcgnccggcgtcgctgtgtcggaggcgtgacgcgggtagacgctgcccnctcgctcgtctgcatgcgcacgcgcggtgcgaggtanatatagtgcgctcactctcgacatctcttgtgcnttctcttctgttgtcatgtgtgtctttgtcgtgngcctgttcgtgttcgtacgaggcgctcgtggctgtntntcgtcgttgtgtggcggctcgctctcgctttccacanaggatatacacgctcacccagtcanatacacagactcacacacacgcacacacacagatacacacacacacacacacanagatacagacagacatagagatatagagatagacatagatatagagatatagacacacatagagatatatatatatatctatacatacacatatatatagagagatatatatatatatatatatatatatatatgcatatgtacagatatagagagagatanatgctggtgtccctnncggtntggtgtcaatgncnatgncgggtgtggngattgncttacnntngcntggnctctaag

SEQ ID NO: 13287 - DNA, 596 bp, Homo sapiens
  misc_feature (1)...(596): n = A,T,C or G
gaaagcacttggacaattttagttgaaagcctccccaatcaagcttttattaaagaacgagtactaccattgtgaccacagaagatagaattcgacaccaagagcgtgctggcccttctcaaagtgtcccatgaaaaagttattccacacctcctccctgaccttgtcgtgcaaacgcttccaggatgaactccaactcgccgagccaccgcagctcctcagctgactaaaagagttaatgatcctccaggttaaaactcctccttgagcacacaccttctctcaacaaatgacaacacttggcaaactgaactcctcccacgagtcgccctctgctaggaggaattgctggctgctccctgcttattgcattctctcagagcagctgtctcanaggaggctgctcccatgccgatctttttgtgcccaacttacagggaaaagaactcattgcctgcccagtgcctgccagcctcagacttctgactgcaaatccaactggacaataaagagttggcaggacccttctcaggagtgaggaccgggtgcaaaaactcccaagtcactggcttattcaaaggaactaaggaattggg

SEQ ID NO: 13288 - DNA, 1682 bp, Homo sapiens
  misc_feature (1)...(1682): n = A,T,C or G
agcgtctcgtggncgagtctgtgtnannactacgtcgannnnacactcatatgngacactgtcgtgacannnnnacgtacttactactactgannngagcntgatagagctcttctcgatgnngtctctatgtgntagagtcatcatgatgnggacgatatactgtangncgatacatctgtgcngctctccggtgcgcncggctcagtgctcncgatgtgatgntgnnnacgcatcacactgtnattcagatatctcnancactntcgacactactgcacgctgactanctcatacatgcagtnntactacatatcgcgactactcgctccgtgnccatctactctcgtgnnactactctgnnntggttacgctcgctatcgctcgtgtcntactctgcgcaacgtgcggngngngcgcttgncatganaattatctacgtctagatagtaggttagatcactatagtagtnngngnacgcttctacagctggagtggtgctcgttttcgcgtcggncgcctnagtatacgacagctgtcaaagcgacagagagtgtgngtacgtccgttcgcatcacacattngcgtgatgagtcgcagtatannacatctatgnacaatatgatatagtatacctcatggacatactatctctgcgtcacggnngnctcacttgtgacnatatgatagtgtgacacggngcgtatgctgtagctgtacacgtatggnctagtacgaagtgantatgtncggcgtnngcaagcgctgacatgtactcacgactatgtgagatacattatntgagtgtgtgangtcagcgtgtctctagcgcttacgccgtcggagtcgtctgtgnntgtgctcgtgtcgctgcgncgcgattttgcgtctcngnanggtnttgttgctgttctgcgcggactgctgtcgctccacgtggnncatgtagcgcgtgcctgtgcagtagtgtgnagtgtangtcaatcgtttcaactcttngacactaggtntnagtctctcatcgtctgtnacaactattnnaatcttctatancaatctgataagcttcttagaatgnatgcttagnaatgtgttacactctcttcacatatgctcgatctgntanacgccgctcctctgtntcctctgncctatctgaaatcacacaaacannnccaccactactcctnctncctactatcttactattntatctnttaaattcccttnnntaatctnaactcctacacactaccanatattananctatcancaccatttctnacttgctannnntcacattaanccttgtaccatgtgacactgttcctaaatctatttctacaggnnctcactngacacttacatcttatcacggaacctgtnnccctgcgccttctatcntgnctcttccttcttnncttctcttcnctccttctctactcttttcactttatcttcatacatactacatcctttantctacttnctgctatcttnaccacttncatttnnatctgtgccctcccgttgnctctaaacaagtcgtgtgcgcagntcactttcctgcgctcagaantctctnnntacttnncttctcttatattcatntnnnnnttcttctntnnnnnnnatatattntattnntattnttcatatatatattattttnattccttt

SEQ ID NO: 13289 - DNA, 1302 bp, Homo sapiens
  misc_feature (1)...(1302): n = A,T,C or G
ggactcgtcaatacgggttacagaccatagcggtagtgaggcgacaacaggacagcctacaatgggtaacaaaacagccgagcgatttcatcacctatataaaccaacctcgcccgtctatcagcacttgcatctagaccagtgcttccacgtgacctaggtagccacctacacacacatatagagttaccaagntcacacatgcactcgactcttngcacaagcaactggcatcaaatttgtagtcacacagtagcattggtcgtcagcggtgatcgcgtacatgccttgtaataccacctccatctcgcaatcatagacagtgctccaacacgcttgcctggacgcatgtagtagtgcatgcacctctcatgacttcattactcaccgagtcttctagagcatcttgtgcacggctgcacttagctaggctccacgtgctatgcaattgtcgctttagcgcaatcgattcttcttgttaccttgcatacattgatactccgcgaacctagtcaccaggacacactcgccacacctataggaccacctcgctccgctgcgtatctcaacgaatatacacacccaaccgccaaacggaatatcgtggccactgcacctcatataatccttcgactacaaagatcatgtcgtngcagcaccttctacctcganggacaantgacatcatatctcccctcatccatgccatactcacactgtgtgagtctcgatatgaatgtgtacgcatagtggcctgtcgttctgtcatttatcccatttaatcactaatattgactcttacacattgctaatactatacatcccacacacactcccttatcctacttgtctcctctcgcgcaatctcccaccgttcctcatgccttcttggtctatgtatcgcatatcttagtccgctagctgtcgttcctgtcgacctttactacacattattctatgcaatccctcttcttctatattctcaatctcttcaaggtgcgacccaatgcaaatctaacgcgcacgtccatcggtcgcgcgcgtactcttagtatgcttatcacgttctactcacgaaaatagtctcactcattttatctcaggactattacttcccacttagattcccttgaatttatttctcactcagtgcattgaaaacaccatcacatcatgagagtttatagagcggcatatgttgatctgtaaagtatcatcaaatctgtagaagaggtcatgcggatangatctaaaacatgtaagatgtanaacttgacgtcggtagaagagtcgatgagagtc

SEQ ID NO: 13290 - DNA, 750 bp, Homo sapiens
  misc_feature (1)...(750): n = A,T,C or G
gctgatctttagagaacaatgactgatgttgcagattgcttgaaagttttcatgactggagcactcaacaaatggtacaagtacaatcatgatttgccagcacggataattgtgtaccgtgctggtgtaggggatggtcnagctgaaaacacttattgaatatgaagtcccacagctgctgagcagtgtggcagaatccagctcaaataccagctcaagactgtcggtgattgtggtcaggaagaagtgcatgccacgattctttaccgagatgaaccgcactgtacagaaccccccacttggcactgttgtggattcagaagcaacgcgtaacgaatggtatgacttttatctgatcagccaggtggcctgccggggaactgttagtcctacctactataatgtcatctatgatgtcaacggcttgaagcccgaccatatgcagagacttacattcaaattgtgccacctgtactacaactggccgggcatagtcagtgtgccagcaccatgtgagtatgctcacaagctgacctttctggtggcacaaagcattgcatgaagaacccagtctggaatgagccaaccatctgttctacctgtgatggcgtgaactactgggctgactagatggacaatgcaagaagaaattggggtgctggtgtgcaaatgcgacttagctgaaggctgagactgggtaaaagattgtactggtgtggatggtttaggaaaaatcctaccgtcttattt

SEQ ID NO: 13291 - DNA, 738 bp, Homo sapiens
  misc_feature (1)...(738): n = A,T,C or G
cccacgtggaacgatgtgtattcttaagcagggcagccaggtggccgccggggaccgggaggccaccccacgataaggcccgaagaggtcaacgggcggaggccgcccaaaagcaggggcgacacgcaaagngagccacaggaccacaacggccggggcaaagccagggccccagcgccangncaggaagcacacaagcagaccgacgggggggcccaaagcagacaaaaagaacccaggcgggaaagagccaaccacctgaacaaccagggagggcaagaaccacaggcaacaccagagggacaacccaagaagaaagggggaagcggggggcaaagccgccaaaagcncaaggcggcgacgggggaaaaagattgagcttagtggtcacggcaaggaaaaaaagcaaaacaacttaatctgaaacaggtttaaaaaatgagagaaaaaaggccataaagagatgtatgcgtggggcaaataaccaatgtcaaaggtggaagttgaaaaaaccaacgggagggagttttcctcatagttaaatatcgtaagataaacacctaaaataagggtnagcggagagacggaggacagataaacagagtctaagtcccactccaaattttgcagaggtnntccaaangccgagcagcaaaagaagagggcacaaacagaaaaaaaaagtcagaacncccnaaaaaagnntgtccnccgcaacngcggggggtgttccaacaa

SEQ ID NO: 13292 - DNA, 880 bp, Homo sapiens
  misc_feature (1)...(880): n = A,T,C or G
aattgcgcaactaaactgacacagatgcgactacgtgcactcctcgtgnctatatacatctgtacttgattatttgggcactttgggcacttggcatttttcggaatccttatagagaaacagaagaacatatgtgatactcttctaagagaagaagtattatattttcgtaaagatatctgcccccaagacgactatacctggtgttctaaatttgccaccggatttctcccatcggcagcagactatcttgtgagctggtgtagtcaaattagagtcttatgacatatgtatggtgaagatcatatttataattagaatgttattagaatagagtaatggaccagtcagagtatggtcggcattcgctcgtcggctgcatcttatcactaaaaactgaacagatgggagtgaaataccgaaaagacaagacttaaagatccacttctattctgggctgtggaatctgcactcttcgatcatttggggaatatcccgttggacacatacaagtggattttctgtcttttatgtggctttggctggtgctctgacatagggatgtgcatgtggtcttanctaattgtcgttggtttttgtgtaataaaactatatctaatgtacatctgatggaaatttaaaatatattcatttatacncccaactccttctctccactcgttcatatttctcatannttatactcctataataaatangcgtttgctgtgnatattttaactgacactatacaacacatatccttattccccgcccctaaattatagctcaggttttacttaatagttgtagtagcattcctgtagagtgtgttctcactagtgtaaaataaagttcagaacatcaaaaaaaaaaaaaa

SEQ ID NO: 13293 - DNA, 719 bp, Homo sapiens
gcattatggttgtttagtggtcacaatgcaattatacaagggttttaatagtagatctagtggttatgaacaagaaagaagtgggctataagtaatttagaggctattttacccttggatcttcagaagctttagattcaatcaggtaataatattttagtgccctgtgataatgttatccgacattttgatttttgaatggtcctatgctgttgaacttgtttcagaaaattcttgattgcataaatcatacatctctggtgaagtgaatcttcccaccacattaatgtcacatttgaagtacctaaactaaagctgagtcttactgaggtcacagaacaatttgtatgagagtgttgaatctgcttgaattagtcaggattatttcccagacttgctttcactgatacctggtacaagattgttggaagagaactcacaatcattacttacctctaactattagaggctactgacatttaccaaaaggaatctaatacttgtgcatgatcatattggctaaggttagtttgtagcaccattcttctaaggtcacaaggattcattacagaatgtaaacgcaacccaactcagggcaataagactaaaatctgggaattttgcagaaattacatagagtgccactttaaagacactaaatacactggcattgccaagctggtcaagttaaatcatgaataaaatcttgaaaatcaaaa

SEQ ID NO: 13294 - DNA, 858 bp, Homo sapiens
ataccgcatctcctacacacgcacgaaatccacgtccgccctaccccacatcctctattcagcacgtcaccgatataattaatttcttatcaggtctgtcctcccaaagtgctacgattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagaacttacactgggttctccttgtcttagagcccagccaccatacgatgaggaagcccaactatctgaagagaggagaggcccaaacaaaggaaccaagccccctggaccacaggctagctgagctcccatccaaccatatagcgccaacttaaccgctcgtagaggacccatctcacaaatgaatttctgcaccctcctagggtgagctccaactgatgaccacgcggagcaatgagctaattgtaccctttaaaatcctggccaaattggtggatggtcaagacaacaaccatgactgctcatgttataagctataaataaaatccgcccacaccggacctcacccatgtagattcgacgacgcctgactttttgcgaggatcattcctgaataaagataattgactcgttcctattgtattcaaaatgagtctgtcctaacttcttttcaaggcgtgagtattgcttcctctttattcagcaatatctggctaacaattgctatctaacccttcatc

SEQ ID NO: 13295 - DNA, 839 bp, Homo sapiens
cgacacgtaccgtatacgtagggggacaaaaaacaaaaacttagcaggaaccgcactctgttttccagaacggagcgcaaaggttaggaccttcatgacggcgaagccctgtggggtctgccgccaggtcatcacccaggaaggctgcacctgcagagggctggaccaagaatacttgctgaggccctgacagaggggagggcctggaaaactccctggttggagtctgcagaggtaggatagcttcccccacgcaagctgctgctcacctcctccgcgctgcgtgcagccatctggcaatcatgaactgagctgtcctctgggtcagatgctgtgccaggtcctggagctgacagccagccccttacctgggaagacagacacagtcagacaatcatggagcacggtacctaagctgacacagtctgcagcttctcctgtcatcggagatgccaggccaagccatccacccaccgccagcgtgctattcctctgagaccgatgtctcccgtgtagccatgaacctgcatgctcaggatgcataccacggtttgagaagaaggtgcgtgactgcccgggagggacttgcatttatcttgccatgaaggggcccctgggtgaactcacatgtgcctaacgcatctgcattttttcctattcaattgaccatgtcagctattaccatccctaaagattgtcacttgatttaaaaaaccacgtgtgatttctttaacccttgatgaatccaatccatcaacgctcggccctgcacacgagagagataaatcgcttggacccataaatacgaaataaatggcgcacattaataaaaaactggg

SEQ ID NO: 13296 - DNA, 1362 bp, Homo sapiens
  misc_feature (1)...(1362): n = A,T,C or G
tggctcgtagtctgatctntggtagtcatcttatatatatgtgtnnaagcctancaagagagatagngcaacaagcgatgtagagagactataagtatagtcggaggtgagggacggagagattatgacttatgaaaagagaaggaggtggagatgtggatattgcatcgtagtatactgaagatgggnagcatctaatcaggaggagagtagatgtggagataggaggagcctctatagnanaatctcgatgggaggacaatcatatactatacgagtaaactcaatagatcgagagaggactagannaattctctcttagatgnacaaggagacaaacgtagtatatanactcaatancgtatggaagatatatagaactcatttataataggtatgaaattaatgataatatgagacacacatagcacactaattatatagatgtgacgtagcatattaatgtctatacttcatgtgtngtatatgacgagtgatgtagagcggagcagagattgtaagagggngnncataagcgagtaagttctgagtacgngnagcggagtgaggttgagacgatggacgaggacgagatagagacagacgtggtggtggngtgacgcggtcgtggacggctgngggacagaggntggtcgcgtgcngtgcgtgcctgagttggtggngcgcgactaatancgatctatgtgtagacgatgtnaagatactacgatgtggatgctgttctctctatgacatataagcatctanaaaanctagttacaaagtgtgtgnactgacgacacatatggaagngagngctgttagggtnnacatacaatgacagantcatntatactcttaagagagatgctactattagcgagcgcgatntatntaatcagatctatancgnnaacatactagaacctatattatttacatcgctactanactcatnctattncacatattcatgcaacattatcatatttatatatcttactattaacatgacataacgttnnctacgcactattgcatatcattatctatatcancacctcttctntatatnngacactttgtattacacgatacactctagctatgctgtcatcgtgtacttatcnctccatacacaaaatatcagtactactnaattccattcctcatcactacaccaattcncatacccaaacataacctttcctcgtcttatgtttccttaaaacaaaattactcgttacctncgttggcaattagtcgngttnaccttttnccgactccaaanctcctctcttnnctcctttcnnncctcttctctctttccttnnncccnnntccattnnccnccacttacct

SEQ ID NO: 13297 - DNA, 729 bp, Homo sapiens
  misc_feature (1)...(729): n = A,T,C or G
accttgatacatacataaacatagacttgggncacaagtaggacgtaccgcggcatggacccgcggnctccttacctcccccctctgtgcaccttagaaacacggggcgctcgataactggcggaaatccgtcctttcccacctttataacaccaccctgcccaactaactatttctcatttgttctgtcgcgaaccaaatatggacagtatgagctttcggtaactaacggactgattacctaacaggggcacaacttaatgaccaattaaagtgcttgacttacaatcctcgttccgggggacagctcccgtgacatagcaaagccatggcggagggatccgcacaggtgctaggcttctgatcgtccgtgcgggaggtgtgcggtgatagccaggcggcggcacgcgtctagataccatctggccgtctcggatgagggtgggtcaccacagtatgcgatgggcatgtcagcctcccaggaacaggctccttgggtgagctcactgtttcctagcggcctctggctttttatcctttcccatttgnccacgccagatatccccatccttcacgactgctcccttcatttaaaaaaaccccgtttgctttttcttacacctcttatgtattctaagtcatacaaggtatggtcttggtctacgactatgtttttaattcttcttgcaatccataaatattcaaataaaattgtgctatgtttccaaa

SEQ ID NO: 13298 - DNA, 1596 bp, Homo sapiens
  misc_feature (1)...(1596): n = A,T,C or G
tgtacattcttcatcaattattcatctcgatactatacgtgacatgaggtctgatcatagcgcacttgttcgttacggagaatctcgctatgtgacagagatgtttacattctgactatttacatacnaatctgcgcaatacgcagccgcgcatacagacttcctctcatatattgtaatggcgtgtgtgatcgcngntgctgctcgtcttgtntgagtattctccttctagtgagcgtacgtctgacgcacnatacttggacactagtcaatacgtctgtcatccgatgcgcgtacatgatccatgcgagtcgtacgtggagatgtcacgtatgtattgtgtacacacatagtatatgtatacggagcgctcgagtatcactctatctgatagtcgcactgccacgttaggactcactctctgatcntcatcagtctaatcnttcgtcatgtccanactacatatagtgcatcatctctgcatctcttctatccgcatggtacgcnctcgacgtatccaggcgtattcgcgtcctcgctgtgtacggtcgtgaancgcatatcatgtatccgaggactaaacgtaagtcaaacggatatatcattctcttctcgcgtcgcggcacgtgtctgtaccactcgtgtatgtatattagtgtacctcctcgctgtctctaatgcacttcacatatgcgtctagcanctgctcagncatncactatcacctcgtgcctatgatttgtgtaagtaagtgggagtaacttgtgttgattcggagtcactgcgatgtgtcttcgctactattatgtgtagtgcatgttgtagtntgcanctgtattacaccgcggtcgctgcgcatgcgcgctcacgctcgcgtcacacatctgcacatctctcgttcgagagtggtgagctctacgatcagtagctgagnatctacgcctntctcagtatntcntgcggatnatgtgttgtacgtatactatgagatcgtaagtcagttgagatattcgttagtctcgcgctnagtgtctatgcgatgacgcagtccatatanaangagtgtggctcgacaaactctggcatctactgcacatgcgancgcagcatcgtgtcacattcatcacctcgtaagttgagactgtctatgatgtatgtgagtactcgctgttgttagtttattgatatngtactcgcgcagatatctgaggcatgcattgatgaggatagcgataatcgaagcacncaatatcatctactcgctcgactcgacatcatactctataatccgatagtatgtcagcgatatcctctatatcgctttantgtgtgtgacgtcgatatntatattcgattctcttggtggctactcatacgtcttgttccgccgtcatgtctctactctcagtacactaagttactgtgagtcacgtntagtgatntcagcagacactaccctcatnctcatcttcgctcattctacaaccgatatagcgatatctagcgcacgtaactatacctagtgtctatatacgttatatgataaagaatactctcnaatgagattctgtcacnatagtagctatactantctca

SEQ ID NO: 13299 - DNA, 847 bp, Homo sapiens
ggagggatattgtaaagaggaggatatgcaaaagaggagtttgcgggacaaccgacaaatttctctgagctagtgactgttgcagcctaacgctggaaagtttcatgactggaacactcatcaaatggtacatgtacaatcatgatttgccagcacggataattgtgtaacgtgctggtgtaggggatggtcagctgaaaacacttattgaatatgaagtcccacagctgctgagcagtgtggcagaatccagctcaaataccacctcaagactgttggtgattgtggtcaggaagaagtgcatgccacaattctttaccgaaatgaaccgcactgtacagaaccttccacttggcactgttgtggattcagaagcaacacattattgaatggtttgacttttatctcatcgggcaggtggcctgttggggaattgctaactctacctactataaacgaacttcttgattacaaccgcttataactacaacatatatcaacaattacatttaaatcgacgcatcctgtcccacaacatggatgcaattgtcattctctcacaacatatcttttgctaactaaattcacttttcggtcgtttaaaattttattatgatacccatgatcgtgttactcccctttcctaccccacacttcctcgccattacttttacgagtcactagtccaatcacgacaatatgagtgtacagtctttagaattgatttttttattctcagtccttctgcctggcaagttccctttcttattgtgttctgtggtattactcttcctctttgatttcttctgttactatagttacttttattaatataattattgtgaat

SEQ ID NO: 13300 - DNA, 759 bp, Homo sapiens
tgggtctgcatgctcctcaaattgagctgtaacactcactgctgcggtccaagccttcattctttgaagcccgtggaaccacaaactcttcaattgagaaaaaccttcgatcggaagagccttctcatctcatttctgggggcctgtccgggatttctctgaagtgaatagaatccatgaaactgtaagtggttctacaaatggagccccaaatgaccaccactagcacctactatcgaggacccctagactgacctaccaacctgttctaacaccacgacactgaagaagactcccctcctgaggaaccctcaactgtagatccccttctatgccccagttcagcaggaagtagctagaatgatcattgcccaacttctcaacagcacttgggctttcctgttgagagggggtactgaggcactaagtggctaagttagctagacttcctgggtcaacagggacttccctaaggggacattcctctaagccaaaatgagtcatagctgcaagctaagggattgaaacttcaaccaatcaaaggggactgtctgctaagcaaaaatgagtcactgctgcaaactaagtgattgaagcttcacccaatcatatagggagtttgagctttagctgcagactgatgtgttgaccaatcaggcctgccacccacaagcatatagaaaatagtctaaggctatggtacaaaaaaggaaaaggggaggagttataaaatgatattagcttagaccccctattccg

SEQ ID NO: 13301 - DNA, 1128 bp, Homo sapiens
  misc_feature (1)...(1128): n = A,T,C or G
gcgacgaggacagtaacgttacgangactctctatcaattgnaacgttangctattcttggattcatgtatttaattactagtatacaattgtaattgaaaaatatgcaatcgtataatatatatataatgtgagcattgggggatgtttaactactattatgncgactagataggtacagttacatggatgggtatagtaccatcatgaacataatatagnggtcttgagcccgatagtggtnaacagtaactctggaacgtggaaatataatgaaactattatcttaaaatggggatatgagctacgaagtgcactgcatcgccgtcacgacacggagcatggcagggagtgatgtctacatacttagcgttacgatgtgcatgcgatattagcttgatgacctgtattgtgtgtgctgactcgctttgcgnntnntcgctatgtgcatcaattgtggtgngagcaacaataaagaatgagcacaagaaatgaagacttactggcttattngctccaagctaggtgtaggcagtcgggagcactgctgttgaggacacttggtggagcatgtggcgattatntctgtgtgtgtatgtgcgtgtagacagtgctacgtgaatatctagggggggacagagatagtgagtattatagacgcganatcacttaannaccacttcctcttagngactgctantatccacatactgtcgctgntnnccctcttcctcnttcttatctctcttttnnnnaatttttcctcttccgntactttctattctttctncattttactttcttttgtcatttttacttganttttatatantaatatctctctctncctttttcttatttnactctgtataacttcattatatacactcttttctttnccttttactatgttctatattctctttcttncttctcttccttttctttctcttttctnctctttaatacactcctctcnctcttcttccnccctccttctatcctanannncgtccctctctnncacactcaancgncgcncttgttcncnctncaaannccttcttnnnncctttncnnnnctctccttccttnnctnnnnnnnnnnnncctnnnnntcccttcccc

SEQ ID NO: 13302 - DNA, 1193 bp, Homo sapiens
  misc_feature (1)...(1193): n = A,T,C or G
cgattgttgtaagtagaaacttagtatcactagaggctgtctctggnngccagcactatctnagagtataaactatgggtgcctagtgctatatatacgnggacaccactgntcatacttgtgcaatctcgccgcgagtgaactatgtggannnaaatattaaggtgtgaatgtatgtcgttgtatttagtgngggagagggggctgcactggtcgaacgtcagtaccgagcgttgatacactttggcaggattctagaggccttgtagctgtagtcaagtganagagagcagctccgcgtgtggtgggnggaggtaactaatgagtnngatattctggtgggtgntatgtgtcgtgtaatctcgactgnctatagtgccgcgtgcggggacacatataattgcatgggaagtgtggctgcgacactgtangcgtcacatagtcgccgaaaatataaactggcggtggaattgtatgtgtactgttgagtggcgttaggatgaatactcanaattaggggtggcgacgggcgtgtatcgtggacacgacacgtatacggtaaataggtgcactggacgcttcgctggggcgcttaggnaactgtacgtcgtggttgatctattgtatagatgtggtggttgattattagaggtcgcggngacgaatggcattctgatgggggatgggccagagtccatataaatttgaaatcgtgatcatttgagataaanataccaagaattcgaacctgtgtacggcgctcnctctgaataagtagatgtagtactgaataggaatgctttgctctaaatctnncactcgctancattaatccacatatactctctttcactcaccttctctataatnnaaaagaataaagtgtgaaaatatgaccatgaaacagacagaatctagcactaatataacattncctatgccactaannncatttaattcctcatctcaagcgtactgccttctcgaccagcgtggggagctttcactcctcgnttttttnttttctttctctttaatcaaccttgtccctgctccctcaaaaaataacgctcggtcctcgttggctaacagcggtggtagtctttcgcgtccaattttcttattttctttttagaaaattannaaattnttntnntactatttaataattattaattaatatataaataatt

SEQ ID NO: 13303 - DNA, 766 bp, Homo sapiens
gatgagggctgggtgctggaggctcacacctgtaatcccagaactttgggaggctgaggcgggcggctcacaagatcaggagatcgagaccatcctggctaacatgaaatgttcagttgtctagctcacagggatatccacaagccagacccagaaagcctttgctaccattgatgaagatgccaagtccacagcccaacagccagaagacccttggtctagtcaaactccccatccccaggaaatggaatccaagttaaagacgtgtgtgcaggtggcttattggaaggtgaagcaaacagggcccttggattcagactgaattgatatcgccaggtttcctgtcttttcagcttgcaggcagctgattgtgggacttctcagcctccttaatcatggattaatatcatcctcaagaaagacccttctctgtgtctctggtattcaagctaagtgaccttacatgtgcgtcattcatgcggaagaaaaaaatgtagtttaacttagagtgatgaaaacatctgctactggcagttcgacagagagtgcgtggactactgtacttcagctgtagtgaaaactacaagaggagaatcacttggacccatgaggcagagttgcagtgagcagagattgtgctaccgcactccagcctgggcggcaaaacgagactccttttccgcaatggaaatcagagaatagcgcgggattcgatccagcctaaaacatcattcataatgccccgtgtgtgtttgacagtgtttct

SEQ ID NO: 13304 - DNA, 829 bp, Homo sapiens
  misc_feature (1)...(829): n = A,T,C or G
cagaaagcctagcaagggggaccctcacactgaaactcgacaattctanctcccactacgaacactgttttcccgtgttaagacttctcagaaataagggcactccggggggatgtcctgaatctggccagttctagtgggncacaggtaaccttcagatagcatcatccgcactgnggatcctaaatcacagtgattgccaatgcgtggacgagcattggaccagccgtaaggntcttcatggacaatcttcccaggcattgcatggaggagcacctctccccgatgactcgaggcccagtacccaatcgcactacaaggaagtttcttcnaatatatcctctgtacatgtcatggttggaatggtgtttcctctccagacgtacatgttgtaatggtggtccccagtattgcagatggggcctagtggaaagtgtttggcatatgggggtggatttttcataaatggcttggtgccctcctcgtggaaacgggtgagttgctgctgtgagatcacgcaagatatgatggtttaaaagagtgtggcatccctctgccccttgctcccactatacctatgtaaaattctgggtcccccttcatcttacatcatcatttcaagtttgctgaggccctcatcagaagctaagcagatgctgatgcctcgattgtacagcttgcagaaccgtagtctcaataaacctcttttctttataaattaaaaaaaaaaaatcggcctcgtggccatcagcggggagtttgcgtcaaaanctctnctnctctcnnnnnctcttcctccctccttnnnnctnctcctnnctccctttcc

SEQ ID NO: 13305 - DNA, 869 bp, Homo sapiens
  misc_feature (1)...(869): n = A,T,C or G
ttccagtggaaatacggctgaccaattggactgcaagcggcgcaccngttacggggatacacagcctcgattgangagaacatccggaggngacacaacaaccatcagctgggagtttgagaggaactcacatgctcttttcacttattgtccagaagaagaacatcacgatggaaacataccttgcactggagtcattgaatcttaactactgaataccttacccaagaaggcaatgctgaatgtcatcaacaaaggccgcaacaaccatatctttgtataagaagaatccttctctgaagacatgcggattatttgagtgctcagggtatggagacatgaagccttagacttgagtgcgggacccactctaagatcctcattgtttcttgtgaagagaggacttaagaactgcctgcctcgcctatggcgctcatgatattccattttaataaactgcgtggggttacttcaagacctgttacagagacgagtacccgggatcatcgattgagctaattggatggctatcgtggcgccgggcgatgcagaggcgcctgactcttggcaaagaggttacatggtgtccgaagtacttgcgtgactgtacgtttacggggcttgggtgtagtgtttgagcagggccgcagactgggcggagctgccgaccgggggtaaaggaaacaaatgtattagcaacatcttagatggttgtggagcgggcaatctcttatccacatatctggcgcgcgcatgcattacgtgcgcggagagaccaggccatttctgcgggacgtgccgcgagggtagtgcgatagcagttacgttttacctgcaccgttccctgggcggctcgcnaaaggaataag

SEQ ID NO: 13306 - DNA, 1126 bp, Homo sapiens
  misc_feature (1)...(1126): n = A,T,C or G
gnactgtcgtgggctatagtagtgcggcgctgtctgtgttctagatcttcttgnactctcgatatgcctgctgttcgngtctctgcgggtgtgtgtgcgtgctcgctctcgtagctggtatggcgaattatggcctgcatcgttgacatttggatcgagctggcgtcagtggtggtactattaatcaagcaaacgcgnagagattcatgtgagctcgaataggcagcgggtgtcgcgggcgcactgctgtnanacatcgctgcggnngatcttgtgcggactgtgagntgagngactgangtgtccgangagcggtggnctcgttctgcgtaggnacgatgcggactgcggtgtggnaggcgatgtgcgagancgcgctcgacctcacacgccgcaagttgaggtcctgtgctgagatgacgctggtagctcgagttcgagtagtcgagacatngcgntggcagttgtcgngggtatgtctggcgttgagggacagagtgaacgagtatacgcatcgcggagaacctggccatggngagcgaggagagaggagcggaggcagcgagctgtgcaaggagnacgacgtcggntcctgtgccgtgcgtgcgtcgcgctgggatcgtcgatgtgccatggtcgcgggccgcgtcgcgcgtttgcacgcggtctctactcgcgtgacangggaacaggactactcgcgtggtagaaagtcgtgaagggagtgtgtcgcgtggtgtccgcgggtgntcctacccaccgtgttgntctcggcacatcaacgcgcaggcggttgcactctcattgaataataacntctatactacagatcatctttatacataagatcacatatcatacatatttctagtccttgatctgtactcgtccacataattccttatatctgtacgggaaccatatactacacgcaagattcaaatgaaaagaacatataagacgagatannatccactgctcatccttactccttatacatttcccccctcactctcaccccgctccancntgtcctttttcccaaannttntttctgtttncctctaannncctcttnnncttnttttntctctttcttnttnnnnntnnntttnnnncctttcct

SEQ ID NO: 13307 - DNA, 1136 bp, Homo sapiens
  misc_feature (1)...(1136): n = A,T,C or G
ctcttgtgtctctggacttgctcgtgctgcgggcgctggtggggcgtctctcgtgtgcgctctcctctttcncttctctcctcgtgtggancttcgtgtgactcctgtggcctgccgcgttggggtgttggtnacccgctttggtgtgctcgttgggtgctcctggtgnntcgccggtccgctccccggtctccggtcgggtctcgggcggcgtgtagtcacgctggccggccggcgtgcgagtggcggcgcctcgcccgcgtcaggggccgcggctgcgctgnggccttgcgctcggtacctcactcggcccgacctgcctctctcccgttcgcgctctcttcccccctttgtctccgctgtgttctagcacttttctactgcgtcgttagtcgctcgggnggctctncccgtcctgaccggcctcttgcttctctcttcgtctctcttgncgttgnctgcgcgtgtgtactctgatctattattaacctctagcctctgttccctcggtggncctgtagagtgtctatctctgtactgtcctctaaaattatcccctactggttccctgtctgtttgnctttctttgctcttttcgtgtgccttgatctactgtttctgtntctgaggtgtgctggcccgtgtacccttacgcgctcattctcttttccctcctttcttgtgttctttcctccttaccttgccctaacactcgttctgacctgaatttaccatttctctnttttccccaacccccccccctttcccccctcttctccctcttgctttttctcttactcttcaccttnntctttnccctcccctctccctnaccttacccttaccccttcccctttgacctttttcgatngcctcgcctcttccttttctttctctgccctctgtttcgtttcggtttcctnnnctcctntcctctttctccctcttccccagaccctccttctccccccttcctcttctncccccnccccccccgcccccccctcttctaaaactcgttctctttntttctcttcttcctgaaaaatntttnntnccttttttattcctnactttttnnncctatttttnnntttaattttttattatttntcttatttttatttaatatatat

SEQ ID NO: 13308 - DNA, 1248 bp, Homo sapiens
  misc_feature (1)...(1248): n = A,T,C or G
aacaaaaccagctaatccagaactatactacccacacacacaaccttaacaggccacaaccaaacatgttcagattgcaacaacaccacgctacataataccgcgcaagttagcgaaaacattttccgaaggcgaatgactctccctcaatagtaacttgatgctagcttcatcgaataggacttacactcatcaacatgtacaggaaacactagaagatagtaacaattcaagctttatcacgtgtttcgcctcgctgtaacatttctgctactcatcattaatatatatacataccattcctattattaatcgtcgcaatatcttattaagtctaatattatgacagagtatttgactggcaaaccttacacactatcacccaagtggtcgattcaacataaactaccgagtgctacactgagtgatgaatatataccaactgcggcaagcgcaccccgatcatcttacctaagctagatagtcagatttgaacctctctaaacattacatatcaataccacaaanacgtatctaaacaccttgccaaaaggtacaaccgaagtcttatggatatcgctccagccttcttctgctttcataataacatacgtgactatagtatgtatagtngactagcacctaacngacactaatatgtatatcgtaacagtatcaaccatatgcagcgtgaactcactacaacgtccgaccacaatggtgacgtcccacagacaacgcacacacctaggatacatcaaganaccgcagcagatatcgcttacgcgacgaggatccgcactngacacgcggtaatatatcacattgatgagcgntatactctaccgcctatcatacacacgagaatcntnggagtcacctcagacgaactacanancatagataacatacacatatattactacacagataggagaatcacctagagttataattacttctcagcttgctcatagctatctcanatcgactttgcaatacacatncgtcttcttaccccttctatcatccacattacactatacaagccactacacagactccanaccgtcgcatatactacagatattngacgtanagaatacggtactggaccgaagcacattatgtgtcatcgacctctattacgacttcgcnctacgatacgtacgtgatcactcgactcatatgattaatccatcgatcaatgtcgcgctctcacagatcactcacgtactcacacgatta

SEQ ID NO: 13309 - DNA, 1070 bp, Homo sapiens; identical to SEQ ID NO: 7390
  misc_feature (1)...(1070): n = A,T,C or G

SEQ ID NO: 13310 - DNA, 754 bp, Homo sapiens
  misc_feature (1)...(754): n = A,T,C or G
atcangctgggggaggaggagttttactgtaagtcaagcccagagttataattgttatactgaattggacaatctaatttctgaatcaagattgtttttcatccaggctcagggaaactttactcctgctaaataaagcctaatggaacagtgggaagaaaaaataaagttgtattttgattacattatatctgcttgagtaacattgtaatttcaaatgcagtgctaggtttgtaggaaatgagagaaatatccaacggtgttaaaaaaaagagagagagagagagagagtactttgttgaaatctgaaaaggagatgcagtgagcagtaagcaaatgcaatcaggacactaagctttgggctcaacccaaggccagtgaatggaacctggaaggaaataaggcagctgaggtctggcgccccctggcccccagtggaagcaaggataaaactgctctggagaagtcaacctcaattagccccttaggattccgtagatgaagatctaccaaacatgggctcaccatcgaagatcaccaacatgacagaagaaaaagcctctgtctcacttggggagagtcagcataaacaataaaccaaagatttaagagtcctcattgattctgattttggaatgatcaagatgtagaatattaaacaatttattattcccagtaccctcacatagaattaaaggaatatggcactaccaaaatatgcaggaatttttgaaacaaaccccacagaattttt

SEQ ID NO: 13311 - DNA, 825 bp, Homo sapiens
ctgagaaggatttcactatatttcccaggcaggtctcaaacttctgagatcaagtgattctcccaccttggcctatcgaaatgctaggattacaagcatcagccattgcacctggcgcagtggctcacacctgtgatctcagtactttgggaggccaaggcgggtggatcgcgaggtcacggatgcaagaccaccctgccaggtcctgaaaatccatgaatgttgtctataaagactgctgctccacccttaaacatgaacctactcgcacatatccaacacctgacagaagcagacattactatgtgtgtgtctcagagcaaaccaattcttcttgacctgagagaaccaactacttgatagcaccgcatatgattgaaagataatctacacaaactacatacgcaccagtccaacactatattaaatacacacatcttataaatcacaaacttataaaaactgtttatttaagcacattatattactaatacaacctcctctttacactctcttaggtcttcgattgattttcatttagtaccaaacaacgcactcccattattcaccatatacagacacccgtttaattctatttagtaattacaattctactctagatacacttcctaaatgaatacaacttcaaatagaaaaccttataatcatagctcgacaaataccgcttctctacaatatggacaatacgcgatgatgactaatggaatcttacctcagcttatttaaagaatattatatctcatctttcggtaatctttattattatgacgttttgttttcttctctacttatagaacgtgatat

SEQ ID NO: 13312 - DNA, 1349 bp, Homo sapiens
  misc_feature (1)...(1349): n = A,T,C or G
cccgtngccagcacgaccgtggcgccgtcaggnagcgtcctgcgaccgtacagcgtgctctgtggcgctgcctgtgcgctgcaccgccggatccccgcccgcgctgtcgccgctgtcgcctcggtggtacgtctctatagcgccgtcctgtgacgcggtctcgtggngcgctgcggggcctcctcctccggcgacagcttgtacgggcttntgtgttcaatatatactcgtggnactctgtgagnggtgtgtcgtccgtcctggggacaacatctgttacgttagccctaccgcgcgtcgtggangggctctgnatcaccctgagggccctccgcggggnaccgactccctagtaccaccctcggtnggncggagggtcagcctcctaagtctcgcgccgcggcagccacgcggangaggctggtgggtggantnagcctgtcgcntacactatctacatcctccgcgacctctnangccacgatcgtgagagctactacacgcaggatgtccggtgcttgcgccgcgggagactcatcgtgcgcggggcctgtcgctcacgtggaacacagcaactcgggncggcgtgtgctgcggcagctcgtctgcgcgtcgggtcggcgtggggcgtcgagggctgggccgaccgtgggcgcgttgggcccgtcgtcgcgcgctcgtggnggtcgtctgggnnngncgcgtcgtggcgcgcgngtagcgcggccgagatagagcgtagctccggcgcgcgcgngcgccgcggcccgcgcgctcttgggctaccactcgcactcgcgcgcgggcgctcttcctnacccgtgtnncacctgcccgctcctcccgcatcctgcggccgtgggctgcggcccggcgcccctcttcatcnccctctcacccttatcancgctctcacgcactntngcgctgtgcgctgccgcgcgcctnnnnccccgtccttgngcccccttctctctctcttcgcnatctnggantcnccctagtggtcttgatgaacaagtatggagnnaactctcgtggctgtgctggagcggcatgtaaggcgtnggcggtcgcatcgcgttgnnagccgtctgccgcgcccacagcgnggacacanctccacatcagaaatactcaataatacaacaacanacaatatanccacccgcactgcgtcataacaacacaacaacacacggagcaagtgcgggccgtgcngttgtgctatncttgctgtgtgcgtagatagctcgctgtgccagcaccttcttctcttctnccttctcgaactctcttccttctcctcctnncctcctctctcccctntccnctnncccccttcttct

SEQ ID NO: 13313 - DNA, 1008 bp, Homo sapiens
  misc_feature (1)...(1008): n = A,T,C or G
cctagactagggaaatgagcaatgaattcgctgtctctttgaacactcgtcaaggcaatgtgcatcatngtactaatgtttgtgtgatgagagcgcgtaggcgtgtcaccacactgactacttgcgagtttagactaacaatcgttcggcacaataaacgaaacacgtcacatcgtgcttgtgtcaactttttaatatcgcctctcaagctagggcgccgacgttgctaattacaagccanttaactcgtacaacagtggcacccttcgatggttcattttcaacactgtgcactcgcacacaatgcgccacatctacgtgttatntgaacgacttacatcatgtgccgcctctgatgcaccctacccgcagctggccacctcatagtcatttcaatcgatgtgtgacgtcattactgcgagacacgaagttaaatagacgttagccgagacagacaccaagccgcgataacgtaaataacatatcacgcgcaccccgcaatccagatacgcgatataaggcgtcgggcagttcgcatccatattaagtgtgatcggtgcgacatatggcaggtgagagagcgagcaccaagcgtacctcagtagcntaatcttattatatatgatgtatgacacctactgtattgaattctccctattcatatatactngctacgacaggcgacttgcccatatatgatcatatcgtaacaaggttaccatggtgacaatgaagattcgagtgaggcaaacataatctcgatacggttggtgttgtcgtaccatgagtgaaccatcgactatcggtgtatcagtctggtactctcatgcntgcgcccgcncctgtgccaatacacaattcgcggcataagtgtccatgccacccatcaattgcactgtactcccacctcaagtgattccatataatgttcgaggcgggagagcggcatcagataggatcacatgtgtttgtcaggcgtgagaggcggtcggtcgtcgcatcgtgccg

SEQ ID NO: 13314 - DNA, 962 bp, Homo sapiens
  misc_feature (1)...(962): n = A,T,C or G
agggtaagtgctataaatttccttttaaaaatacatttagagtgagcaccaaggagaaaactacattttcatgctacatttacaattctttgaggtttgcagggctatttattcaggaagttagtggacttgtttcccagctaagatctgggagcagtaatcgtcctctcttgtggagggtcaggtgtttgtagggggcgctgctggtggcttagaaaagtttccagaggctttctatttgctgaagatttcctctctgtctgtgtcctacctctctctgccacttactagttgtgggtccgcggacaagtttcttcagctcactgnaacttagtttcactgnctataaaattggacttacctgatcgagtgatttaacagaaaaaaatgagctaatatgtaagaagtccttatagcactcaagtaatatctgctattataattatttggttatttcacctcagatagtatatttcctcttgggttcaacatctaagtaagctcangaaaatttctcttgnttaatttatcacacttaattttccttaaacactggaatctnatcttaactagattgnngaacgcatgaattttggatgcncacaacttatggatatctttggggggtttaagatcaagggcctttaaaagcgttcaaggggaattgaaaaggattgagactgactttngggccttcttagaaaccttnggagaaattgggccttaatcattgggagataacctaggttttnaaaacagcttgggttaaacctgggncnttaagggttcaagggnaatngggncnagaccagnacctngggtttaaaaaccctaaatttnccccccaggggattttaacctggaannggncccnaggaaaaaatggggccttggaacgnnnctttggggacctnaaanggggttttntttttaaaaggggnggggntnaatnaattaactnt

SEQ ID NO: 13315 - DNA, 530 bp, Homo sapiens
  misc_feature (1)...(530): n = A,T,C or G
ggggttaataanaattccccgngantttttgggtnttttaanatatanccttaaaaancatacgtgaaggcccctgatacttagaggcactcataaatagtagctcttattgtcatcatcatgactcctaatactataataatatatttctcagcatgacatttattttaatgtgacagtcagggtaccaatgtgtagtatattccacagggcataggtgtgaatgaacactcaagatgcaatttcctctccatcgagttctgttatgtaaatagtgctaataatagagtagaacagattttgtattacaaaataatagaacagtaaatggtagaacaaggaaaaagtgctaagtacacagtgaattcattaacacattttccagccaaatgtgtagatatacatatatatatatatacacacacacctatatttcagctattttaagtattgagatagctactgaatgaaacagcacatgaaacgcaatgtacaaaaaatacttcaaactttttgtacaaaatgaaaat

SEQ ID NO: 13316 - DNA, 556 bp, Homo sapiens
  misc_feature (1)...(556): n = A,T,C or G
tnttttntngtnanaaaaaatgntnaaaccgggngngattcccngcnttnagggcaatattcnaaccttntgaaaaattttttaanatttaaaatattggtttccagaangccaggancagaatgaaaatttaanccttttncaaaagccagggatccaagncaaagcnggatggcattattatgctgaagcttaatgtttaactataccactagtggaaggcccaccatagaaaaagcancagaaagaaaaaaatctagggaaaatattttaaaataaacatggttcaactatgtaataagtggcactttcatgttaaagtacatgatactttcaagtgaatacttttaatgtgagctgtacagttagaaagcaaatgtgtattcctcccttagttgattcaaatgaacactaacaaacacactttaaacaatatttagcaggatccgtgactcaaaacttctttcttattttatctatgtgaggcaaatttattgtgtcatttggactgcagtgatatttaagccctgtactgattgtcacatgacaaaataat

SEQ ID NO: 13317 - DNA, 522 bp, Homo sapiens
  misc_feature (1)...(522): n = A,T,C or G
aatgaanncttggngttncntctncctgnnaaaagccnnaaagnattgtaatttttgnaaagttncaaagttttggtaaatgttccttgtactttgacctgggccagagttttttatgttttcattagattagtgtttactaaacctcctctatgataatcacctgaggaatacagctttctgggtctctttcctggagagtctcactcagtaggtctggtattaggccatcagagaagtttgggaaatttgcagtagactgagcaatttgattgttccattcaaattttctttatttgtactgatttgtgtctgtttgatctatcatttattggganaaatgtgttcaaatctttcagttcaattggtggattttttactttttattttaatgttttcatacatatatatatatttatacacatctatgacaggtatattaaattctcagttctgtgtcctcattttataaaatacagaagagaaaagtaaagataattattttaaagtcttaggacaaat

SEQ ID NO: 13318 - DNA, 535 bp, Homo sapiens
  misc_feature (1)...(535): n = A,T,C or G
gnaaaaaaaggnttttttttcnaatngtccaaagacccccnccnggcagcctggcantcctgtcttnggancggggagacaccgcnctgatttcttgtgccacccagtcggcccacaagcactgaaatgtcagttcctgttagcacacaaactttgccacagacccagctcaggaagcagtgacaaaataccaccccagctctttctaagcctgagttcaaaatcccaggagaaaaaaacagatccgtcatgatccagccatgaaccttctcatagagcactcagcagtaggcatgtatgttcttcaggatcaccgtatacatctgcaatcccacataaaagtgaatagggtgttttcctacatcctaatacctcctttaatccttatccagtgatctagattgttatcagtatagcgatgtaaagaggttccaatctccctctctctccatcccctcagccctgctcacccaacaccagaatatcatcagtgtttaccataaagaaacaggtgacaattcttttaaaactaaat

SEQ ID NO: 13319 - DNA, 760 bp, Homo sapiens
  misc_feature (1)...(760): n = A,T,C or G
acttttgatgtcttcaaagcaaggcnagtgagtggactcttcagacaagaaggaagatggcaggtgaaatcatcttcttctaatgagccctgtgctatgcttgctgatgtccttggtcaccggagattttcaagaaaaagccatggccttaccagtgaaggttacacagaggtcactggagtcaagtaatncattgcaccttattacatttangccttctttatccatcatgcaggctattgggattaaaaatgggtcctttcaacaatgagtcaaatatnnnangattctggnggatccatttaatggccccatattggggtattcctctggacacattccttaaccttnaaaacngtttcttgggacattgngcntaggtgcttaagggaacccaaaatngganggnataattccttggcnttntggggtgttcactggttgggtctgangccctacaactattggngaaccccccangggaatnttagcntgtggntnttgcccttaagccttaaggagcacaanccctganggtngaatgggtcttcagattccaacnncntccntgccttttttnacccttggtttccaanncctggctttctnnccaancannttngggcccccaaancnngattncntggaccgggtttctttgggaccagcccatttactncnatggcntnagttncctttcaaaggtttgggngtnnctnntnnanggantttggaanantttannggnccntnttcncct

SEQ ID NO: 13320 - DNA, 556 bp, Homo sapiens
  misc_feature (1)...(556): n = A,T,C or G
ttccaacaatnagncaaaaattanaanattnttggggaacccattttaatnancnnaaaattgggttatncntntggnacacattccctttaaactncaaaacatgtttcttggaccattgtgctaggtgctaaaggaaacacaaaatggaaggtataaattctttgtcttctgggtgttcnactgttgggtcntgatgccatacaactattgtgaacacacgaagggaaagtgtaagctgtggttcttgccctcagcctgaggagcacagtccctgaggtggaagggtctccagatgacagcagtgnccatgccttatttacccttgatttccagcacctgcctcctgcccagcacagttgggccccaaacctgatcactgacggggttgctctggnccagcccatcactcaatgcagagcttccttccagtgtttggtgtctgcttgaggatgtggagatatgagggcctctctcccactcctgcagcccattccattgttgcttcacactgattactaagagatttccctgcctgccttgtaacctgaccaat

SEQ ID NO: 13321 - DNA, 552 bp, Homo sapiens
  misc_feature (1)...(552): n = A,T,C or G
cnntttnnggccaggatgggtttnnantncnccnaaccccnaanntttaggnccngcnntngnccttcccaaaaggtgtngggaananaagggggggnnccacccgntgccnntgcccaaaaaaagcnnanttaacccagtcaaacgtngnnnnccacttttcctcccnccctgatcacaaacccacatgcattatccacttgagcagtcacaatcagangttaaaccaancattattcanataagatctctgaaaagcctntnatcctttctcttttaaaatggaatatattctaancacctctccaaggacncaanacttaccttgtctanntaatgacttttctagcttcattccctatcattctccatcttgccccatgctcctcatgcagcagctttttttttnttttcctttttcaaatatgttggttttgatcttatccaagaacctttgccctgatgtatgaatgaataantgcttttntacttcgggggtctcatatagaaatcctgcttcagaatactcttccctgagcactctatctaaat

SEQ ID NO: 13322 - DNA, 537 bp, Homo sapiens
  misc_feature (1)...(537): n = A,T,C or G
annattnaanaacngggtnccncaaatgtttntcangtttggcagatgnggnatccnanccaanccanggcttnnctagtnatgccacaactananaaanatatctgcnanagncaaaagggtcttagcatntgtccccatgcactgtaattctcattaattaaaagaatttantccatttcaaaatgtcatcagtttgatgctgctntgcttcaggnccagatgtgtagtcatggcaaaagagcatgaggttaaatatcccaaataataagaaancttcataacantgcagcacagttcataccaatgtgnaanagtgtatatagaaattnaaatttgaatttgtgttttaattttagggcacaattaaaatatttggcaaaatatcttagactcaaacctatttgggaaaaaataagtatttaattcatgatttctttcctgcatgctgtattcgttctccagtgtggcatattctagcagcatggactgatgaaatcttgccaaagcattttgttttaactctcctttgccaat

SEQ ID NO: 13323 - DNA, 1106 bp, Homo sapiens
  misc_feature (1)...(1106): n = A,T,C or G
ggccgcgggcaggcggagagggcgagaacggcgccagcagaagaaaagaagaaggcccttcccgtgagggacgacaaacagaggangccctctagggggggagacaacaaaggcgggggcggggggaggagaacgagagggagcacaggggccgaggcgaacgacgacgacacggcgcgggcggagaagaaagacgacgcccgcagcacgagccgccgcccgagcagccggacgaagcaccccgcagagcgaagcggaccaacggacaccagcgcggacaccacagcggaggcgcaagcgacgccagacgcccggcgcacagacgcgcgaggggggcgaaaacgctctcttaagggagaaagaagcaaagcggcgcagccgcaaagccggagacccgcgaacagcacaacgcccaacaggagcaggcacccggcacgcggcgcgggacgcgcgggcgacaccggacgagggcacgcacgagngacggaagcggcgacagccacgacagaccacacacggaccaaagagactgcgaagcgcggggcgacggcggggagagacgggacacgcagaacaaggagcagacacggaagacaccccgggaaggcgcaagagcggaagagaaacaaaccaagagcaaagaagaccggagaagcagagagaaagagcgaggcaacgcgacgagaagcgaagaaacgcagcagagaccaccgagccgcggacgacggcggcgagaaagacaagagagacagacggcaggcagagagaaacgagacgcgcacggcaacaaagaggaccgagacgaggagccggcaggagatgacccgcaaaacgagagcggcaaagacaacggcacaaacagagagaacacggaggagcgggggaggacgagaaggacgccagcagccgcgacgggcgcgacgcgcacgagcgggaggagcgcgaaaagcgcagaagcaggacgcgcacgcacgccagccgcgcaaaaccacccacgccagaggagggagcggcaaagaagcgagcggaacgcgggacgcgccacgccgacnacgacggcgcgagcgacgaaagacagaacggcgggcaagcaagcagaacagaga

SEQ ID NO: 13324 - DNA, 674 bp, Homo sapiens
acgtgaaaggtctctataatgaggattacaaaacattgctcaaagaaatcagagaagacacaaacaaatggaaaacatctcatgctcatggagatgggatttcaccatgttaaccaggatggtctcgatctcctgacctcatgactcacgcctataatcttggcactttgggaggctgaggcaggtggaacgtgaggtcaggagttcaagactagcctggccaatatggtgaaacctcatctctactaaaaatataaaaaattagctgggcgtgatggtgcacacctgtagtcccagatactcgggagactgaggcaggagaattgcttgaacccgggaggtggaggttgcagtgagccaagatcacaccactgcactccagcctgggtggcacagcaagactccatctcaaaacaaggagaaaaaaaaaacaatatggtggttaccaggggctaaaaagtgtcagtcaaataatacaaaatttcagttagaaataaagaataactccaagacatccattggacaacatggtgactacagtcaattacaatgtattggttccttaaaattggtaagaaagcaaatttcaggattctaaccaagaaaaaataggtttgtgaaggaatgcatagcaattattttttatgtgcattccccaaggaaacacacttaaa

SEQ ID NO: 13325 - DNA, 428 bp, Homo sapiens
  misc_feature (1)...(428): n = A,T,C or G
aatgttctagaaggatatgatgtgatcttgcacagattgaatgcagaaacaaagatgagcgtccagccatcttccattaagccagattttaagagactttcaaaaatgtcccagcccctgaagcaaccagggccaccgtgtggaaaccccctcaccaggaaccgatgcaaatgccctcggcttatgtacaagaggaacccagcaagttacaggggagactgtggtgatcccagcagtcatacaaaagtgatcttgncagagcaagccacctgctcgaggccactcaatacatttatcagcgtcgctgctcttcctttagcataaagagtgaagtaggtggacacgttcaccgagctggaaagaggctggataaactttggtgttcaaagtcaagtcccactgttatttcctttgtaattcaatagaat

SEQ ID NO: 13326 - DNA, 727 bp, Homo sapiens
ccgggcgaagagccaaagacaaattcaaattggtctcctcatcaagatcttaggcagaagggtctgtcactgctaaagccagcaaaggataattcactttagtcagtgctggcgtgcttgcagaagaaatgtaaagcactcaaagtcagaaaataaaagcagtcccagtcctggaagtcatttggacagtttcagttgaagagccaaagcagaaaattaacattccagctcctagaaattttattttcgcctttcttctaggcataatttataagtcaaatagaattgctttggcctgggtgattttgcataatggttcctagcatggtattagggtctgcattcagcattatttttcttacatttctgtagagcaatgacagcactattccccaagcatcccaacaaagctctcagcccacacccagctgctgcccaggccagtgacctgtggaaagacaaagacaagaatgctatgcaataaatcagaaatggcctggaagataaacctggccaaagaactgagtgcctgcagccagactacagctgttttctctttgggcagaaaggaggaagcaagtgtgactcctcagactccctcaagccctgctgatcaagacaatggttcttcttcattactcatctatatgaaatagttcagacattgctgtttacttatttataataaacctaattactcatcttattgccaaaaaaaaaaaaaaaa

SEQ ID NO: 13327 - DNA, 728 bp, Homo sapiens
ataagcaaagtttcctttatatagaacaaggtctctcaactttgacgttattgacttattggactggctactcctatgctgtggggggctggcctgtgcattgtaggacgtttaatggcatctctggcctttgcccagtagatatcagtagcatctccccagctgtgacaactaaaagtgtcttcagacattgccaaatattcctgggaagcagaatcaaccccggttgaaaccactgctatagacccatttctttagcgaagttgttcaagacaggaggagtatcatttatatttgagatgggctcatgccaaagacaaatggtaggtaaacagtcaagggttttggtgaaacatacgactcatatgcccaagtgcaggtggccaatttgatttgtcacaatggagacacatttaaagtggggaaataactctccaatgacattctgccaaacctctcattgctatagtctccaagttcccaaatcctgctatttggaatatgctcacttctcctcagttacatatttcttattttaccttggtatctatcatccattgcaagaagggtttgttctggaaaactatgcctagttgatctttgacagcaaaaccaatcaaggcagagataatgaggacataaatcttgagcccaattgtgtaactgttatcaaccacaggtgggatgtttcctaaagagccttagattcaagcaaaaaaaaaaaaaaa

SEQ ID NO: 13328 - DNA, 265 bp, Homo sapiens
  misc_feature (1)...(265): n = A,T,C or G
tagccatgacgaagccctcagattatgcagcccttggctgacaactgtactgcaaccttgtgagaggcccctancaaaaagggctcgggggaacctctcctgnactcctgaccattggaaactgcggcagatgaggaatatttgttgttttgagctaagttttacataatttgttatgcaatagtaaataaataatacactttcacaagagaggatgtattattacacattaaaaagaggggggggaatggcctcgttggcctca

SEQ ID NO: 13329 - DNA, 745 bp, Homo sapiens
ccctggctcctgcaccttgacttcctgggagaggaggagtcttcccacctcagccttgaaagtagctaggactacaagtgcacaccaccacacctggtcaatattttacttctattttgtatgtgaattaggatatatatgtgttctcctctcttacattagtctacgcccatcaagcagctatcaacagggtgtagccatggaaggtaaatatgtttgcacatttaaaaacttacattaaaatgaatcacagcactaacgagaaaagagataccaagccattaaaatacattgagggaaatatattttaatgtcatattactaagcaaaagaagttactctatgaaggctgtatactgtattattccaactgtatggcattctggaaaaggtaaaactatggaggcatgaaaagatcaatggttgccagggtttgggtggggagaagaatgaggccgagcccagaggatttggggaacagggaaactatttagtgccatactataatggtggatacatgccattatacatttggccaaaccaggagaatgaacattatcaacagtgaaccataatggaaactatagattttggaggctaatgatttcgccaaaaggtttactattgtaacaaagggtgaacactcgtggaagggatgcggatcatgggagacttgaatacctgaggcaaacatttttgagaaaactccgggccctccgggtggctcgattttagtacaaaccta

SEQ ID NO: 13330 - DNA, 924 bp, Homo sapiens
gaaatagcgttgagttttccctgtctgtcatttttttccttctctcatattgccgcgcttattttttctcctctcccctctcctgctctggtggcggtcacggcggcgtcccatgctttgtgcgggttcgtctccgtccagctcgatacgtgacaccgcgacccggatatgacggggcatactcatctgggggggatgtcatttgtacgcccattgtggttttgccaggccctcgcaatcctgttgttgtcctgggatgacctggcgtcatgtgcgttacatttatgcggtttggtctggctcgcccacactgtttagttaggtgggacgatatcgctactgcattggggtaggctcgtcgttggggtcgtcgggggggtaattccgcggatcgcgattctgctggtactacgggttataccgggtcatcgtttccggagggcacttgtctcggccgtcgggcgccgtctctattcgcgccgttccgcgggggaggggaatggggtacggcgtggatgcctgctgttattggggtggccgggaatgaaccggtcgcgtggccacggcccgttctgggggtgtctacttgggggcatcgtgggctcatggtgtttttcttgtctttctgtggtctctggcctatctggttttggttgtttgttccgggtgtccttcgcccctagtggttggtttgcgcgtccgttggcagcttccactcccatccaccaagttctttctcttccagcgtcttttcttgctatgttttgggatgttcggcctgaaattagccctttcctgtttaattaaaaccctgtcaaactactacgttaaagataaaaaaataaaaaatggcctcgttggctacagcggggagtgtgcggccacctttctttcttcttcgttctcggtgtttttttttcctcc

SEQ ID NO: 13331 - DNA, 724 bp, Homo sapiens
gatggtccccaccagtctcatcagcatgaggatagaattttatctcaatgataaagcgtgatatgatcatttgtcctagggcacaacttaaaaactgtcactatcggccgggggcagtggctcatgcctgtaatcccaacactttgggagtccgaggtgggcggatcacgaggtcaggagttggagaccagcctggccaatatggtgaaaccctatctctactaaaaatacaaaaattagccgggcgtggtggcaggcacctgtaatcccagctacttgggagcctgaggcaggggaatcacttgaacccaggaggcggcggttgcagtgagccgagatagccccactgcactctagcctgggcaacagagtgagattccatctcaaaaaaaaaacaaagttcacgatctaagacttctgtcacttgagttctataaccattgtataaatgatcagtgatgccagtcactggcattcacggcttgtgttctgcctaaatgttctgcctaaatctggctctctttctggagaaatctccaccccacccatgtcatcatcccaatctttcgcttcagctgcctataaatagaatatcctaatcccatataccagccaggtcacaagatgtagtgaagaaatcatttgtagtcagaagaaaagaaatgttgtatgcaaaaattaagaataaaaataaattaaggaaaacaaaaaaaaaaaaaaaaaa

SEQ ID NO: 13332 - DNA, 864 bp, Homo sapiens
gggggggggggaggggtgtgcggcgagtgcaaggggaggggggggggcttagctgggagacgggcggctgcatgctttgcggtagtgaaatcgaggggaaagacaaatgggcctgcatattgcgtcgtctcaccaattgtcagggggggggaactaatttttccccttacatccatctctttaacagctggagcgattaaaaaaagaagccagccttcctggtcccgattgggccattaagctttatcctcacctaccagtatgacttgggctatggaacccttttataaagagggggggggcaccctgaggacatactggaaacagaaaaaagtaaattgcaggtgccaagagggggtgatcacttttgaaagcgttgaataagccagaaagggacagactacattcttcatagacgaaggagatcatgcttaccaatcaaatctccgagcacagaattggttacttgaatcacgggtcgtacaggtgtttaaagggtcaagactgtggtatgggggattgtatttgagatattaaaatgcgaggatggtgggagctatggcagagagaggctgtcgcgttggcaccgagtcaggggggggggctctagaaacttgtaagatacctctgtggtggggggctggccggggtctaaaggggaaatcagtcgatggggggggatccgcgggaaacgagaagacgaagggcgggcggtgccctcggggggggggtgttgcgggcccttccctctagggaggggcaacggggggtcctgggtacctggcggcgtgggccggggggggcggggcggcgggacgcgggcgcgcggacgcatagggcagctacgcgggctccgcgaaggag

SEQ ID NO: 13333 - DNA, 1042 bp, Homo sapiens
  misc_feature (1)...(1042): n = A,T,C or G
tatatttttatttnnttttttatataaaattaaatttttatatttaaaaaaaagaaaatttttttttttaatattaatttaattttttggtttttatatttaagattaatattntatttttagttaattaataattattttaaaatnnttttgtttaaaaatattagaaaaaatatatatttagatgtgaagttaatgaacggatatttattattaaattaaaaaatatttaaataaaaaaaaagaaaataattatatatagataaacagaaggggtagaggagaattagatgtaatgatgcctttggttattggtagtttttgttgttcgcgtgttgcggatctagtcgggggtggcggtgcggtcattgaaggacgcatagaaaaacgacatgtgacacgcattcgcgagtgaatagcataaggagcgtcaaaataaaatagcatgaaagagagtattaaagggaagaacttgcgcagctagggtctgtaaataaactcgaccgaacaggccgctaacagaaatatatatgacgataatttaatcaaacagatcagtgagagacgtagaagtgaagagttttgaatatgtatatggacatggttatagctaattttacttccatactgtaggcattgtcaatatttgtggtatcggatgggcattcacgtgaaatatgggttgcagtatgtatagttaattatatttataactagtgttggagtgaagatatgtggtagggtaggctggaataagtactgtatatacatnatatccatagtatatatagaaattaaataataacataaacatgaaatgcgaataataataagaataattagaaaagaagcgaggaagagacgaaaaaataaatacggtgtatgagatgtaaaanataataagagatataattgtggcacggagaggcaagcaagaggagtaaacgaggttatacaatatgcgatatgaatagtatatacatacttgatgaattgagaatgagtaacgacacgaatacgagagcttgatggggaaagcaat

SEQ ID NO: 13334 - DNA, 782 bp, Homo sapiens
ctcaggtacaactgtcggctcactgtcacctctgcctcctaggttcaagcaattctcctgcctcagcctctcaagtagctggaagtacaagtgtgcaccaccgtgtccgactaatttttttttattttaggagagacagggtttcaccatgttggtcaggatggtctcgatctcctgacctcgtgatcttcccgcctcagactcccaaagtgatgggattatatgttgctatttacttcccactctttgaaaagatttttctaatgacaagtgaagacaatacaggggtgacaaatgtatgaattttttagcagtagctgagtggagtccctgaatgtgccactccctgggcctgaagtgctctgtgcccagatcaatgtgtgactggctccacttaggactcagctgaattgtcaactccccagagaggccttccctgatcatcctatctaaagaaaattcatttttagttattatttcctttaacaattagcttataaaatttctataaccccgcagctcttgaaatctgtataatataaacaaaatataagaataaaattacactttttagcataaaatgtaatataggttcattgtagaaaaatttttaaatgcaaatcagcatcaagattaaaatgaaataatttgtaatccttccacttagaaaaaagatcagttaaaattttgctgtatatttttttaaagttttttatggatcaagctagctttttaaaaagtttgcatatcctaatcctatgtaaaagggtttaaggaagaaa

SEQ ID NO: 13335 - DNA, 859 bp, Homo sapiens
  misc_feature (1)...(859): n = A,T,C or G
gtgtgatggaagtgttagataattgtagttaataanactttcaatttactctgggggaacttgctgccatgctctgagcagcccactggagaagcccacgtgacaaactgaactgaagggtgcagcgcaacagccagggaacctgagttgggaagtgggccctccacgagtcaagctcttggatgacaccttgacagcagtctcatgagagaccctgagccagaaccacccagctaagcttctcctggattcctgacccacagaaactgagagataatggcgtgtgtgttttcttgagctgttttttgttacacggcagtagataactaatacggtataaatagtaatggtacctgactgcagactctcagtaaggagcgaataggcaagcgcaggtagagctcctagcacagagcacggcacatagtaaggtcttacgattattagttacaatagagaatatctgcttcccgcaagtgcctctaaaggagcgagtctggtggtatcattgggggcacatagcaagttgtatgagagagtcgtgggtgcatgtatcatttttcctagcgggttgaacaaaattaccaataatgtctggcttaaaatgactccatgtgttactttacagttgggggggtcagaagctccaaatgggccatacaaaactataaatcaagggggtcggcagaaatggtgttccttctcgaagcctctaaccgaaaattgggntcctggcccgggaccagtcttcacagggtggcccagatatctttgggtagttggggggtacttgcgtggagttggtttcctttgtcaaatttcgtttggatctgaaactttgggatttttgttttatttt

SEQ ID NO: 13336 - DNA, 692 bp, Homo sapiens
  misc_feature (1)...(692): n = A,T,C or G
aaaaaaggcgcgatcacttcgtgtaatatttccgtgtcacggctagtagggattgtctgtgcatgtgttgatcctttgaatgttctctctgcactgtctaagtgcgctaggagaaaataggtcggaatcgggcatttattcgcactcagggcacacactcagcgggcacgatagtgtaacaaagtcgtcatgacgtgtcctcaaacgtcgttgcaaggtaaccaatcgacgcgggaacccaaggcgaaggngacgggcgatatgaaggaaatacgtgggagcatcagatcggcaaggggaggataaaccagcggagaaggtgtgtataaagagggaatggaattccgggtactgggtaaaaatgggtggtaacgcacggggaattcagctatttggggagttgcggggaggcgaatgcttgggccctatagtttggtgcctgcccggaccaaaagggcagagccggaggattataaggatttttgtttaagatggggcggggcagggtgaaacagctctcgtagtccacttacttggggggcttaggccgggggaacgcttgagcttcggggtttggggctgcagtcaaccatggttatgcccatgccctctagcctgggtgacaaaacaaatttccagctcaacaaatggaatggaataaaataaaatcaaatcgtttggtctgaaggccc

SEQ ID NO: 13337 - DNA, 730 bp, Homo sapiens
ttaatgatcatggatctgtctggtttagactcagagaagaaaccgttcaggaacatggacatgagtaggtagttaagtctaagtagcacaatcaggtggtaagttgggctcttgctctgaaaggtcaagatatggatcctaggctgctgacattcttacaaaagaatgccatcaggcacagtgattcagaaaacagtgcatactttttactaacggcaatatttacttgatataactgaacggataggtgtataaaagactcagaatatggctccacctattccaagtgtgattttgatgtgcacaaggtttcaaatcacaagtggaattgatatcagattctgtccttatcccttcatagaacactgttcaatacccaagaaatcagaaaagatatgggaaactaagttctcttatcaaaactagcaatgtgactaattacatggagaatgaatgggcagtattataagcaacacatcaatagtcagcttaggataaaatttttcgttctgttcattggtgttaccactgtctaatggccagcatgactcaaaaaatatatttgtatccacaatagttggtgactcccatgattgttatttatccaacatacaatatctggagatggttgtgtttttcaatatgttttataatcataaaccacttgtttctctccatgtgaactaaatgttttataaaggaagaataaacatataacatatgctaaaag

SEQ ID NO: 13338 - DNA, 425 bp, Homo sapiens
  misc_feature (1)...(425): n = A,T,C or G
cttaggtaaatcagaagagccatccttgagnaatctgcccaggctcagacatccctccgtaacaactggcatttaagaaaacatggaacgcactgttgaagtctagagactaccctggctaagaagtcattgctatgaacagctgaagaattacgatctgaccttatatctactcgttccaatgaactgagacgcttctctcacgaagattctgtttccttggggactgctcggtgccctgggggatgtgttttagagttcaaaacaaaatctcttagctacgaaaaacaaattctttatccattttatccttttgttcagttttctaattctgaattgtagagtataatagcacatacaaaaaaggtaattctattcacaagcaatgaattttattaaatcgtctagattgaaaaaaaaaaaaa

SEQ ID NO: 13339 - DNA, 298 bp, Homo sapiens
ttaggcattactaagggggaaacatagcacatcagccatgtggatgcatcctgccggccgcccctctgcaagccccgaccaagtgaattgacagtgtacatgggaactccaggaggctctgatcaccaaacacgggtaagggccatggactattggcatccctttcctccgctcccaagtgacaaacccggctgtgctgctgaacttgaccatctcttctcatcatgccttgcctcagcccaggacccatcaccgatggaatgaaaataaacccacccagcactcaaaaaaaaaaaaa

SEQ ID NO: 13340 - DNA, 587 bp, Homo sapiens
ctaagtctatctgcaacaatcctatcacccctaccaatgagctttgcctctactcacccatctgagccccagccttcgcgtgtgactccgaacggtggagttttctcctaaatccattcatcttgccaaaacactgctcacaatagcaaagacatggaatctactaaatgcccatcaatggtagactggataaagaaaatgtggtacatacacaccacggacaaccatgcagccataaaaaagaatgagatcatgtcttttacagagacatggatggagctggaggccatcatccttagcaaactagcacaggaagagaaaattaaatactgcatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgggtgatgaaatcatctgtacagcaaaccccatgacacaagtttacctatgtaacaaacctgcacatgtacccctgaactgaaagtaaaagttaaaaaaaaaaaaa

SEQ ID NO: 13341 - DNA, 751 bp, Homo sapiens
aattttcttgggagcgagctttccgcccccaatggcttctgaaaaacgtagtggcccagatggggaaaggcattcagtcagatcagttcctgcttgcgtagtccagcaccagttttccagaggctgcatctggatccgggtaggggaaagcacatgatccaggcagtcctaggttagccggacaccgaattgacaacagaaagaacagaaactcctcatgctacacacttttaaggttaaccccagagaccaaaaacaaaagcaagcaagcaaagaaacaaacaaacaaaaagacttcaggacagacaatgaagggcacctgggaaagcagacgttttcctacacaaactttgttctccgctgatctctgtgacactaaaatacctacatagaaatcctaggatttaaatatcctagagatgatcagaagtcctttaaggtttaaatctttcctgccaaggaaagaaacagtactgagacaggcggagaaggtggtgacatttccaggattcttatcctgcaatcctgaaggatttctgttctaattgccatagcctcttaatcagcaggtgtaacggggtcacttccagctagtcagtgagagaatggaaagtgggaactcacatgtcccagaaaagaaatctacatttatattcctttcatcctctctgaaacaaattgttattttatcttatttttcagaaggaacgaatataaataaaaatacttttttccaaaaaaaaaaaaaaaa

SEQ ID NO: 13342 - DNA, 812 bp, Homo sapiens
  misc_feature (1)...(812): n = A,T,C or G
agaaggagtctcgctctgacgcccaggctggagtgcagtggtgcgatctccgttcactgcaagctctacctccctggttgacgccattctcctgcctcagcttcccgagcagctgggactacaggcgcccgccaccatgcctggctaattttttgtatttttagtagagacggggtttcaccgtgttagccaggatgggctcgatctcctgacctcatgatccacccaccttggcctcccaaagtgctgggattacaggcttgaaccaccgcgcccggccaactgatttttatattaacattgatacttagatgttagatgggtttgtatttttaaaacatgtattcatcagcctttatttactnnnttttttttttttttttttttttttgtgagacagagtctcactctgtcgcctaggcgggagtacagtggtgtgatctcggctcactgcaacttctgcctcccaggttcaagggattctcctgactcagcctcccgagtagctgagattacagccatgccccatcacacgttactaatttttggatttttagtagagatggggtttcaccgtgttggtcaggctggttttgaattcctgagtctaaatgatcctcctgcctctgcccccaaaggactgggatccgggtgtgacccccccacccagctcatttacgttctattgggtgcaagtccaaatttcttctgaagaaataaaacattttctgacttggatagggggaaaaagattcatgaaagatttgggaggcttcgaaacctcctgaatggtccaactaaccaggaggctc

SEQ ID NO: 13343 - DNA, 517 bp, Homo sapiens
atactctgcctctagtagtgggacagatagcctctgagtacctgcttcaaatcaccctgcacgtattctctttgcaaacataagcactggagagccatctcgttcccttcagcataaatggaaacgaatccagacactaagaatgccgcagtggacaccagttatgcaaggttcagcagaggaagttttcaagatggtgtgcctcgctagccaaaaatcagaaaagattgaagctagccttttcatctcagttgctccttaaatcagagcaacccctcctaattaatgtgaacttcaacttgcacagcttgtccacttaattgaatgcttactgagtatgtgaaccagctgcaccaagatagtggtaagagagattgtggtaagacaaaaatgtggagcctgttttcaatatatttacagttagtttcagggtacaatgtttttgttctgctgttacattagcgtgtatcccccagccaataaatacatgaatggcaaagtaaaaaaaaaaaaaaaa

SEQ ID NO: 13344 - DNA, 870 bp, Homo sapiens
  misc_feature (1)...(870): n = A,T,C or G
tcattttaagtaaatttttactttttaatttcgaataaagagagagtttganggaacacttccacatgatcttcagttacccacacctctttccctgttgtggctctgccctcctctggggtcttggaggggctcaccataaacagcaattgtcgccacaaatgaagaatgttcacgtttgttctacaacttcttaatgcaccgcattcagtcttcctgtaaacttgactgcttagtccttaaagtatattaggaggagcaatgtctgcatgccttcttcaacacatgtattggcctgtttgtcccagcatcccagttggaatgggaacccttctaagaaaggcctttatcctttactcacctacaaactcactgggcacccccggaattgtggtcctgggcgtatagcaggtgtctagtctctattttctgggtgtgccagaatttggagcctgattacaattcttgttcatccattgcacctcaatggaaagaaaccagcaagaaacttatgctttcttgcccatctccttcctttctttcggggggtaaagcggcataataggtttgagaaggcggtaatatatgaagaaaccatgcggatcacacataccgaaacaatttggttaattaaatcggattattcagggagattttgtagttcatacgaacggagagacctcagaactattagacacagaccttaacgcgggaaaccccatagggggtggcccttaacttattgataaataacgacattcaaacaagggaagggtttgtaaaaggccttcacatcctcaccacccccgccctccacgaagacctctatatagaactcccgtccctttcctttctaccttgagaacaaag

SEQ ID NO: 13345 - DNA, 575 bp, Homo sapiens
aaattttaaaattattttgatattatataagaagtgaagggggagatctcacgattaactacataatcactaatggcaacaacctgagtatctaatgagagatgactggctaaagaaaatgtggcatgggaggtatgcaactggaatattatcatccataaaatagaagaaaattctgccatttttgacacatgtaagaaccttaaagcacatcatacaaagtaaagaaaataatgatgtgctcaggatagcacagaaaagtcaacaaatattttgatatgctactgcgtggcagggcagaaaatgattttctaagatcaaagaaaaatgaaagccactggtggcctctaaataattcacactccatatgcaaaatgatccgcaatgtgctcatactagaaaatgaacagctctaaatgtaaaaaagctctgataatacaaactgaagcactcctacttcatggaatctggaactaactaaacataaaagctcgttaatatcgcgagaaatacaatctggcactggaatagataaaaaaaaaaacacaaaatgcccctctttgtggcaaacctgt

SEQ ID NO: 13346 - DNA, 1764 bp, Homo sapiens
  misc_feature (1)...(1764): n = A,T,C or G
atattattatatnnnatanttnntaanananatataaatnnnnttttttatttttantatattatnntattagtattgtaannnatntagttgtaatatnnaaggtannngananatannnaanatattttataatatcagtataatactctcttatagtatatcttattatttcacctatatcanatcgatgtgtgtntgnnnncgtttctntgnnagnnnattatatattgatgatacantgatttttatntgataataatataataatatatatantgatatacantatanaatnctttatatgtatatctattctatatatgatggtatcgcctgggcaggaagtcgatcgataatctcacacgacgctgacctccaatagtgttgtacgcaccgtggaccgcgtgtgagcaccgctagtacacgccagagcaggagcgtgcccgcgcgcgcgacgaacgcatcacaacgcacgcgtaggaatgtaagatcgctatcgtgcgcagctgcctcgtttcgtcgtcggaggtggtacgtagaggtgaaggcgctccacccgctcagcgcggtatggtacagaacacttccatcgtngtggangtagcgaggatattcgggcgcgatgtcaaggagtcgcgcgctgagttgtgcgatcactgtcaggaatactctactgtgtagcctactagacatctttcgntcgtttggatccgcctgaacgtggtagaggagtanacgtagaacatgcgcagtaggaacaggagtnatatatataatctagagtctgcgcggcagtcgtatatattatgagtagtcatctcgctacatgaaacacgacattggtatgctgacgcacatcgacgcggcggtnataagatgagagatgngtacagaggcagcgtatntnnatcgcacggaggtcgagagtgtagtcgccgcgcgtcgatgcgcgcgcgtgcntcgtgcgcgcgntnggtcagctgctgcgcagcgtgacgtaagactttgntcgcgttcactgctcgcgtanctcgncctcgtgtacactatgacagatcgtctcgatnaccgcgagcgctacgcaacgactcacccgntcgnanncgtntggtcacgcgatgagagagcatccgtcgtgtatcagtcgnttnatatctcatcgtntngtngtntgtagaggatctgcgcgtgatntcncnatctcgntnntgcgaccgcagtcgtgcntgcttactcgtgctatagagacntcgtgtacagctctaagcgctnantgctatngtgtagnatngtatatangactgcagatcgtgtcgcgacgcagtcacntcgcagctagcgcgctcacgagtgactcacanctnactaccacgatacgcgctgcgtatngctctctcttcgctgcgattgaggctgctncgtgtggacggcagtnatgcgacgtggcggagtcgtgacgcaacagatgcgcgtcatttctcgcgcgcgggctatgtgttctacactctcggcgcgcgcggagagaacgaggcatgtggatcacgtccagcgtttgttcgctcaaagctgtcgcgctcgcgtctagacgtatctcnccacgactttacatcattcgtcgaggacaaccgtggattgtgcgcggttaatcgtaccgcagaggtcagcgacctatgcacggaggtacagctaatcgtaggctatcnacgcctcacatgagtcgagacgcagcgctgtgatagtacgcgtattcgatcatctcgt

SEQ ID NO: 13347 - DNA, 483 bp, Homo sapiens
cctaggacgtactgtcctcatcagaattaggaagagacatcagaagcaggtctgcacagaggagaagccatgctgggatacaatgagagggcatctgtcagcaagccaaggagagaagcctcaggagaaaccacagctatcgacaccttgattttagacttccaacctccagaaatgtgagaaatacatttatgttgttttagccacccactctgtgataccgtgttatggcagccctagaagactaatatacaaataactagttgtgaaactgaaaacttctgaaaaaatctttacaaaacatcaaatattattaaccttgattgtaaaaagactgaattttctttctactatctttatagagaaagataatacaaaatatttgtaatatgaatacgaagtgaaaaaatgtaagaaaaaagtattatagagatgtattaggtagctgattaaaaatgttatttttctagaaaaaaaaaaaaa

SEQ ID NO: 13348 - DNA, 429 bp, Homo sapiens
ctccgggtatactgggagaagaattatgctctctactaatgaatgaacaaatgagctgcgggaagactgtgtatgacagatgcgtgcctttcctttcatcccttttcaccttattctgataagccacaaatgcagaactgaattcagaggatctactggatgacacttgtttcgttattggtgacaatggacccagcactgccaaactctgtacagagatgcgtggattggtctctgtcctgaaaaacctgcagccaacctgagtggacaggactaacatgctgaaacaagtagaggatgacagagatgctacagacttgactactgcactgcataggtcagcagttgcattagtctgttctcacactgctaataaagacatacttgagactgggaaaaaaaaagaaaataatggcctcgttggcctca

SEQ ID NO: 13349 - DNA, 849 bp, Homo sapiens
cgtcttgggcggccgtccgtcggctgtttctcggtctgcttcgttggcttttcggtcgccactttttcccgctcctcgttccccgttcttctttttcctgttccccgtctcccctgttcgtcccttcctcgctttaggggctttttcgcggggcgtctcgtccgccctgggttgtttggcccgcccgttgcgctttgtcctgcggcggttccttgcgtggggtcggggcctgtcggccttgggtgtcgccttgtctgctttggtggttttgcttggtttccgggcgtttttgcggtgtgcctcggccgctctcgcgtttctctcggtgggattcgtcgggcgtttgtctgctccgtcgtccttcctcctggctgcgcctcgtggtggcgggtgctcttctctctgccgtttcgctcccttctcctcggtgcctggtggccttgccgcgcggttcgttggcgctccggctctcctgctggggggcctcccggcccctttcccggctgctctcttcgctttgtcgtttgcttctccccgttggtcgcttttcaggcctggtgggcctcttctgtgcggctccctctctccctgtgctgaccttgtgctgtgggttctcttcttgctcctctcctcgcccgcctcattttcctcttccgtggtctcgccgtcgtgtcggggtcgtccggtcggttcgcttcgtccgcgcccgttctcttgtctttctgagatctgtctctcctgctcgtcttcgcgcttgttctctggttttgcccccttcaacctttcttgcttgttcccctctaagctgtctttcttctcttttcttttctgcttgttcccttccttctc

SEQ ID NO: 13350 - DNA, 702 bp, Homo sapiens
ccttagtgggcactacgcgtcccacgagcgggcttttcacaaccactcatctctccgttggttgaggactttattggggtgaggatacaaaggtcttctcgctgccttttcttctctgttcgtttagctttatttggaaccgtttcaagcgccggaggttcgttccatcttcaggggtattaatatgcccattgggaagcattgctaatgacagtatcagaagctttgctaagatcttgtttacaagggttgtccaaaggacttgttgagtgctcccctatggcaaggccagaccagggtacttgtggatttcccaggaaacagaggagttcaatggtagatatgtggagtcccaggtgtctctgtttggatacccgtcgcctggagtcactagagaaaggtggccatctaagtgctgagtgtgaatgaaatcacctaggaagagacacaggctatgcaagaaattctgttgtgacattttaggggtggacattgtagccaataaactcaagaaggaggaagccccaagaggtagaaaggagaaccagaaccgtatcccaggaaaccaaaggattaaaaaaaaaagtcaagataatgcccaattcttctagagggcaaatacaataaaaagcgcgattatatttgtggtttatatttagtcgaactctaccaacaatggtgtttcaatggaataataagggt

SEQ ID NO: 13351 - DNA, 830 bp, Homo sapiens
gatgggtgatcttgccgcctccagttcgttggaagggaagggttcaggttcccctctatgggtatatctcagtcatttagcatctgctctatctttgaggctgagtttccagaagacctgattcaaccagaagcaaaagacagtagccaagaagatggcatagcataagaatcttggaaattgataaaaacatcccagagatatccaacaaaattagtaactatgtgaagagattctgtaatattgggtctattgggctctgtgggaaggtattctctttggaaatgactgaaatggaaattttgaaccactttcaatgatacaagtttggggttaacatggagatggtgcttcacagaagacaccacatttcaataatcgtattcttatcgaattgtttaaaattggtcagtgactaatattaagcctctaagaacaaaattcattaagtttatttagcctgtttttgcattactgctaaaaatccaataggtcaaatagctcactgaatactttcagatgttaaagagcacaattccctgaagattttacatccaagagagctacccctgagaaaaaccaatgcgcatttggggtaaagccccatgaatttgttgacctggcaaggccttctgaccctcgctgctgaagaccttctaatggggacttccttttcagcttcttatttccactactcaagatggagggattatcacatgtctgaccacaattcggtctttcgttccccactcctccggcctcaatgacgactcttatcttcaccggggaggggtttgtgttcgtgaaaaacaaggggggtggaagggggg

SEQ ID NO: 13352 - DNA, 767 bp, Homo sapiens
  misc_feature (1)...(767): n = A,T,C or G
ctactctanaactagaaaatgatctgtttttagtcgtggcatttaccctgcaggtggaagcttctcaacacctcccaacagcacactcaccagaagccagccctctcctgtgcagctatagaagtagaggaaattcatcccaaaagccatagagaaaatggaggaataattttactctcaataactttatcttgcttacctaacaacatgtaatacttgagaattaccatgtttttgtgtacaattctcattgaccaaaattatttctattcattctgaaaacagtataccataaatcaaatatctgatatggctcctactttttcttaggcaagggagttcatcacaaactatcctctaaggaaatctcccgtagtcagctccctgctccattttgctcttctcgcaaggggtcattgtaagtcctcaataaatattggttgattgaacgactgagcagaactttaagacttaacctgttttggagaacagaaaataattcagaatggctgcaccacagagtgtgagaggggaaatggaaagaaatgaagctgaagagcagaccctgaagtgctttatcatgtcaatgttttttctttgctttatcctgaatgaaggggatagtacaaaaggaaagagtcaccttgangtttttggataattcccagtatctcccatgttaaactctaccattctgttatgaaatgttatttgtccttaagcaaagatttaatagaagctcattttaaaaaacgtaaaattcagaa

SEQ ID NO: 13353 - DNA, 1601 bp, Homo sapiens
  misc_feature (1)...(1601): n = A,T,C or G
aacaagacagagagagggacactacaatagtcgctagacataattcgcgtagcagtgaantgaacacacagagagtgnganancccatataaaatacaacaacacaaacctacantcatatgatatcaactatatgcatataacagatagtaggcacgaaacacacaataacaaagacagtcagtgatgaactagcacacacgataacgacataactcgagtaaataagaaaaacaagcggaaacaacaggagcagacaagaaaaacaaacgtggagaggaagaaacaacaaggaacgcgaaaataagtcaaacaaataaaatcgacaaaatgagataacgagaaggatgaaattatgtgaaatcaaagaataagaaagaagcgaaaacaaataagacgaaagagaaaacgggcggcaaaaaaatttacaataatctaagtggatccatgaatgcaataaacaaataatgagcgatggaataaaaacaaatgtgaaaagataaagggagaatgaaaaaacagaagtcaaatacnggaaaacaggcagagtactcacaacaagaggtacaatatattaggagtagagaatgttaacaaagggaacggtgaagacaagattaaactcaatataaacgatgacgcacaataaataagcaaacgagcatatcanagaacatagatggtgagagcgacgcaacaattacagagagacatatagttacnagtagaacgatataataagacaatcaaaatacaactcagcaggagtatgcatatagagataaacacaaaagagaatgacgcgtgatatgagtcgaataacgacaaatcacagcatatgatggtagtgagctgcatataaccctgtgncngctcgggtaccttctctcctgctgttcgttcntctgtgcgtcgtctctcgcctctgcgctccnctctctcncgcgctcgcgcttcttgtctgtgtcgtaacagattcgtgcgcctgttgtgnttgngtgcggcgtcgtcctcgtcggctcgcttgggcgtcncgtnccgcgtncntcncgtcctgtcgtttgcgtgtgctgttctcggttgtncgtgttgcggctcggntcgctgcgtgtgtgtgcgtgtcctcgcgctgctcctcgcnctgnctcaatncttcnctgttctggttcgccnctngttctgctgnnnnnntgcgtcctgtgtgctctcgctgtcgctctctggctcgccgctgcgntgtcgtcngcgtcgcttcttcgtgtcgccgcgcgcgcgctngctgtctgcggctgctngtctgccgcctgcgcgngcgtcttgtctccttgngcgtcgcgcgctcnctngtgntgaaaaaacnccgtcgcttctctccgtcnctctgtcttgcntcgctgncctcgctccngtccgtngtcctcgtcgggtctctgtccgctcgctgctccgtgcagagaaccgcgtgtgccntntncctnggtccctctgcngcctctcncaggcgctcactctnttctcacactcacactccatnctcacactatagaatatacatatctaacacacgcagcagatgtagaaatagagaaacgaaaaaataa

SEQ ID NO: 13354 - DNA, 744 bp, Homo sapiens
acaccggggaaaaccagaattttttggccaaaaggctcctccaaaacttttttatgacacataagattttccccccttgggcgagcccattttaatttttaacagctctagaaaacgtccccgggaacaaacaaacccatggtggaggtaataacctcccctaaaggggcaagaaacattgcctttaggggtggggcaaaaaacccctaagaacctgttttaaatcccccgggcggttttctcttttgaaaaataaaccctggagaaccttttcgtttccttccgccgaaaggggaacaaatccagcccttaagaattcccccgtgggcaccagttatgcaaggttcaccaaaggaagttttcaaaatggggggcccccctagcccgaaatcaaaaaagattgaaggtacccttttcatttcaggggccccttaaaacagggcacccccccccaattaatgtgaattgaaacttgccttgcttttcaacttaattggctccttcctaaatgtgaacccctgcccaaaaaaggggaaaaaaatgtgggggacaaaaatgtggagcctgttttcaaaaaatttacagttagtttcaggggccattgttttttttttgctgttaattagggggatcccccagcccataaaaacatgaatggaaaagtaaaaaaaaaaaaaaaaaaaaaaaaaaaaaaaaaaaaaaaaaaaaaaaaaaaaaaaaaaaaagaaaaaaaaaaaaaaaaaa

SEQ ID NO: 13355 - DNA, 961 bp, Homo sapiens
cagaatcgggcgggttgttgcggtgttttagcttctgttgcacccatctcgtcgacggtgcatttgtctaatcgatacatacttaaccttcctggtctatggtgttctattgtctcgccgggtgttgcgacctgaacgcaagaaacggcgaaataaacacggaatgtcgtggctacacccattggggggcataataacgtacgtcaacaccgatctgccgtcgcacagggatcgtcagtgatcctatactgtatgctgttatgtgggatactgtctgcgcaagcgatcgggcgtatacctagataatacgaggggacgttacgaactcccacttcgggagggttatacccggacatctacgggttgataaaatcggtcggcatcgctcggaacttggaataacgtcgttgtaaccgaagggacatgtataagataacgagccgcactgttttgggggtcgattggtgggcggcggttcccgtacgcccgcttccaaccgatctaatagggggggcgggcatcgtagggacagggggcaatcgcttcttggcgtcggaaatctgcggtgtcattgtggttcgtcctgttcccatagccgcgttcagacgagctcgtaacagatggggggggtgtgtggcgcttcgtcgggtcaaatattaactacgtcgttggtcgcgcgtgaccgtcttgtaaatgcttgacaaatcaaaccacgtcaaaccgtacggtgtcgttttgcttgtgttcttgacacgcctacgtaaccccttgacactcgccgattctggaccatacacgacctgcgtcgtgacgacgcttatacttagtcttcatggtttttatattccaaaacacgcgcgtcagcttttctacccctaaaaccccttcgttgtgttctcctctgacttctttctttactttcttttcttcaggctagtattatatccactttatatactat

SEQ ID NO: 13356 - DNA, 744 bp, Homo sapiens
aagcccaatgtgtatttctgcaaattggtacaagccgaatttttccatcacttccttcatggaaaagtggcccttaaaaggatttggagcatttttagcagaaccaaacaataggggcacctagtagtccactttgtccagccagagtccaggtttcttcagaaaacagatgaggctcctttcgcaggggctctgagaaaaactggagctgatctcaagaagccccacatcttcctaaggggccccatggcctgtatggaggcagggtaggtcctggggcactgtgggccgcctgcctgctgatgtgggctctaggccagcttgttgtcacgtacgtggtgtgaaataaagcccaagcactgggtgcccgtttcctgtgtttcgaattatgccaattcaaaacagaactatttaaaaatattggccaggcacggtggctcacacctgtaatcccagcactttgggaggccgaggcgggtggatcacttgagatcaggagttcaagatcagtttggacaacatggcaaaaccctgtctctacaaaaaattagatgggtgtggtggcacgcacctgtaatcccagctgctttggaggctgaggcatgcgccgcttgaacccaggaggcggaggttgcagtgatccaagatcgcaccagtgcactccagcctggaagttcaaacgagactttgtatcaaaaaataataataattaataaagtttttctggaaaaaaaaaaaaaaaaa

SEQ ID NO: 13357 - DNA, 804 bp, Homo sapiens
ttcaggaatttgttcatcgtctactgggcctgttatgtcattttcagttttgcctctgctctctgcctggaatgttccataattgcttttcaggttcagcattcctggtggaagcaatctgggcctggttaaaggaagtggctgttccaaaagtagaagggcagacaaagccaaatctgggtgagagatgaagaaggaactccagagcaagccacaaatgactttagcttcaaatagaatcaaaagccaattaaagaatcatgctacatttataaagtatataggttccatgattctgttgattgtgtacttttctcattccatagtgtagattcagacctttacaattcttttactgtgtttataaaatctcagaagtttttttctaatcccaagtaatattattggtttagtgttgctaccttcaacagtttctcttaggtagatctagacaatttgctgcagcttctatatcaacacttgctggtttaccttgcacttttatgttatagaaaaggggttcttttcttttaaccctcatgaaccaaaactctggttacctttaaaacttttctttttgcagcttcctgattggagcccttcaccaattaaagaagagttaagagcttttgctctagattagggcttgggcttaaagaaaaacagggggttggttaattcccttttggcctaaaactttctccatataagcatggagcttggcttgttttttttgagcaccctgtccctggaagaaccatttttaatcccttcaaacttttttctttggcttcacaacctggg

SEQ ID NO: 13358 - DNA, 738 bp, Homo sapiens
  misc_feature (1)...(738): n = A,T,C or G
cctaataggcgccaggaaacacctcgctgggctggttattaagcgggtgagacacaggactgcaggatgattgcgttggagtgggatgagagggcaggcagagaggaacctacaggggctaagcccagctcagtatggccncagctaggagaggaaggctgactctcaatccctaaggataagataccacaaagtgagcagcaatcaaactggagctacaaactgaaggctcagacctgggatgcctcccttggggagagatttttttttccctggcccattctttttctcttttgagtcagcaaagaactccttcttcctcttctacggcatggatttgactctgggaggcggctgcccagccgaggaccacgttacccagagccccttgcatccagatacggccactgagttgttcttgctgatggactgtaagtggaaggcacctgtgtctcttctggcccgaggtgattaagaagcaggtgtgctttctccgtcttctctcttctcctttctgctggcttgaagtcaacatccagggtgatctgggaagtcacatttggaaaaccgcagagcctctattagcctgggtccctgagtgcctgtgcggagcagagatcccccaccccaccctgacacacatgcatacttaccattcagacctgaccaaccttaaagtgtcaatacgtgcaagaaataaacatatactgtggctgagccattaaaaaaaaaaaaaaa

SEQ ID NO: 13359 - DNA, 989 bp, Homo sapiens
cgaatcctcctcttaatcactaaaaaaaacaacggggtttcaggcacactgcaaaggggttactggagaatacttaatgaaggaattggatgtaagaacatgagcagagtaaaggaaaaccaacaaaagaaagaaatacttcccttggtccccaccacataggcactgacagaataaataaattgggactatcgcaaactcacgaagcttagtgcataggcaaatggagccaatacaacagagttcaaaagacaaccgtaccgaacacggacggaaatgatttgcatgctatgtgatacggacaggcggatgaatataccaggattatacaaatgaacgtcagacgatgttttacaggcaaaataacaaaccaaccaacgcataacaggaaagtcacaagccctccaaacaaatcacaattttaaacagatgggcccaaatggatgctgacactcgataagttcctcaaaaagaacgacatgacattaaggccactgaagatggcactgtaaataatgtcgcagtactcacctcatgaatgtatgggacagcagacataatcgaacagcagaacgatcgagcgtaactattctccacccccattccagtgagggggaactaatagagcaactatacattaaagtcaacgacaatcggagcataggcgccctctaatgccaaggttgactgaatgaacgtatataaccctagaatagagattgttggaacacaaaaaagtactcgagggctagaacagaacccctcgactaactccttacacgagagcactagtgccggggtgatcaagcgtataagattttgggatttgatagaataccgaatgcatcccaacacgacaatcaaccaaacgatcgtaaacacatccgaacatcgaaaaaagcagaccactgctatgccctctcggtgtgaaacaaagagaaccaacagagtccctccggacggagaaacacgaaagagactttaataaa

SEQ ID NO: 13360 - DNA, 602 bp, Homo sapiens
aaatgcagggaagaaacataccctgggcctgctgcctacggacataaggcacagatctgaatttgtatacacaaacatcttcatcctctgaagaggacaaaaataccaacattcttgtattttccaacatttttcaaaataaggtaccaaaggcttaagaaactgaagaaagctgaaagaatccatgtcagaactcaatgatcgctattatttcaaggacccagagtggaaagaagagccaatgcatgaagaaccagacgccagacaggctagtggtcctacccaaagacacagctctctactggcaaggggagaacaagtgtcttttaatttctgggcctctgaagtgccattatcaataggcactaatcttttataggtagtagtaatgaatactttaaagggattaggccattcacaaaagaatcaaacaactgtaattattttttaaaatcctcactcatttatcgtcctctaaactcccaaatacaatactttaaatccactggggcttcacatgtacctagttgatacaaagttcccaatctaagcttgcaacctcatcaaaatacattattatagtaccaaaaaaaaaaaaaaaa

SEQ ID NO: 13361 - DNA, 601 bp, Homo sapiens
taggtgtatgcttggggtgacatcgaccacggccagcagggcaatggcacgaccacggttaacaggaagcccacactcgtgcaaggcttagaaggccagaagatcatgtgtgtggcttgcgggtcatcccacagtgtggcgtggacaactgtggatgtggccacgccctctgtccacgagcccgtcctcttccagactgcaagagaccctttaggtgcttcctatttaggtaacacagatttgtatcctgagatttttctgtaggttacagcaactttacatttatttaattgtgccaacacattagaggttgtagtgctgcgttaactacattatgaatctaaagacacagaagaattatggtgtgcgctcatgcgatttatacatgctggaatgaaagttttagaagaaagtatgttgctgattcttgtgtttatgatcaggtaaattcacggcgctgtacttgtgtgtaaacaggactcctaataactgcctgagagatacaggcactgtactgggctcttttgtattttttaacagctttattcagttataattgacatataataaactgcacctatttaaagtaaaaaaaaaaaaa

SEQ ID NO: 13362 - DNA, 1321 bp, Homo sapiens
  misc_feature (1)...(1321): n = A,T,C or G
cattcctctcgtcgcgacggctcgtgcgtccgtctctgccgttgctatcgctgccctccgccgctctctttcgcgcgtcgtcgagtgcctgtttgtttgcgtgcgtcgtgagcgctgctgcgctcgtgcgtcgacgtgcgtcctctctggctctccctcgctcctgccctcgtgcgccggcgcnttgccgcctctgctcgcgccgcgcttcgcctgtacgggggcccactgcgcatctcccgctgcccttgtgtcgttggggctcanttcttcgtgcgcgcgggcggcgctgggttcatctggggcagcgcgcgctgtatcgttgtgtgttgatcgcgcatctcgttgctgattcgcgtttgcgcgtgcgcgcgcgtgtctcctcgcatactgctcgcgcggcggttctctcgtggtggtggcggtcttggcggtctgtgtggtgtcgctatccgttgtctgtggctctgtgtgtcgatgcgcggtccgccggctcgcctcgcgcgcgcctcgtcgcgcgtcggggtcctgccccacggcggcgctggtcggcgcgcgcggcgcttcctctccgtccgcgtgaccgtgggcgctcgcgctcgtgtctcctcctcggggcgagtgcttccaggtgcgtcttgggtctctctcgctctggcgtccctcgcttccctggcccgtctcgtgcgcgccgtccgtgcgcttgtcgcgcgtgacggccttgtcgggcggcgtggggggtccggggtgtttctcgggtggtgcgtctcgcgtctccttctcggggctgtgggcgtggcgtctgtctctggctctcgtggcgcgtnttggtgcttctgtctgcgcggccgcggcatacccctgccgcggtccccgtggtcgggccctcctcccgccgccgccgtcctccccgtctcgccgttgcctctggtcggcctacggtctggcggtgtggggtggggtgccgcctccgggtcggctcctccccctgcctctcgctgtccttctttttgtgcgctcgtttgggcgttctgggggctgcaccgtcccccccgtcggctttttgtctgcgtgcctccggcgcgcggttctgcctgccgtccctcgtgttcccgggcgggctgctctcttcttttttttggcgcgggggggtcttctgttccctcccctggaagtgcttcccgcccccggctcgcgggtttgccccgcgggggttccgctccccctgtcacgcgcttctttctttgtttttctcctccaaacgtcgtctgttgtactgtcccgtttctgccctctcttcccccctcccccgcccgcctct

SEQ ID NO: 13363 - DNA, 753 bp, Homo sapiens
aatttaaactctttccttcaagggtagaatacatttcccttttcttaagtgtgggtaaacttaatgactcatttgtaaaaaataaattgaagtatgcatagaggtgtcacttttaatgctaggtcataaaagacgttttgttttctgccctgttctgtctctctctttgatcattcaggctgggggatgccagctgccatattgtgaagaccctcaagcatccctgtggagaggtccccatggcacagaaatggactctcagcccaaaagccaacaaagaaccaaggcctcaagccagcagccatgggaatgggaatgtgccatcttggaagccaatcctgcagccccagtcaagccttcagatgacagtagccccagccaatatcttcaccggatcttactgagagactatgtgccagcatgaccctactaaacaactctcaaatttctgaccctcagaaattgtgtgagataataattgttttttgttttaatatgctaagctttaggtttgtttgttactccaaattagacaactaattcagaatgcaatatatacactcagccaggtcaactcctctgcttcttgatgcctggggagagtggagagagtgatggatccccattattattgcacccagggtacactggtctgggtttagaatgtcttgtgctttttcaaccttctgttcccacatttctcagtagtatgtatattaaactctcttcagtaacccaaaaaaaaaaaaaaaa

SEQ ID NO: 13364 - DNA, 927 bp, Homo sapiens
gttttttcgttgtgttaacctcgctaggctctaagtgtattcggcgttaccatctcgcccagctggagtgcaaccgcgtgaaatcagcttaccgacccccacctcccaagctcagatgattctcccaccttggcctgtcaagcaactgcgattacaggaagtcagggaccttgaatggagggactgcctgacgccatggcacaagaacataaattgtgaagatttcatgggccatttattagttccctcaaattaatactttcataattcctttatgcctgtctttactagcgatctctgaacgcaacactgtgaacattatcgtggacatttatcacttgcccaattattacttgtagtggcttacctatgcctaggcctaactccctaaaccccatccatctttgtatattgaagattgtatgtaactctcaagaacctgttgatgatcgtgtcaacttgcgcaaatttggtatgtaaaccatgccccctctacacccacttccttcccggctcttacaacaatcagcaagatcacctcgttctttttacggtaatagaggtaaatctttacaaggcgtataattgacctgttgcgagcaagcgaagaacaaaactaataatgtctcttctattcaaaagtcatatatagagatcagaaaccactgaagtgcgtagccccagcgaagagatctgccctcgggtaatttcaacatccttctccaatttgtgagctcttctttatcatggtctgcgttagaaatatgtactgctatgagctcaagaccaagaataagggtatgacgatccagccctgggtcctcttatcatcagcgctcctagtctagctccagatctatatcatcactaactataatttaattgtctaatattcactgtgtagtcctatatatgattatatattgt

SEQ ID NO: 13365 - DNA, 1556 bp, Homo sapiens
  misc_feature (1)...(1556): n = A,T,C or G
cacactcacgcgcgtcgagtacgtgcgngttgcgggttggcagtacatctcctcgtctgtcgcgtgctgctgcttggtcggtgtgtcgcgtctctcgtttctcctcctgcgtgtacttgtgtcgtctntgtccgctggatgtttcttgtattgttgcatctctacntgtttgtgtggngtgtggtggcgcacttattctcacggtcctcgatatctcggtcggcacgagcgtnacacatggcggcattgacttgtggggcgcgcggaccgcatcctggcgctggcgcgccgtggctcactgtggtccgcgttcattgtgtcgtagcgtgagctgtggctatgcgtaggtgaaatggtgatcggcggtgccngcgtgtgtattccgatatccgttgtggggccggatccgtcatactattggtggttcgtgggtgctcgcggggccgctacacatgtntgagatactgcagcgatgggggtccgattgtcccgtcgccgcggatagtgggcggctgggctacgtgtcgctgggcgtaggttcggcgggcgtcgatntcttagcccggatatcggggtaatgcgcgtggcgcgacgaggtgcgttatacgcatgaggtgcgcgttgggcttgatcgcgtaccggggctccggatgctgatctcgcgtcggtcctgcgcgggcggcacactgacttctgtcntggcggtcggcgtctgctcatgtcggtgcgcgggcgtgtggtgcgtatacgcggcgctagtcttggcatggtgcggtaggtcttctggcgncttctatattcgcgtcgcgtggtgcggtcgtgttctcgattctgcgtccgggtctccgtgatccggggctcctgatcgtgtgtgtgcgcgtttctttcggccgttgtctctggtcgcgtcctcctctttcctctcttttcgcgttctccgctcggtcgctccgccggggctgatataccgtggggttgggaggtgcgctgacggtaacacgttctgtgtcgtctgaaggcatgctatcaacgtgcgctgtgccggtatcgcggctgcttcgtgtctctggcacactcnctcgcgttcgcatctgcactnctgctctcgccgcatgacaacactcgttctttgtgtgngttggncactactgcgtgctgtgtgtgtacttcctctgtacatgcagcggatccgctctacgcgctcggtgtcgacatcgcgcttgtcgntacncatggcgcgtggtgcctgtagtctgtctcgcgtcgcgtgcgtggtcgatgctgttnngtcggttnttngcgttgtngtggagcgtgtgtcgcgggggtgtgtgcctgccgcctggtgtcttcttcgtctcgtcctgtnttgcgtcgtcggctgtctgtgtctgtctgccgttctntaaaaactgnctcttgtctcttctctctggttgttcctccctcgctctcacgccggtcgctgtgtctgtcntttcttctctattgtgtcgatctttggtcctcgtgctcttatttctgcgcttgctcctggtctctccgtcccctgcgac

SEQ ID NO: 13366 - DNA, 737 bp, Homo sapiens
tttctccccaggggggaggagggtttttgggttttgtgggaaacggggtaggagggtggggcgttttcgttatgcgggggtcctggttttttttgttcgagagatttgggggggcgtctccccggggggggaagttgtgtaaaaggggcgggagaaacgggggggggttttttttcggcggggttaaagagggggggatccccccggggggcggtggggttatggggccctgggccccctttgtaaaaccccccaaaaggttttttgggggccccgggggtgataacccggggggggaccccgggttttttttgggccaaaggggccccccccaaacggtttttggggccccatttgtttttccccccctttaccaaccggggttttttttgtcccggtcttggggaggggtccggggggggaaaaagcccgggggggggggaaagccccccccttggggggggggggggaaaaaagggtcccggggttggggggccccttggttgggggagggggctcccccccaaaggggggggggtttttagccccgggtttccccttgggggtgggggggttttcccccctccccaaaaaaaaaacccccttttctttttcaaaaaaaaaaaaaaaaaaaaacccaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaa

SEQ ID NO: 13367 - DNA, 866 bp, Homo sapiens
  misc_feature (1)...(866): n = A,T,C or G
taaatatataacatatgctgaaaaaaaaggaantttgcaaaaaataaaagcatngtggagggagaagtggcgaaaggttgctctggaagaacgaaagaccagcggcttcaagcaaaaagtaaatttataatgggagatatctttttgtgtaagaaagtggaatcaccaaagaagaatttgagagaatccaaacaaagggaggaggatgatgaatatccagatctgatctatgttggggtggagcatgtacataaagatgctgaagttctctttgacgggattatttcaaattcaacaccattcgtttcaaacattaagaacagagtcaccccaggctcaaagtcaagaaagaagaaaggccacttacgtcaatatcctgctcacgtgtcacagcctgcaaataatgtgacctctatggcagaagccatcatgcccgcctctctgactgaggggcgaccgacagatacccctgcactatgaagtgtggatcttgacctggtcataatatgagctcaccacaagtttgtttctcccaaatactccatagccgcttccccaagcgattcagtgtttattcggcaactatggtcattcgcaggcacgctgaacccgaataccttttcccgatccagctcaactattccgcaccttaatgtagacctgacgagatttcaaaaagggttaacactcccgtgatggaatccacagggagaactctctctaatctgatacgccccttattcgtacgtgcttatacaaaatatttccagacactcttacagagggcggtaatttctgcacatcaaactataattgtatacatgtacgcagcacagatcatttgcatcgacgtcgtatgtaatggt

SEQ ID NO: 13368 - DNA, 1726 bp, Homo sapiens
  misc_feature (1)...(1726): n = A,T,C or G
ttttttttttttttntannnntnnttnttnanntanataaatattatataattattagtatatgttgatatgtgttaagatgnagtatgatatgtgtggatgtgataaattttattggtatatgtgattntnatataatgtntataattaatgcttatttatattantntattaatttttatatattcatatattatatatatactnacaatatatattataattnannatttatannanttatattaatanatnnataantatantanataattattnattataaatattagnntcgaaagtagattagtatagantnaggattattgacaaataatattctcgatantatattctagtcatatatcatagatacatanagcagtatagaagtcaagtgttagcttgacgancgttgcagatgtatctntcagtctgatgtgtatcntngtatcatccaagaatatatattntntaatacacatganantaantgtactcaacgatagtnatatgtatgananngattattagtatacgtaggagtgngtanatagtangaccgcgcgagtgtgtgatgcttgtcgacatgtcgcagtgctgggtgcgtcacggncngcggtccttcnacacatagtctagttgaacagcgtcgcgctatgacacactccaacactatcncttggagtttagctcgcgatcggtcgagtgtgctgcgatctggcgcgtacgtagaactcgacgtngacgtcggagagcatctatgtcggncgagnacgggagacggagtgcgtcgntntacgctctgtgtgcgccgtcgtgagtcttattgtgtgtgtatgtctgtacgtgtgcctactgcgtaggtgtgtcgtntctcactgagtcacgtagcaccttctctcccnttctatgtcgagtcantcacactactcgtggtcgtactantcgctnattcgcatntgtgctgtgtctctctcgtcantactaattcacacgtaatcgaccgtatcaatagtantgcttgaggcgtactcgcgccccnagaatgtgtatgtatgtgtatagctgtgagtcagtggctgtncacgctacgtgcgacagcgacagacgtcaggaccgtctgagagtcatgtcgctacagagtcgtgcgatagagagaggcccgctgaaggtcgcgactatgacgtgtggcttgtcatggtcagagtaccacgatgatggccgcgctcgtggttatctcgtgctgctcgattgtagtcgtcgctgcgcgcactagacacgcactcgactctcangtcgtgctcatgtcgttggggagtaatatcagtaccntacctgcagagtgcgcggncgtctntgtcttnctgttgcaggatgagtgcgctagtggtcaatggaacaattagtacgaataagaggtattagatgtcattngcacggcacagtgancgncgatacgcatgagatccganacgacacaacacgatgccgtgttacaagaggtgctcatcncacatcatgcacgtccngactgcantgactcgtgcncggccgctaacgacangccacggtgcagctgtagcgncgcgacgtatcctgactacgtcattnctgtagtacataggctaacctgcacgagtcatagtantacgncncaccagcaggtctcgtgagcgagacgtgagagatagagcgcacatgactgtgctgttctagctcggag

SEQ ID NO: 13369 - DNA, 226 bp, Homo sapiens
gaagccttattctctggactaagcaatcctttgacctcaaccttaacagaatccatcttgcaagagaaatggtaacttgagtcaaagctcaaagtcttatgctggtcttacgtggaattctaccctatatgctttatagaatggaattctctccttttttacttcattatatgataattagaacattttatatgactaagtatacatctatggaaaaaaaaaaaaa

SEQ ID NO: 13370 - DNA, 1909 bp, Homo sapiens
  misc_feature (1)...(1909): n = A,T,C or G
cgatcgctcacagtgcttgacgnctgcgctccngtctntgactttgctctctcgantnatgctnctgcactcgatctgtctacggcgntcgcgctacggttcntntggcngtgcagcagtcctgcgatccgngtagctcagtcgtcttnntgtgcatatctgtcgcggcaccacgggacgntgcntatgtgacgancantgtgctgctcgtgcactcnttcccnttcncgctcgcttganngnccggggcggcgtgtgtctcagtcancgtgatcagcttgggnatgtcgcgacatatatgtgccgngcntcaatgtgntgctaccgcacggntcactatntcgcggagngtgtgcgcatgatatcatactgcacgtgtgtgcgttcgcgatntnttactacacttagttgtcacgcgcgcacgattatctcgggtctcattgcggcactgcgtgggtatccacatcggatacatacngcgctcgtcgcgctncatcgtcgtgtgtattgtgaagctcgcattgtgtctctctgtgcgcgcgccggtcantactacgatgatactcgcgtgcgctagtggccgtgactatgcgctgcgtcgctctnaatactctntattgtacanaatgtgnatggagttgngcggtatntgcacgncgttcgcatatgtatgcgccgcaatatgtgtgcgatgtgtaggatatatgntctcgcnatgcgcgctctctgtgatcgcgcgcgncgtgtgcgtantagtgatgatcgaacaggatgangtcaggaggggtatgactgcggttgctgcctgtgcgtantatgtgtcgtgctggtaagatatgtattagctgatagtgctgcntgtgctgtatcgtctgctcgnccatctgcgcgtacntatatgtgtcgcatctatngtanctatactcggctcnggcagtcgcgtcgctatgtgtctatctctgtctcgccgtncttcctgttcccacttgtntcnccngcgctctgncgtgtgcnttatctcgctgtcgcgtacggcgtcgcgtgtangtcgcgggtcgcgtcggcgctcgtcgcttcgtacggggagntgcggtgggcgcgggcgcattcggacctgacgggcgtctgcgcgcgatgtgccgcgcntctccgcgcatctccgcactgcgcgtgttgttgtcgactaccttaacgcgtaggtgagtnaggactatcggggatgggcgctgctcgagattcgcgcgctgcgttcgctctcctgctcgtgtgtcgtctgacacccattctgtctttgcttgcgcgtgccttctgatacatgtgtgctgtgtcggcgtcggtgcgtggtagctcgctctcatgtgtctcgtcgctcgtcctcatcgtgcaattctatctgcatntgttgtcttctgtatgtgtgagatcgcatcgtctgtctcgcggtctatccatgtcgcgncttccacntctctcaccactctcctcgcacacacaacatgatgcantgtgtnccgcgcncgtgcgcattggttgtctacgcgtctatgtcgcgcgctccgttatttcggccgcgtgtcgcacgcgcgactggctcgtgacatcttatgctctgtgctgtagccgatgctgactccgagtatactctctcggactctatctnctatgcggatcgctcatctgnctccatgtgtcgtccgttccctgtcggcgctctnttctgtctctcgtntctgctctctcggtgtttttcttcgtcgccccgtccgtaaaaatatccgtntgctcntcttgtgggtttttctccctcctgctgcagccgctcatatctgccgcttatattgctgtgtgntgtatggctctgtcgatgcgtccagtccgcctgatgcctcgggtgctattgcataccctc

SEQ ID NO: 13371 - DNA, 691 bp, Homo sapiens
aaaatcccccacaaatgtctccacggccccttggggatgcccacgcggtggatatcccctgcatttttcgggcctaaggggcctcctgccgaccttggttagggccacctgtcgggttcccccccttatcgggcccgtgtttattttccccagcccaggcgggcgtttcccggggcggccaagaccagggcccagctaagacgcctccctttagggcgccagtagtgttttaggcacccctggtatggcccccaccttagtggccccccggggagcgataggccaaggaaagtgggggtaaattccccacgggaaaccaatcacccctttattaaaaaaaaatttcgtccattgccccgccggggcgagtccacaggggcttttggccatcttttattggccttatgcccgcaattcttcttctccttataaccattgccatagaaagccaagggcgggtagcgggcccccatatggggaatcaactgttttttttagttgttttttatcttaacttgttttttaataattttaataaaaaaaagggtttcccaaatgttaactaatggttttttttcccaatattttttggtttttgtaaatgtagttatttttcttaaaacttgtttcttctattaatgggccatggggcttctattttttatccctaaaccttttaaaataacaagtt

SEQ ID NO: 13372 - DNA, 515 bp, Homo sapiens
ggctgattgagaatccactatccaagaagcatcagtccacatagaaggggaccaaaatgtattcagaatttttcagaagacacgtggttaggtgaaaaatgtatcaagacagaagaacagaggcctgagaaaatctgaagaaatgaaaagaactcaatcaaacatgaatccaagaagctctgaggattgtgtgagattaattccaggaaggtgaacagcaaaatctaaaatgtctctactctcaaagaattcatgttccaccaatgtaatgaatctttaagatggccatcatttggattcagccttaagatgaagaactatcatgcatccaaaaaaggtgtttttttcattaatctcacaacagaacatcaaacaaagcaattcaaatggatcagctccaatccatctggagtggtcagactgtgggaaggatttccaatcacacagtgaagaccataaataaaagctatatcaaaagaaaaataaactatgattataaggaataaacaataaaa

SEQ ID NO: 13373 - DNA, 1746 bp, Homo sapiens
  misc_feature (1)...(1746): n = A,T,C or G
cgccantctggctgtcttgtctcctgttctctgtctgtcgttctcttctccgcgccctgcgtgctctcggcagcgctgtcgtgtgctgcgcctgctcgacgtgtgatctcagctcnctgtgtgtcgtgcgtggcgttcatcgcgtctctctgtctctctcgcggtctcgtgtgcgtgtgccgctctgtattgtgtgtctgtcgcgtgtgtctgctcgctatccgcgtcgctgcggttgtgtcgtgtatgtggctgtgctcgtctaggtactntcagtctgcnttgcantctttccgcgtcgtgtccggctgnttcctctcntcctggggctgtgctgcggtggcntctgtattcgtgtcgcgcgcgggacattggcatgcgtgtctgtcgcgttgtagcggcatgcgccaccgctatacggtgctcngcgccgtcctctgcgatacgttcatccgcatctgcgctcttgccgcggtttcactcgttctccgccgcgctatgcgcgattccgcgtgggcgctccaaccatgcgtcnggccatcgtcgtcgcgccgcgcgcgccgtctggcctccgcttctcgccgccatctgctgtcgtggtcggtgtcngtgncgcgtacgcgtcgtctattgtctnggcggtggaggcggctgatatatctgccttcgtgagtacacgtgctgatgtntgccgcgcgtcgcggatcgtcctcatggtcgtctgcattactcgtcatgcgncctctctgctctgtgttgtgttctcttccggtccgcgtgtggcacgctctcctacagcntnccgcagctcgtcctcggtgtgcgttcgctacgccccgttcccgctctgcgcgcgtgttcgctggtctttatgttggcggtgccgcgggngggtacaatatgcgcgcggtcttctgtgtcgnggctgtgtgtgtgtcattgtcgcttcctttgtctcgggtgggtggtgtggtggntgtgtggttctcgatatccgcgggtctatcgtcttggcgtgcgcnttactcgcgncgttcttgctcgcntngggtcgtgtggcgtcttcgtacgcgcgcgggcgcgtcgcgcttctcgtcgtcctggcggttgctgccttccgtcgtcttcttcactacgccgcntcgctcgcggtgcgtcggctcgcgcgcgtctggccgngcgtctccgtcttgcgcggcggttggatgatgtgtggtgttggtactctcgggtcgtcgcgctgttctcctgtgctctacgcctcggtgcgtagttgtgtgtntgtcggtcgttcgntgcgtcgcgcgtngtcgcgancggggtgtcgcgtctccgttggtgtcgctcgcgttgctcncgcttcgtcctgctncccgttgtgtgccgcgtcttgctgntctgtgtgcttctccgtcgtctgcgcttcctgcgttgcctcgtgtgtgctgctcgcctgcggcgcttcttggtgcnttgcgcgcttgcgcggctggtgctccgtcgnctgttcgctctcgtgttcggcctgctgctgtgcgcgacacgtccgtctctngcgtgcgtccggtcctcgctttgtctgccctcctcttcctctgttggttttccctcccgcggcggacaaactgctgtgttttgtcttttggttgtccccctctcgaaaaccgtgtctttcctctgcctgtgttcgttctctgtctctcttcctgacctgtcatacggctcgcgctgtccctggctctgctc

SEQ ID NO: 13374 - DNA, 333 bp, Homo sapiens
cctgcatactgatggaattactacaccagcttgtctgtaagaccccagtggtgccagctggtctgaaggataccactgactcagctgatctgagggtccccacgagaagtggactcactaaagaatgcagtttctatatcgtgatgatatcaccctccttgccctgaccaatcaacaaccccaattttccaatccttcaccctcaatgatccccttaaaaatcccagccaagaactcctcgaggagatgggtttgaggatgtcctcccatctccttgcttggcgccctgcaaaaattaaactctgtctctgctgcaaaaaaaaaaaaaaaaaa

SEQ ID NO: 13375 - DNA, 861 bp, Homo sapiens
tcgttattcgccctccatttacatttaattaagagctcaacccacctatctcaacgctggcagtttctacaaaagactttaagcccactgattctttccttggccatgttctgatttacagctgcataatttgacatgccttcagctggggaagaggagccaccttattataatctaggcgacgatagcaactcacactctccaatgggttttcattgataccaaaggggatgatgccttgataccttatacagtgatgggagtctctgttccccaccagcgatagggatagaagatgttcacacggaaatagcgctctcctgatctctgactctccatctctccacaactgccggcccagctcacagcttgtgtatcgatcatccaatctccgcgtctttctagttataacatgtatttgcgcactgagacatattataactcctcagagagatctgtgaatgtttttatcacacgaggacatacaattctcgagttaacccgtacaaaaccagttcctcatatttatttcatgggccacgccacgacgactttataatgcatccctcaccaacatatatattgccgccttgcgcaacattcaacctcaatacacggttcatcaccgatcaacatttctcatatcattattaccgttctctatacctccccacatcgaaacgattatacgtaaattacaccagtcacatgcgcagcaccggcatcatgtcaatacaatgtttttaatttctaccgattgctccatattccgcgccctaatctctcacgtcctttactaaaaacacgctcgacacaataattagtcaaaatcgctgcgtccacaagcccgtacccggcgac

SEQ ID NO: 13376 - DNA, 997 bp, Homo sapiens
  misc_feature (1)...(997): n = A,T,C or G
aaaagattatctattaagaaataataaaaattttacttttgtngtgntaganggtacngaagatggtgagatatggtatagatgnaggtgttagagtgtataattatggtgaaggtgggggnatggagatanggtgggagttactccagttgatgttttttttatgtcagcgaaatagaaagtgattgaatgcaaacagctagacttaattgccaggtttatttaatttttatactcgattggtgtgtgtgtagttctggttggtgatgtttgttatacttttatattattatatcttattcttcgatggtatatcacgcacttatccaatcccgcggcaatccaatagtcggtcccactgcgtacagctttaccctcctcgtacttaaattccttactcgttgattatttgtgcagcgcgccgccacgcctcccgccacgcagacagacgtgacccccagacgcgacacctggcggccgcgcgccccggtccagcgcgcggagtctacgtagtataggctaccgagtgagaaaaggttgtggttgtgcttagatgttagtttagatcgtgtctgatctcattgtacaagagcccatcggctcgacgtaagggaaatgggggcgactcagcgcagagtcgagttgaagaagcgactagagttgagtgggagtcgtcgggcgcaacgatgacggagcgcgtgcctgtgccatcactgncatcgctccactttgactcgtgcgtgatacgccgtgtgcccgcgaccagcggtgaccgtcgctaccacggcactgtgtgttggttttcctgctgcgctcgcgccgggagtcatctccacatgtgtgtaggaagtagtgtccttgtgaggcggtgaccgctgttgtgttaggatgacgaacctcatcgcgctgagctgtgcgacaggggtagtgcacgcgcgggtatagggattgattggcgtgagggctgtctctgggtgctgctccgatgtagcacgcg

SEQ ID NO: 13377 - DNA, 766 bp, Homo sapiens
ccttcgcccatttaggaatctcaagatagtaaaatttgacatgccttcaggttgggaaaatgcagcccgctgtattatatttaggttagtgatagcaactccgactcttcaaaatgggttcgcattgagacctaaggagatggatcctttgttccttttggccggtgaaggcagttcctgttccccccctcgtgcaaggatataagttcttccccgcaataggcctcttgattttgaactttcccgcatccaaaagctgcaagccaagatggacaatgtgggtattattcagcccatctgtggtcttctgtgaaacagcaaaaagtgaactgagtcagtttatttcttaggagtggcctgtaagtgctttcataagaggagcaagatacctgaattccctgtataagtcctctccccatgtgatgctctgaaccacctcaggactgtgcagaaagttcccccatccccgcagaattttaccagctgtggtctctcaacttcagagttctccccctatataactgtgtaccgaaggagactttggactttaaacttttgtcttggtcttggaacgcgttaagactttagggcattgagattacatgaatataaaaagcacatgagtcttgagggtctatgggcagaatgctacgcttgcaatatttgtcccttccaaaatgcatgctggaatttatcctcaatatgtcagtattgagaggccaggtattaaacagataactgtgtcatgggaaaaaaaaaaaaaaaa

SEQ ID NO: 13378 - DNA, 743 bp, Homo sapiens
aacccagggctggagtaataccaccccctaaaggggggcagggtggtcattttcctgttttttataaccaaagaagtcctgataaaaatggacaaatccagcttttgtgtatcatttgtttttgggagggggccctttttggcaattgaatgcctcaagattctgaaaaaaggtcataaaacccctgccagtttaggatcccataaggggccctggataagttggccttagatggcctttcagattttgagaatttgttccggactcatctgtgaaagctgcttttcctctttttaaaacattttgtcccctttgcaaagctcccttccctttggggcatttcacattttaccctgggccggagctcctgatgccccctcctgtttcccccattagatcatgacccttttgagtaaatgtgatggtaagttttgcttttcagctcaattagtgttaaaaaaaggaagggaggggggaaagaaaaaaaaggaaaaaaagcaaaaggaaaaggaaggcaagaaatttcctttttatggtattttaagcgcttaattgtgatgcttcatccagtttcaatcaaatttttgattcataattccctccctgttgggtttgcttcctttaaaattcaaaatgctcatcattttttaaaaaaaaagtttatggatgatagtgttatttagccaaaaaaaaaaaaaaaaaaaaaaaaaaaaaaaaaaaaaaagaaaaaaaaaaaaaaaaaa

SEQ ID NO: 13379 - DNA, 225 bp, Homo sapiens
  misc_feature (1)...(225): n = A,T,C or G
tgcggccacgccgcacacactgcacctctcctgctcacgcacgcacaagctactgatccactcgcatagccccgcgagcacagactacagatgctatactcctctctcntcataactcgcngactagctganacannnacntcagtngcatggctacacacatcgtgacggtgatgtgtgaccgatttgctgctatctgtacagtgcgtcantagatgtatatat

SEQ ID NO: 13380 - DNA, 820 bp, Homo sapiens
ctgttttgtcgcacgtgctgcgcataggtacggtgacacctacttcagctctgtggctaggagctgcttggatgaccacattaagtgaatggccgcatctgtgcactggctctgcagccctgggcagcgacacagagacagcaagcagagcatccatcaccaggattctcagagtctcgccctgtcaccaggctggagtgcagtggcatgaactcagctcactgcaacctccacctcccgggttccagcgattctcctgcctcagcctcccgagtagctgggattacagatgtgcaccaccacgtccagctaatctttgtatttttagtagagatgggatttcaccatgttgctccaggctgttctcaatatcctgacctcaagccatgcacctgccctcggccttccatagtgctgcgattacaggcgtgaggaattgtgcgcagcctgccctatcactcttgaatttcttccctgacgattactcgcaaccccgtgttacgctacgcggcatgtgtcccgatttgcggggtcaactttgtttaggcccggtaggaatcacaatggcgtatcccctttgccccttcctccctgttcccattatcgcctcctactgcggcgctcgtgtatacctttccgcccctccacccgtgctaagatcgtcaccggcttttgagctgcagttagctgcggcggcccgggtgtttaattggataatattgtcccattgtcatatatgtccgccttttttctatttctcgctccttccctccatccgatgtaatttgtatagctgaacggcctggacccgcccgttccc

SEQ ID NO: 13381 - DNA, 739 bp, Homo sapiens
cagcatagagaacaaaccttaatgaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcgcatccccacccagggcccgcttttactaagtgttctgccctagattggttcaaggaggtcatccaactgactttatcaagtggaattgggatatatttgatatacttctgcctaacaacatggagaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacaaaaaaaaaaaaaaaaa

SEQ ID NO: 13382 - DNA, 1054 bp, Homo sapiens
  misc_feature (1)...(1054): n = A,T,C or G
gtgttttacgttttctctcctgccacttatacttccaggacttttattttcgtctaggagcaaccagtgaagtgggttctattattgccctgtctcatggatgaggcaaccaagcatcatagatgttaaaagaagcactgttgccgtgctcataccagcttggtcggttgtaaacttgtgtgttcagttgagcttacacgagtaaattcgctgcggagtgaatacaaaccgcttgttgatatccttgtataataataaagatgccatcgcagtgagtaaacctcgctcctttacacttcacgagcactctcttacataacttcacttggcggaaatataaacgatctagtgtttgtcatgtatgtagtttaggcatatgcctgcctatttattaccacgattgatatgttttcatgaacaacgtacatcgatatgtacatgtacaatccctcacttccaactgacagttctattcgtacttcatggccaataagaaagacataggaacaagatgcttacatgtcttcacatactattactataagttcacancggtcgacatctcataacgttagttattttttcctcttattttctcgcttccctcctcgaccgcccgacattagaactttacattagcataaataatctgctatcacatctctatatttatgccctcataatctctaacactttttctgttttaattttgcctctacttatactttgcatttgggcagattgcatcctactcacacgatacataatgtattcagcgggtcttcacctctgaggacacgtgctgtcatctcaatcaattccttatcatctcgcccactcccccgtcagatacatctatgtacaaatatatttgatttccttgcctctcttcacatcccaccgacacaggatagctgttatttctttaacttcatatcgctcatatatgctattgttacgcgttcgttacttccgaatatgagtgtattaatcgagccccgccattaataatcattacacaagctcttatacaatatcactacctccttaaacg

SEQ ID NO: 13383 - DNA, 2135 bp, Homo sapiens
  misc_feature (1)...(2135): n = A,T,C or G
atatttaattataaatatttantatttttntttttattnttntnatatatttnataatttnatagtagntagtagtangagagagngttgtagcatacactatnnnnnnntnnttgtngnnccnacncacctttggcgtancgacnanngcntnagtngtngaganagcctcgggcgagtctatcttacatcttatnatgggcnacacctccggtcnctcncaatgcgcgcnatctgcaacgaggncgagaccacgaaangatngaatngnagtantagntcatncgtgttgactagaaatgcaactatggctactctgatangcctncgngngtcanatccnagtcnaccacangngcnctntgtgntncgacgattngcagtanaactttnngnttcgtgactccgactgccttgaacncnctctacnacaatgtcagtgcacactactntctgnctntgctgcgcgacgggngatgangagcnatnanatcgtcgacactatggtctanagctacngcacgnttnggtattgcaatagagataggacganantcacgtcgactgagctagcgtggctatgtacantatccgattgtgcactgctatgtgtgccattcttnagtcgtgngtctgcgctcgatgtgcacacagacnactagtgcgatcgtatgagagnagtgtgagtatactgctattgnagcgntgcacatnganngangcatccgtangagcgacttnacatccngantgagacgagacngttgnatnagtnctagnagnattgactttagagangangctgtacnccgacgacgatcatgatantacggcnagcagcagaggagntgcaggcacgngtgcagantgactgacngatgacagcgcagganagatcantggnagncngcagnacagcagcgnagtgtacagattgatagcnctcnctcgttcacntagcaccgcagctgcacgactcacgtcacgacgcatgtcatacaagcgnacatcgacgtcgagcatagtagcacnggnacgtcggancgacgcgtgagcngctgcagagtagtgcacgatgtgctgtnatnatcanacgacnatcatcatnactacctcngtngtcgctcacanctnctntcgtctctcatcatcttactnctnacatgtntgananctncgtatcantggtacganttnacganctntcgtagttcgtgctcgatcgtacngnnatgctcgncgtcatagttntcagacgagatcactctgnatgcaangtngnagntnatnagtacgantgncgtgctagtcaacacntantaganangtatctagtnatctngcgnctgcnatgtccgtcnntgtcagcntcnacncgntangtcagagtaatcatcnatatgtcgatatntgnacctganatatgtnngtctgcggcagtcagtctncagctgnactggangtacactagtgctnatcanctaggtngtngcggnatcantgcngtcactgatgcngcnaacgancgcagtagatgaattgacgtgtgtgctgccgacgntcgcgtacgtactcgtcgagccgtcctcgcagctgagagctatgctgagtcancgtagctnctgaacgantacnctacgtacgctgcgacacgtcgcacgtcgacacacntgagacgaagccacncgagtacgcgcagtcgctgtcgactcactctcgcagcgacnatctacttcanacgtacatacgacagcacancacatctantccgttctncntcgtgtatgtnnatcatncncgcntagtactgtagctcgcatcggnctcgncacgcgntatgtgaggtaagacgctccgtcncgtntntcgcatntatatgacagtgctantnctacactcctcancngtctacgtncnacagtgtgatctcncntncgtctncncagccgcaccncacaacntcagtctacgtaagtcacgtacgtatgcngcntcgatgaccatcgctgcncgacgtcgagntcgcgtctgcactgacgngcgcatggatgatcgttacagcgactgatttctgagccacgcgaagtgatgttatgatgatagtanacacgnctgtgtcntcgctcgctcctant

SEQ ID NO: 13384 - DNA, 740 bp, Homo sapiens
ctggtatatttcttggggaaaaaagctaagggttgccagctgcagtaggtttttgctcattaaaccagaaaaaggcagaaagcaagacaggaaaaccacggacttcctcagggacattgctgagtctgggaaccaatcctgcaacctccttactgctctggacttcttattggcaatgaaaattgatacatgaagtttcaatggctcacccaaggatacacagcgagatgttcatgaaatcaaacctatgtcagatcttagaatccactctaattccactataccacatgacctcccttcctaagcatcaaagcctactagactcatgacagcgcaagctccaaagtgggtgcatctgaaggaagattttgtcttaatatattttacccagtggatgatgcttcttaacagtgacttcaagagcaaactaaagagtaatactgaggaagagagttcaaataaaacacccatcacctacagttaaagagctgtgaggtttgggtagggttgaggggtacggcatacagatgaagatcttgcttcaagatcaggctccctggggagctactcagttcttctcctcgttgtactgccaacctctggcaagcctgccatcaacactgtgatattaagagcacaatagtgatcatttcttatgtggttgccagtcagtactgtgctgttcttcctaataaggatgaataaacataactaacttagcataaaaaaaaaaaaaaaaa

SEQ ID NO: 13385 - DNA, 340 bp, Homo sapiens
ttgtttaccccgctcgttcgtgcgaaatactaggcacacagaaaaaaggtcactatccagttcctggtcctttctcttgaatcctgcctcagttggcctcctgcataatctgcctggttcattcctgcccacccagcccataacttccactggatccttactcttgcctgtgtctggcctctgatggacttacctggtgttgactcctgacttatttctgatgttacccaaatgaggcatattactaccaaggatctctagaccgatttatttcatatcactgactaaactttgagcagtggattaaagttccatcttccaccaaaagaaaaaaacaaac

SEQ ID NO: 13386 - DNA, 189 bp, Homo sapiens
  misc_feature (1)...(189): n = A,T,C or G
acgcgaacagcagtgacgcgaccgcgccacacgaaccgacctcgacgtcacatctacagagagcacacgacaccacgacgaaagcaacctttcaccaggtcgagagagatngattatcttcaccaactcgctgcaccagcagctgtcgagagacaagaccaaccgcgcangacaactacagagtatgag

SEQ ID NO: 13387 - DNA, 128 bp, Homo sapiens
  misc_feature (1)...(128): n = A,T,C or G
accacgccccaaaccacagccaccaaagccaccccaacaacaaacaaaaaaacttttcccgttggcgggggggggagnnntttccccctagcaccccccacccgcacccaaaaaccagaacaaaacag

SEQ ID NO: 13388 - DNA, 794 bp, Homo sapiens
tcgctaccttaatttctgactgcccattttacaggtgggaaccctggttcccagtgtgggaaatacatagttgaagcagaggtggctgaaaattcttgatttctatgctcctgcctttaaacctagccgcttcttattccctgtgttctctagccaggtgtagtcttggagtttcctgtaggcttggagaggatttccttttggatggtgttcagatggagcagacatgttacttccttatctgctgctgttgttgaagagtggccagctgcatctttgggtttccaagatacagctgaacagccagagaagacctactctcctctaataataaagattgttctctctttcagatgtatgttaatatgggacaatcctagactgagtgagcacagctttagtatatggtcaaagagactgggaatgaggaggttaaggatggctggaactggaggaattgtgtcttctagccagaggcttatcagggtcatagttgtgcttttgccaaagccataccttatatgccatacacaggcacgcacccaaaaaatactgcatgaggatttggtccagggctcatcttgtaaagcgaattaacgcgccacacaaagtgcaaattgattatggcacaccgagatgacattgagacgataagagataattaagcctgcttttgctttattggagcaacccagtacatgaaccaaggttttcggattcttttaaaactccaaacacgaatcttatgttgaaatggttttttatctcaagcacctggccaggcttcggaacag

SEQ ID NO: 13389 - DNA, 746 bp, Homo sapiens
  misc_feature (1)...(746): n = A,T,C or G
aacaaaattttatttcgaatcatttttaattagtcanggcccagtattcccactaggggcagggcagagagggaaagccctcactcattgagcacttatttgccaggcctggtggtaggcaacttggcaattgttatccagttcaacactcaccacggcncaataaggagtaagtgattgatccctattttccagatgaggaaacaaaagctcagagaagttaatggccacacccaagctcactcagtcttgaaagtgcagagctggaatttgtatgtgacttgatttaaggctaaattgatataaaaaaaatccatttctctttctggttttaattctgctttcatggagtgaggattcgtcttctctccctcactcaaactctttttaagtctactgttgatagctttagtggctttaactattattgttcacatccagtggggaagataaatttgcccatggaagatgacgagaacttgtgtttcgcagaagttctcacgaatgtctcactgacactgattgtttcatgtgctgattggctaaagctcatgtttgagaataaggatggggacaggatgatgttcccacgtggaaatcaggatctcattaagagagatggaagaattcctgctgtgcaggcaaccacagatgtctgctatacggtgtctggaagatactggttgtgaaagtaaattttgggaaataaaccaaaaaaattagaggctaaaaaaaaaaaaaaaaaa

SEQ ID NO: 13390 - DNA, 629 bp, Homo sapiens
ggttctgagcatccagcctccaggccagtgttctgtgacatagcatcccatgagaccaccgtaagagtcacctggacttcctatcactcaaagaaccaagaatcttgtaccacgttcatctctctccaacaacacgaattctacgataaaaatccatttcagtatggcaagattttttaagtccacctagctggtgttgagaataactcgaggcagaggacgttcaatgaaagcagaataacttttccttcttgattggatatgcagtaaagataaatgataaaccacttcagaggtacatagaattatgctcattttatgactcctttcttcttaggatctcagagcaattatgtaaagaatgctcatgttcacattatactaaggtactacatatctgcacaagaaaaagagaagctcattcgctgcccttccctccactcactttgtgtgtggtgtgtgggtgtacttaaacagtgtgcctatttacattcaatcacatatggacgctatatatgaattaggtatctataatgcagatattttaaatatttgcttaccaccaactgtttaactgggatttccatgaatagaataaaagatgtatgtgctaaataaaaaaaaaaaaa

SEQ ID NO: 13391 - DNA, 777 bp, Homo sapiens
tgtcttagataagccaaaaaagcccattgacctaagttggaaattaaattagttaattttttccaaaaaaatgcttgaagaaagctagattatttagtccattaagaagatgagcaaaaatttacaaattttaactatttctgtttccacaattccaacaatttatcctggtgtatatattgttactttaacagaacttgcattattttgttttaataaatataaacatgcaatttttgtatgtgagaatgattgaactagtttgttcttaatctcaaaaatttagttaccaaagtagaaaaggtattttgatactagatattaaaacctacatatagttaatataattttataatttttgtaattaaatgtgcttctgtgattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcgaactgcttattcaggctaagtgggaaatgaatttgtgcagtgtgttcccttaattatctactgaatgttgctaccgactaaacaaggtttctaaaagtctcgcatttcttttactattcaaaactctttggttggaaatgactaatactgctccaatttaaattatctgaaatgtgaaaaaaaagaaaaaaaatggcctcgttggctacagcggtggagctctcggccaa

SEQ ID NO: 13392 - DNA, 760 bp, Homo sapiens
ccttctgtcttagaacctgtaagatgaagtgaagctacatggcccaaaggggtagattgtgacagacacagagaagagcttctcagatccccgctcaagagaggactatctgtccacttctgatgagtgtgatcagctgaccttctagctgttaactcattaagagtcaccttagattccaaggcaaagtcctttcctttcctttccaaggtggcttttgaccaatggttttccaaggtggtgtacaggaacctaaccatctctcctcacaaaggactccctaatgagcaatctttactctgttgcttaaagtcaaggagactttatagagtcagcatcaaggtctgacaactcctcctaaccaattccacttgcatccctctctttccatggttgttaacaataaacctttcacacacctaacttcttattatctgctttccagaaaacacggtctgcctcagccagtcaaactctatgcatcatcttatttaattaaggaaagattttccagaagattatagtcatatattatcttataactagatatttaaacatgcagccatctaattctcatataaaaatgatatcgtgtgtatataccccagaacccacacatatcaataatagctatgataaagtaagatattttcctcagtctcatgatagatctacataccgtcaacagacactaaacttatccccggcacattcatgaccggatagaaggctatttcgttccactttgcatggcgcaaag

SEQ ID NO: 13393 - DNA, 787 bp, Homo sapiens
atgctagaataagtaagactattcagtttccgaactcgcatggtgaaaaagatcaataaatgacttcacgcttcgtgtcgaacagatatttgtttagtagaaattaattgttcaaaaaaaggggaaaagttgtttataatttaccccctacaaaattgaccagatgtacaaaacttgaaagccccaccacatgccaggaaagaaggatgaatatatattctgatcttgaggcgccaattgcatgaaattgtttcaaaatgggaagtttataatttcccaaataattgaaagacgaatttaattttaacaaattatttttatagcataataaaagagttcttaatgctgagtattagagaatacaaaatgtatttgaaatgtgctctgacaaagtacttattcttcatagaaaaagaaaatataatctctttgtcctcccataattatgatggtaaaacaatttattatgctctttccagcacatgctcacagaaattatgacctttataattttgttgggcattttatgatcatgtcttcagtgatatttatcatttcatgaacaattggcagttaaataggttcaaacattaacattttaattcatctgcagatttatttcagaaataagctacacgcaatgtggtttctctattataacttcccttgagcaactataaacttaaacatgtgactatcttttatgattttaactcttcttgaggatgggcatttgaagttttaatattccaataaagagagatttcttgaaaaaaaaaaaaaaaaa

SEQ ID NO: 13394 - DNA, 1621 bp, Homo sapiens
  misc_feature (1)...(1621): n = A,T,C or G
ccccccccccccnntttggggccgcccgcggagcgggnggacgtttcaanctgatccccaccccgactcacnttatcgccataacgagaaacgcgagggtgagtattgtatactgggtagcgagagttataattcgttgataagtgcaaagattaggtgggggttggcgacgcggccagccgcagcatgtacttgtaaagtgcgtgtttcacgatgagtgggtgagtggngagatgtacgcgcgctggctangcatggatgtggaccacgcacaatttcgcgccacccacacaccaacctaatattattaaaaaaaagagtggaaatagaaattatttattattactttgctgtgtatgtagtgtatgtattgcgtgggagtggtgaagcagcgccgggaccggagtttttttattaactgaccgangggaacagagtatgttttagcgtacctcccgtgtagtggataggggatgtagtggtaataggtgggcgttagtatgtcagtcggcgggacggacgagaggaagagtgagaataataacgacagcaaacgacacaacagactcatacatattctatttcccatctaacagatataccttctatatatcgtatctttataccggtcgcattttaattttactatcgatacgcacccatataaaccgcactaccacattctcatctatatcgaatatatatacgaagcaatgacacgatgctctgtctgtgcggtttatattcgtttgttatctagatttcgtcagtttatatcgttatatgttaaatattatcgtatatagtacttgtaatagtgagtaagagtgaaggtatgagtctcatacagcgagagcggcagagcggttagactccatatggtgtagacgtcggcggtatgtatttatatttagctgactacgctgcctganctcgacgagaagaaaagtcaggctggcttctaccgcgtcaaagtcaagcgcgtcgcgtctatggattctcttctatatctcattaagaatataatcctagagtagcttcgacctaactcttgacacccgcggaagagggcggacgctgtattaggatatggtacgcgtcagatatggcgagttntatatcatctctgtgtgagagtcgatgtgagacgagagtgagtagattgtctagtgtgatgctgtatcacatacttctaacagtgagcagttagatgactaatgatcttagttcgcgatcatgtatataggtgacatagtgtagttataataaaaattatcattgtattctatacgcgacggtttaatgtggtggggttnggctactcgcggcgagcaggcaacaaggtaatcgatnagataatagcattcattgacancgacgacatagtatcattcgtcgacgagacttgtaaaacgaacgagcatcaaacgtactgtgactggttagtatatatattagctacggaagtgatgagtcgacgtacgaagtattgatccatagcatacgagtataagtatcaagactattatgtaagagggcaggcggtgggggtatgtgatgtgagcgacgagngttctagatggggttaagcgacaagattattaacatcgactgccgaggc

SEQ ID NO: 13395 - DNA, 1640 bp, Homo sapiens
  misc_feature (1)...(1640): n = A,T,C or G
cgatcccccgacaggcgtnggatgaggcgcanacccagaagagacgccantatgtgtctatgtatatatatgtgtgtgtgtgcgcgagaggagagagacatgtgtgtnagtacttataganggaggctgcgtgtgtgaggcaanancgacaatgatagtgtggagcgacgcatgtgcagcgngacgactgtgcagatgtcgcatnctgcgagtgtgggaggcagacaggagctgtagccgtgctacacacgccacacgaagtnggcgccgcccgtggtaggccaacgtcacacgcnatgggcgcgctcggcgtggcgacgcnactccgcgcggcacgcagcgcgcgcgccncccccctggccgccaccaactgaccctgctcgactgccagcacacgccgcgcgattggnagcgcgcgagacgcgtgcgcgcatgcgcgccgcacctcccggccgtcctgatntcactcgcagcccngngcgatgcggtcgcaggagcgcgcaacgcggccacacaccaccatatcacgccgctcacgccacgccaggcccaccgcgcntccgctgngtangngaggggttgcaactatatatgccntcaccatacgccagccccgangccacacttcaccgaccgcgcacagcacccacaacaccgacacacgcnaacncngcgcacactccgccacagacacagcgcgcgcgcgcgcgagcacgcacacacncgacatcatcacgcgcccaccacncacgcgcggctcnctgcccggacgctcctgagtatcagcatcaccangtntgacttcgcatcgtaggtgtagaggcaccccggacgcgcgacgcgccagcacgacgcgatcncnacgctcgccaccncntgagcgntcgcanagcgccgacggcgacgcgcggcgacgcatcacgcccncnacaccgcgtcagcgctcccgagctcgccggctcgccgcgcccgcgcgcgccncgcncgacgcgngcagcacgcgccacgcgcgcacgcgctcgccacgcgcgcggcgcgtcngagcgaagcgagacccgaggctcacgcgcacacgcgacgcgntgccgcngagagcaccagcagcgatcnagcacagcgcgcccgcagcgcgcgccncatggcacngtcccnancgctatancccagccngcacgagcgcgacagccgctcgctcngcngccgncngcncgncgcacgaaggcgtcgagcacgcgcgacgcacncncgcgcgacgcgtcngntcgtcnacacagctcgcnacgctcccnccgctccaccgnacgccnactacgcgccancnccccagcacgacgcggcagcacntgcgcgtgtcagcgcgcgnacgcacggtcgccancagcgctcctgcngctagacgccgccgcgcgangacgcgaactncgcccgacgctcgnacacgncnacntcgccctcgctcactcgcacacctgtcgncgcggcgcgtctcgcgcggcgtgccgcgcgacgacgtcggagcgtgtacccagcacgcatcgcacagcagcgacacacgngctacngcacgtctgctcgtccgcgagctgcgcgacgcgccgtgtcacactctctccagccacgacacatcgccgcatcacgct

SEQ ID NO: 13396 - DNA, 1256 bp, Homo sapiens
  misc_feature (1)...(1256): n = A,T,C or G
ccaccgcgatgtgtgtatgcgcctcgacttccctcccgccgcacgaccacgccctcaccttccgccctgccagcctccttcttctttcatgttagttcataccccaagtcttgtattccacgtggtcatgagaacgttttctgcatcagcgaccacaggtgcaggtagtgggcctacctagccagcgataccgatggacaccactactgtagtgcgtacagatgtatatgtgctcttcacaagcatcccatactgatctgactgcttcgtatgttgtaaagagcgctgtgtcgtcgtcactacagctgaacgctggtacgggaacgaatgaagaaccatagtgatgagtgttgaagcacgtacgcacgtgatgtggtgaagagggatgcttgtangcaagatacgtgtgacgatgtacgcgcgtgacgaagtgtcagcgctataacaagctccgtcgtcaaccagttagcacgcccatagtctgttgattgcaccacaatgtctgtctcacatgcgactactcgacttgcgccacttggcacggtcgaccatatgcggcgcgccngaccatgcgcgaccgacttgcaagcaaatngtctactgcccgctgcattaccacccanctcaccgccagcgtacgacaacgagcgacgtgncgtgtgatcgtacgtagtccatctatccatcactcgtaggagcactcgttcgataaacctctctgcagcccggcgccgccctgctcaccaatcagatcatcgtgcatgacgatccgcgcggccgcggccatagtcgcgacgccatcgccctctatcacccttatttccccgatcactctatcatagtgatgcgaattcggctcacgccgtcacccgcgaggatcgtgccacttactttcctcgtcatcccgatgcgcgttgtacgcctgcgcgttcgcatctggctcctcgacggccgtgcgcccgagtcatgcttcgtcgcttgggcgccgccaaccacgaggcatagtcggcatcttcatcctcttccatccatgcgcgtactcgcnctcggggcggcgggaggtggtgtgcggttattcacgtggttagattaggacggatgggcgccgcagttcgtcacgtctgcgtcgggcgcgccgcgtgcgcaatccaatcgaacacgcatatccgatgcagtcgccgacatatgactgcgcctgcgccaccgtaaaccccgaccgacggcggcctcggaacgatcaccacgcatcgcaccga

SEQ ID NO: 13397 - DNA, 798 bp, Homo sapiens
ctaggtgcacttactcttgctgatgaaaccagaagaagcttcagctcctgaacaatagctacagccaaggatactatcatcatttcttccttttcttggcctttattcttccttgtcagatctcatacaactcaaccaaaaggaagaagaataagaagaaggaagaggaagaggaggaggaggagaaggagaccatttttctattaacttaatcagatcagaaaatggacttacctacttgggtgaaggaagccaaagggaagcagtgtgttgacgatgctgggaaaagcactaagcacaccatagttgctgttatctgaagagagaaatagatgttcccaacgaagagggtgtgaggaggtgggtagtgactgaatatgacagctttgcctctggtcttctccgtcagagaaaattggggcatagagagatttgtcaaagttagccttggtgccaaagaaagcagctatggaaagagagtcctgacacaactgtatctcaagaaacagctgtccatgatgtgtcatgggggagctgcttggagcctagagaaaaagtgactcctgctctccctcctcagactcagcagagggccgtgtggacctgaggctccttctctgtaagataatgcatttagacgagagcagtatttccaaggttgtgttctacacagcagagagtcttaccaaatgattagtttaaagggggcacaaagatacaggcctcggtgggaagtcagacaccttcctccaattggtaagaaagccaacatttaggcaagtacaatgtcttagcatt

SEQ ID NO: 13398 - DNA, 120 bp, Homo sapiens
tggatccgagccgaaacactggtatgatgcaaggatttgtggccagccaattcaagcttgaaaacttatctctatcactaacatgacattatattcctgatatttttaaaaaaaaaaaaa

SEQ ID NO: 13399 - DNA, 864 bp, Homo sapiens
  misc_feature (1)...(864): n = A,T,C or G
agaagcggaacgtgcgcggttgtgacgttcctaaaatcgcaaagtatcctttaggcttcacagnagtatggttctggcatctgctcagcttctggtgaagtctcagagagcttacaatcgtggcggaaggcaaagcaggagcaaatacttcacaaggaaagaaattgaacaactatccacaagaaaaatcactgtcataagaaacaaaaatcagggaattctttcagatcttgtcaaagacaaccatggaaatacttctacaagtctgcaagagccacagtgtcattggtcttggggtgtcccctaatgcaggtatggctgagtggccaaagacttagatcaaaacatccaagtttcactgaatacctggaaggccatcccaagaaggactagtacaaaaaagctcacaatgtgaaaactacaggaaatacataattcttcaatgcctgaacacctgacgaatatgcacaagcatcaaagaccatcccgggaaaatttgaccacacaaaatgaactaaattaagacccaagggaccaattctagagaaagaaatatgggaccttttacataaagaattcgaaacagcttattttgagaaaactcaacaaatttgaggataacagaaaaaaaggtttaagaatcccttcagctaaaatgaaaaaagaaatttgaaaaaaataaaaaacgaatcaggcgtaaattcctatacgtgaaaagtgccatggacctacttaagatgggcataaaggggcttaaacagcagactttattcaaccagaaaaaaaatttgccgggcctgaaaaaagcggatttgaatgcccggccctaaatacccaatataaaaaaaaaatggctgattggat

SEQ ID NO: 13400 - DNA, 585 bp, Homo sapiens
acttaaagctcagggctgctgtccagccctgtccactcccctgtcaggggattgtatcatcattccgaaacaagcatataatcttttacgacttccaagtacatacataatggcacaaaggaattatagtttttcagagctcttccctgaaaccagatgccatgacaagttgctttaaggcaagttacttgccaggcttggtggtgtgcacctgtagtcccagctactctggaggctgaggcaggagaatcacttgaacccaggaggcagaggttgcagtgagccgagatcacgccactacactccagcctgggcagcagagcaagactcaaacaattaataaataaataaatgactcatgaatactgccattgttccagatagcagcagaatccttttctgggaataattatttggtgatttttatggaggatacaatttgctggcatcctagtgaaactgtactcatttttaagatgtttagtatacaatataaaagactaagatttgaaagactgaaaattgtacatcgttcagaggttatcagtgttcattaaaatgtcaataattcaaaaaaaaaaaaaa

SEQ ID NO: 13401 - DNA, 263 bp, Homo sapiens
  misc_feature (1)...(263): n = A,T,C or G
gcttctagattcccaggagtatcttgcttctacctcagactggggagaggggagctccccacaacgatgggagggatgaggatatcaaccatccaaattcctgttcacgaccagcctgttgtgagctctcctgggggatcagcagtggctgagaggttggatgtgtgatggagtacggtgggtttctggacagtgtctnccccccaccccccactccgcacggggtgcgggcccctccccccgcgctcccccgcaaaacatcg

SEQ ID NO: 13402 - DNA, 736 bp, Homo sapiens
  misc_feature (1)...(736): n = A,T,C or G
tacaaaagaatcgtccctgaaggtttcaaagctttatgcaccataaggaaaacttctgcggatggactattcccattgcgggaagtcattgttaaatatttgggtgggccatgtataatcttacctcataatgtgcttaatgagcggtattattgcctctttcgacctccgctctctattttaagcgaagtgtcctcatctgtttatttcctgcggagtctagtccaatttttattatttttagaccactagaaagctatttactgaaatgaattgagttgtaattggtatagacaagccagtatgtctggtcatcttaatcgatatgttattgagcaatgtgccatctggaatttccttttatgtagtgtccttctcagtattctttttcctttcccatggcattttgagtcctactgctaaagtagaaaatttaagacagcatgttttccatagtgaaaggaacataggtagaattctgataaaaataaagcattagaactgaacattcagttagtaaatgctaataaatccatggactaaaacaaaagttatcgtaaaagtagctagcaatgcacaaggacatgtttagataatattatacaatttatgcttattttctttctccaagtgctcattctttccaaatngtttgttatccatgctggatcttgatgagaggaagaaaaaaagaaaaatgaataaaccatatcttacaaaaaaaaaaaaaaaaaaa

SEQ ID NO: 13403 - DNA, 751 bp, Homo sapiens
  misc_feature (1)...(751): n = A,T,C or G
taatagcccggagggtgaggagtcccactcttcatagtcttccttttcatctacctcatcactctggttgggaacctggggatgattgaattgattctactggactcctgtctccacacccccatgtacttcttcctcagtaacctctccctggtggactttggttattgcgcagctgtcactcccaaggtgatgggggggtttctcacaggagacaaattcatattatataatgcttgtgccacacaattcttcttctttgtaacctttatcactgcagaaagtttcctcctggcatcaatggcctatgaccgctatgcagcattgtgtaaacccctgcattacaccaccaccatgacaacaaatgtatgtgctcgcctggccataggctcctacatctgtggattcctgaatgcatccattcggacttgggaacacttttaaggctctccttctgtagatccaatgtagttcaacactttttctgagatgctcctcctttcttaactctcttatgttacaacaactacatcagatacgatggtttttttttttgagggagagattcaataaacctcttttttatgctgggactcttaacccgctaccttatttattttaccaccttccatganaaccgccctccccgaaggaccccgaaaggcctatttactcggcttccccccttctcgaattaccaccttttatgggcaaggattttacgtattgccaacctacccacacatttacg

SEQ ID NO: 13404 - DNA, 711 bp, Homo sapiens
agccaatagaatgggaaatcattcaggcacgccttttgaaatccatgaaaaatgacagcaatgcaggaaggtcgtcgtatataactgtttcatgatgagacgagtgcaacagtaggatggtaattgtactgtgaaaggaatcaaacccctactgtcaaatcgtgggaaaagatgatatcatcctgatttatatgttagcaccatcatgaagatgcgctctcctaaagtacgacaaaaagcattttgtacgtgtgcgttcccaccgttgtgcgggtttccaccttatatggggcggaaatcttaaagactatgggacctaactccatccatttcatgggcacatacaaaatggcatctgtgttctataccatagtcattcccatgttgaatccactggtctacagcctgaggagcaaagaggttaagagtgcctttaaaaagactgtagggaaggcgaaggcctctataggattcatattttaattataaagaattcgcaataagataattttttccacctcatattaatctttgtctaccaagcccaatatttgggcttcctcatggacagtttctattgactgttttcttaaacatatgaattggccatactttcttcattctttaagcgacactttttttgttgttaaaatctggacattttaaataataaaaaatagcatattctaaaaatcaaaaaaaaaaaaaaaa

SEQ ID NO: 13405 - DNA, 849 bp, Homo sapiens
  misc_feature (1)...(849): n = A,T,C or G
tgtntgaaattnttntgggtggttggggggggggaaaaaaaaaaaaaaaaagncctggttganccncgcgacccaacctgaggggacaacgccagccgccggcgagaaagaagcgaagagagtccgaacgagcgcgcaagagcccgaagcggcgagcccgagcgcccccaccggggacgccggcgacanaggcgccagcggccgcgccgggggcgccggggacgccgcccacgacgcgcccggcgcccaggagcagcgcgcgcacaagcaaaagcagaattttttaaaaggggcggccgagccagggccccaaagacacaaccccccggcgcccggggcccgccccccccggacgcgggcgcgtggaggggccccgcgcggcgccgcccgggcgcggcgacagcgcggcgcaccgcggccgcccccgccgcgcacaccggcgcgccggcagcgacaacaggcgccggcggcggggcgcccgcgcgcaggggggacgcggggggcgcgcgggccggccgcgcggggggcccccgggggggcgaaggcgcgcacgcacgagggaggacggggggcggggcgcgggggcgcccgagcggcggacaggcccggcacgcggcgcaggggggaggcggcgcccacgcccacggccccgcggcgcgggggccgcgcgaggagccgaagccgaagtccgacgagacggagcgcggggcagaccgaacaaggaagaagaccacgaggcggcacggcaagaaggcggcaaacggcgaaacaggagaaagggagcgcgggcgcccggcgcgagcggccgcggcgcccgaccgcacgggacggacgaagaaagaaaagaac

SEQ ID NO: 13406 - DNA, 736 bp, Homo sapiens
aaaagcaatgttttctgtaaaagtaaagactatattatattaaatataaagcatagacacaaaatgattaaaattgatcataatcctaccactcaaagaaagccactgctattataccacactggtatatttactttcagttctctttcttatgtatatttttagacagctgagatcaaacattacttaaaatagtttatctagacttcaatgttcacttaaagttttaatataatcctttcccaatgttattgaaaatgagagtattcattatgtactttttaaatgttatatttaaacattccaaaaggcctaaaaacaatttttattgacaagcaggttttatataagttactggcagtagattattctctagtcattgatattgaatttgtgatttataggcttaaaggcaaaactatactacaggaaacatttcaaccattaagtatgcagttttgagacgagacagaatattcctttagttcattcatttgtccctacactcgacaaatatttattgttgacttaatccagactaagtactgagaataggatgagcaaaactacacagctgctaccccgtagagcttataatctagtcaagggagacagacattaatcaaacaatcaataaagtaattgaaagttgtaaatgttaggaataagaggtatatggtcatatacgtcactattcaataaaaggagctgttcaagaaaaaaaaaaaaaaaaaaa

SEQ ID NO: 13407 - DNA, 879 bp, Homo sapiens
  misc_feature (1)...(879): n = A,T,C or G
ggagctagtgggagaggtttgtaatcgtgttgccatagcaaaagaaaaactgagtatggaaagctccacaaacaccctgagtgccctgaaaactgcttttgctgataaagaaacacaggcaatctaccttctgggcggggggagacctgatcanccacctgaaacagttatagaccaggtcaaacgttttcaggaaattcctatttataccatctccttcaattacaatgatgagattgcaaacaggtttttgaaagaggttgctgctttgactggaggagagttccggtggggtaatttntggttgcgaggatcccactcccccagaggctgttcaaaatgaagatgtgactctttgtattaaggaaatggaacaggggcccagtgagctggagaagatgcaagacctttattttgagtccttgatcatggactggtggtacaatgcagaaaatgatgggggaccgcatgcctcaaaagggaaatctgttgtatgatttccaaccgcaaaaaagtgtgcgaagccttaatcctgatggtcgatccaacacaaactttattcctgagatatgctgaagggacccttggggcctttcatattaaatggtgaagaaaaggaaagtccttgacacagaattcaccaatagcaggtctgctcagaagccaaatgtgcccccctcaggagctcagcttcgagttaacgggacgtgtggcctctcccttgccacccactcggtaggactttttttagtctctggaatcagacactttgcgtggctaaggatgctctgtatacaaatgtgcataaagaggtacccgagagggacgcagggtattaccacaatttttcaactgtccccaagaatgggcgaaacctat

SEQ ID NO: 13408 - DNA, 723 bp, Homo sapiens
gccattacaaagaggttgttgttaggtgccaagaaatggagaatcttagtgcataagaagggcatagagaccaaagggtcagggaggtaacggaaaagaaaatccgggttcggaccctaattcttaagatgtgtattcagaaatctggctgaagatctaaggcttggtcgccaagaaactcaccctcatggatgcctggtcagaggcaggcagtcacgcacagctccacctatgttacagttctggacaagcaggtcatgtctaaggtcctcgatgagaaggtgctcatctttctaagaataattccagtggacaggcattactgcagtgggatgaagaacatcaaaaacatgagaacatgaagacggaacctcagtgcttccaggcaaatacaacagcaactaacgatttaaatagaaacatttcagtctttgcagtcactgaatggaaacaatatccttaaaagacctgtctcatgctgaaatctttgcagaggaaatgatacaatgcttggggatgcttggggtttgctttattgtaattggggtggtggagtagtgggcgggggagagtagatgaaatagatagaccacacgttgatcattgttgcatttggataagacttagtgagaagggtcgtttcactcttctttctgcttttttgtgtatttgaaattttccataaaaagaaaatgaaaagaaaaacaaaaaaaaaaaaaaaaa

SEQ ID NO: 13409 - DNA, 853 bp, Homo sapiens
  misc_feature (1)...(853): n = A,T,C or G
gctaggcttacatcttcctcacattttccctctttgtgacctgtgctcacagagttaaaacattgctgaaagatgaangaagggttgggtggacggagattgatgtcatcatcttggaaatgaagactgagtattatcacaatgtcaattaattcctccaaacaatttatatgattggtgctactatattaaataagccccaggggatttggtttgttttcttgctttgctttatttggggggattttgttttggtttataagggggagacaaagaattaataaagtattttttaaagttcatctgaaagaattaacatccaagagaggctaatacaattctaaaacaatttttagtaccatctattagtataataaaaaatactaaaatggtacaatggggagttgttctactataggcctagatggacagacagaataaaaattaagaaacagcaactaatattatggctaaattaaataaagggtaaactggacatttcaaataaacatggagaggggaaatattattaaccggcgattttgttactaattacggagaaaataaaactagatgtttatcttcaccgccctaccttcaaggattgaacctcccagaaagatattgggttttcaattataaacacacacaaccccctgtcctattgggagaaaggggcagatgagtattttatgaaaatcttaggcggggttctatccctagtaaaaaacggacgaacctaacacgcggtactctccctagaaagtttttagagcttgtgaggggcgaaatgtttaaccacctttgaaggcgaggtgttttacggtcctttgggacaaattgggagtaggtt

SEQ ID NO: 13410 - DNA, 739 bp, Homo sapiens
atttaaagaaaggtttaaaaatatatagacaatttagtattttatagacaaacgggcgtgcaatgcttgataggtggcatggagcccaacgttattataataaatgtgcgatggtgcacacaggttaacaaagttctatttcacaagttaatatatccttaaaaaaaaaattctccctataaagtaataaccaattctaacacagattatatgtactcaactgttatcttatattaaaaaaatggttgacgaaaaggatggtaaattccctttagtccaattattttttagaagtttatagacctaaaaaaatgctctcactacaatattaagtgtgtatgtgtgtgcgatgaatgtattcacccaccaatttatcagaaaattagactacaaaatatgcatgtgtgcacacatatatacacagagatttaaaaatagaaaggaatttcattaatgttaacattggtttcctgttggtaaaattatttgacttttttcacattttctctttgtacctttgtgtgttttctatatccttcacaatgaacatatacagtatctataatttaaatagaaataatattatctttaaattgcagatactgaattagaatagatacacacaaaaataaatgctgcttatatgatttttgcataagtaatgccctgcataattgtatctgttctactgaaaaaaactctacagtaaagacaagccattaaaaaaaaaaaaaaaaaa

SEQ ID NO: 13411 - DNA, 468 bp, Homo sapiens
ggcacagcattcatgtcctgttgcccttcccccctctgtcatgtgaggatgttgttgcaagaagatgcttttactggaacagaccctcaaagaagctgccagtgctttgatcttggacttgctcgcctccagaactgtgagaaaaaaaaaattctattatttataaattacccagtctgtgttattttgctcttgcagtacaaaccaggcagaccaacctacctgtgcctaggtggtccgcaaaaaaatgtagccttcacagcagtgttcgcagagccagcccacattcatggattcatagaagtctaagtcctggcaaactgacagaagagctttggcattgggagagtggaatctaaattttagatgagatagctaaggatacctcaattaaaatgtgacattgtaggcaaagatttcatggctaagacttcagaagcatagacaacaaaaaaaaaaaaaaaaaaa

SEQ ID NO: 13412 - DNA, 659 bp, Homo sapiens
gcattcgaggttcaaggaacacattggtccctgaaaaaacaggaccgggagctcaaagatgttggccatgctgcaggtgtatacatagatctgagcggcggcccctctggaatacactattggacttggccctttatccgttaaccaaactgttggccccatggacaaaacttgtcctcggggccatccgatttggttagcacacaatagtgccaactcctataaagtgttctctagggaccgcctctattttaatagggccacttcatcatcatggccaaccatacttgggttcctggcccaatatctgagggaaccatcagttgctggaaccacactcggtggatattcccattagcctctccggttctgttctaacttgttattaaaaacccaggcggcctttaactttagctggggtagagctctgagtccaaaaaacttactgtgtttcccccgggcgttttttttccagtggcctttttaagaacattttagggcgttttatacgggtttgcccaaagaaccgtggaccaagcccaatctctctgttgtacgttagtatttgtaactatggatttataagttcactgtgatataatataagtctatatagatgatttgtataagcattatatatatacatgatatacactaag

SEQ ID NO: 13413 - DNA, 797 bp, Homo sapiens
atggagtctagatctgttaccaggctggagtgcattggtgcgatcttagcttactacaaccttcaccttctgagttcaagtgaatcccctgactcagcctccctagtagctgggactacaggcacacaccaacacacctggctaatttgtcgtgtttttgagtagagacggggtttcaccatgttggccagtatggtctcaatgttttgacctcatgatcagcccaccccaccctcccaaagttctgggattaccggcctgagccactgcaactggttgctaattcctaagagggaggtctgatacatttgtttggactaagtgaaaggatattatctttggcctccaatatgactaaggttaaatggaaattttatgctggaaactgtttataagaaaactgttttcctttttattcaatgtcattcctcagatcactgaggtattgcgtattttggtttggctcctctgttaaacttattaaaaactcatagtatgcacctttttggcttgtacatacttgtgaccgtgaatactattgcctgtttaatgttagcccacttttattgacaaaaacttgataccaaatactgtatagtcaaatgttttacgattcttaaagttaataaaacaatattaggctttactcccattgtacctgttatatagttttaatagggttaaatatggcattcatatttaccttgatatatatactattattcataaattactattatatggataatattataactatttttaagttttctaaactgtaatattttagtattatt

SEQ ID NO: 13414 - DNA, 315 bp, Homo sapiens
taggttcatgaatcaaagatgacttcatgggcagaagagcgtgaggggaatcccattcatggagcaaacgccggagaaataaaaccatgaggaaactttgagaggagaaggatatcatggacaaagagggatttgcaggaactattgcaggatcttgttcttcaatttctcctactcctgggccatgcgtgtttggcactgaaaggaggagattgacatcactgcagtgggaagcttcgagtggttataaaaaagtatattcttatatcaaagaaaaaaaggacagtaaaaaatagcagtataaaaaaaaaaaaa

SEQ ID NO: 13415 - DNA, 187 bp, Homo sapiens
  misc_feature (1)...(187): n = A,T,C or G
gcctagctactagccgcgcatagggacattgtcccggcccgcgcccccnctctgtattgacgctaatggagctgaagatttgaactatctgctcaacgcaactggattgagcaataggaaactgattagagactacgtgtaaaaagatattaaactaataaaaaataggagtttaaaaaaaaaaaaa

SEQ ID NO: 13416 - DNA, 190 bp, Homo sapiens
  misc_feature (1)...(190): n = A,T,C or G
ttgcctcttagtgttgagcttcctggtctccanaagagtgagaaataagtttctgttcttgacatcacctatttcatgttatttttgttacagcaactcaagttgactaagatacacttgtatgaaactcttttttcacaggctctagacttggataaaaactatgagggggtggggaaaaaaaaaaaaa

SEQ ID NO: 13417 - DNA, 850 bp, Homo sapiens
  misc_feature (1)...(850): n = A,T,C or G
gcgccgtcatccatacactgtccgtggggaagcagcgggggcgcttatagaggcgtctcacttgttgcccaggctggcacgtgaagccctgggctcaagcaattttcctgccttancctcctgagggtgggggactacaggtgcacacaactgcaccagctcanggccgtagttgatgagacacatgagagatccgagggtaattcttaaaaagcaaaggtaattaaacgaaagacaattggagaaattgagaagaagataaaaaagcattttttctgaggggagtaggggaacaatagtggagagaaaacaacaaaaaccgggcctcgttggcctgagcggggggaactctactggtcgcttccttttagtggggggatagttcatgacgctgggtcactgactccgtggcgttggggggtgcgggtggggcggaggggtatcacgtcactgaagggcggggcgagggcggtccccggagtcgggggcgggctcaggaggaaacatgtgtacatagggccgtagtgggcgcgtacccttaaaaggccgccgtgctggcgtgtggactaggttccgccctctggtggggcgtttagaatcggcgtctaatgttaaggtgggtaatcccgtacggctttaaacagccccagcgcgtttccgtgtgaagttcgtcgctacctcctctgattgcctccttgcctctatcggatgagcgcccagcttgttcctttaggaagaaacggcgacttctgattaggcacggtttgggtttggcattgtctgggggtggtggaggctaggagcggcgtggtcagctacgcgccggtgccaggtgagggggggtgtaggg

SEQ ID NO: 13418 - DNA, 1554 bp, Homo sapiens
  misc_feature (1)...(1554): n = A,T,C or G
ctctcacgtcatatgtctcgcgtgatctgccgntncactgacgtatgtacacacgnaacgttatataggaatcgtacgatcaagtnganatatgatcagaacgcgntnggtcgatctgcgtactgcgtactatgcgacgccatacgtgcggataatctacntaagagcgattaaacaatctatatnatatcggcgcgagcggtgtcggcgnaatgctacgtggatagcgtangatgtgacgagcttgtggcagatancgcaccgccgctatatagtgggtaatgacttatttcactctgtatctgcgccaggctactcgcgtcagacctaacgcgcgcacgaatgagcaatataacataaagngtacgacatatactgncgantacgcagtacaactgtaacggtatgatacatagcatncagatgcccgtcatncgcatgcgcctcatcgttgtgcgatccgcagcctcaatantaatacattatcgctgtaataccgcgcggacgccgcgcacgtgtgagtggtcggttatacctgatagatacgcagtgcgcgggtgaatnggataacgagggaggtatatcttcgtcgtctgtcgcgacgaatgatcaggagngcacacaccaatatacgatacgcaggcctgaggtgactacaatggacgtagagccacaactatgcgcaggtgatgtngcctaaactacgcgacgcgtcaaataacgcgtggcgcgcgagtggtggtgcgtagaataatctcgaactcgcgatgctgcgcaatcgcgantggatatatgtcgcgcgcggtgcgtgagtcggatagcaccatagaatctcccacagtntatgcgcgcggatatnatgcgcaatacatgtgatanctcgcatgcgnttactagaagtgtgaacgaganccaatccgacgcgtgggcggngggntttcctnccgcgcgcggatantangtacgcaccgcggggggctnattgatgggtataggtcgagaggacgacncatgagagacttccacaaagncccgaatgtntttgcgcgtncacacntatagagcctcgttcgcgtcgtaagtaataatatgagagattctcgaccagggtgtgtccacacacaccacttcgccgacccaggtctccgaggcgacctgtgagtgttgtgctaaacacaccatgtagaggcatcaccgacgggtgatatttcctttaacaacagccagagagtgtgaatttctacaccgcaacaccgctcatatctgtgtacanacatatctgtgatnacacaaacnaatagacagaacagaacacagacatataacacaagcagcagagtataagaatagaagtagtcganaagatacaacacacaagaatataagacagaacataananagatatggtgtccctncngtntgagtcataacaagcctgngtgcgnagcttgtttcngctgcgcacnngaacctctattctccactccactaacatcctcattcgctcacccgcagcagccaactgcatatctagaccacagatcatccaatct

SEQ ID NO: 13419 - DNA, 737 bp, Homo sapiens
accatgcccccctcacagtgttaggtgaaagagcaccaacaagtctttgagcaaaaaaaaagtatcctcaacaaatttgcctcaccaagtggtgacagattcatttgaaaggctggccactgtttgatatgaatccccagtcctgtgccagtatgtgtggtattgtccaagcgtccatacctgtgcaagtggggtttcctaggtcactcatggggcaacagggacatacaggccagggcaggagaaagaccacatcctctacaacggtaagataaggtgttcagcagctcactcaaatatgctcgaaaaaaggggagtagccataatccgcactgggagatgatgcccatttggggaagagcttcccatatggagtcagaaacggctaattctacatcagttccccagagttttgcctagaataatacaacccagtccaatcaagtcggtctctaaagaaagataggggcaaaatagctaatgtgcagaagggtgtgcctggccaaatggtgggggtaggcgcaggcagcacacgccattgactttgtgggttcctagttagaagacatgatttaagaggagcaggtccccggttcaaaactaagttggaagaaccaagatttgttcaatatacgcccgtcctcacacatgaatagccccatcataagcaagatcccctatcagagtgtatagagtcaatgaacaaacgaaggagcatcataaaaaaaaaaaaaaaa

SEQ ID NO: 13420 - DNA, 876 bp, Homo sapiens
  misc_feature (1)...(876): n = A,T,C or G
gtagggcaagggagggtggacataaggtaatggngnncccttcaggtccacgnaactaaatgatgtggtgagaacctgctgtggaaagctaccaccccagaatgaaaagagacnacactggggatggagctaaggtgatanaacanaactgggaaagacccccagcagagcccgagagacagcactaatggctttaacagcgaacctattcttgctactgagcttaaaaaaaaaaaacaaagtgaatctataaggagacagaagctctctccttggaagaagaataaagtgagtaccangagaaggaagaacattccaacaagttatgcaacaatgacactaggggtgacagaaagaagacatttaataaatctaccagggagccaggtgcagtggcctatcccttggatcccagggactaggggggctaaagcgagaggattacatgaggccaggagtttaagatcagcctggacaacacagaggaccccctttcaaaaaacaaagctgggtgtggggacatggctttttaggcccaactactccagaagcgtaaggggaggataaacacgctgaagcccgaaagttaaatggtgggagggatctatgagatctggcttgggggccctaaggaacaagaagggagatncccttttttaatataccgcgtttcaagagagagggggagaaaaacattcaccccggcggcttcttcactacttggaaagtaaaagggtccgaaagtgcttgtgcctgcgcgccagcaccaggtggggatggggaaaaaaattggtgccttttggtgcaaccttaggaacttgttggttttttgattgggagatcccgcgaagacaccgagggcggggaacacttctg

SEQ ID NO: 13421 - DNA, 732 bp, Homo sapiens
cagaaaaagtaagaccgtgccaccaagctaatcattaaggaccataaagtaacaaaaaagaggccaattaatgaatcggcaagtgaaacagttcgagtggcatattccgggtaaggcccagtgattagggggttagagacgtgaggattccataaggccagaagtttgagttcaagctggacaacacaacaagccccattctcaaaaaaacaaaactgggtgtggtgacaagcatctgtagtacaaaatcataagagaggataaagtgaggatagtcagcatgagaccaggagttcaatgctcgagtgatctatgatatgcaatgtggcctcagtgacagagtgagatcccatttctaaaatacagttttcaaaaagaaggaaagaaaaaaatctaccagtggctctataattacttcaaaataaaaagtttccaaaaatctttcacctgcagccagcacagtttgccatggcgacatacattcgctccttatgctgccacactcaggacattctgcttcttgatatggagtatctggtaagaaaaagaaggaaaggaaaaactttcagggaataaatgttggcatgataacatcatgattggcacaaatactatggtcagcagtaaacaaagtgcatcatctttgttaaacttacaaaatttgattaatccaaaacagtctgttttacacatgcaaataaatcagcactgaataaaaaaaaaaaaaaaaaa

SEQ ID NO: 13422 - DNA, 383 bp, Homo sapiens
  misc_feature (1)...(383): n = A,T,C or G
gaggaggcagggagatgntcagaactcacccaaggcagaaccccagggaagagcaggtgcggagaggaaccagccagggaacctctgaccaccatctagggttgccttcttttccttcacagcatggagccctcaggagaccacccactaggttgtctgtagctcacgtccttcttgtcttgaagcaaaacagacataaatatgaatttgcagttagccccttgaacctgggtcaattttttctgagaatgccaacttaatcgtcaacatcatgggcattatatcaaaatcgagatggatatttagtcaccaggaagacagtttgtctcatggtagaagtgcttattcaattaaaaattacattgtaatgaaaaaaaaaaaaa

SEQ ID NO: 13423 - DNA, 359 bp, Homo sapiens
gggcaaggatgatactgcacaccaagggaagaagaaggaagcagaagtccaagctcttcaccgagaacagacagagtacatgctagaatacttcataaatacttgccaaatgaacaagtgaatgaacaagtgaaatccaataacatttcagagaggaggtagaattttggataccctttgtcatgaataacagctcatttttgcacaaggccaaatcgaagaaaaataacattcctccaaacatggtgattttgtaaaattctgagtaggaaaaaaaatgtttaaaacaattttacaatctttggaaccaagtgaaagtacacaaggtatgaaacatgttatcaataaaaaaaaaaaaa

SEQ ID NO: 13424 - DNA, 841 bp, Homo sapiens
  misc_feature (1)...(841): n = A,T,C or G
gaaagaggagaagaaacagtgttgtagatgagagaagcggcgggggggcgctcnagtagnacaatatatgaatgttgctgcaaaggtgcgtggaccaccgacacttggagaccataaccaccaggctctcacactgggaaagggggcaagtaagcagtaaatagagaatagggagatggcaaaaccatccatgtgctttagaaagattactccagcacacttaagcatgatgaagaaagaaagacaggaaggtaaaaagatttacccagagaccagatttcttttcctataaaggggggggataccaacgaggtgcccttgcttcaccactcacatttgtcccggtttttaaagacaatcatatacacagataaaggaatgctgaaatggacactcacatgttgacaaacgtcaactgttaaaatagctgggcaatatgtatgaaaaatcttgttgattcttgtcttaggaatgaatatgatctctgtcagatgttgggattctatcttaagaattaatttctggaaaataaaccaaccatttttcagttaaaaaaaagtatacaactattatcaaaaatcattggttatgaccagccacatattgtaaatactataaatgcaatatgtttcgatttgaaaacaaaaaaaaaaatgggccccttggcctcagcggtggacctttgggaccggttcctttgggagagggttaatgcctgagcctgggtcactgactcgcttggcttcgggtagtcgggttgggggaaggcggataagcttaccaaagggggtatacggttttcccagaattgggggataccgagagaaaacattggagcaag

SEQ ID NO: 13425 - DNA, 110 bp, Homo sapiens
ctttaggaaaagcaaaataccggcacatagccatgattgaagacgtgtaccttcatctgagaagcatctgcaatattctggtcggtattgaactatatccaatttttaaa

SEQ ID NO: 13426 - DNA, 949 bp, Homo sapiens
  misc_feature (1)...(949): n = A,T,C or G
atgggagaggacgagcgnaacgcggncaggagcccgaggcccgagggcgncggggttcagcctcccacggacccccccaaatattttcatctattatattcgagtcttatgaaattaccaatttttacctcaaaatccgggggtctgggggtttaatatacttcaacccatnactccctcggccttctcttctccaaaactgggtgggctttcatctccatctctttcctcctccccccgagatgcccacctcccactgtgggggagtgggctgaattaccccagtggcttggcggaggggggggtgcgcatgtggagagcagctctgcgcgctaaaaagccaaaaaaccctccgtggattgtgtggggatcgcgcgagccctaaggcgctgagcgcccgccaagcaacctgcctgcacccttgctggggaaggagagagcgccgcgcacccgccgccgacaggagcgacctagttcggaatggacggggcgtgcacccttcttgctggggcttcgggccggggggagcggggccgccccagacccaagagacccgcgggggcccccggcgcgcgcgaggagcccccggcggccggcccgggtggcggggcgggccagcggcccccccgctgcaccccccgggggagggcgcggggctgggcgcccccgccggcgacctgggcgggcgcgcccacgcccccgccggccccgagagagagcccgggcggctttctggcgcccctggctggcgcggcgcggaagggccggcgctcgagccccgtgcgcccccccactctgcggggtcacggtggccgcgccagcccncgtccctgcgcgccacccgcccgcccgcgcgccggcgagggccgcccgccaccacacgcccaccccgcccccgccctcgctcccagcgaagggccgcgggcgccggcgcgggccggggcgggcg

SEQ ID NO: 13427 - DNA, 799 bp, Homo sapiens
  misc_feature (1)...(799): n = A,T,C or G
ccctcttngagggactacatcacgaagccattctaaaggggtgtaaactcaacacttgattaattgggcctaatanaaatctacaaaatacgccagggggggccaaaaaacatacattttttttatctncgcacanaacatatttcaaaagtgagcacatgctcagccataaaggagggctcaataaattcaaaataattggaatcataccaaccatactctcagaacatagggggataaaagggggggggggtatcaagaacatgtctcanaaccaaacatgggaattaaacaacttggtcctggatgacttttgggtaaacaacaaaattaagggagaaataaagaaattctttggaataagggggaacaaatatacaggacaggaaaaatctctgggatgcagcaaaagtaggggtaagaggaaagggtatggggctaaatgggtatatcaaaaaggtagaaatatatcaaattaacgatctaacatcacacctagagggactanaaaaacaagaacaaactggcctcaaagctancagaagaaaggggatagctaaaatcagagcagaactggatgagattgggaccccaaaatgcatacaaagaatcaaccaaaccaaaattttggctttngggaggggaagagnagtgagaaaccactagctgtattaacaaacaaaaaaaaaaatcgggctcggtgggctcangcggggggctctncgggcggttccttgaggagggggaatgatgagcctcggtcactgggtcgctggcctcgggcggtcgggtggggaag

SEQ ID NO: 13428 - DNA, 1406 bp, Homo sapiens; identical to SEQ ID NO: 7426
  misc_feature (1)...(1406): n = A,T,C or G

SEQ ID NO: 13429 - DNA, 993 bp, Homo sapiens
  misc_feature (1)...(993): n = A,T,C or G
cctaacatgttcctctgtccccctccgggtggacagggctcactcctgggggaactaaaccctcccactctccttaactcacaagcgtactggctggctccaacctaccaanntaccctcgaaataccacaacccccccccccccctggctggggactaatattttaaggtaaaaacaaggtgctccactatgtgtacccccaacgtaggaataaatctacttatctattaattaacctattctcttgaaaaacacaagagtctacccttccttttctcgccgcggggcgggggacccaccccacggcggggggccccccaaaaaaaaaaacaaaccaaaaaaacgctccgcgcccaccgcgggcctcctcctcagacccccacaccgccacccccaccaaccaattaccaacacagagcgaccgagcaacaaacagcagccacccccacccggccaagcacaccaaacaacgacacaaaggaaagaccacaccacagcgaccccacgacgacaaaaagaactaaacaacaacggaagaacgacacaaccacaaccatacaaaaaccacaataaaccggcagaaccccaaagcaaaaccaaaccacaacacgacaccaccccaccagccccgaccagcacccaatccagcgcgccccacaccaccacacacaaaccgccacacaaccccccacccaccccacacccgccccaccaccctcccccgcgcaccccacgcacgagcagccccacgcacataccaacgccaccaaacacgaacaaacaacgcggccgaccccaaacagagcagaggccacacaccccagacacccacgacaccacacacccaacccggcacgcgcccaccccgcacacaacagaccaccaggctacgagacaccgacgnagaccgcataactccaaacaacgccacagatcaccacccacacgtagaagcaagacgaaacagcaacaacaaagccgacgaaacaccg

SEQ ID NO: 13430 - DNA, 1770 bp, Homo sapiens
  misc_feature (1)...(1770): n = A,T,C or G
ttttnnnnnnnnnnnttttnnnnnnnnnnnnnnnnnnnnnnnnnnnnnnnnnnnnnnnnnnttttnnttaattnntnnnnnnnnnnnnnaaggtaannnnnnntnnnnnnnnnnnnnnnnnnnnnnnnnnnnnnnnnnnnnnnnnnnntnnntttnnnatnnnnncnnnnnnnnnnncannnannnntnnnnangtccacanncntnattcgccgatngatanntactgntcatnaccgacgnnnannatagnntagaanctcgannanntcncgcncgccgacacnantcacnacgatgcgancccgncanctcaacgcaatagnctntgtatattacatccnannaatcactngngaacntcactccncatanacccgtacagcacgctcaaagacagcaccgcgtactatgcgatcatacgcgngttgtctgcacacgctaaatctccggngtcgagcgtgctactatcgactactctgactaacgcgcgctgcgagngcccacgngcgacgcacgcgcgccancttactatcttgacgacgcgtagtgacacantcgtngatcatctcacgtatcgcgatctgactntcatagcgcagancagctccgtgcgtctctcntntnctcatncatcgtgctccctcatccctctactactncacaccgcgccgcacctcgtcatcnctcacatacgcncactanattcaagatcctcaccgcctatgtatggagtganntacncttgacacgacacggagatataccacgtagccggcacggcggtgacngtgagtgatatgangagttgtagaacggcacacggcagcaggacggaaggcgcagccgntgtgtgtgaatantgtaacancagaatattagagagagatcacacttcacgagctccgacggcaagatgatgcgtcgacgactgctgccgacgtgtaatatactcatacgatatgtgcactcaagcgatgtntatgtcaccacntatgaccatccagaacgaagcgctctacaacgacagctgacgctgcgnacagcatatgccctacttattntacctcagtatatctgcggacaggcaagagtatcagacacactgcgcattcgtgatcataagcgttncanacatactgagatcttagtactagctactatacatatcaatatcnancatgcataataacatagcacantacctcatatcgatcgcataacgtgtaacaacangtananttagtaatatcaagtacgagcatacttccgatccactacactagagtcactatctactccagatcancgatcagcgcnctcgctacagcgtagctccagcacactgatacactcactcacacgtggttancacgtagacacagcccnccacgcactatgtgtcgatccgaacactcgctcgaccgcgtacattatatctcatctaatagtgtatcaccacatgacacgagcgcacgccatcgagtcagagccatgcgtgatnctctgcaatgccgatacgccactcactctcaatacaccagccgactaggtcaacgtgcgtgagatgacaacacgtcactcgcacatacatgaccaacacgtacagtcgaacgttgacggcgccantattggcctccgcgacgcaanaaccgagagaacgcgttgtaaacatggcaaccacacaccacgacagtacatcacatactacgtagggactgcctgtagagaagtgagtgtgagtangtgcctacaaagacttgtcgactt

SEQ ID NO: 13431 - DNA, 1280 bp, Homo sapiens
  misc_feature (1)...(1280): n = A,T,C or G
ggggaagggaggcagggggccgggcccgagaaggagaaggcgttacagaacttgatncaccacgactttacctcaacaacctcancacgttccacgggatgatgggcaccaaccacactctcccacnncgaccaggactggggggcgtttaaataaacacaccctcaacacacctacctggctcangccgcgcaccagcagtaccagcgcggagccaagtagtcctcagaccaaactgtacactgggccgcaaaccttcgtcaggcctacctagattatagctgtggggctgcctggccctctccaacactgagaatggggctccgcagggggagggtnggggcccctatcaaccgccnnacccaggcgaaatacctgtcactatagctggggaaggtacccatggagcgccctccctgcgccaagggggggccctaattcctgtatggcgcgcgctagaccgcggcctccccctgttaggcgaaagaggcctaataacgcccagacgctcgggacgcctcgcgtgtacatgcgacactaaacgaagcacgcgctngccctccgtaaccgacccacaatctgacacctacgtacgccgcgagcctgagcaccttatgtcgcgcgcgcctcgccgcacggaatcaacacctccgcaccgcacgctcagttcgcctcaacgcggnggagcatgtcgcgacacgacagaggctnacgatcacgcntctgtacanacaacgccaccgaacgcgctcntcgttgtatcatgggagtagctgcgatctagggcgtcggacgtgggngatgaacgcgtcgagnaaccgagatcaaaggtgtggggcgtcgccggagacgcccacagaggacacccgccgacagcgagaacagggtgcctggccgccgcgtccgcctgggttggtgaacaggtcggaagagcacgcgctgccatcgaggctgaggccgtggggggagacgcgctcgcgccaccggcggcggacaacgacacggcgagggcggcggcgcgcgacgccgtcgaaggaccgcaccgcctgnggcgcgagacngcgaccgcagaagacgacgcaaagggggggagagacagcgangagccgtcgcgagacgttgagcgcggtgtgacgtcgcacgagaccccgacgcacgccgaggacgcaccccncgcgcncccggccaccgccgcgcgcgcgggcgtccggcccgcggcgcagtcgacggcgccgggtccgcggcgcgcggggcnanagacggcgcaggcgcgcgagcgg

SEQ ID NO: 13432 - DNA, 751 bp, Homo sapiens
  misc_feature (1)...(751): n = A,T,C or G
cctacgagctatagtcagcagactggnacctcaacaacctcagcagttccagggatatggccagcaaccaacttcccaggcaccagctcctgccttttctggtcagcctcaacaactgcctgctcagccgccacagcagtaccaggcgagcaagtatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattctaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgactcgactttctagcttcccttgtccggaggatattaaaatgctagggtgaggtttagccatcttacttggctttttactattaacatgatgtactaaagtagagcc

SEQ ID NO: 13433 - DNA, 756 bp, Homo sapiens
tagggtgctggtgaagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacatagagacaagtaacctcaattgtcaacagattgttaatgccccatgtgcaccatatggcaggggttgtggacaacagtgtctagagtcagagcagactcttcttaaataagggaaagggcactttctaagaggggcagctgatactcaacttcagcttagtgttgacaacgcctctggttttgtaagggaaggcagaagtttggatatttattgaaacccttcaatgtttatgtatcaacaactaatttttttttaaatgtaaacaccacaggggcatggtggctcacccctgtaataccaccactttgggaagaaggcagaagaattgcttgagcccacatgggaaa

SEQ ID NO: 13434 - DNA, 840 bp, Homo sapiens
tctcatacttatcatttactcaaacttcttaacactctagtgtatactcccccctaaagatctggtggctctatctaaacacaaacctcactccccctctccctaaaccctttaaaaaaaactatatactcaatacactagttagttaacgagttaattcctctgtatacatcttctacctaaaagctccatactccttataagaaacaccgggaaaccccccaccttcactctccgaaaaaaaatttctaaactttcttctctgcctttttacccccaaaattctcaaaccttcacaataagcaatcacacccataaattcctccctttaacctccagccccttaacttaactaaacaaaactacacactcaaaaaacaccctcaacattccacaccccaccaaaaaaaaaaaaccctcttccaactaaacaaaacacactctaacacaaacaaaacaacacacccccacgcaccaaacacaccccccgacaaaatcaaacacaaccccacacccaccacacaacttgcaccaacgcccaccacccactccacaaccccctcccacccccaacacacccaacacatcacaactcacacaccaaccacccacacacaccccaacacacccacaatatccctccccacacccactaccacaacccaccactcacacaaccaactcccccactcacaacaccacccacaccccacacaccgcacacctcccaccaaaacacaaccaccccaacacacacaaccacccccacacccccccaccaccacaaaacccaacagacccaccaacacacaaacacaaacacacacacccacccgaccc

SEQ ID NO: 13435 - DNA, 791 bp, Homo sapiens
  misc_feature (1)...(791): n = A,T,C or G
cctagggnagcatcaactttcgcatcttagtccttctccatttcctgaggcttcttcaggctctggtgtgtggtccagcctggagaatgtctcgctctcctctcgagaggaacgtggctgcggctctgcgtggaccgtttggcagaggctcatatgctggatccactggttggttcacggggttcattcctgtctgttgatcttctacctagtggctccatcactcattcaaggtaggaccagtgaagtcaccaacgttcactgtcagattgtctatttctccctttagttctgtcgttttttacgttgtgtattttggggctctggtgttaggcgatgtgtgtccatatatttctccctttaattctgtccgtttttactttgcatattttgggctctggtgttgggtgatatgtgtccatatttgttacgtcttgggagggattgacctttatgattatataaaatgacctttaggtgtctcaaacaacgacttttggcttaaagtctattttgtctgcattcagccggccaatgcaccttttgattatgggttacacggattcgtctttttccaccttttgcccgatggacctctgacgcggtctttgtctggggggaagccgcattctgtcgtccaggagcgttatttctgtctgtggtggtgagcgccattcccgcgccccggaaggttgtttcttcatatttgggagagtcgcatagtgcggtcccaggctatccttcatgcgtttggcttagagatccttccacagctctagaaatataaactg

SEQ ID NO: 13436 - DNA, 896 bp, Homo sapiens
  misc_feature (1)...(896): n = A,T,C or G
ccccctctacctacaaagatggcacctggaaacttgttaaaaatggggaggagcattttattcaaaaccctggcaggggggggccacaactattnnaataaaanttcaccttcaactcaccttccctnaaaccaaaaccgaggagggattttataaacggctcagggggtgggcactccttgctcaccaaaaaccagcaaacaaaaattggaaaccaaaaccctattttcttggtgagagggggggggaccttccctccgcaaaggggagtatcagggaaacaccctttaggatgccaaggaggagaccccctctatnctgcgcatgggcaaacagtggctggctgggcacccacagggaaacagaggtcaacgggagacgggccctcgtatggggttcctggccatcgcctacagaaagaatgattctcccttttggctctctttactttttaccctatagtctaggcttataccattataagaatggggtgccatggacctaaaatgaggtgcacatnctaacattctacctacacaaaggaggtccccttccttgggccctccttgctgagtgccacattactaacattttggggtggaaagtgccaaagggggccaagcgtgggcttttctttccccgcgaaacccttggggggcgccccggtgaattgtaaagagggcgtggtatgctgtctcgaaatcctcctccggggtcgctccaggggggcgcgaaaaaaaacaacatgctgccctcctctctcccacaaagggagaacccccacaaggcgagacgcaccccccgcaaggaaggcggggggaaattcccttacttcccgggcccggcggccctttaggggagttgcggagagacccgggactaacgaccggcgcctc

SEQ ID NO: 13437 - DNA, 775 bp, Homo sapiens
atggcccaacacaaactattaaaaagaaagattgcactggaaacttgttaaaaatggcaaggaagattttattcaagaccattgcaattagggacaaagactattggaataaaagttgagcttgaactcaacttccctgaaacaaaaagcaggaggattttataaatgctcaggtgtggacatcttgctcagaaaaacaagaaacaaaaattgaaacaaaacctatggctggtgaggaaaattgacttcctggcaaagtgatatcaggaaacccatttgtctgcaaaaggaaacaactctatctgcatggaaaagatgtctgctgtaaccacaggaaaagagtcaagggaatgtccatgaatggattctgcaatgctacagaagaatattggctttgggtcttgtatttgtacctatatctagctgatacattatagaatttggatgcatgactaaaatgagcgacatctaaatgctactacataatgacctcatgcgagcccatattctgataccaattatttcattttgttggatattgcagtatgtcgcatgtttattgctttttacccatatctttctagtttaaccgtctcaaacttatgtagctttacatatttttatacaattagtataatatttgttattgatgtaatttaatttctatttgtagttgctatcttgacaatggtgactctttttatcagttttattatttttttgaaacttttataaattctgctatcttatttttcatagctccctttgaatttat

SEQ ID NO: 13438 - DNA, 780 bp, Homo sapiens
ctagggagacagttaactgtttaaaagccacaagagctgtatggaatgcaagggaccaggggccaagaactgcaccttgggccggggggacctggtgctgcacatggacaacagccactgcctccactgctgcaacacctctgatccccccagtgcccaggagtgctgtgactgccaggacaccacggacgaatgcatccttcgaacaagcaagggtaggcctgtttctgagcatgggggggacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccaggaaacaggcacttccccaccaacaccaccatgcactttcagggctggctgggagcatcaactgtttttgggtttatccccacccagggtgatgtgggagttttctatttgggttctttaaccatgatcccaccagagatggaagaatgagaaatactttgttcttcttggggggtaaacctata

SEQ ID NO: 13439 - DNA, 999 bp, Homo sapiens
  misc_feature (1)...(999): n = A,T,C or G
taactcttctataggccactgcacctaatccagagagtaaggtcttctatctcaaaataaanngtaatgacttgcgggacctacctaaacttnncctctcctcactaatcccaaaaccacaccataccataactctcccacacgaggccttacccaggaggggactttgagtataaggcaaagaacacaggagtcccaanccccacaacatcccgacatcccgcgccttgaggggctgtacgtgctgtaacctctttnctggtgtgggggagctatgnagcatctgcttaagtaacccccngaggcttaaaactgcgcccactaagcgctcggcgggcttgttaggggagggccccttacgtagaaacttccagtaccctggagatgaaggacctcataaccaaagcaccggcacccctcactaactggccatgtggctctacagagacaaccctaaccccctgtgggaccctcagaacaggtcgcacggaggaaaaattgggcatgngcgngcacaaaggcggcgtcgaaaaccctaaattcccctaccaggggggggcattccttcctttgccttccaagaaagccctttttcaacagcatcctcccttgtccttatcacccactggggggctgcctcattaccgagagaagcccccttttcttgtggagtggggactgcaactcgggtattaggatgtctcgcacactccgcacgctctcgggaaacacgcacaccgcctctccgtgcgccagcccggccccggccccttcctggcggcgcccgcgccgcccgggacgaagagcggcccagcacggccgcagttcgctcgcgaaaccgagaccgcgcttccgaaaacactctttgataagaggacacaacaaaggtgacctggcgtgtctacacgacgcacgccccgcacccccagccccagccgctcgccgcgcacgcctccgcggcgaagacccgacccagcgacgtcggcccgccgcgtagcg

SEQ ID NO: 13440 - DNA, 758 bp, Homo sapiens
aggaattgttggataaatatttaatagccaatgcaactaatccagagagtaaggtcttctatctgaaaatgaagggtaattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaacggcttttggtgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatctaaacataagtaactcccaaacacttatgtagaggactaaaaatgtatctggtatttaagtatctgaaccagtctgcagt

SEQ ID NO: 13441 - DNA, 1178 bp, Homo sapiens
  misc_feature (1)...(1178): n = A,T,C or G
ggggggcggtggcgtgcgggccgcccaccgcgcggagcgcgggcgacccgcctccacctagcacgacctctggagtcttggaggaccccctcccctaccccttctggagtcgcgtgtttccgttancaggcggccactacccgtacgacgcgggggggtggaaactacaacatncancactacccttccccaggacctgtctccgggataaagacccgcccctgggcccccatggcggnccgcgatctctcggcccggaggggaccctttccctgtgcctgggcccctcggcctagatcccaggggggactcgggcggacccttcgtgcgctcgctgtgggggggcgcggtacggatccctcgccgtgggcctctaataaaaaaaataaccaaaagaccctgccttcctccgtgctgcaacgccccgacgccaggcgcgagggccgcggcctgttctcccgctcgttcgcggccggcgcctcttccccccgccgcgcgccctcgtcggctcttcggggtggttcgcgcctggtgtgcgcgcgcggcacggcggcgcgcgctgcgcccgcggtcgcgcggccgtcncccgcgctccggcgcgggcccgcggcgcccccccgcgcgccgcgccgcctccgcccgcaccagccgccgcgcgcccccctggccgcgcgcccgccggccacggcggcgcggcgtggcgcggctcgctcgaccgctctcgccccgccggacgcgtagtccctgcctgtggcgtgtggcgcgcgggcgccgggcgcgtagcgtcatcgcgcgccccgccggcgcgcgtccgagcgacggatggcgcggtgcgccgccgtgcgcggttggctgcgcggcgcgcgcacgcctacctctgctggcggcgcggccgcgcgccgccgcggncgccgccgcgcgcgcgcgcgggcggcnctagcgcgtacgcgcgcccgcgcgccacgcccgcgcccggccgccgcgcccacttctgactcccctcgcgagcccctcggtgcgcgcctgcgcgccggcgacgcccggcgcgcagggcggctggccagcngctgtgtgagagcgcatccgctgcgtcccgacgcggcccacacgccgccatcgggcgccacggcgtcgcgcgccgggcgcgtgcgcgaggcgcccgcgcccgccccgccgcg

SEQ ID NO: 13442 - DNA, 477 bp, Homo sapiens
  misc_feature (1)...(477): n = A,T,C or G
aaagaaaagggaagagnaggaangaaggggtggggggnaagggaagatgaggagggnnannaagagtttaggtgcagaagctgtgaatatggnaggaccaactgcataccattgtaaatgggtgtttggttagagcggtcagaagctacaaagcaggcatgaactacagatgagaataacttaagagacattctgggataaaacagacaatgaccgaatggatgcagatgctggagagaaggacatttccttcactggtcctgaactaatcccagcaaactgaggtgacttcataaatgcttactcttccactggaataatcacatgacattgttattggattactttggcaattttcatttttttaaagcccaaacagaagaggaagatactttatgaattttagagtaatatattactgtgtccacttctgttattaaataatggactgtttggtgactaagaaaaaaaaaaaaa

SEQ ID NO: 13443 - DNA, 842 bp, Homo sapiens
  misc_feature (1)...(842): n = A,T,C or G
cctacaagctacagatcaaaccaactctaangaaactccccctcacgaccacggtaaaaaaaaggaaccttaggctnaccaaagacatcgctgaactataaaaaatnnctttccacatccccaccctcccttctcctnaacctntctctccctaccctcttctcanctccactctaaantcccttcctctcctactcacctctataaantctttcctttccccaccactanccctctttctgtgtgggtggcaaacctttggncccccaaaaaaaacccccaaaaatcccccctcaaaccctgtgccttaaacattttttctttcttaacattcttatcacaacttttccctaataaaattcaatccttttaacaaatccttccccttataccaattatttgatcccatcccttttgaccctctaaaaaatccactttcctctctctctttctctctctctagaaccaccgcccccgccatctcccccctcctctaaaaaaccccaaacactccactcattccaaaatcctttttcccttccccccctttccctnccatacgaatcacccaacaaaaaacaactctcaacaccccccccctcctcttaaaaatcacaccacttcaccccacaccccctccacccccttcaaacaaaaaaacacccccccccctcccccccaccaagaaaactcctccccccctctcccctttaacacaccccaaccccataaccccccctacctcgcctctcctaccttataccttacaccacccccaccaccccaacacccaccccacccacacccctccgccttccccccacacacctacacccccacaa

SEQ ID NO: 13444 - DNA, 920 bp, Homo sapiens
gcaaggcgcggcgtgtgtagccgaacgagcagaaaaaaaaaaaaagacttgatggacaacatgtgtggtgcctctagccagcctacaagacgctccctgcagaccttgacaccatccttctctaccccttggggtctcgccctcatcaaagaagggaaggatctgctgccagccacgtgagccttgctaatagttgattatttgccttcatgcacaatagaaatattactcccattctgaaaaaaaaagataaaggcacgagagatagcaacgtctttttttttagaaaggggggggcccacctattttctttgtcggataaaaagaaggtagcagtgttcgctcaatgcaaaggatactgatctgtagtgatggccgttctggatagagtctttcgccgccggcgcccacacagtcactaatgtgaacaaactctagtctacaccagaagtaaataagcttttactatggggttaacatagagtcgtcttcgccttacacccctctcgctcccgcgcgccacaggcgatatgtgcggcgccgcatccagtgacgtgagcctcaggcgcggactatgaccgtcataggcctcatctcacgcatctatatcattgtataagtctttgacagagcagtcgctgctggggccgccttccagtcatccgctgtgctctccggagttcgtgtggactgctggtgagacttacggcgtagattgtgtacgggtgagtttgtgtggtgcgtgagtatcggtgagctgagagatggctcggcgggataggggatcgagcatccgacatgatgctagttgttcttcttttcgcctacgctctttgaaaagaaagggagggaggacgggttgaaattgaaaaggactcgtaccacaatatggtgtgaggcgagcacagaacaccccggcg

SEQ ID NO: 13445 - DNA, 1494 bp, Homo sapiens
  misc_feature (1)...(1494): n = A,T,C or G
ggtaggtganaaaagtgaaanntatggnnaagagagngnnnagagtgagaatgannantgnntagagaggtgagattgaangagagagnannaannannannaagnttttnataggggaggacaccaagggaagaaagcgagcgtgtgttaagggcgcgacgcctaggnnnacacgtcttncattgnngcagtgaacgcaaggagatacgcgatatgcaccgatagtgatggatactgaganaagcatcgcgagaggtagtnncatagcataagagagagccggtggtacttgatgttgttcgacgaagctcacctccccaaacacgaatgacagcacacgacggagggngcnagcgacggcnacatgcgcgagtagcaggcagtatntcttactctaacatgtcgccgtntgccacaggcgagccgtatatctgtacaggagactcccgatacgacgactctctgtcatctctcagttcacctgtncagacctcctgtcctcgttgtgtagcgtgagttacatnnncacctcctctccncaagtaatggaatacacntagctgtcgcgatacagtgtatgtgtagttcnnncntgttgtattgatgagagtttttctttatatnttatgtactgtttctctactttgaatatcagtgttctcggttgtgagcgcgtgncnatactggattgacaatagtccnagacggtcncacagctgtcncactctgtttgtcgtgaggacatacataacacttctaggactatccacagacgagcacatatgccacgcgactatcttcgcacaggcnntcgcgcggagtcatgcagcggcgcaactacgcgcggcgttcgcgcgagagcagtgacacncgctcccctctctaatgtatgtggcatcntntctatgagactagttatgtaggtcntcgcnctcatcattcacatcatcgtcactggcgtgcccacagtccgtccacagcttagtatcatggtacgctgacactcctgtctatnnnagaccaatagtgtgcacactcgcgcacactcagcgtgctcgcccagcgtgtgtgtctcacggtctcagatatccncctcgtgtagggcgntcacgntagagngtatcctnatctttactgtgtgtctncnctantgtgnccaccgcgagtgttcatnntataagtgtacgcacaaatcgatgttnagcgagntgatgaggggtcntaacagtgcncacagactaattatgtgtncgatnctatgatcacatcntcgtcgcatccccaccgatcaggcnctatcgtgacacttcntctgcgagcgcgcgcagtagcgcaccgcagccggacgacagatccgtcncgcgacctagagtagatacacagatacngacaccgctttgtattccncgcaccacgctgtcgtctccgcgtcgcacgatccgactctgtatgtgtgtgctccgagttgtatcacgatattcgtaattatgtat

SEQ ID NO: 13446 - DNA, 1476 bp, Homo sapiens
  misc_feature (1)...(1476): n = A,T,C or G
tgacgccccccgcgcgtcacctcgtccagccgggggaggaggaagggnggggggctttagtagccgacaactcgacanactgttcatcnctccctgacgcggctttattctcggggattatgggcaccttattactcatgcgtctttctgtcganaacgtgtgtggggacttaacacatatncaactctcactctcttctacagtgtgatggatcgaatcgaaggaatggcctcgggaggacctgccgaaccttgggataagtaatttcatgtccatctatgatatctttgtaacaaatcgtggtgttgctccttggctatcgacattcgggacaatcacnctcatacacgcgagaacgtgggggtggtgggaactncanccctagtctagagtcctccgatcacacatatagacacacagaacacatancatctcgcgcgcactgcgcccagccnggcctgtgacntngcggcgacctgagaactgatgagtcgccccgagcgccgcctcgcgagtgtgtcgcgtcgctgactgtactcancaccagtgcgcacggtcgagcgaccagcgagccgtngcccgtagctggcccgtctcgggcctgggcgcgcgtctcgagaaagattagagctgaactgtgtcgcgcgcgctctagactgcgcgccctgtgccgcgcactgtgtggtgatagagagangcgacgagccagcagtngcgtcgaggagacgcgacccgcgntgacatacgtctgctgcgcacgctaacngcgccacgagctgactgagccgcctgtgtcgcgcgcggcgacngctcgcacgtcgcgcgtgccgcgctactcaaccngcacttgcacccgaccgcncgtcgtgtcacgcgcgctctgacggngcgcgcgcagcngatcgctcggtgtgtgcccgcggcagtgggtacgcgggtccgacggcgctcgctgcggcgacctcngngcggcccccactatcgtngnngcgnggcgtgcagcgcgctgtcttccttgcgccttctctctgacgcagacgcagcggcgtgcaacgcngacgctacgtgctctgccgcccccnctgcgcgcgacaagcacgccactctggcgagtgcgatcgcgngcgcgccgcgctgcgcgcgtgcntgtgngccctggngtgctcgtgtgcggctntgagcgcgagtcgagcgcgcgtgcgtctcctctctgcgcgagtcagcgagctcggcgcggcaggcgcgngcgcgctctcagcgcgtgcgtgtgtcggcgagcacacgcggctcgcgtgtgccactggtaccagcgacgnactcctcccgcgctacggcacgnangtcgcgagtgccgttcctctctagcaacgcgcatcacgggtcganctcgcactctngcngcagcgctggactcctntcagctnatatcgctatccgtagcgccgcgtcgagctacacagcttcgcacgcgccgt

SEQ ID NO: 13447 - DNA, 790 bp, Homo sapiens
  misc_feature (1)...(790): n = A,T,C or G
aataaagaaaagaagaggaatgtgggaaaaagtgaaaaaaagagggnaaaaagattcaaaccaaactgaaaaatggcatcctacctgggggctttattctgggattatgggcacttattatcatggttttcttcaaaacttatggaattaagcatatgaagttcatcttttagagttgatgatgaatgaagaatgcttggaggactgcaaacttggataataattaatgttattatatatttttaaaaatgtgtctctcttgcatgaattggaaataactataaggaaactaaattcgaatcaactatcaattgcataacttagagaaaaataattgatattgcatctgattaatggcgctaaatatatgccagtgtacgtatcctgagcattatataagctaatgaaactcatataaaaatacattgtctggagccgaaaacaccagattgccctgatgtcgtagaactcagtaaaattaaacaattcttatcaccatcatttattactccctccccctacctttattttttatttacttttnctttcttgagtacattatagcccacttgcctatttctataattttcaaatatccctttttatatgaatcctgtaatgttttttttcctgccaatcatgatccctagctaaaaatcccacaaggactatgttttataccgctatcagtcgacgttgagaggcctattcttattccaaattttttgtcatctacaatagtcgattcatgctccttataatattatatatgataatatcattattaata

SEQ ID NO: 13448 - DNA, 934 bp, Homo sapiens
  misc_feature (1)...(934): n = A,T,C or G
gggtgaggtgatagnaggggggaagtaggngagaaattgagatagagataagnnaagagttattggtnaggaacatgaatattctgagaacaagaaaagacatttattataacagtaatgcactgcttagaaatgagagagtgaagattagcttaacacagagttacatggttctgaatgcctccttgtccctccacacaccaatatcaactgaatttgttgtgttttcttcccagtgcactcccagtacacatgtccgatgttttgtgtctttggttcccttttgcactgcgtttgtgataaggtaatgaggtcaatttaatttccgttgacctagttaattatccnctcatttttctgtatagtcgtttatgaagagtaataggtgntttgtgttgtgttaatagagtgtatgtgtatatagtaaattaatagatncctatgatgtagtggngtatatatgtagccatagtgtcgttatcncagtcgcgatgctgtgcctagaagaccaactctttttagttcggattgttatctgtggtcctgttttgtattttagtgtgttctttatattatttcatgatgtgttctgttataaatccctatctctcatttattgatttacttttatattcttcatgtttcgtgtcaggaatgttccagttatgccattagtagtgcattttttnccattgtaagccatttattccatactttcctctttatttcctattatccctcagtcctaggtattgtttnaaatttagaatagagaatangacaatacgtatggtgctttagaatataattatatttagtttaaaattaatccaattcaacaataatccaataatagttcctgttatttatattttatatcatagtctctcgtgtagtcttgagatatggtgtctatatgccctattgtattttt

SEQ ID NO: 13449 - DNA, 716 bp, Homo sapiens
  misc_feature (1)...(716): n = A,T,C or G
ggatttaaggcttgtgccggcgataacgggcgagttggcatgaagagaggcagagatggattaattatgcagagaacatggaaattctgcttatcatcggctagcaaaggagcccggctcacataatcagcaaacgaagggagaggaaaaaataacaatgcaatggcaccttccagcccatcatcattattttttctacccccttgtaattaaaaaataacatacacttatagccctatctcctgtgcaggcaaggagtggatgtccacaaaataattgcactgggatattagagctggcgacacgggctgaccattccggcttgctctactgctcaccctatgtttctcttttggcctctcaggcacttagcttgtgaacccagtccaaatcagagagacgttttatgtgacattcaagctcggcttccaaaaatgccaaattggtaccttatcatgatccaagcaaacatacatacatatatgataaatattgggagggctgactctataggaggctttggaactgatcactctgtggactatttggtttatttcatattgtacaaatcangttcaaatatactatattttttaaaatggatggataaaattggtggtatatcatactgttaatatattattgttcaattatttatcttcctatttgtatttttatattttttactgattttcacattgcccaataatttttat

SEQ ID NO: 13450 - DNA, 864 bp, Homo sapiens
  misc_feature (1)...(864): n = A,T,C or G
caaggcacactacgccccctaagtgaaaagaaannaaacctagctgcacgagcctggaatttttatctttatattgagtcttatgaaattaccaatttttaggtcaaaatggcttagttcgggggtgtcatatgcttcaacccatgactccctgggccttctcttctgcaggactgtatgtgctttcatctccatctctttcctcctccccccaaagatgcccacatcccgctctgtagaatgtatgaattaccacagtgcatggcaagatggggggggcacatgtgagttaagttatgggcctaaaaattgagagactatcctggattttctggggatgcctaacctaatccatgagccctcacaaagaaccggctgcagctatctgggaaaagaagagatggcacaattaccgcgcaaggaaaaaataatgggaacgggggggacggccgcatcatgggctggctctgaacctggggggaggaacggcccgaaaccagaggacacaggggggcacccgggaggcgtaaagatccacctgcaactggccagctagcaaggggagcggaggacggaaccctgacagcgaggaggggacgcgcgtggtggctaccttgcggagaccgggagagccgagtgctccccggacccgcaagaagagacggcggccctggcgggacccgggattgtagcggggggaggccagtattaccgcggctcccccccacacgtcctaggtcacgacaccgggcagggtggcgggggcttagtcccccgggggcgggaggtgggggtcgggcacaaaggggagccaagggggcgggggcacgcgcagagcgtaggaagagggggagcgccccaccg

SEQ ID NO: 13451 - DNA, 722 bp, Homo sapiens
accattttcttctttttgccttcttatactagctaaaattccagtatgatattgaattaaagtggtgataatggatacctttacttgttgtctatgttaggaagaacgtatttagactttcaaccattaagtctgatgttaaatacagttttcataacgccctttcttcaggttgattatatctcctatttctagtttctggagagtttgtattcttaaccgatgttaaatttttttcaaatgcttctcctgtatgttgagatgatcatgtgtttgactttttttgtttgtttgttgatttgtggaagtagattgatttgtaaatgttgaaccactttatattccagtcatgcaatcaacagggtcatgatatattgccatttttacatactatcaagatcaatttcattatgctgtgttaaggctgtttgtgtctactttatgagggatattggcttgcaggtttcttgcaatgttttggtctagttttggtttacagaatctgcgaaaaaaaaacctatgactagtgggtttagcactggtttatcataaaatataaggttggataagctgattggccaaactgttaatatcgttaccatgtaaatcacctcactggctttattgaaacatgtactttcattcactgtaaagtttgtatagaatggaaattactatttccttaaaagtgtcataaaattcaacaatgagtccatgtaaaa

SEQ ID NO: 13452 - DNA, 750 bp, Homo sapiens
agaaacccgggagaagtttcctttccctaaatatacctgcaattttcaagtccttttaattcacgcctttaaatgaaagggttgagtatacaagaatatcaataagttccaattgaagagcggattcttttgcaattcaggcatgtgccggcgataacgggcgagttggcatgaagagaggcagagatggattaattatgcagagaacatggaaattctgcttatcatcggctagcaaaggagcccggctcacataatcagcaaacgaagggagaggaaaaaataacaatgcaatggcaccttccagcccatcatgaggattttttctacccccttgtaattaaaaaataacatacacttatagccctatctcctgtgcaggcaaggagtggatgtccacaaaataattgcactgggatattagagctggcgacacgggctgaccattccggcttgctctgctactcaccctctctttctcttttggcctgtcaggcactttgcttctgaacccagtccaaatgagagagacgtgtcaggtgacattcaagctcggttggcaaaaatgccaaattggtgccttatcatgatccaagcagacatacatacatatgtgataaatattgggagggctgactatagaggaggctatggaactgatcacctggggactatgtggtcaggtggcttatgtgtgaaacatgggtcaaggtccttattaggtttagacgcctgattaaaatggatgct

SEQ ID NO: 13453 - DNA, 841 bp, Homo sapiens
ccttcgccttccctcatggctcgcggatatgcgaggcgcagccggaggcgcttcagactaactaaaagtcatcttgcctacccaactggatcaagattgtagaacacaaggatgcatccttaaccttataagggggccttggaatttttaatgagcagaagtggtcagaacctcagtcatacgtctcatccaatagatggttctcctgtagctcagtgttccataacccaggctgaagttggctcagcaccaccctgggatggaagagggccacctactgaatcaccgtcgccacatcctgcagcatcctccatccaagtctttcctgggcccacccctgctgaactcccaagagcaaacagaagtgttgggacatattccaagactgatgtcagtggagaacggaagctgcttaccgggacaagtatgcactaatttacatctgaaagaagggctcattgaggcctagactagggaaatcagcctgatctcttcaactagcgtctgctgaacaaaacttcatggccaccacagctcaaacagaagtttctcagttatgcgacaacacactctttctttaagacggaaggacgaaaagaaaccttctcaaacgccttatccacccattttggtctctcgccctgatatggattcgttagcgacaccaacggggaggacggattgtttttcgattgaccaaaacctgcccccaagctgacttccacccaacctgagttcgaaagataaaccaactcagcgttgatgttacggcttcgtacatataccctacaacctagctatcggcgtcactgtgctttgcagcgcctccttactccacttc

SEQ ID NO: 13454 - DNA, 623 bp, Homo sapiens
ccctaggacacagctgagctcaagaatccaccaaacacagagcaaaaacaaggatttgaggcacagttccacactttctagctatgggagcggggccaagctacttaattctccagccttatattttctcggctaaaaatatatggggcaagtcttgtgaagatgcaatgagataatggatgggaaagccctttgtgaagtgtaaagcaacacacaaatgcagaaataacaactaacagaagggtgccaactggaggatcatgtggaaaaatggaagaactgagactatcttctggccatgaacagaaggagaaaaggatgctgaggacacacttcaaaatctgcatatcttctgttcctctgcttctctaaaaattgcaggaataggtgaaattgagcctatctgttttctgtaattagtacttcatttttgttttgtattctgtgctgttcacattatcctgtcttcctttgggtgtaacacgacatctgctataatctccctgctttcacaaagtattatgattggttgcttattggtcttgcttccctgagggcagggacggattttgagacttcaccctcccaagtgtccttcctggcgcctggcaaaaaaaaaaaaa

SEQ ID NO: 13455 - DNA, 900 bp, Homo sapiens
ttttatcttcatctcttattataactaatcttacaaatcatttctttacacgtaactgtctcctcatttgaaaataagcacactgaagtgctagcccaccatctctgtccagtcccaacaacaagggccttcctctgatgtcagagacctcaggttgcacgaaatgcgaatggattccaaggggcatgctacaacctaaaaggaatttctttaaagagcactgtgcacccgaaaagacaagtatcactggctatttactcatcttgactatgatttgccaatggcttaaagtctttatgacattcatgactgatgcacgaagcggacttgatgaatgcaaactaattagtttctacatatacttacatggaataaatgccccccacaacaataccacactgtattctgtgagtcatcgtttatttgatctccaaatagaatttacacatcttcctcgtatttacctttaccctacctccttcatcttccccattttctacacccgccgtacatcgacccctctagtcaccagactttatcctgatccgcacatccacaaccaaccctccccccctacaccctaacctcacacctcacgtcaccctcccaccctcccctcacattctctctcgctccagataccaccgcgctgctcgcctcggaccagtcctgcattattggtgatagtatattaccacgacgacggctatacttgcgtcaacactgtagctccgtctcacacttgatgtgctatatattatatctccccttggtatctactacattccataccctctatagatattcaccacaccccccaacataaattaccgacaccagtaaaccaaatttatactaatcagaactcagtcagagcctctgaattaataaaatcataat

SEQ ID NO: 13456 - DNA, 797 bp, Homo sapiens
  misc_feature (1)...(797): n = A,T,C or G
ctggtggttaatctgaaccagtaccagtctgagtacattttgttaaatcccggttttcccatgatattccataatttccatttcatcttgatgatttcatctataatatttatttggtgctgagaaggttcccacaaattaggcagattccaatgctgatatcctgttactttccacctgctaccataaccctctccttgggtatccagacagattatggcactgtcttgtagctggtcccagaaacaatttatatggccaatatttgttacagggtaaataccaaggatccaggacatctggcatgtcataatctttagaaaattttgattagttgtaagactgtcttagatttgacaatatccggatttgtcattatggggtccccctaatttgtcttctggtggtgtgctggaagctgaaataacctgatgcattaattaggctagtataacacatgaaatagagtgtggtttggcagactagggcctctgtgaaagaaaattaccttgccatccatgttgaagaattttataataaattacagacaatatataacaaaacatttatgaaagtagggaccagtgctgaatctccagagtgaaacctcacatgtagcagactcagaacanatgctggttgaatgaattaatttcaactcactcatctgtgggaattagagatccttcaaagaaatacacagatgagagttgaaaaaattgccttggtgaagcctcctcctttnttttttttttttttgagacagagtctactctggacctcaggctggagtgcag

SEQ ID NO: 13457 - DNA, 776 bp, Homo sapiens
gatgcctggaatagatttcatctattatattgagtcttatgaaattaccaatttttaggtcaaaatggctgaatatcatcaatttcatatgcttcaacccatgactccctgggccttctcttctgcaggactgtatgtgctttcatctccatctctttcctcctccccccaaagatgcccacatcccactctgtagaatgtatgaattaccacagcgtatggcaagatgggctttgcagatgtgagttaagttatggcccttaaaattgagagactatcctggattttctgggtatgcctaacctaattcatgagccctcacaaagaactgtctccagctatctgggaaaagaagagatggcagaattacggcagaaggaaaaaataattgaaatgtgaggacttcaccatcattgctggctttgaacctggaggaggaaggccacaaaccaaagaacacaggtggcacctggatgctaaagatcacctccagctgacagctagcaaggaaacagagacgcaatcctacaaccacaaggaactgacttctgctaacctgcaggaacttggaggcataatcatcccgagaccccagaaagaaacagtgtccttttgacacctggattttagcctggaagcccagatgagccatgctcctcccagacttctgatttacaagacagggaagtgcatgtctgtttaagccgctccgttggaaatatttggtatggcagcaaaggaaacaatcccgcctttgatatatttgctaaaaaaat

SEQ ID NO: 13458 - DNA, 822 bp, Homo sapiens
  misc_feature (1)...(822): n = A,T,C or G
cttgggtgcaccctagaagactctttaccagattccctatacagctggtctctgcatttattccaagaggaaagaaatgtttaaaaaggaaacttggccaggcttggtggctcatgtctgtaatcacagcactttgggaggctgaggcgggctgatcacaaggtcaagagatggagaccatcctgatcaacatgatgaatccccgtctctactaaaaatacaaaaattatctgggcatggtggcgctcacctgtagtcccagctactctggaggccgaggcaggagaatcgtttgaacctgggaggcagaggttgcagtgagccgagattgcgccactacactccagcctggcaacagagggagactccgtctcaaaaaaataaataaataaataaataaaaaataataacaataaaaaggaaactcttctcctaagaccatttcaacagggtcatgacctttgtatatgttctcatctgctctggaagttctgcttgacanaaagcaaagtcatccttcaactccctgtgattagtagtttatcagtccanagacttactcttagttttagttnttcttaatacaaatgactttaactgattttccaccggaactgtaatttttaacatctctttctgcctcaacccatgcttnctgagctaatggtttcccaacaaaggccctctcttctcctactcggttgtgtcattctgcctcttgaatacctaattaactttggaacccacctgccctgaattcaaattccagaatctgcgctattacaaggatcattgggggcaaaatcctaaccttccatgacc

SEQ ID NO: 13459 - DNA, 853 bp, Homo sapiens
atatcgagtcacaccgtaaccaatagttaaattatagctcggggacacgatgaacaaagttgaggaagagtctctgggccagcaagagcaactggagatgggaaagaaggactttgaagttaaaatctagaagccattgataatacaggataataccgttcatactgctcagagacagagagcaggtgaataagacaagagaatacatctggaagagaaacagtcattagacatccctacctcctcccaagtccccccactactctttcaagcctctgatactgcattttttacaaatcaaaggcttgtggcagccctgtgtcaagcaagtctaccggaaccgatttcccaacagcttgagcctatcttgcatctctgtgacacattttgataattctcacaatattacacatatttgcattactgaactatctgatatggcaatctgtgatcagcgatgctcgatgtcctcgtttaattgccttacgaagccctcgactgtgctcttttaatacacgctatttcatagacctctgtgcgcgctatcgccctgcctcgagtcctagcaagtaagtaaacatgtatagaacattcgacacacgttaactacccgactaaccctaatcctctgcttctaccttcttgtaatagcgtccgcttgaccttatactaaatccataatccccctcctctctcctcctatccattccccagcctatctcccatcccttctataactgttatcttcctgtactccatcgtatttactcatttcaccagctacttctgcatgcccccatacactccttcccatcacgttcaaccctcacatccccatcacgcatcgctctca

SEQ ID NO: 13460 - DNA, 986 bp, Homo sapiens
  misc_feature (1)...(986): n = A,T,C or G
atattcggagtcttatataagaaggacgagatgnttatctatggatgctgacaagttgcacaaacacaggattntctacaatatatatacagagatgtgcagacangttaggcagtcgataaacagatgcatattcacgtaaagcgtgttacttatattcgctngtagacacattggtttttctgcgagtgccgatctcgtcttttcattcaactagagtgtaggacctcggcttcttataatggcaaagtaggattaagtttcgcgcagatacatctattcagttatcatcataatacatctttttaaaagtcttatttagattactcatcgcttttacgatgataagaggtatacagcgatctactgaaaacgtgttaagcataatcaatgtgccaatgggcttgactatgaagtataggtctatgacgatcaattctacgcttgagagacnatcctatagaaatcgttcatgaaacanatgttggtttgacactctgctcgcacangcaaacataagattagaatgcttatccattatcgttcgctatcagaggactatgaatatattttcacaagtgcatggtagcttcatctacggagcaaagactagacgccaatctgatgcgttgcatagaacatgcaggtgttatataataatacaagttcttcgcatcgcgataagaccatatgctgggtatgtacatgtggacatgacatgttcgatgttatagtatactatccacaataccaacaccatagtaacaatgtagtgatgataatatatacgtctcatatcagaaggatatatccatcaccacgctattcccaagaatcacagttattcaatttatgatgagacaacaggacggtatgaataagtaaataagtagtattttggaggtatgaaatagtccaccacatatgcatccatgctcatatgttttgttatcttgaatcaaataaagtggcatgtcaacatgaaa

SEQ ID NO: 13461 - DNA, 780 bp, Homo sapiens
cctaggagttaggaattcattatctcaacctaatcaatccagaagtcaggaagtctccacccactaattaaggtgactcaatataaacctgcctcctgtgcctccacattagctcatttggaagacctgggtataggtggtcgtctccttggctcagagtccctgcagcagctgaggtgcctgtgtctctcttgttcccagtggccaccatcatgctctcctccccactcagggtggctgtggtgtgtgtgagcaacatcaacaggagcatggaggcccacagcatcctcaggagaaaagggctaagtgcccggtctttcggaactgaatctcatgtgaggctaccaggacgaagacccaatcatcctgtagtttacgattttgcaacaacatataaggagatgtacaatgacctcctcaggaaagatagagaatgctacacccacaatggaatcttacacatcttgggaagaaatgagagaatcaagcctggcccagaaagatttcaggaatgtactgaattctttgatgtcatctttacctgtgaggagcgtgtctatgacacagtggtggaagatctgtgttccagaggacaacagacctttcagcctgtgcacgtgatccacatggacatcaaagataccctggaaggtgccatcctgggagctttcctcatctgtgagaattgccagcgcctgcagcagtcctacgacttggaagacagtcttggaggcacttgctgtgccaatggaagacaaggcaggaaaaagtctttttctc

SEQ ID NO: 13462 - DNA, 585 bp, Homo sapiens
  misc_feature (1)...(585): n = A,T,C or G
gcacacagaataacaatctttgtatagtacagaggaaaatggatttctcaccctgctgtggtggttactaaggggatcaatatctctttaccatttaatttacctggaagctctaggttagggtctgattctgcaggaccttgagtctgcagaacaatgtctggctttaagtttatcctttaacaggccattgggggttttgagaaggagttaacgtgcccgcaatggaatttaagattaatctggcagcaaggtgtaaactggatccgagaaagaggaacccaaaaacctggtagatcagttagattattggagcagttgaggtgaaatgatacagttaacttgggtaatagaaataggaatgagactgagaagatagattttcaaaaatactgtgacactgtgaaaaggtgaaatcagtaggactttggcaatttgtggtggaatgggaaatggagagtgaaaactcagaggtagtggggatgaacgtaggtggttgggagataaaaggggaagggaataatggtagaaaaanttatggaaggattgaaacagggattggcgccantggctcacgcttgtata

SEQ ID NO: 13463 - DNA, 941 bp, Homo sapiens
  misc_feature (1)...(941): n = A,T,C or G
cctccagcttaactgcatccactggttgtcaatcaaatactgaatctcacccgcgtctttgggcccccgaccttgggcacataccttgactttgcgggganataaactananccctaaataattcccaccccctactatatancctccancctcctaccacannaatctctnncttanccttnntaccactttcctctnnaaactccacctttcctaaancctttccctcactccaaanccacngcctcattataataaattgggggggggggggaggaaccatacccgacctttcataacaaaaagaaaaaaatacaagcctccgttgggcctcagccgggggggagctcctcgcgggcccgcttcccctgttagggagggggtaatttcatgagtcccccgctccactgagctgccgtggcccctccgggccgttcgggctggggggggaggcggggtccaggctcacctccaaagggcggggaataccggcgtatcccacagaaatcccgggggataaccgccgggaaaagaaccatggggagccaaaagggccgcgccaaaggggcccgaaaccccgaaaaaggcgccgcgggcctggcggtgtttcctgagggcgcccgcccccctgcggcaagcctgccacaaaaatccagccccccaagcgcgaagggcgggggaagcgcccagcgggacctttaaaggagagccgcgccggtgggccccctggggagctcgctcgggcgcgcggccccggtgcccaacgctggcggggtgacgcggaacgctgggcgcgcctctcgccgcttgggagagcgtggggggctttcccgcaacgcccccggggcgcgggcccggccccccgggcggcgcgcgccccctccgagcgcggggcggggggcgcaaacccgccggtgaagcccgcgcccctggggcttga

SEQ ID NO: 13464 - DNA, 274 bp, Homo sapiens
cctgagcttcttggatagcagtggttttcaatcaagtctgaattcaccggcatctttgggccccggacattgggcaatacggtaactttccagaagatgaactgagccagaaataattccaccccctactatatacctccagctcctacaacagaatctctgcttagcttggtaccatttcctctgagactcgactttctagagctttcctcatcgaaagcagggctcaaaaataaatttaaggatgggagaacataccaactttcatacaaaa

SEQ ID NO: 13465 - DNA, 869 bp, Homo sapiens
acgggcgcatggccctcaccggccccacggcgcgcgacacgcccacgcggttcacattcccgaagctccatgtgaagagcggatcttttgcaattcaggcatgtgcccgccataacgggccacttggcagtaaggggggcacaaatacattaattatccacaccacatggaaattctgcttatcatccgctagcaaaggagcccggctcacataatcagcaaacgaagggagaggaaaaaataacaatgcaatggcaccttccagcccatcatcaggattttttcgggccgcttgtaattaaaaaaggacctacactaatagccctatctcctgtgcacgcaaagagtggatgtccacaaaatcaattgccctgggatattaggagctggcgacacgggcgtcgccattcccgggttgctctcctgctcacccctctctttctcttttgggccccccaggcactttgcttcttaacccagtccgaatgcagacagacccctcgggcgaccctcacgcccccctcccacactcccagattgggacctgacgcagaccacggcgaactgcctccgcggcccaggaccacggggagggcgggactatagacggggctccggcaccgaccaccgggccgcgctgccccgcggaacccttcctcgggaaccccgcgccccggagccctccgctctccgaagggggcagcgccacccggccgcggcccggggcggctccgcgctgcggccgccccggcgaccgggcctgcgagcggccgcgccgatgggctggggagggacgggtgaagggggcccgcgcccgcccagcccccccgcggccgacgcccggccggcatcgggggccccggggagca

SEQ ID NO: 13466 - DNA, 839 bp, Homo sapiens
  misc_feature (1)...(839): n = A,T,C or G
cttacatcgtaagaatgcctttattcttcacggtgcccaatataaatggatttctcctaccaaaatannagatnataanttccgataaggggggggtaattaaaaatcccatccaaacccctatcgagaagtgagacccaacttgaaaacttgaggggtgccaattctccccacaaaagacagaccacatgtgttttctcttccaaaatatcccctaaaaaacacaataactctgctgggggggggggataaactagggtggcccctgaagtataaaccactaaaaggctttgtcccttcggctcccttatgtagaagtgactaactacttctgagtgccaaattttcaaccacctcttttgcgggctatatttaatgggataatattattcagactaactggacgggatgaaacccaacacaaagcagccccattggggaaacgtctatcctcatgacctaatcggaaagccgccaagcgaaacaggaaagatgcgcccctccgtggccctacgcgggggggcctctcgccgccccctcccccttcaatacggcgggacactactcgaacctcccctacctgagctccctgaccctccgacccgtccccctggggcgaaggcgagcccctgccacctagcgaggcggaggtagcggggttacccaagaacgcgggagataccccgcgaagagcccctccgaacccaaaggacccgcccacgccgcccaggcacgctcgagagccggcgggtccgtgcgggacgtgcgctcaggcgcccccctcctcccaccatatccaacgagactcccccctcaactacccagcgccccaccccccc

SEQ ID NO: 13467 - DNA, 1093 bp, Homo sapiens
  misc_feature (1)...(1093): n = A,T,C or G
gtgtnnctcnnncaatgnnnnattctctcttttcacttttgcgtctgtatncttaaaaactgtgccnccgtacggctatgtctgttgctnactaagtgtatatattggatcgtcaccngtanatctccaatatgcagtacaacgatagcaccgccgccacgccacagtccattacaaaatcaaccctctgccgaccagcggcgccatggcacatactaataactgaatgaatgccnactgaccaccgttgttattaatactacgcccgccgagtgccccctgcgttatctctaccgctacggccctccccgtcgttgcctgatgaaatccacattgatgacaaaatgacacantccaaacacaaataatcgagcaagagccnatcatagagtaattgttaaagatgtaatatatattagatcaccgaaatcgaatggcagagggacaagagcgacaaaacaaactggacaaagccaaaaggccaccgtagtcaggaatgaagataaaaaattgctcatacccagcttacacctcttgccacacattaactcctgttttcgttttgtgtgtggttatatagctataagatctagcacagtcgcgggtgatgctcactgttgaaatatgatccggccaacaagacgtaccgaggagtatcccaagtccactcaaggttgtacacgcatacaggcacatatatgaccgcgccacagggcgatcacaccacaancaatcggactaccacaggagcacgtacgtgagtcacgccagcgataactcacgtacgtgacatcacatcgatagcttcgtccaccccgtctgtatgttctctctattatcttccatctcgtccgaccagtactcttccttctgactagtaccgtcctatattatcacccaatatacatgcgtcagtagtggttgtagtatgtctgagggagatccacgatcaatcacaaggagccgacatactttaaatgagtctcggatacattgtacaacacgcacatattattgtaaacaacgcacataaatctctccgagtgtgtccaagctaataagaaatccagtatattcctagatataagttact

SEQ ID NO: 13468 - DNA, 833 bp, Homo sapiens
tcctacctatgaagactgcagattgatgacttcagcaggacagctaacattgcctatggaagctgggctggtggaatttactaaaattagccgcaaattgaaattagattgggatggtgttcgtaagcatttggatgaatatgcatctattgcgagttcctcacaaggaggaagacttggaattgaccaattcgccaagtctttacagctgcctgttccacacgtcttgacacccctttcctgcctatctgacaggaaccactgatgcgcccacttgcctttccacagtctcttctccggccgtctcgctctgccacccccgcccccacagtcgagatcatccaccccggcattttactctgcttcgccttgcacgcggctcgcctacgtccctctcgacgatctctctctcccctcaccccccggtcccctcccctactaccgcacctgccacctttagcgctgcggactgcctgtatcgcctcggacgttctattgtacgccgccgcgcatcataccgtatacctgtttataaactcaaatgtacctctatcaccccgctagcctgcacgtaaccactaccaccttccacatctcttgtaattccgttatccacctcatctctctcctctacggttccttcccttatcatactatctctccgccatcggccgccgagcgcggcttgctactctgcttcccgtctccttcatcgatttacccaattccccaccctacgctttcttccctttctcgttcccctgtgtcctttttcccccacctcaaaccacccccacatcctcctttccccgcccgccgtcaccattcattcg

SEQ ID NO: 13469 - DNA, 815 bp, Homo sapiens
  misc_feature (1)...(815): n = A,T,C or G
ctagctttccactttttgctactgtnaatctacacacaagtcttgctcaatgctttcatgattttaaccacaaagaagaagagaaaaacaagaagggcatggtatacagtgacacaccgtttgcggtagaagcgaggtgaaatgatctgaacaactgaaagaatttgtgttcatgaagttgctcagacaaggagctgatggagcagggcattgaaatctccttgcatattggagtttaattataaagcattaggttaaatttaactcctcagaatcattatgaaaatttgtaactctctgggacaattttagatccatcaactggcacataaatttagcactcatacactatatgtagaagtgtgtaaatatgcaagcagccccccccaccccataacaatgctgggttattattccacaagacaccacttttgaatctgaaatcttttaaattactaatctgttgctcttctcatggaacatcttacctacttcatttgaatgtactatttaaataatactacgaaggactcctcatgaatatttatttctgggtcctatgggttcatccttccaaccacgataataatgcctagaaaattatcttgattttctccctaaaacctggttgaaaatttctaagtccacgccacaccctcttcctttatcacaacacattctattcccattgtccgtcgccgacatccctgaattcaatgcgctcgccctcatgcccctcatctcctcccccacccctccttcgccctcccacctcattccccccccccttcccctcccaccaccccccatcacta

SEQ ID NO: 13470 - DNA, 900 bp, Homo sapiens
  misc_feature (1)...(900): n = A,T,C or G
ccgccaccaccccgtagcataaccaagccaaccgaaaagaaagtttgttggcagacaanattccaagcttatttgggaaacacacctgccaaagatctgtattggattttcaagaaataagacctgcagacccctctttgctgattcaagtatgcctgtcgaagatccacaaagtagaaggcagaaggtcagctcagtacccaaggcacttcctgtggaaagttactcacttaatccctaaaggcaagacaagggccaccctttaatattcatttttttttatcagagagggagagcagcataaatcgggacgctgacccagcccagacaataccacgcttcgtacaccttctgccaatggctgcgccagaccatcggaccaatgatgcgcaggtgactcacattggcggagctaaatctctaagcctcacgcaaagattatggcccacttccctcccccccctccctctcgcgtatactgagtcacgagcgcgcccgcagaaccgcgtccgggaaaactcatctcgttaagcgactccagccgaaaagaggctcccgcttgagcgcgcgcggatggataccctgacaacccgaacccgtctaaccccttgcaccagctccacgccacgccccagggatttaacgtcatggccgctcggcccagatacaacaccgctgtctcgatactgaaatacccacggcactaaaaactgtttcggtaaactaaaccacacataaagagaccatgccacgacggcgctaccacctcaccacacctcanttctgctccctgtgtccccccaacgcctcctccagagtgacagtccacgccacttccaatggacccacaacttacccactgcgctcctccgagcccacggaccatcacgctcaaatcgt

SEQ ID NO: 13471 - DNA, 882 bp, Homo sapiens
gcagttgccactaacaattctacattaatggagtaaaactgactaatgaacctcccacgggtcttcggctgaatctccttcaatcatatctcactgatccagtttctgatcctgagtttttcaagggatgccgtggaaaggaactgatttctctgatgcaacaggagccttcttcgcctgtagacacacaagcatagaccaaaaatgtggagaaattatcaaccccaggttctaccttcaactattcagagaccacttgtcccagcagaactgagtcctcatcacagcaacaacttccataattcttcctgatacttttcctctttctctgcctccctttccctactcctttcctgcttcctgggatcacttctcccatacacccaccttcacccgcatctttctctcaaggtctacttttggaggaacccagtctagatagagtccaaagacagacacaattgtgaccattcagttctccaaaaattttaaaggatggtccctgcctttagaagaacccaattattaaaaaataccgaacaaaaatacattgcaaaattgggatcacttggctccttattggctaaagggtcctctcccctattaactcgtctgcaccccaagcaatcactcttagcctggtcaaaaaatctgctctggatgtgccttggaaacatctccacaggacgtccccaaccccaaccaggcatcgccgcgcctcggctcctctcacgttcgcacaaagactcgcccacctcactgtatttactatccaaccatacgccgcacgcaattctgcatcggtatctccgcagcaatacgtaccacacctatcctatactactacaccaccacgcctcaccgccgccacacctagcaaat

SEQ ID NO: 13472 - DNA, 275 bp, Homo sapiens
  misc_feature (1)...(275): n = A,T,C or G
cgtggcgggactgagaggattgcttgncaccaggagcagacagcctcggcagcaaaagacgaccctgtctctacaaaaaataaaagtaaacatagtcaagtgcagtggtgcatacctgtagttccagctacttcggaggctgagatgggaggatcatttgagcccaggagatcgaggttgcagtgagctatgattgcaccactgcactgtagcctgcacaacagatttttcctgtctaacatgaaatgaaataaaataattctaaaaataataaa

SEQ ID NO: 13473 - DNA, 275 bp, Homo sapiens
ctaaagcggatttcttggcaaaccaccaaatgaaatattctttgtatgaagaaattattgtttttaaaaagacaatatgagatcatcccatgatccagaactccatcgtttgaataaacaagatatcttgtcttctcttatctttgctcctttagttattactgtaccttataggacacctctcatggttacggtccttgaagaaaaagttcctatggatattttatgttttatatgtattaaaataaaaaatatgtataacaaaaaaaaaaaaa

SEQ ID NO: 13474 - DNA, 813 bp, Homo sapiens
cctagaggagcaaggaggcccagtagagggtgtgacctatcccaaccacatggtcagaaaaaaggcacagtcaagaaaagaacccagcttccagtctgaacacacaacagagcttctcagcagtggcactcatgtttgtattttgcctagaaagttccctgggcagcccattggattgcagacacaggaggagcgacgacctcagaagctggttcgtgctatgcgtgtagtggccattcagtaaatgctcttgagtgaatttgtaaaacttagataccattgcctggcagaccaggagctctttgagggcaaagcctgtgcctgattcttctttgtttctctagtgcctggcataggagactggcataaattaagtgcttaataaatacttcatatgtattaataattaacatctgatgctacttataaataactctgggggaaaagcccagttggggattatggttatatcaaacgttaattcttagcacacttaccaacaggttatgaaaaaacatgggtcgcaatccacccaagaaggttctctataatgacctcctagtcgtaaccgccatttagggtgacactgtcaccctgaccccagaggtaccagatatgcctttgctcatcctgccactcatccaaaggaaaaattagccctgcgtcgtctcgctttttattttaagcaattgccatcgtcctcccgcgaaaaaaaacgcggcctgctgcgcccctccgcagcatcctccccccgttcccttcgctacgcgccctccaccccctcgctccctcccgcgccgcctcatcttattt

SEQ ID NO: 13475 - DNA, 779 bp, Homo sapiens
  misc_feature (1)...(779): n = A,T,C or G
ttgattgcaacacttactactctcnttggnncacctccgacaaccttctgcttctactaatcagacattaggcagcatctggggtgggagtaggttggaaaggagtgagcttctgttttatttttccttcttcagcaatcgcgaaggtatatccacgcagtacagatgacatgaccgggaatcgaattctggctccaccactgccttgccattgatctcgtccctcntacttagcattcctaagcctcagtcgcttctgcgttaaaagggcttataatacctaccacaaatgttgtgatcagtggtgcctggccaatgtctaattattccttctctggacgacaaccctggtcccaaaaataaatcggacgctccggtccccgtggtgcttctctgccgccccttccctcccctgacgggcactaactgacctccactccctgactcctccggccttggcccgctcaccgccgcccccgcgttcacctcactcccgcgctgactccccgccctccccagactgcgtgactactcacgaaccacctcgcccccacacccccccccccaccccccgacccgccatacagtccgccctgtcgacgacttctcattcacatcccacccccgcccactctccgaaccgtccatcctccactccaaacgttccctcacctcctgcggtttctccccccccaatccctccacccacgtatcccttcttctcgcccttttattatgtcatgcgtggacgtttcatgcaccgtctgcctcctcccctc

SEQ ID NO: 13476 - DNA, 869 bp, Homo sapiens
cctaggaagacaagtcacactcattagattggccacagacagctgcagcttgctccttaacaactgctctagagctggtttctcctaaagtgattatactacatatttctggtctctatctttgctctgttttttgtaaagggacaagcagactttttgcaaccttctcaaatatagagaaaaaacagaaaaaatggaagcagactgcctcttagtctcttccattttataggaatagtagctttatcagtccacaggttaatgaatgaaaataaaagttgcaattaagtcataaaccatcaatagaaaccaggcggacacatccaagatgtgttacactccgaatgaatacgagccgcggatgcatatccgccattctattcacgctgtgcgcgatctggccaccataccacaaccccctcgcaacccccgcccacgaacctccgggaccccccctccccgcgcgctcgacgctacccctcatctctcataactccaccttctccaaatagaccccgccatacgcccaaagacccgccccccgccgaaacagaccactgatcccacacgcagaacaaagagcaggcccatctccatcatcactacacccagacctccccctccccccgagcccccgtcccctttcgctagagacaatcttcaccacctcgcttacaccttgctctatgttgctccgaccccatccttctcacccaccttattccctcctcccttcagtgctaggccactcccctcccccaccctccccggcgtactcttcctcgacctctcttctttttagctcacgctacccccacgaccgacaagcaaccacccggtcctctacgggtcatctcgagactccgtgg

SEQ ID NO: 13477 - DNA, 405 bp, Homo sapiens
ttcgttggagactcgaccgggtcctgcaagagagcaactgcttcccatagtggaattcggggacctggactgtactgagtgctaccctgccattatagctgtgccatctggaacgtgggacctccaagattgccccggagtgggaagagtgagcgcccagcttcttaaatgccttgctcaggaatgagacacgtcctctccactcacttcattggttgggactatcttgtggtcctgtataactgcacgggggctggatagtgtggggttccaggcgtggaggaaagaaagacaaacctgatatacacaaacctcagtgatgtctgctacaaatggtaaaggttaacatcatggaaggcttccttgggcaaaataaacctgagttgaatcctaaaaaaaaaaaaa

SEQ ID NO: 13478 - DNA, 820 bp, Homo sapiens
ttcgtgtaggtaactagggcatcttcctggaaaggctaatccgaatcgcgccagccccagctcaaaccttccactggctttccaccacaactagcatggaatgtgacctccttccaccgccctcaggggcctgcaggatgcagctctgattcccctccctcctcgctcgcctccaagctccaccttcacttcactgcagccacagcggccttcttggagaaggaccacacgtcaccatgctcatccccacacacccctccttagagggttatgtgcccccaaatcatcaggtggctatctcctctcatcctttgggtctacgcttcactgtcaccccatcagaatgaccatacaaatcaccttcataagcagccccttcttcacccctgcaccgtccaacacaggagccctcgagccacggaagctacaggacacccaaaaagtggcccagctgagagacgctctaagtaggaaacacactctaggcttaggacagaaaacctgagggcacgccatcctcttgaccagatctatatctattacactcctgacccaaaaacgtgcaatggggatataacgcactcgcttaactaatcaaaccgcatctcctaaagatcccacgccccccccgccacaccgcccccgcccccccggggcccgctgacagcgctccctcaccaccagcacgagcactaaccccatcccaccactatgcgacataggcacggctggcgggcgcgcaggcatcgccacgatcagcgcctcacgcccgccccatgtcagccaccgtacgcacaggagggcgcacagtacagcatgc

SEQ ID NO: 13479 - DNA, 778 bp, Homo sapiens
gtctattaatagtcggacgcgtggcctcaaagaattaacatgatattaacatcagtgcaaccattctttctcctttttgttttgatttaacataaaggattttagaattttaaaatcaaataatgctaaataataaaattggaaaataacacttatttttcatcataataatacccataaaatgggggggcagtattcattataataaacaatataaactccgactttgtgcttgccctcaaaaagagggcttcttttaagaagataatatgacagataatgaaaaaatagacctgatgataaaagagataaaatctgttattttaaaaaggacgggagaagatagcaaggtaagtattgtagaaattgatggctgcaggcgtataaatattttaatagataacatatcaagttatctaattaaattttcagagcatcacaaccaccaaatcacatcattataagatgtcttgtttaaatctgattgcccattcaccctgattgcactagagcacgcactgcaccaaagaatttttatgacccgccctcctgccccactttaagacctaccaccccaaggtctctcaaacccagcctctcgccctcccccgcccccccccctccccgcggcaccacacatccctcctccctccctcgctccctcccgtcgcccctcgcaccctcctcccccctcgaccccactcctcctgcctcctccctcctctcctccccccctacgcttccctccacgcacctatctcccacccctactccctac

SEQ ID NO: 13480 - DNA, 920 bp, Homo sapiens
  misc_feature (1)...(920): n = A,T,C or G
tcatttgctacactgggagtcctggctgaggagcagcatctggtgagggtcttcttgctggtggccttcttctgcagagtcctgaggtgctgcaggggatcttgtggcagggtactgctgtgacaaaccaccacaaaccgtgtggccaacaacacacaaattcatcctctcatggctctgggggccagaagtccaatgacaaggagtccagggtctatactatgttttttatttctcggactgcagatgagaaacactaacaagatcactagaacacttccacctcccctgatatctacttactagcccacacatcgcaaggttttaactaccagacgcctaacgaagaccaaactgacgagcgcatagcggaatcgactagtgttagcagactaactcaccatatacctaaaaccaacacgaccaaaacagaaacacttatcaccaaccataaaacccacacgaattatcacactcactacttaaactcctgcactactacacacgtagtaatactcatacttatataccatctatatatcttacggaagtaccgcggagtacactccactcaacacttacatatgccctccacgattgttgcccaccctccacatgaacccacgacaaaccccctcccttctcaacctctcaccacccccatacactcataaccaccaaacgtgcaccttngtccataccgttaagctcacacttacgcaacattaaccatacataacagtcgacacgcgacaagcacacaacacaactacaacaaacagctagttcaataatatgtaaatacacatagatacctgaccgcacatggccacgaaaagaaacagcgatcaaattcaaaaagcagatatccacacatcacatcctatagccacaagttaaacaaagcacggtacagacgg

SEQ ID NO: 13481 - DNA, 251 bp, Homo sapiens
ctcgttcagtcatcaacacagattgttttgacaatgaccctgctctgccctgtatttattcggcaatgatcttcagaagaaggatcttgacaatgcattggaactcgaaccaagagcgaatgcgattctgaagactctattacgtgcctaaaactctatttcaagctacttattataattcctcctaaaaccaaagaaacaacggacagacgccccccgcccgccccttccgtaaataacgcgctcctcaa

SEQ ID NO: 13482 - DNA, 843 bp, Homo sapiens
  misc_feature (1)...(843): n = A,T,C or G
tcatggtgctacggcggcggagagtcccngataggagcaggagagagagccaacagccaacccctacgacttcaggaggctcctgcgcaaaacctaccagcgccggagcctcgtacagcagtcctaaccgttcaacagaggcagtcaccgccgccggaaggcgctggagtctgcggccgagcaggggccataatggcactgctggggctgcgaacgggaggcactgaattttttgccctgagcgaagcataggatgactgctgccgtacgacctcaaacgacccggcccgaccttaaatgtacatataaaaagaactgacagccctcgggaaaactcccactaccattcttgtaagaacttcctaaatactactatttaacaaccaccaacactcaccccaacccccttgctttttaaactagaggatacaacagcagctaacgattaagaaaatccctaatgagatcaactacacaatgcgattcaaacaacaacactgacataaaagaagttttagtttaattacaaatactctatatactaatattactaatctccatttttctagtacccgataccgtccgtactatccacgaatattaaccaacctacccacttcaaccgtcacgctacaactaatactacgctctacaaacagaatcaatacgacaaacaacacccgagatacaactcttagtctatctcaccaaatgtccaataatactatattaatatgagatcacactagacgcaaagtgcactaccagccaattccataccctttttttgtgcttgtgtattcgagtattattctcttatccgtatagcggagatattccacc

SEQ ID NO: 13483 - DNA, 789 bp, Homo sapiens
  misc_feature (1)...(789): n = A,T,C or G
cctanggtggcaacgaccgtgcggtcctgttccgaagtagtgatcaggcagtgagagcgaacagacagcccctacaacttccagaggttcctgcgcaaaacgctaggatcgcctgctgccatgacagcagttctacccgtgcagagaggctctccccgcagcgtgaaggctctagattgtgcattgcttctggggcaaaacaggcactactggcgctagcaccgcgcaagcactgtaattgttggccttgtctgctgataggctgactgctgctctcggacctgaattgccccgtccggtcataaagctgctaaactctatacctgagagccttcgatacacctcgacttagctgtctctcgagactcatgtatcctcctttataaccatcctttgagctggggcaaccttgtacttgttacgctctgccttcactatgtgcttaattgctgagactcctgagcactacactgtgcctgggatctctccatcccctccctaaatgggggcgagtgaatcaacagattttagctttattggatacggtttctgttgtccaatggaacacttgctgcaggctgaaacctagatagaacacccacactggggtggggagaatgtcgaagatgtatttcatgtagagacagctttgtccctttcttcggatattgaggtcactaaatagggcagagcattgcataaccctaagactacaaaatctgggctattacggctcataggcagcacatctgggcccgaacatttttaatgagggtaaattcatgcatc

SEQ ID NO: 13484 - DNA, 1237 bp, Homo sapiens
  misc_feature (1)...(1237): n = A,T,C or G
agtagatcatggcggccatactactcgtcgaaaacgagacgaaacctcagtggcgaccagcgatcatgacttancaaaaggaaacatttccacggagcgaagagaaactcttcgactgggtaggtcctaactacactgagaactcacacatctagccgaaacctgaatctcaataggccgccttgcaactgctagctcgcacgacatgatcgagacccctactcaacctgtgcatccctgtcgcacaccctcaacaggtcttgcactgcatctgggagaccacccatcgtcgctaatgctagcagacaccacgcacagtctactctgttgttggtcaaagcaccatgtccacgctcttaccatcggacaacgcttcgcctcgcccatgaccagacccagctcgctcgacttctgggcgcggttgcgatcgagaccttacgtctcacacgacacacttagccacgcagcatacagacactgtgacctctaccttagcgttgcgtctaccactctcggtctacnacacgtccgctgactcgaccacactcgtaacgtacaggctcagccccgaatagcaccacccccactctacattctcatcgactacaacatccatccggaccacgcgagcaagctgagacgcgagtgaatagtggtctcatcctcgttagccgccagctacacgagaatctgtagacggcgtccgtactggacgtacgcgcgtatctccacagacggttgttacgactgagcaagttccacgtggtagtgtgtaggtgtttnacgacatgtagcgtctgatgacgcactgcagtgtggagagatgaggatctcgtccatgcatcagatgacaggcaacacctccgagtctcttacctcacttatagatgtcatgaaacattacgacgtcatgcgagacccgtgccgctgtggtcacgtcgcacgtcgacaccgttatccccaccgagactccgaagcgcttctttatagcatccaatcctgaccacgctctcgcacgacgcgctgatactcgagagcgcactgcgcgaccgcccgtcacaagcggtacctactgtaatcgcagcgagcagcgcgatcgaccacgcccgcggcgcgaatcaactgattacttnctatctcgctcataagtcttcacagcgacgtagatagaggatggcaatagtgaacgccggtgctcaatacgtggtcgctcttacacccaccatccttcctacca

SEQ ID NO: 13485 - DNA, 339 bp, Homo sapiens
  misc_feature (1)...(339): n = A,T,C or G
gcatgcagcccacggctcgaaggaaaagaaaagaagcctcanaaaactgcctgctgtgtatagacctatgcaaagggccacgtgacaaaaactggagaacagtctctagtagttgagagtgacccctggctgacagccaacaagaaaatagaaacttcagtcctataatcaagggaactgaattctgccaagaagagcatcatcagatgagacctcagtcccagctggcatcatgatttcagtccagtgagaccccgagcagaggacccagtagatgtgtgcagacttctgtttcatagcaactgtgagataataaattgctgttttaagtccttaaaa

SEQ ID NO: 13486 - DNA, 899 bp, Homo sapiens
caatgaaaatacaattatattattaaaagaaaacacccacgaggtgatagcacaccattgtgaaagctaacctcataaacgcctgcgagaaagaagagggaattgtctactgacttattagcgtccttacaaacagagacatgagagggctccactgtctgccacttaaggatacaatgtgtgtaaaacaaaaatgctaaccactacactatggaaccatgttaaggatacaatgtgaagttggtcaactgaaaactgagggagctgacccctttaggacactggatccgctggaaccctgaccttgcacttcccagcctctcagaactgtgagatatatgctttccgccccttcatcacacccctctctatctcactttaacgcactcatctatgcacatccctgccctctccgccccccacacacccccacggaccccaaacccccctcatatacagtacctctgggcgcgcaaagacaccatcttcttacagtacctactacacaactccattcctacaccacatcttaccccctcacccgtctatccccttccgcagacaaccctccctccacacccctcacaacatactctcaccttctccctttcacgctctacatccccctcttacatggcccataacgtgcccacccccctgtacaccagctcattccctctcgaactaatatacaacaaactagggccctccttcatttacgctacgaaacacctcttcccaccttcacttgactcacccccattctcccccctcctcactctacctctctttctcttcacactccacctaacctaatccctccgtcactatcccccaacaaacccacctccaccctccccccccctgatcctcgacaccacatcccctcattccccact

SEQ ID NO: 13487 - DNA, 312 bp, Homo sapiens
cctgggaaacgacactgtctacacatagagaagaagcagtatcttttcatgaagaattgctcatgctccagactttgaaaggaaaatcaaaataactcaagtaatacagggcctaaatgtggacacaatagaaacaacaccgagaaactcacacaagctcagaagccttaaatttgggggtagctcatcctaggttgtgcccctacgtaatccagaagttattagatagtaccggatatcttaggtactcatgattcttgacagacaagcctgtgtagttaacagtaattaaaatgttaccttaaatcaaaa

SEQ ID NO: 13488 - DNA, 851 bp, Homo sapiens
ctgactaactgtgacaacctggtcctccgtgtaggtccacagtaactgacagcactgaagaatgtgcaggaggtatacatctccctatgagggtgcgccctgatgataaatgccacgtactctgttcccaggaatcacagtggatcatgcacaaccttgctttaaaccaggccagagaagagggaaagctgaagagaggaaatgacaaggcaccctacagatggaagcatcatgagggattcgaccctttggaagctgctatcccactgtggagctatgacatttgggccattttagaatgcaagtgtcctaagattagagatgatatttctctacatgtgtaatatgccacttatcactgccactgttgagaattactgggatgggaaaaaactgataatttcaaggtttaaggctttccacctttgtggtcggcctaccacgctccaatgaagccagacctcacgcaccgctctaagctcgcgagggaagaagaacaacccggggcgctgatggccctcaagccggagagaaaccgtggggaggactcaccctgagtggagggggagacccaatgacactcaagacacctgagcctctacccccacctccctaccccgtcccggcgccgcgcgtcccgcccgtagaaaaggaggcaagtagttgaatcgccttgtacccaccggcacaatcacccaacataaccgctccgcgtcaacgctccctcgcgacgcccccgacccgagggcggcgcacccgctgacaacccgacgtcccagagactaccccacccctgccccacctctccaacacatactatctacagatgaggttgcccgcacagcatggtg

SEQ ID NO: 13489 - DNA, 828 bp, Homo sapiens
  misc_feature (1)...(828): n = A,T,C or G
atagccaagggaacatagccattggacatctttcttcaatgaagtctacatttacagcaaccaagcgcatacaactccatttcctgtttatgtaagacttcttgctactggatgcagggaaaatatatccctcttattggctttcccataaaggtatctcccactcaccaatgccctattcttttcaggtaagattcattcacgtgacaactgattaccaaaagactgtattggggcaaacctcatgttttttgtgtcttgtcattctatagggagggaaatgtctcttgcctaatacttcactttgttccatgcccactgtgttccatagtttgggaaagcatactttaaatccagcgtgggatctgtttgagtgatccctggatttgtattggttttgttttctgaagcaggtttgtcttagtgggtgccctttagagatcacttttgttataaaatgaaccaagattaatagccagctccatgtcatgtgtatgcatgtcttcagctgacgaatttcaaatgaccttcttgttctgccactacattgtggagataccatcactgaaagccggccttgctactgctgacctctgtcatatggggaaggcgacagcgggtaattctgcctgtgcgaatctgcttggggcaacgcatttataagcctgaaaactcttgtctatctgaacccaaatgtagcacgatcccttcgccaaaaatcccccctctcaaaagaaccggcctaacctctttcgtatgaaacaaattnactgcttaccatatcgggctcagcatgcgccccctccgccatggaagaaccaccctcag

SEQ ID NO: 13490 - DNA, 1459 bp, Homo sapiens
  misc_feature (1)...(1459): n = A,T,C or G
aaaccactctcccataatatcatgccactccactacaacacattcaaccncaacataaanaacctcctangtagcgatgcgactgcaaacgagatnaacctcctatctctgcncacncatngcgtacggaagcactatcntccacacatagactactgtagtaccatatcggtcatcctccagcacaacactgcacttaacacgtacgacaactctctcctcgacaatagtcgcgcggtctcatactaccccattcctactcggtctgcagatactactccttaactactagactactaacaaccagcacaaanacagnaccacaaaccaaccaacaaccacacaaacaacaataacaataaatacaatcgcgcgcctccgtctcgcgctctacgacgccgcgctcggagacaccttctctgcngcgcacgccgtgtgcactctgtccacgtcaggacgcgcgcttacatgccacttcgcattcctctanaactcacaccctcgnactcttaccatcgaccgcactctgatctctcatctctacggctttcgaccacgaccaaccgcaccggtgttgccacctctaacacctctccgacncgcgaccgcgtctctctctncgcgcctacatctccatctataacactactccagatcgactatactcctaccgctgnatcacggaaacactactcaacaaccaatacaangagctcacatccacatatagcgcatcaagagcaccgcctcacgaaacgaacgccgactcgcgcgcgtgcactgcgtactactactccactccctccacggcctaccgtcgccgtcaccttctctacgctcaccacttcgcaccattaactgatctctgactccctctacctctccgctgcacaacacctcgtagcatcacctcgccgccgagcacgcncatctnatncttnatcacgactccacactaaccacccgcgacatacacgaccgcgcctacaccctcgacanatctcctncacgcttcactcgacctcgactcacaacccacatacatcacactctcgcatcaccacnacagctctccacactcnactcgcacgctctacgncactctcctcccgcccacactacgcgcgcacncagcanatgcctctcgcacacccgtacaacacctacacacanctcanactcacacacactagtatactgcactacacatcatcatatcgatcagctacccatacccatatcacgactccaccgcacttcctctaccgcatatatcgctaacatacatcgtaccacaccncctgctcagtcacatctagatcacacagcaccnccaccacacatcaccactcagaccgcctcgccgacacacnacacatctacaaccactcaaccagtatatactgatgcggagatctcacacgtcgctctcgcccacgcccacatcgaaacacgacgt

SEQ ID NO: 13491 - DNA, 281 bp, Homo sapiens
ctttcgaatgttgccttttccaaactacctatggcctgccccacctccccatcctgtgcctataaagacccagactcagtcggtagagaggataagcagctggacatcagggagaggcaacttgacttcagagacagcggctggatgaggcagaggtggcttaacttcagggtagagtgacctgcccttcccatcctttttccagctcccctctccgctgacagcgactttcattgctcaataaaattctccacattcaccatccttcaaaaaaaaaaaaa

SEQ ID NO: 13492 - DNA, 229 bp, Homo sapiens
atattctatactacatcctgctgagtctcaagaggagttcttctgccagtgattgaatggtgtccatttaattaggtcttccaccacgtgaggacacctgatatggtgccatctacggggaatgagccttcatcagatactaaacctgccagcacgctaatcttggactttcagtctccagaagtctcagaaaataaatttctgttcttataaattaaaaaaaaaaaaa

SEQ ID NO: 13493 - DNA, 196 bp, Homo sapiens
gtggagaatacaaaaaggcctgactggaaggcaagtgccaggattgccttgatcctgacttaaggggtagccctggctgacctggccactaccccagtgagagagctggcctagactgctgcccaggtgatttccagatgcttttaaagactactgttattaataaaatgaattaatgactgcaaaaaaaaaaaaa

SEQ ID NO: 13494 - DNA, 517 bp, Homo sapiens
ctgaacctcctctatacaagcgactgagcaggaaataaagctcgctctgctttaggctcaaaaaaaaaaacaagtaatggcatcggtggcctcatcgggggagcatccggcacggttgccttgagcgaggggcaaattaatgagccctggctactcgactcacgaagatcgcgcaaacacgatcggctcgagcgtgacaagacaacctacgcaggcgggtgtgaggatattcatagaaccaacgggacaaccagcagcaagaacatgagccaaggagcctacgagaacgcgcgcgatcttcacaaagcgccgcgtttctcggattcaacagatgaggacgaagacgcatgctagactgcgtaacagcgactactagtgtgaaggaggaagaacataatggctactctcagacccgcatacgacaccactgagatatacaccgagcatacatggccacgacacgaattaactataattaaacacccactctaaccattacggggagtgatgacaatat

SEQ ID NO: 13495 - DNA, 1343 bp, Homo sapiens
  misc_feature (1)...(1343): n = A,T,C or G
tgtataatagnatacagtggcgggtgntngagaagttaggcgggtgggcgcgcggcggaaagcgaggtggtcgggaggagatagagagagacttttaaaaaagaaaaaccaaaagagaaaagaaaaacttacgccacacaccggaaaccacagcccctgcgcgggtttctgctaatacacgcacgaccagatgttctaagatacatgagcgatggtagcgcntatgacggaatggtgtcataccagaacacagcccagaacaagagacaacatcncgcccaagagccaaggataatggagaaatagaaagactagcaaagggacnaacgaaaantcgacggcgcggggggcgcggcggggcaaaggacaaccgacgcgtccagcagacaacgaacctacaacacgccgtcctcactacgtgcacccgncctcgttcttttactatagacacgatcccacaagcacgggcaggagaaaacgccacacaaaaaacgctgtcgatagggagagcgcacccgcgttctgttattgttgagacgccagggaanacgctgcaaaacgtacagcaggtcggacccaacacaacaaccgacgccaggatcgacgccgtacgatgtgcgatgatcaggacaggacgatagacacaaacgctgctgtggcaccggcgatcgcaaacctaccacgagagagaggtgggagtgggcagaggnctatacgggagaatagaaactgactaagaacgtgtcaatgaaaacgacgatcgaatgaaacgaataaaacgcaccctcacaacccatcaaatagagctacgcacacgaatcaataatggggtatgtgtgacgagtagcaagagtgtgagtcatgtagatctagacggcaagaagagagcagatgggtatgaacgtggtaacggagttgagagcgggttgtaatatatagataatgaaatgagcacgtacntcaagtgcgcccagctggtcacgaagcacaacacgtcgcgcagatcacagcggcgacataanctaaacgtaaantcaantgacaacacaatcacgacgacaatatcagcatatgacagactcgcgagaggtgctcgcagcgcgacacaagatgttaggataggaaaaacggcgaggncgagcggagcgaggcacgcgacgcgagcggacgagagacgaggagcacacagcacgacacgcgcgagagcgacgagagcgtaagcagcgtgnagagaaagcgatcggcggtcactgagtagaacacacacgangcagacgagatcgcagagcganatagactagaatatgaagacgtgcacatgggacacagagcgaatcgactcg

SEQ ID NO: 13496 - DNA, 338 bp, Homo sapiens
  misc_feature (1)...(338): n = A,T,C or G
attagtttccctantggagagaaccatttgaacaagaaactgatgtctttggacaacagccagcgaggatctgagacctgccaagaattacataaatgtgtttgtggaagtggatattcatctagcccagcctcgtatgattggtgctccagccaacaacttcatgacacccttgcaaagcatcttgatcctgagaaatccacttaaactttgccccgattcctgacccacagctttgggataatgaacgtctgatgttttcagccactaagttttggtaattttttgtgccctggaagctaacaagtatatttgttatcattgcaaaaaaaaaaaaa

SEQ ID NO: 13497 - DNA, 174 bp, Homo sapiens
ctgatcgctactcattataatcactgataactggaaacttaaggaccagatagcctgttatgaataatttactgctgtcattgtgaaaaacgaattgttaaatatcactgaaaaaaaaatatttacaattttatgtcaaaaaataaattttttccagttccaaaaaaaaaaaaa

SEQ ID NO: 13498 - DNA, 534 bp, Homo sapiens
ctgatgggaaactagtttggacactaagagaggaccactcctgtgtccacgcatggagaagaaccgctggccctccctggtcgtctgtccactagggcatctgcctctgcgttcttgtgccctggtttctgagtgcagaaccactaaaatcctggcttctttcctcagcatcctggcgaggtatcctcagcctctgaacccgtcagccacattcacacccagaggaaccaggatttttccacaggttcccctacaccctgcagctctgcctcaggtcctcccaaagctatatccaaataaggttacattctgaggtactaggattaggatttcaacatatgaattttgggggacacaaaactgaatccataaaaaggtggttggggtccttttagaaaacatgttccaaaagtccacgtatctacgaatttttaaaaactagaagatgattttgaattgagcctgctattaagagagatttcatttaaagactgaaaataaacatcttctataagaatgataaaaaaaaaaaaa

SEQ ID NO: 13499 - DNA, 906 bp, Homo sapiens
  misc_feature (1)...(906): n = A,T,C or G
cttggaaactggagcagaccttcaagcacaacggagaataccatgtaagagtggagttatgctgcctcaagcaaaggagctaccagaagctaagagaagcctggaacagatccttccccagaatcttcagagaaagcatggacttactgatgtcttcatttcagacttctggcctccaaaactgtgagacaacaactttcttttcttctaagcacccagtttgtgtttttttgttgcggggaagaaagtaatatgatatttaagttttaaaaatgaaataatttttatttaattacctgcttgagaaagtgaaaagaatttaaaacaaaccttacctgtaaaaattatttaggtgagcccattttttatatatggagtgagggccataaaaataatcgccttttcaaaaaaaaaactctcccttacttacaaaatactattttgtacgatcgctcagcccgtgtcttgagccccagtgcatcactcactttcttccctctgcggccctctttgcccccaaaggaggagaactcttcgcgccccctccctttttagggggggtatatatatataaccccgccaaccaccacccttccagccgccaccggctacgcgcgcccgggggcgcgtttatcctctctctccataggggtggggatactgtttttctccccaagtatggggggtgaaacccggagaaaaaaaacccggcacttaattccgcatatagtaggccccatcgcctaacaagggcggccagtcgggggggtgtttttagtaggcctcgccccccataaaaagacaacaaaaattccgtcccaaaatgagggtgggccacacaccccgagtgtttantaattgatagcgcgttcctcctcagaagactgtccaagttcgctctgaacg

SEQ ID NO: 13500 - DNA, 827 bp, Homo sapiens
  misc_feature (1)...(827): n = A,T,C or G
gattaacacntgataacnctgcctggcacacatcacacagagtggctccttccagccctcaaagacctggctcagctgtgccactcacagcacagtcctcagggtcgtcttgcgcaaacccagcacaatgtagagggcagccaggtattcctgcatggcgggcacggtgaacacgaaggtgcctgcacgccctggctccacacatggggccaggaaaaacctcagggcatcccgacggaagatgtgcagcagctgaaactcctcctccgtcctgatgccagcctccangcagccacagacatcctcttcagagaagttgggaaaaaggcagctgaggaaggtgaagcnacatgctcaaggtcaacagctagagaaccacggagctgagactagtgcacctggtgtctggatccctgctgtcttggaggcattatgtggaccctggaaagcaagaaagaggtaatctgcctgccttggccttgcaaagtgcttggattacaagtgtgagccattacacctgggacttcctgncaacgttttgcctctcccctgaagcttcacgaaccacctttccctgagttccaccctggtaaactgctttatttaaggtggccttttttcctttttggcaccaacaaactcaaatnagagtcctgggttcattttaaggggtttctctgtcctaaattttccgaaataatatcccccccactcggcttttttcccagatataaatcctttaactgaggttaagggttcctnctttatgtctctggccttttttaaccggctttgggctgcctaaatataataaggaaggactccca

SEQ ID NO: 13501 - DNA, 729 bp, Homo sapiens
  misc_feature (1)...(729): n = A,T,C or G
tttgggtttaggaggggggggatagtgagagggaggggtggggtagaggggatgggaggaacggatgggaagggtttaaaaagggttgtgaaggagggggtggggagaaaaggaggggggggggagagggaggggaggttgggtgggaaaagaggggttttgtgggagaaggttttagggggtagactaaggggttgtgtgaaaaatattaaggagagggggagggtgagatatattaaaagggtgtaagggaagagggtttggggaggaggaaaaggaagaagggtggagtaaaaagggttttataaaggggggaaggagggaaaaaaaggggtaaagagaataaagaaaggggagaggggggaggggaaatttctaaagggtggggggaggattaaggttaaaagggggggggtatttagagaaaaattatctaattaaaaagggggggaaaagaaaataattggtgttgtaaggggagagtggacttgagcttaatggatggcgagaagaaaaaggaagcaacggggggtggttagttttgggaagatagggtncgaaggatctttaaggagatataggattagagggaatagaaaaaaggaaggatagaatgttaaagtagatgttaatttttaagagatatggtaagaagaaaaaattgagggataaaaaaaaaaggtggggtagggagtgggggagnnnttttttacctgggtgggtgggtag

SEQ ID NO: 13502 - DNA, 349 bp, Homo sapiens
catatgctctcttttgaagaagtcataactgaaaatgtggttgaaactcaggactgctcttgcagcgcaacgtcagcagcagtggcttccctggaacactctggaagtctgaggaacctgcaggcacctgtggttgctggagctctcttctctgcgagaggcagcaggcagttctctgtggagggacccagatggtctgcattcaagaatgtaagaaaggcccttaagcaagacctgtcttttatggtctcttgcacagtctttggattcatcattagggtcacagacaaaccccagaagtcttgctctcagaataaatgtgaatttcattcaaagaaaaaaaaaaaaa

SEQ ID NO: 13503 - DNA, 854 bp, Homo sapiens
ctgatcgccatcgctgccaccatcctgtgtgaccagacgctgcagcacaccctgttgccagccaacctgtggtgggtccagctgctgtagccaaacctgcaatgagtccagctattgtctgccttgctgccgtcccacctgctgccagaccacctgctacaggactacctgttgccgccccagctgttgctgcagtccttgctgtgtctccagctgctgccagccttcctgctgttaatccacttgctgcagacccaccacccaccagagacatatttcctgaaacattttgtcaaagttcctattccaccaagaaacattcgctaagcttttctgagaaacaacattctgacactgaactttgtgatcatcttcttcctaccatgcttgggattctgctgaagggttgcagtctacctcactttcatacttcttcattccctctgtggtaatgtaccaaatggtggtcagtcaacttcacctaattgacatggatacatggactcaaccccagaaagtgggcatcagcttttggcccctatggaacttaaaaaaaaattcttaagactgcatatctaacttcttttagtgatcaaacctgatcatctttttagatatatacttttttatttagtagcgcttggccaaattacatacttctttcgtgatcacttgttaatgcctccccacctggggtttgctactaaaactttattaccctggaaaaaaaaaaaagaaggccttggtggcccagtgggtgggctcggcgcgcctgccttagtgggggggaatgccgagccccgtcacctacctcctggctccggcatcgtcgccatagcggatctaattttcga

SEQ ID NO: 13504 - DNA, 290 bp, Homo sapiens
  misc_feature (1)...(290): n = A,T,C or G
agtaatggggagaaagtgccaaagaaacaagtcaataatcttgagttttacaagccctcgtgtgtttggccagagtttttccctctgtcacaaggccatcatataccacaaagggctgcttgggcagcacgggtcctggaataaacagacacatggaaaagagccatagcagagctgcagcatgtgtcatgcaagaggaaatcaaccatgtgnggttttaagctactgataacttggaagtacttgttacctcaccattaaagggaattgatatacaaaaaaagaaaaga

SEQ ID NO: 13505 - DNA, 431 bp, Homo sapiens
ctgaggatgacgcttctcacaggttctcttcttaggcattcaaaagaaattttctcagatatttcgttagaagaagaataaagaaaaaagtaacaaaaggaatgatgtaaaatagaagcctgtataaaccactaaagacaccattagtccctgcctgcccaagcgctggctctgtcatgccccttctcctggaaagaacagtctttttctaatacgcactggaatcagtgctaatcatcgccatcctcctctctgcagctagcttcatatgtgtgctcccatgaaattaaccaccctcttccacgcattcacatcctggttcactttagcatcctttctgttgtccaggtttttttgctttgttttgtttttggtaaatgctctatcccattttatattctataaagtaattatccctaaaaaaaaaaaaa

SEQ ID NO: 13506 - DNA, 981 bp, Homo sapiens
  misc_feature (1)...(981): n = A,T,C or G
gataattttacaatatgncaaagagaaatgaaaataggctatagcctacaaccagcgtgccttanaacccccctcaagtcgtcatatttggatgcacactggggtccgttcgtctcaggtgggcagtgacaactgttggttacacaagagcacaatgtcagggcatgcgctttggggccagtgcctgtctcttaatatcaatgaganaaataattcaaattacaaatgagcgatgttaactgtggaatcagtagccagcaatgcaaatttactgactggagtggagggataaaattactattgctgtgcttcaaatgggtggactgagtaaatacaatggtacgtgaaacatcaacttattatccgaggggaaaaaatatcggagctgcacactagcaacagagcttttatcttgnctttatgagatatgattctcatcntagtcccttactattatatatctagtttggtctataaatgactttcatatggactgtcgaatgataatgggagggattacggagtgaaattctaagattataggagctatgctcatatatgctcgaaaaggttgtgctagtaaaaanctctagagaacgcctagaatatctctcatacgaatgatgatgctttccctcgtacgtcttacttggagtgaatagccaatattcnnaaagatcaagcctattatagggcttttacggttcatgtatataactgaaacttggatattgacctaattnncaacttcccattatcatataaccntaaaaatattattctacagtaaattaaatacaacatgatactgtgatataataanntattataagaacaatataaaatgaaaaacantcatataacatgttatatcgataattacgaagtcactgtcatcaaatatacatattttacgaaacgtagaatctaataagaatttttccgtctgttgatgtaaagtcttgaagagacttcaatatg

SEQ ID NO: 13507 - DNA, 1460 bp, Homo sapiens; identical to SEQ ID NO: 5913
  misc_feature (1)...(1460): n = A,T,C or G

SEQ ID NO: 13508 - DNA, 199 bp, Homo sapiens
ctgtgagatacgacggtgaggtttcagatgaaacagaagcagatgcaagaatctagctgactttcaggatattagaccttaaagcgacttgcaaaaatgaaaaacgaagcctcttccaaattttttgttttggaaaataagttatttttcataaaaaacttacattaaagtatttatgtcaaggtgaaaaaaaaaaaaa

SEQ ID NO: 13509 - DNA, 364 bp, Homo sapiens
  misc_feature (1)...(364): n = A,T,C or G
catggaactccactttgatctatacgtagnngctgcttgaactaacacagctcactgatgctgtttatttattttttggattttatttttcttccgtgttttattttggattgtttctaattctatgttttcaagtttctattttttctctgtaattgttaatctgttgttaattccatgcagtgtatgttttttatcttagctattgtgatttccatctctagaagtttattttggggctttgttattgcttccatatttttactaacatgcttagtatttcttgtgtcttcttgacgtacaaaatgtaatgttaataataattgttgtaatattattgcttgctaattcaaaaaaaaaaaaa

SEQ ID NO: 13510 - DNA, 138 bp, Homo sapiens
  misc_feature (1)...(138): n = A,T,C or G
tgtatgagaacgtgagactccagtanantgaagagactacatcgatcctgactgcttctggtgaaatggattcaggatttattaagatctatcataaataaatattatgagggtgttttttgttcaaaaaaaaaaaaa

SEQ ID NO: 13511 - DNA, 1599 bp, Homo sapiens
  misc_feature (1)...(1599): n = A,T,C or G
cgcccccccnntttttccnnttcnnnnnttnnnntttttttatnanggtttgtgntnatgttcttgttgtgggttctattggtgttatagtcatagtcgcgtcgactgtacgggtaccgtacacgtgctcattatctcactgtatatataatgagcttatctcgtcacgataacatggagtagaagggagcaccaggtggacgccacaaagatttagatatnancatatatattatctactctcagcngcgtccnatattctgcatcctgtgatacagagcctctcacctcggtcgcccatcgacgatcttatattgctcgcttatatagatgtgtcgtttgtctcatgccagttatattccaatcantcnaaagagatacgcaattctattatatttcgattttctgttttcgttgtttctgtgcggtgggtccgcntcgtgttgtgtggagtgctgtagttcggtagtctgtatggtgttgtcgttagtgtatataagtttgcgtgtagtgatgatttgttgttgtgaatttcagttatgattttatttatatgtgagtggagagaaatgatagggagagcgagttaaaaatatgggtggacaatgcgccggtcgttctggcgccgacgccggcgggagtctggttcgtcgtcgtcgcggcgacgtgcgtccatgtatacacattcagagtgcactgggacgtagacccagtataacaccgcccgacgagagaccgtggacacgcgactcgcggcgaacgcggcagataggcgagaganagtaataattatgtgtgacagtattagtattgtatagttgtaactaccgaacgtaccatcggtgtgctcgggtatcgatatatactcatgaccgcaccgcacgcccgggcgcggagtcgcatgtatgcaatctaattcttatcgtatcgcgcgcgccctcgcgcacagcaaatacatgtagcctgacccgactcctttgcgctgctgtcgcgtagcacggatggtgatgatctattcncgatgtataattgcctctccttctacattgtcgtgacttataatgttatctctaaataacaggacggcagccgaatcacgtgatcaccttattattaccacgcattccactttcatctctacttcttcattcttgtattatatgagatatatatagtctagagtttccgactcacgcgcgtatgtgntgaggttgtgtgatacgacgcgcgtaggctgcgagggtcngtgatcggaccggctgagccttgtgttaagtggcgtgtggattcgtggtgactagtgtatgttacgctcgccatatattatatcactctctttcttcttatgcttcggtctacgattctctatcatcctgcgcatccgcatgtacatgttatatttattattccccgcgcacaagtgactgtagcaggagttcgtgatccgcgacaccgcgtttcattacgtatagcggtggagtgttttggtggcttccacagcacgcgatttatgattttatttaattncagacaccggataggaacnacactatgtcggtgagantagtcgtcgccgccgatcgccgcagcagcatcgcg

SEQ ID NO: 13512 - DNA, 1053 bp, Homo sapiens
  misc_feature (1)...(1053): n = A,T,C or G
ctatatttaaaagggacatgacataagtcgtacaatgtattggagtgncccctggtagaagcaccgcgcagtactccatttatattgaagagtttacctcgttcctgactgcttctggcgaaaaggaaaacaggatttattaagatctatcataactacatattctcgaggctgttctttgctcataatacatcactgcacattcacacaacacaccaaatcagatcatcactcctatctccctcctattacaccgacatagtgtcagcataaaccatacttggctcgtctttcccctatactgccagagagacttccggcggcccacttcnccctacatggagtcggcctacgccctcacgccccgccgatccaaaccctccccttgtccacgcacaccgctcccaccctcccgtcaaagctggcactcaatccccctcattctgccggtcaccatctcggctacttcttctcacactcgcncccgtcaccgtccccccaccccacctctcccacatcttacggcttacctctccgtctacacgaacaacttaaataagtgtctagttcatatgtgtctgtctctcttattccagcctcccccccctcttctcattcctctctaattcattatagcnccactattcatacaatgtgngagactactcctccacaatttcttttcaactcactacctagcctcttttctctccacaacgatatcttacgcccactcattcataaagatgcgcctttntnatataatccctacactacagtacactctctacttnnctatgcgatcgtgtagacggccatggcgnctctgccaccgcccaatacccccgtccactttcaattcataacnagagttcactacacacaccgccttcgtcagccccgccgctcactgtnaccctctcaccacnctcccacacgcaccgcccactccgttattgtatcctacatctttatgcatctctnctctcctagtccctccgcgtctgatgncctccttgatcatgacagttacgatgnttctctctcaaacac

SEQ ID NO: 13513 - DNA, 1289 bp, Homo sapiens; identical to SEQ ID NO: 5938
  misc_feature (1)...(1289): n = A,T,C or G

SEQ ID NO: 13514 - DNA, 698 bp, Homo sapiens
cgggtaagaagaatggggattaggggagagaggggaataaatagggaaaataggggtgggtgtgaagaaagaaaaaaagggaatagggggtaagggaaaaggggggaaaagggggggggtatattgaagataagagaggggagtgtttggtgtgagagggaaattgggaagagaatttaaaggggggggaaaaaggtgaaaaaaggggggaaaaaagggggggaatagtttttgggggtttaaaaaaaaggggaaaatataggggaaggggggtgtaaagggaaaaaggaaaaagtgttaaaaggggcaaaaaaattttttggagaggaagggggaaaataagaggggggaagaaaaagggattttttggggaaaaaagggttttaaaaaaaagttttttagggggaaatatgtatttttggaaaataataagagaggaggttaattgtaaaaaggtaagaaaaaaggttgggggaaaaaaaaaaaaaaagggggaggtaaaaggtttttttttaggggggaagaggaaaaaaagacccccctaagggagggaaaaggttaaatggatttggggggttttgggggaaaaggaaaaaagggttttttaaaaaattttaaaaaaaaaaattaggagggggttttttggttaaaaaaaattttgggggttgggggagattttttattaaaaacccaaccac

SEQ ID NO: 13515 - DNA, 731 bp, Homo sapiens
cccgcctccctcatcatcttttctgatatagttcagagtcagcgcgtaattctgtggtgctctggttagcgccgcattcatcgctcttttattaatacgcccggtagatgtgagtcgtggcgcctcgaggtgtcccgaaccaatagaccccaccagtgtttatatgccctctatgttccccggatcctaagctaatctagtccgggaccgtaatattaaatgcgcgggcataccaccgcccgtctattttacctagctactatatgacacgacggtgtatacctcaaagagatacatttttagaggcaaactttacccacctacttcataccccccccgaatatttttttccaagcacctgctgaaattatcccactcgagcctcctccactcgctatttttgggcatcaaaagaccgccccgacacttcctggttctatgcggtaccattattttggtcccccgcctaaaccacgcccaaattcctgtggccctcagccccgcgcgcgatgccccgactcgccttccaatccctacgggtgcggaggtaatccaactcccttttgggggcccatttaacaaattgggccctccaaaaaaaaaaaaagtttccctcgcgtccccgcttctttctgggtcaatggcaacccaggatttattaagatatttacacaaaagaattttatgagggtgttttttgttcttaagaccttccgggggtttcaaaagct

SEQ ID NO: 13516 - DNA, 240 bp, Homo sapiens
gttaatgtactttgagttgttagaaggaaggggaaagaggtcttgtacaactacaccattataatcacattataactggaaagttaaggaccagatagcctgttatgaataatttacagctgtcattgggaaaaacgaattgttaaatatcactgaaaaaaaaatatttacaattttatgtcaaaaaataaattttttccagttccctttgttctttgttagcttttaaaaaaaaaaaaa

SEQ ID NO: 13517 - DNA, 842 bp, Homo sapiens
  misc_feature (1)...(842): n = A,T,C or G
cctgtaagaactacactttcacacttgtcaagtatgacggttaattttatgtgtcagctggactgggctaatagatgccaagattgctggtaaatcactgtttccaggtgtatctgtgaggacatttccagaagagatgagcagttgaagcagcagactgcgtaaagatcaaccttcaccatccacattgtgtgcatcatccaattgactgaaggcccacacagaacaaaaagctgaattctctctcttcttgagctggacatccatcttcctccctcggcatcagagctcctagtccttcagactctgagacttaatctgcagtccccggttctcaggcctttggactcagactgaattataccagtggctttcctggttgtccaggttatagatggcagaatatggggtttctgatcctccatcattgcataagccaattcccataataaataaattaattaatgaataaacctcaaaannaaaaaaaacagaaaaaataaactaaaaaaattnttatagtttacaaattttttattattgctcgagctggggaaaagatatctaanctggcccctcttgggctcacgcggggggactttggggcgctttcctctttgggggggtaaattcagaacccccccacatgacccctggccccgggcgtgtcggcggggggggcgggtttcctttctcaaagggggtttccggttttcccaatatgggggaatacccagagaaaacttttgaccaaagggcccaaagggccagaccgcaaaaggccgggtggggggtttttccatggcccccccccggagagtacaaaaatcccccctggaagg

SEQ ID NO: 13518 - DNA, 903 bp, Homo sapiens
  misc_feature (1)...(903): n = A,T,C or G
catggtcatgaactgagcgtacttctcttcaanacggaggacatggcatcctatcatacacagtacactatatgagacacgaaactaagaatctatgcgtcagtaacttcaagccatactacaaaggaggaaactgctcatcctcactagatgcattcaacagacgcctgctagcacagtctgatgaagtgacatatggggaatttgaacataactatgaaggtttaagtataggaatatgtgatgatgaacactttgggaacatcttacctactccatgggggatttaacctttaataatacatatgcgctcaacactaagcattaggttggagacatgatatccactgaatggatgatcaaacactggaatatattttcctcagacttcctttattctgccttctcggtagataggtctggtaggtgttgctttgtcatacgtgttcgatttcctaacgagcactatgcacatcgatcgacgtaggcgtgtgttagtgtccgtgcatgtgtatgcctatccacatgggcttaccttgaaaaagacctctttcccgtgtatgacccaacccgcggatatttcagaagcccttttcgattaacctccttcagaaagcttcatactccttaaacaatttggccatatctacttattaaccgcggatggtgttcttttccaattggggcttggtcctcatacctcacaattatttcgccaacctggtccttattcgaaaccttaattctggcccacagccacttgagaaaaatacattgtcggctcaacacactgaacgatttttaacgagggttcatataaaaatatgtttgcgccgggtgagcttcggatgtatggcggttttacaacatttcgatggacgggaggaaaccccattgttgtct

SEQ ID NO: 13519 - DNA, 931 bp, Homo sapiens; identical to SEQ ID NO: 5967
  misc_feature (1)...(931): n = A,T,C or G

SEQ ID NO: 13520 - DNA, 354 bp, Homo sapiens
  misc_feature (1)...(354): n = A,T,C or G
tgaacgaaaattattactagagaaaaaaaaaaaggncctagtgtaaaaccggtcctgcattgaagcgaggaccggtgcgcagtgccagcactgcgcgaaagatgatctgtcacgagcgaccgtgcacatcgaacgcactcataaggcagtgagtgctcataccagaatagctgaatgagcagcatgcaaactagctttaggatctgagccactataagtaactacctactgcggttggatggccttacttatggagcactgaagacgatcaccttgggtgaaaggtaatgaatgatcctctctgactgactctctgtgctcagtcacttcggatgaagtgaacgcatataaata

SEQ ID NO: 13521 - DNA, 1254 bp, Homo sapiens
  misc_feature (1)...(1254): n = A,T,C or G
tctgttnagtgttattagatcttgtatttgttaatatatgagagtgaggatactgctttntattntattagtactctgtcatcacatgttatgtagaattatttgtgatagtttnatggtaangttacaagagngggncgtgcaggccgcttcnnaacntccggnacacgccccnnactccgaccagatctcgacatgattaggaatgcatcgcagggacgaagtacagacgtacagagagancacatgcagcncnaactgacacaagaaaggtgnccacagttgaaccgctagagcgcttggcagacgtcgctncgcctccaccatagtttacaacgacacacgcccagcnagagcgagagagcatataagtccagagcagtccgtccagcatgccactccatcatactaccatagcgaccttcccgttctccttcatccccgacccgaccacccagcggcgcccgcatgtcccacaccgccangagcgccnngcccgcgcccctccgtggagttggtcatgatttggaaatgtncatgtgtgncatttcagagatttataatgtactcagagagaccatatcgtaatattatagantgcacgcactccctgctactcctacacctcgctactcttctcccgcttatctatctcactccccttccctgtctgccaactctgtcaatcttcctctcgacgcgtcncgcgttanctcgacagactcacccgatgttagcatgcttttaagctcactcattcgcgtggtacgattcttgtcgtacatcattactaacaagatctcacacacttcacggtgcnccaatctgccgaccgcgaccgcccgccgctcacagcagtacattcttnccgtagcgacgacagcacgcagtcgaccactacaataagtgtnntcgtagacacagaggccagctcttggccgtaccaaatcaccatcgtgcatgncctatatatgtccactgcgctctgatagcgtagngctcctccaccattaccctgcaatgctcaggccccgattccctcaagctcatccttctattagccattgcgtcttgactcactcgctccacctcccccacacgcgaccacgccgcgccgcagngtgtaatcacaagcacgnaccgctcacctcgacctnatacgtacagaggacgcagccgcatccagatcggtcccacatcgccacccgcgtnccctatataggataacatcacacatatgacagcgcaagtatc

SEQ ID NO: 13522 - DNA, 766 bp, Homo sapiens
  misc_feature (1)...(766): n = A,T,C or G
atgaccacccggtggagcgcgtcggccaggtggggtgaggaggcgccgcacggccgctcctccctgatctgattttgggtcgcgcgggggctcgaggcggcccgcggacgggtgcgccgcgcgccggctcgccccccgcgctccgccgtcagacggcgcacgggagccatgcggggcaccctggagtgagcgcggtgcgcgcccgcgccggccgggcctcccactctgcggacgccgcgcgggcgcgcgtcgcgggggacgctgcgttagtggctgagccgggggcgcgcgggccgggcgcggggcgggtggggggatgcgggtgtggtcgccgagactgcgcgtttgctcgtccccgcgccggccggaggcaggcggcggggcgggcgcccgtcgccgccgctcgcggggcgcgtcgcgcgcgcggcgcgtggcgcggcggccgggcaggccggcggcgccgctgccgcccgggccgcccctagtgccacgccgggggcgcgcgcggcgcggggcggttgccaggccctctgtttcagcgccgcgggtccgtataggccccccccccgcgggggcaggcttgtgcgaagtgaatgatgcagtgtccctccgcgctatcaggccagcaagatagaaggagcctctcaccgaatgcccaggcagagcaaagttactcatcaggcaaggactactcataccaggattgttacatgcccccgtacccatagttntttgttatttgagccactaaaaaaaaaaaaaaaaa

SEQ ID NO: 13523 - DNA, 862 bp, Homo sapiens
  misc_feature (1)...(862): n = A,T,C or G
cttccgcttcgagcaagggttcctatcgagtttataactttttgtacgtgacttacccgtccgtttactgtgtgtattattccttacgatgtgtggcgaggttactcgcttactgtcgcatctgttgaggtagtgtggtgtgctnggtatgtgcggacctattaatttatactgcgcgccgcgtgtttgcgtttgtcgttggccatcactattcagggtatattatctggagtattgtaatttgtgcatggcggcgtcatgattatagttgttttatagttactgtatctagcttctgcggtttgttttgttcttgtctgcggtgcattgacttgtgttcgatggatgtttcgttgatctgttgtagttttggtttataaggtcccctttatccctcttacttttttgtgctttgttgactgatcttgtcttatccagattttggtgtatgtccacgtgcggttcttgttctggggcttttgattgtctttatgtattccgtcctgcttgagtctgtgttggtgtccctcttattggtttgcccacgccttttagctagccggatgttgcagtggcttctggctcatgcattgacgtccacgggtgctggtaagggccagtgcttgatgtagttcgtcttcactgtagggtgtcagcgtttctaaaaaaaattatgcagtagtgcatggtggcagtgtctctacgtgtcagcaggcccccgagtatagaagttgtcctctctccggaatgaccttgcgagagcagaagttactctgtcaggccatgacttctcatacctaggattgttacatgagcagtacatatacttcttagatatttgagccactaaaaaaaaaaaaaa

SEQ ID NO: 13524 - DNA, 1365 bp, Homo sapiens
  misc_feature (1)...(1365): n = A,T,C or G
gggagggagagagaagtaacgagggcgcccaaaagagagagcccctcntggtgcaccggaggaattgcccttanagctggaaaaaccagaaatggaaaggaagaaggcatagagagaaaattttccttatatgtgtgaaacgcgcaggctggatgaggaataaagcccaggaagaccgctgcagtactgcaaaaggaggagtgtgtgactagtggctggacggagagtgggagggatgtggatgggacatcgtggatcggaggacgtggagtcatggcgcgttagtgtgaaagagtgcaggcgggatcgatagggtgggggaggaacttgttttcgggaccgcgactgtactggtgaggcaactgggtagcacagtagcggcggcgtcatgcggaataggcgagcgcgctgggagagaggtgaatcgtgaagggcgtggagtcagtgcgggtgtggtacgaggaggctgtcaacgtcggtgagcgtggaagaacgacgagaaatgcacttcggcgctagtagtggcgccgcggagaatgcgaggaccgcgggtggaggccgaggcgccgcgccgaataggaacagatcgnacggacatggaggccggacacgtggcgcagcaacccgcggcccaccgcggccngacttgtcgcccgagacagcaccgcagcgcaagacgccccgcgcgcgcgggctctccgaggacgagntcaacgacaagtgacatggagccagcgcgaggcgactgagtggagacgctgcgcgtcggagagagagtgagacgcaactgatgtacgccgagagagcaggctacagcantacgagacggcgcgagaactccacggcgaggagagaggtgagtgtgaggtgaggagggagagagagtgtcaggtctntgcntgcctagacgcgagtccgngtgtacgctgcatgaccngcgtgatggactagagtaggtgacatcgacgtgacacgagtatactcctgtcncaccagaggtctgtacgagcgcatgatcacaccggtgtcgtagcctgtcagaggcgcgccaaggtcgacacgtctgagcgaggagttgcggactcagtctcacgcgtgcnantacgtacgtgtcgtgaggctagagnagcgcgtactnacatcgcacgngcgagtatacagccgtgagtgtcacgtagtcgcagcntagacagcaggcatagatgtncgatgagtacacagtctacgcacgaggatcgatgtcnancgtgcgnagtgaggtagagcnagcgacacagaggtgaggacgagcgatgagacacaggnagcganagaagcgtacggtcgagagagcgagngagagaccactacgcgcggacacagcgt

SEQ ID NO: 13525 - DNA, 1626 bp, Homo sapiens; identical to SEQ ID NO: 5997
  misc_feature (1)...(1626): n = A,T,C or G

SEQ ID NO: 13526 - DNA, 384 bp, Homo sapiens
  misc_feature (1)...(384): n = A,T,C or G
ctcaacgttnaaaagtacgtcaaagaagaagtanaagaaaggggaagnccttagttggcaacattgggaaaacccagttcctatattgtaggcagtcctgtgaaaaggcacatgtgaacgatctcggaagtggagctgctgaggcttgccaacagccacatgactgagctcaaaagtggatacttcagagactccagccctggctgatagcagaactgcaaccccatgagtgactttgagccagaaccatccagctaagtaacacccagattcctgagccacaggaactatttgaggtaataaatatttgttgtttccagccactaagttttgtgataatttgctacacagtaataaatattagaacatcgaaaaaaaaaaaaa

SEQ ID NO: 13527 - DNA, 273 bp, Homo sapiens
cttcttgtaccagaaagtttttgttctcccaagaaatactgaactgaaaagataattggtattcaagacacacatgttttctaccagcaaataagaagaaagcacaacagtattcttgaaggatgctgatttttttgtgttttgcaattctgcattttcaaaaacgacatctgttttgtgagtgactaaaaactctgggggaagaatttgtaaaaggaaataaaattgtgtttctgagcattttgctccttactgccttcaaaaaaaaaaaaa

SEQ ID NO: 13528 - DNA, 178 bp, Homo sapiens
ttgatcgaaaagtgttctgagagacggctgcaaggatcgacgtccttttagcacaaacgtgacactccaagtacattgaagagtttacatcgatcctgactgcttctggtgaaatggaaaacaggatttagggagatgtatcataaataaatattatgaggttgtaaaaaaaaaaaaa

SEQ ID NO: 13529 - DNA, 992 bp, Homo sapiens
ctttctgaacctatgttatgcgcttagttacaaaaccaaaaacaaaggctgagggaaacctcatacagtggtgagaggtgatacgaggggaggagactgcaacctggatttcatccccatccgtggcctcacaaggccagctgcatctcgaagatccgcgcacctgcacacccttgacacgctcgacccaacctcacagactcctacatcatagcctccatatagacataccttctaacttcattcttgcgggggtggagcatcatcccacacgcaaacaccctaccatctgatacatcacttcttttcttatcacccacggcatcacaccaccaccacccacaagagataacaaccggcatcattcgaccctatcccaaaaaaccaaacataacaacaatactatacatccacgacaccacccgacgaacgcgaccatcccacccatacgcaccccgacgtatacaccatatccagcgttaacttaaatccacacttctaacccccaaaacagctgccaataacacaacaacaccaacacgcacctccccagaattacatcgcccccccaacaacatcaaggaccaccacacaacaacaaaccgcaccacacaacctacaacctccgtcccacgccaccactccagcaaaggcccggtgagcaccgtagcacttaaaccaataccactaccaacacctactccatttcgaacacacgtgcctctcccatcaacactcaaccaattccctactacgacgtcaccatacgccatgtaaccatctagaacccaaatacacacaatcccctcacgcacacacctcctaactaaccaaccacaccacaacccctcacgacacgccacaccaccctccacaccctcacttataccctccacctcgcctctcatcctctgctcctccactacgcactccatctacccgcgaccacgcccacggacagcgaccatacacagcatgcaaataacgactac

SEQ ID NO: 13530 - DNA, 827 bp, Homo sapiens
ctaggttctcttaaattatctctgtacacaattgtgtggtccatgaacaatgacagcatagtggactctgtggcacggcacccagaaccaccccctttcaagacagaagcatttattccttcacttcctggagtgttaacaactgatagctaccagttgtgcccgctctggacttttgcccatagtggcctatcctctgtgattatgcatttgtaactgtgttcttcctcttttgaagacatcagtcacattggattagccacccttatggctgcatttcaccttgattaccactttaaaggccctgtatccaaatacagacacattgggggtcatcggctccaacatactgctccggaacccacggcgcgctggattatgactgagtacccaacactttatttggccacggccggtaggattgcttcaatcctcagcacgcacgcaataactcaccgataaatgtcccagcccgcaccacaccggacgacacattcttcccgaacatccacaaatcatgctgcgagaggggcggcgcgtccataggcacacgttaccacgcgtagcgcgtatgagggtcgctacctccctatttagcatgggggggtagtatgataagtgcacactgccggaccgccagccttcttgacctcatttctcaaccccccctacctcccccactcccctcgtatctccgtatccagcacacatgccacatcgccgcgtctccattcatatctcaccgcgttccgcagcgcgcaccacatgcccgaccccgtcaaccacacccgacctgatcctaggcaccctatccactctcctccact

SEQ ID NO: 13531 - DNA, 839 bp, Homo sapiens
cctaggtggactcggaacctctttatatcaggctgccgtgctgtctgccaatgtattgtaattgagacctgcaagggctcttctcacacctgggaacatcatggtgacattgcatctgccaccagctccagccccaggaaggtagcatgtgaggacaggtgtggctagttatcatcccgacgcctggttaaggcacaataaaaatcaaatgctgttggcctcccttttgaacagggtccccaaaaaaaataaatccggcctcgatggcctaaccggcggacctctcgacgactctcccctttacagagggtcccctcccttgatcctccctcactctctcccctacccctgtaaaacactattaccacccccagtccctctccctctccggctacacctctcctctcccctcccttcctcgaacctcccgttatccacacctcttctctcttcctcaacacgctccccacctcacctatccccccccctacaccccctctcgccacacactcattctccccccccccccccctcgacttcctatctctcttctcccccctctcccttctctatcaatctcgtgctctctaccaccatactggtatttcacttcttgctctctgcactcctgaatttgtcttttatgcccctctccgctcctctccttctcccctctctcctctcttctctatattttctcaatatacatctaactaatttcacaacccactccctccatactatcctaccaccatacactcctccctctccttctctcactaacaaatcacacggaagtactcccacaaccctcagctccctccccctctccctccccc

SEQ ID NO: 13532 - DNA, 1194 bp, Homo sapiens
  misc_feature (1)...(1194): n = A,T,C or G
tctaacagcacctcatcctattacgtatcttcaaaaactcccaaacctcactgcaacagtatccagtgtcgtctgagaacactactacaattctcattcctagaatatttgcttgagacttgctaaataatactgttaaagtgaacttactgctaaatctatatctgaatcgaaaaaggatcatcgtcatatcgcactacctacgggctctgtaacatcaataccaacactcactcacaccgtacattcgcgtcccctcctcgcaccataaccctaacgacaccacccattccaacctccaaccccaccatacctcacaccacaataaacacccctcatccactcccccatactttctcccacaccccaaatcaacacaacgacaccatcaccccacgcctacacacaatcccacatactcacacataaccaccgaccactatccacaccaaccactctccccctcctctcctcttccctacttcaacatcccacatcacacatccgagacattagaaaccaatacacactncaaaataatcactttctttaatctcgactgtctcacatcagtgtgtcccccagctcgcaacacaggttaaccgatattgccctcccacgtactcgactctcatctcgtatcttacgatatagcgtaacacagacaccataccacaccaaccatcgttaagtctaacatcttcaactacaaataatcactacgtaactctctttttcctcttcgcctaccccgtcacactagcttctacatcaaccgcgtactactacaaacatcacaccactacgtacactaccacccaacgcctctcaccctcctaccaccgctcactaccacccatcaactatcatagacactctccactccatctcacgctccaccatccaacactatatcctcactatcgatacatcccaactctagactacgcgcactcccactctacacctctcatcagctcacatacactctcatcacacgacacgcctacaccagcgactcctacctcccacaacatcactcgctgtgagctctaacaccacacgtcgtctacgtccaccatctctactcttatcttacacatactctctcacgctctcctcgcgcgcgctcatacccacctacccgcaccatagtgcgcacacgccnctcactcttcattcacgtctactcat

SEQ ID NO: 13533 - DNA, 1519 bp, Homo sapiens; identical to SEQ ID NO: 7287
  misc_feature (1)...(1519): n = A,T,C or G

SEQ ID NO: 13534 - DNA, 803 bp, Homo sapiens
cctcaccgaaacgccttcccatgagtttgcccataaccatgggtggctcactggactttcatctgggcaaagagaagggtgtgctgacactactcatggctccttcatctgggacctacccaaatcccgtggctttgctcacaatcatctgatcctgttgtgcccaagatgcctgctcccatgcctggatacctgctgcagctgctccaagccaggaccctgccaatctgtcattttagatcttcagctctgggttggtcttccaggtgcctctgcctcccaaggaaacccaaggaactccgccagaaagggaatgcctaaaagagcagcagtggggactgtaggggtcctcctgcctgcccctttgttatccaaagtggggccctgacttgcctgaagtcacacagggactccggtatttcaatgctcggccttaagaccgctgctattccgttacttctatttaaaacccctacacaagtcttcgcagacactcacccggccccttgtttggactacacgctgcacccctgccatagctgaacaccttcccccaccacccctcccccgctccgctccgctgcccacaacacttcaccgcgagcgcctcactaccacccttttccataggtataccgccgctcgctccccgcgccgaccccatccctctctcgcccccctccgcctcccccccgccgcgcactccgcacgcccccaccactcccacgttccttcactccccgccttcccccatccatcacactccgcccctacccactcccgtcagcccgctcctgctctct

SEQ ID NO: 13535 - DNA, 966 bp, Homo sapiens
  misc_feature (1)...(966): n = A,T,C or G
atgatgtaaaatagaaggtatatattactttaagcaggagaagnagatctccgtagactactagnaatacctgtgtactggataatccaaagagaagagatttaattgactcatagctccacatggctaggggaggcctcaggaaacttacaatcctggaagaacgggacccgaacacactcctctccccatggaggcaccaaacagaatagctctactcacggcaccactctattgctctgctcccatcactccctcacggtatacttccacacataagaccatactcaccacgcaccgctcccacttcctccctccctaaccccctcccctcgccgcctcttcgctgttgtcctatggtcgcatctactctcttagtatcctcttccccttacactgtgatactcaatctgaccatgaccactcttccacaccatccgtccctcctaccacgccttctctgcttcttccttatgtaaccctagacgtactatctcagggcacacacatgttatacaccacacaccagcacaaatacaagcttgtcacgcccgaccacccatcaccttcccccccacaccacgacccacaaccaaacgacgccagcaacgcaacccaccacccacgctcaccatatgcagtctatgaagaaaaaccgacgcgacgctaagacacatgatcaaacctgatacgacaatccctccgaatcaatactacccacactgccaccatcaccctacactaccacgcccagcgtcgtagacataacactattactaacaccaatacaataacaaaattaaacacctaccatcactcatattcaacccacacacaaaatcatgcccacctgatatagtcacacccatattcaccaacagtacctacgccgacacactctcaaatatctcctaccaagattacacctcaagataatatagctaactactcacctcggacgctgtg

SEQ ID NO: 13536 - DNA, 309 bp, Homo sapiens
  misc_feature (1)...(309): n = A,T,C or G
tctgtcctgacaatggcttcaaaatangactgaaatctccttgaggagcataatgtggagggtgggccctaatccaatctgtcattataagaagaggaaatttggacacaaaaagagacaccaggggcgtatgtacacagagaaaagatcacgtgaggacacagagaggtctgcaaaccaagaagagaagcctcagaagaaacataaccagccaaccccttgatcttatttttgtagcttccagaattgtgaggaaataaatttctgttttaaagccacaacaaaaaaaattcgcctcgctggcctcaa

SEQ ID NO: 13537 - DNA, 889 bp, Homo sapiens
  misc_feature (1)...(889): n = A,T,C or G
tcttatgtattttgaagaaggtaggaggatgagcaaagtgattggacagccacattcatggtgctgagaaaagaatttgcttttctggaacatagcctgtgatagcagaacaccaccctgccaacaaacacgttatgacgaggctggacagtcacatggcactatacaagaaatattaaaaccgttcatctcgccacaggagcgacctaaccccacccacaaccacacattttttctcaaccaccacacaccctcaccccctcccacgaacaccaacacacaccacgacccaatagacttcctctccacagcactactctccttactctttttcccaaccatcgcgacaaccacccacaccctccacatcacccacncacccgcgacccccccctccgctccctaccatatccatctcaagaccagcacaatcgtcagtgtagtcggaacgacctctgtgtgaccaccctccatctctatgaacaacgaacccaagcagacgcacaacccggcaagagcaatcaaacacacaaccaccaccacagaccacgtcgcctcctcccgcaacacccacgcaccaacacaacaaactacctacattctctctccgcgctcgaaactaccccatcccaaaactcagagacacacactccccaccacccaccagaacaccaactcccttcacactatccccatccaaccacctccacacaccctcacacaccaacccataaccacaccagtcacactcatcgccacaaacacaataacacaccacctatcccactcctcaccacccacaccaaccaccccatacaaccacatcctctgccatatatactcactccaacacactcctccacttgcgtatgaacccacaccaacatct

SEQ ID NO: 13538 - DNA, 489 bp, Homo sapiens
cctaggctggcatgcaatggtgtgtatctcggctagcccaacctctgtctcctgagttcaagcgattctcctgcctcagcctcccgagtagctgggactacagtcttgcacctccacgcccagctaattttgtatttttagcagggacgtggtttctccatgttggtcaggctggtctcgaactcctgacctcaggtgatccgcccactcggccttccaaagtgctgggattacaggcgtgagccaccatgcccagccaattgttcctctttccatagaaaaatctggttttgtgtcactgggtaacataagcagcaggtcgggatagaaaactgatgatgaatatggaaatcagtcacagagccatgacaaaaacactggatatttccactaaatatttcccaaccaatgaaagaaaccagaaaacaaaagctgggaagtcttgttcattacataccatgtaagctcattaaaaatgtctctaacaaa

SEQ ID NO: 13539 - DNA, 891 bp, Homo sapiens
  misc_feature (1)...(891): n = A,T,C or G
acagtataaaaataaatgtcagtctatgcttagtaacacaccaccccacngtccaccgtccgctnatatagctaaggtagataacaagcacaacaaggacttacagcatttgctttgcaccagacaccatctaaaacacttcacaaatattaactcaaaggaacctatcatttccactgctcaaaattactcctgaagggatgaggacaccaggatatgccaccggaccactgaagaattgggagcatctccctatcctgtatgagagaccagcaccagacctgagccctgagtcagaaacacactggttctgcacagcccccacttcagcctgcaccaggtggagccagctggggcttcacccccagctccaggactgcaggcaaatctgctagcagtgaattttctcagtttttgcgtgagaaagtctttttgtttctcctttcacttcttgagagatatctttgctgaaagtagatttctgggttgacaacactttttctttcaccactttaaagatgaccctcctttgcttccttggtctgcacaacctttttaccaagcatcctgcttaacttctcatgggaccctctactgcgggaatgtggtattttcccaccaccctttgtccccaagtcctcgcaacaccctttcttaatccccctttgggctcaccctcttcctataactacaacccaaatcctcttgtctcccacgactaaaccctcctcaaccttcccgaccgcctgcgaacctcccttcctccctttgcgggttcatacaagataaataccacgctccaaaactcctctcaaacggacagaacaaagatccagatgcgtccaaccaaaaaaaaactacacctacacgactcaaccctaagtattcgcg

SEQ ID NO: 13540 - DNA, 226 bp, Homo sapiens
ttaggtaaacagcaaaaagcgaatgcatcacatcttgttcatccatgttgtcacaaatgacaagattttctattttccgactgaataatgttctactattgctattcaaaatgctgcttatgtcctctatcactacttcacagagccacaaatactggtgtaatattgagcatgatttatttcaaaccaatgaaataattaaaataatattgtttcagaaacaaaa

SEQ ID NO: 13541 - DNA, 405 bp, Homo sapiens
ctcagtgctcagcagattccttgtattgaaattacgatcacaggttggagtgctacttaaaataattttgccaaatgttccatctctctgtgttgatgaatataatggatgacaatttaaagagcaaaaaaaaagtgactcttttgacccccaaggatccctgaacactcatgtgctgtctccagcctctcttgcttggaagaggaaagaaatatctcgggttcctttgtcttcgggccacactagctcctccctaccccacttactcaggacgcaccaggagggtgcagaaggactggctgcccaacggaaggagattttaacactgatattgcttgaacttactggcgtgtggcaattaaaatgtgctaatagcagaaaaaaaaacccgcctcgctggcctca

SEQ ID NO: 13542 - DNA, 896 bp, Homo sapiens
  misc_feature (1)...(896): n = A,T,C or G
tattgtagtgcacactaccaccctcgtttctttgccaaggcgctgactcgcctatctcatgctcgcaaatcaaacgcgctcttggatcaggcaagccctcgcgaattcatctaaagatttatccgaaccacgctgggggggacaggggctgaagagctagatcaacctggtaaagttctttcatcaaggattcactccattgaagaacagacctctagactgaccaccggcgccacagaccagacggttcctttctagctgtgattctagagagannaataatttgggaaaggatcctgcccactcgcattattctaaatatcacacacaatatactgactctccgctgccaacgcgcccctcgctcagcacaaagcccccgcctgccttcacttctaccgcacattccggccccgctggcactacgtaacaaacttgttgtccactattctccttccctgacgtgtatgagatgctcttcgccccgccacccgccctcgcctgcttgccgtatctgaggagcctcctgtcagtcccttccttatgtcgagggcctgctcgatcacccctcgctgtctcgcaccccccggcatctctccagccggcttggttctacccatctccagtcccttcagaggggggggttcgcggggcgcggcgggtgtcgtgagatcccgagcgggccgacgccttgccgctacagcggcccgaatggcgtcagcgacccgtatgatggagagggtgcnttcgtcatgtctcacgtacgatcgtcgtccccatggacattcaccagaatttaaccggaatgcccgaaatggtgtcactcgtctcgagactttggtacccgcagctcgtcccccggcacgcgccccgcgccgctctccttggcgctcccg

SEQ ID NO: 13543 - DNA, 900 bp, Homo sapiens
  misc_feature (1)...(900): n = A,T,C or G
aaattctatgaaaactcacaatatcaacaacaaccaacccttcggggctccagatccaatcttgggagccaacccagacctttccacctgccagctacagtttctttgtgtgtaaaacgggatgacaacactacacactccaaaggattttgataaaatttaaatgaaacgtacagtgtaaaagtcttagcatggcgtctgatttgtgtttatgaaatattcgctgttattcttatcgcctccttgactttctatcatcgtctgnccttagaaaataatgaatattgaggaaacttaaatttctcaacaaccaaattctcaaatggaataacgtaaatatggagtctcaaggtctaattactactatatcgcgcactgcctcccccccacgcgaccgacatgaaacatacgactacctgtaactgcaacatttgcggcacaatttaaccgctggcatctttactatactggcgctgcccttttcatgccaaaggcagctcatcactctcgtactacacctttgtatctactacttttaattattggcctcacatatttctcgttgtgtcagatcacgatgtaaaaaagccccacacgactcgtgttctatggttcgtatattattatttttaggtcataccgaaccaatcttaattttgttcccgatttttttttttggtcttatctgttctgatcgtcaatcgttttatctttccttatttaaactatgttacatgttttgtcacgagatatatgtgtttgccctttttgttcgtgatgttcattgatagtctggaaccattttgtagttctcttcgttatctctttatacttaaatgaggtgcatccacgatagttttttgtgccctcctaggttgctgctggttggcgtcaacccct

SEQ ID NO: 13544 - DNA, 946 bp, Homo sapiens
  misc_feature (1)...(946): n = A,T,C or G
ccgtggaaatcaacaagaaacgaaacaaccacacaaccacaanaaatatttgggntactncctnnctgttgcccagtattgagtgcagcggcacaatcacagctcacttcagcctcgacctcctggtctcgagcaatcttccagcttcaccctctcaagtagctgagactaaaggcatgcgccaccacacatgactaattattttttttatttttttgtagagatggggtcttgctatgttgcccgggctgatctcaaattcctggctcaagtgatctccagtcttggggtcccaaagtgtagggagtacaggcatgagccaccaaacctagccaattaaaactttcaagaaaatgtctcctgggtcgaaactaaacaaaactacggagtcgaacatattcttgacctcggataatcaaagttacaacaaaattgtccactgttacaacctgtttgtccaggcaaaataaattataggcactgattaacaaaacaaaaacactcggccctcgtctcggcccaaccgggggggagttcctgaggcgcgctttcccttttagtgaaggcgcaaattctatgattctaagtgtcaatcaacttgcttgcactactagccgatncggtttgcatccaatcgtgtattcaatctgatagcgtggccggtcgcttctcgttgttcctgcatattttatgggcatatatgtatgtgatataacattttttggcgatacgtcttattcaatagtgtccccgtaacgaccataaaagatctaactgtgcatgcattttctcccaatagtgtctcctacgacgccctacacatcaacgcatactcacttgacaactctagcccacgagcccaccaaacaacattcagggcccattaaaccttacgtctcctcgacatgcccggccaattccttccagccctgttacacgacccccg

SEQ ID NO: 13545 - DNA, 891 bp, Homo sapiens
  misc_feature (1)...(891): n = A,T,C or G
gctagaaattagcaatatnctggaaatctaagctgcagcttccagcctgccttttatatagaagaatcacaggcatcttttgttagacagaagtctgcttgagaatatggtcaacagacttatgaaaccacattttctcttaatcaagaataccagacaagtggtggtaatgtgttacttaattacaggctctgtcgcacatatatcattgctttaacagctgtgagtctacctaccccctccaaaacacaaaactcccgcctctatggcctcatctgagcgagcctctgtcttccgcttgcctttgcacgggggttagatagatggaccctctactacacccacttaactcggcctcagcctactcatcgtctcagacacacctgccccacgctcacctagcccggctgcgcctcgcgcgcatttgcccgcgcccccttcgcctctgcactactccacccccccccccacccccgtcccctccctcgttctgctctatctcacctccaaaaaatcaacgatgtccatcttttttctctccctctctccacaggcatatttcctcgattgactacaactaaacgcgcacgctgtctctcaacgtctattatattttcaccaatcatttctgtctagtcttttgtatctctgtcacgaaacgtatcatcgagaaatcaataacaccaccccactaaccccgtccagcccatcatctctataatatcatattgtgtactcttatacgtcaacttccgtattctncgctgcctcgcccttctaccccgaaccacacatgtcagcaaatcccacgacacacacataatcatattactcttatcaactcctcttccccattgttcgcctttgcccgactcccactaacaactcacc

SEQ ID NO: 13546 - DNA, 798 bp, Homo sapiens
  misc_feature (1)...(798): n = A,T,C or G
ttcgatgtgagggacgagcactggacctcncaacatcatcgaggaaatataaaatgatacaaccactttggaaaaagaagacaggcgtgtgaagatagagacacacagaaagaacgtcatgtcacaatgaagatgaagcttgtagttatgcagctgaaagctaagcgatgccaaggaagctaggaagaagcaagaaaggatttctctacagatttcagaggacgcaggactttgtcaacaccttgatcacagacttctagcttccagagctgtggaacaatatatttctgttgttttaagccacccaatttgcgatactttactatggcagctccagtaactaacatacataccatatttcgatctcatcttaattatgtaaatatgagcacttgacttttccaacaatcattataatagcaataacaatcaacaacgagcacaataataggtggatttgctcctaccttttccaaggttgtcagctctcttcaccccacaggcggcatctgcatttcagccctagatttcctacaatgcactattccaccttgccagcccctccgcacacatggctttggccgcctcacaatcgcggtcgtccacagcgagacgtcgcttcacctaaacatcctcctccatcgtcactcccttcggacaacccagaaccctcaccgcgccccaaaacctttcaccgcgcctaactctgaaataatagggtgactcgacgttgcccccgcacacctcctccactcccaccccccgctcgccctgaccccgcccccggcgcacaccccc

SEQ ID NO: 13547 - DNA, 875 bp, Homo sapiens
  misc_feature (1)...(875): n = A,T,C or G
atcctccccatcacgccctacacctctccaaccccacccccccttcaggacatcacagnacatggaataaaggaggcaacgatggtttacagatccagctgaaaccgaatggaaggaaagacagtggatttcatcaagatcctacaggcaaggtgtaagatctgtaattacgaaaggacatatacacaaactcattcagccacattccagtctacaacaaacatgaagaaaatctattaacaatggtaaagcttttttcctctaacaatgaatatggcaatacccattctggagaactcttatactctgttgaaataacgcctcttttatatatgggcatctaccactaaatataaaaatcgccaatttgcacaaaataaaatcgggactcttggcccaaatgagcgacccactgcccccgctctcctttattgacggtacttccatgaccctcactcactgattcagttcccttcgcacacccccctcccgtacatagattcattcactcccaggacccctctctctaatcctcattcattcaccgcacccacacacacatgataatcttcccccaatggtccaccctggccacaaccaatttacaacgtacccaagcgaccacatacaatataataagcccaacaaagagagaatccacaaaaccccacacctctcctaccacgcgtgttatttctgctacgtgtttcaaacatccttgctccnggccgatccagcacctcgccccatttttgcccttctaccttacatccaccccatcccctccctatttaactctttataatctactgtaccaccactcccttctcgaatagaccactatacctcccttccttcccccctgactgcgctcc

SEQ ID NO: 13548 - DNA, 837 bp, Homo sapiens
  misc_feature (1)...(837): n = A,T,C or G
gagacccgcgccgccccacacctccctgactaaaagaaagccggttgtctccagaaccaacctgngaggcaaacagacctttccacctgccagctacagtttctttgtgtgtaaaacgggatgacaacactacacactccaaaggattttgataaaatttaaatgaaacgtagagtgtaaaagtcttagcatggcgtctgatttgtgtttatgaaatattcgttgttattcttatcgtttccttgactttttatcatcctctgttttttttaaaataatcgaagattcgacgaaacttaaatttctccaacaaccaaattctcaaatggaataacgtcaatatggagtctaaaggtctaattaataatatatgtgatctgtatacccatcacggaaccgacctgaaacctcctcactaactgacacccgaccactcgccgagatcctcacatcggcacttttcccaaccgcgcatgtcatcccgaaccgcacaccccctcaccccccttctaacattatatccacggagccccatcccaacggcctcaccgagccccgccgtccaactacccacgaaaacaactcatcatgatccgaacatagtgcctaatttcacactcccttctcctcacgcaacccgcttcaacacaccctactaccccactccccgcaccacactctactacatactctcccttcaccttcctcccaccttccctacccccctcccaccacccccccaccacctccctcttcccgcctcaccgccctcccctccccgtacacccaaccatctcttcttctccgtcctctcactctccccacctccccccaccc

SEQ ID NO: 13549 - DNA, 135 bp, Homo sapiens
ctacccgtctaccctcctggttctgaggctcctgcactgcaaaagccttgtctgtcctgttcacccgtgaatctccagcactcaacatggtgccctaataaatactggctgaataaacgaatgaaggaatgaaag

SEQ ID NO: 13550 - DNA, 965 bp, Homo sapiens
ttttccgtcgcgcgcccggttcgcgcgcgtaggtccgcccacgtcccacaccgcctctgtagtgtcccagtgacactacacttacaatgtactcgaatggaagagctaaatatattatctacatgtatacaagttgtgctgaagtaacttctacttattctaactgcaatgaccactctgtccacatggaagcacctctcatctgaccttgctacatatgcagactcatgctatatcgacctagcaagttttatatcttccaccttatgtatgacttaactttatctgctatttagttcagtcgacctctcccatggatcagtcaagcgctgaatacccatgcattgtctctacttggtacatggatcagccgtactcgttgcgccgtccgagttttactccggtacgaggttctagtttatccgatctccgcaactcggtacccctcttctagatcgacgtagaactgtctctgtcactcttccattagctctcatccccacacacattgctcttcccctattactcaggctcgaatcgaagctaacgctcgaccgtggctgttatgcgactgccactgtccaccttatcctgacgtaccggcgagggccacatgtgacgtacggttatccgttcaccccgtggtcgtcatggccgcgcgagcttaacgctcactcacgactctctcccgtttttagccccacaccgacattctgcgttcgcgaccgtttcacattcgacggtcatttcactccgcccgccgtcgctttgtgctattatctcatcgttaggccccccgatcatcctctgtgtcatgcagtgcggtgatgtcatgccaatcttaggactgttgactggcgcagtaggggatcacggaatcatcaccgctcggtccgtcactgagccagttcctgctgtacacccgagatgccgcgaagtgcgtgcgtatggaccggcgcacgctc

SEQ ID NO: 13551 - DNA, 722 bp, Homo sapiens
tttgtttttaaagagccgaatatccactggaagggtggttagggggcattgaaccccgctgttaacgccccccaaattttttttggccccccggggaatatcaccggggggaaaacagaaattatttgccgaaaaggcctccccggagattgttttttgacaactattttgtttcccccctattaaaaccccggttttttttttcaaaaattaagagaagggtccgggggagaaaaaaaaccggggggggggagaagggcccccaaaaaggggccaaaaaaggggggtttcttttttgccccccttggggggggaaagtttaccccccaacccttttttttttttttcccttggggggtttgggaataaagggaaagaagagggccccccccccccccctcaaaaaggggggccttttttaattggtttttcgggagagattttaaaaggggggggaagaaaaaaacccccccctttttaaaaaaaagggcctttttaattttaaaaaacttttaaatatattttcattttgccaagggtaaattgggggggttttttttttccttaacggggaaacctttttttttaaaacccccccccccgggcccttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 13552 - DNA, 510 bp, Homo sapiens
ttagatggtctttcactctgttgtccaggctggcacgacctcggctcactgcaacctccacctccagggtacaagcgattcccctgcctcagcctctggagtagctgggattacaggaatgaggagagatggccttggtggtcctccttaggttggcaacatccagatgcaattgttcacgtaccagcttctcatagcgctaccaaaagtcttcaactctttaattgggcctctcatgccaagaaccagggagaggcacaaaattcctcactgagatacggtgtgttctacttccatgacttccactcaccattcttagaaaaaggaggtgagcatgaacagaaggaaaaggaaaaatatcattcatgtctgacctacattgtttgcaataagagtaaaattagtctcatctgacagtgaaattattgcatgattcttaagattgtaatagtctttataaatttatcttgatgatttggaataacaaaattaaatgtgcataaaatatta

SEQ ID NO: 13553 - DNA, 443 bp, Homo sapiens
ggctaggtcttccctttcttcctgcttccaccactcaagcaggtgcttgggttctatgctgatgaccttgtttgagagatgtgattggtcagaaaagcagcaacggggctgggcacggtggctcacacctgtaatcccagcactttgggaggccaaggtggacagatcatttgagccaggagttcaagaccagcttgggcaacatggcaaaacccccgtctctacaaaaataaacacaaaaactagccaggcattgtggtatgcccctgaagtcccagctacttggcaggctgaggcaggaggacggcttaagcccagaggtggagattgcagtgaactgagatcacgacactatactccagcctgggtgacagagcgagaccccatctcaaaaaataaataaataaaagtaattaaaaaaaagaaggaaagaaaaaagaaaa

SEQ ID NO: 13554 - DNA, 422 bp, Homo sapiens
  misc_feature (1)...(422): n = A,T,C or G
taacttcacgtcaactgcgtcagtgacaatgataagtcaactcaggactgataatttactgttggctntatcaatgtggggactactgtgacctcgatcagaggaactgacaagacactccttgaaaggaggagtgatggagacaaattctcgaatcgtagagtttaggaaagaatagganaagggagtatgagagacagtgattttgctgcanatactggtcgtagtttttgtacagatgtggagcagagttgccaactcaggtgctgggctttgcaanggagggttgtntgttgtattggtgttaaatatggaagaaaatacagcaagattgtgcattgaaggggaatataccatgcaggaaaaatattttgctattacaccttagcacttgttacttttgcagggtaacatcttttcct

SEQ ID NO: 13555 - DNA, 488 bp, Homo sapiens
  misc_feature (1)...(488): n = A,T,C or G
ggaaatagattattctccccacnccggcccccaacccccccctttcaggagcacctggnanaactttttattntactaacgctntgactggaatggtgtgctttcctttaaggaatcaaaccttgaattcgtggagccaataaaagccccttgggaaaactgactttataccttgtctacacattccctgtacaggggtcctaacccgggtctacaaaaaaagactgacaagatgaagcaatgtctgatgaaagaagatgtaactggtttttaaactcctacttgacttcatttactgaatcaaatattatccatcagattggagttgcctctgggttagacttgctgattctgcactctagcagcttcgcagaccaagctgtcagcaaaagaatatatataattgttggtacaaatttgctgtgatacttgcattgctcccttggtttgtaataaatatagaagttttttctttaaaaaaaaaaaaa

SEQ ID NO: 13556 - DNA, 976 bp, Homo sapiens
  misc_feature (1)...(976): n = A,T,C or G
ctgtctcttaatatanccacgtatgggggcctgcaccctggagcagggggagacacgtncacagccaacagtacacgcactgtagcctgtatgaccggttccctcctcctcttgctnngcacggttgggcttctctgcctcttccgtgcngncccgtactgcgctgcctgcggnngatcgcccgcgcgccgtggggggtgcaacaggtggaggcgccgtggagccctggccgcgcacgatcagtnacccgttcgccgtggcttgggcacggggggagtggtagcggcccccactcccctttgantcacaagaaccgggccgctagctgtggcagtggggtgggatcaacggaaaccgtaagagggaggtgtagtgaggacctcgcaaagactccgaggtgtatgactgcgggctgtggcctgggccgtcgtggaccctctccnnnnngggcgagacgagagcagccaggggagggagacggcgaggnngatgtggggagagacgaagagaatttactgaggagatcaanagcgtggggcggggagcttaacagggaganngcggcctgcatcctagccgcttgagngtgtggttacagaggtgncaatacagaaagtggcgagagagggcggacgcggactgagagcggcaccnggccgaggcgtaagacatgggggcggggggggagggcctcctgcttcactcacatgctttcggtaaggatggatcaccgggcgttgaggtgaacattggctgggactaggcctcgtcgcgtgngggatgctaaatcgaacgagaaatctgcttgtccatggggaggggtatgatataaaatggcatccccttcacctaccatacattccccccttnccccccatcacgctnactcaacctccgtggctcgtcgtccatcctnccttnaacctcctncnnnccttcctcctccttcctctcnncctcnccttccttcccttcc

SEQ ID NO: 13557 - DNA, 648 bp, Homo sapiens
  misc_feature (1)...(648): n = A,T,C or G
accttctccacctcctttttccttcctctaatgtttggattcttttctaattcttctctgtggcataaattgctgttcacttataaacaaaaaatcagatgcaaaaaaaatactcttaaaacacatgtcactcactcttatttgtacaaatctgaataaagtatgtgcttttaaatgtttaaatggtagtgactagagaatatgctggtagcaaatgaaggtaaactataaatatatctcttgttgatattttactttaatattgtaggtgaaaacagttattataaacacaaaattatccatacaatcacttaattcctttacatcatttgctaatatatctcttggtgatatttattttgcctaccatcaggcttgccaatctaagctcanaactggtgtagtttatcatttaacatagtagttgacacatagtccaaatctaataaacatctattgagagaataaatataacttttaactctangatttttctccatttctagcgtattcagctaccccattcattttatctcatgtcctaaagatttttgttggtttgagtcccacctctgaaatattcctttgggtggcattgtgaagcttgtcaagataacatgggcctggcaggattccatgatctctatg

SEQ ID NO: 13558 - DNA, 819 bp, Homo sapiens
  misc_feature (1)...(819): n = A,T,C or G
ctagcngtagcatcctttggaggggtacttgagnaaaaaagaccacccaactggattattaaacagccctggagtttgtcctgagcgcaggtggggaccaagggtcctcatcacctgtattcgtcttcctccgttctgaggagtgaagtctagcctcctgtctgcagaattctgggggctgaggatacggcagctgagaaggcactgacctgggaaaaccaccttcctcttcaccctccttcacaaaagcaggaccagcaaccactcccatgtacacagttgatgaagtacttttcatgcaattcaccatttaatctaaaggaaccacaaacaattcacagatgtacttcccgtcgggcccctgataatcagtagtgcttttgctcactctcatgccaaagagatactcagtgaatgtggtgggataaatgaaacagaactgacagccanaaaccactatttacccccaaattccagatactttatgaaagtccctgacaggagtgataaaggatctgggacgatatgccaaatgcatacagtttaatgtttaacaatatgcattagagacagatattcttcataaacaccagccttaaaaggaaacatgtgccaggaacagattagctattaaatcagaggacttgtggcttcacctcttatgtaggatttattggtcgagaaggctctgcccttaccaaagctgggctagtattggcttgcgttaggggaggggatggataacgggtatattaaaacaggctcgcccatcgttaatgggggattcaaatttatttaggcgcgaattggggagagtag

SEQ ID NO: 13559 - DNA, 686 bp, Homo sapiens
ttttgtattatgagcaaggagaagtttggacccaactgtgatataaaaaagaaaaaagaggggaggaggcttttttggggtaagggatatttacgatttaaagaacgcccagaagtattcttgcccctttccatgcgaaagaggtatatggtggctctccccagctctcggccacggcgggggttgtacattgccatttggaaagtttaagttgtggaaaaaacgcgccagtttcattaaaaaaatatagagggggggtaacagattggcctagtccacaagcgctaggttatattttggtccaggaatcaccaaattaatgcctccctgaaaaaaaaaaacaaaataagccccgtacgcgaaaaaaacggggcccccccccaaaattgggggcagtggtttatgcctggaaccccagccctttggggggccaaggtgggcaaatcacttgaggacaagagtccgagaccagtttggccaacatggtgaaacccccttttttttaataatccaaaaattagccaggcatggtggcagggacctgtaaaattttttggttttccaatgcatacaaatgttatatttttattatacggtaggttattaaatgggcaatacccctgccttaaaaaaatgtagaaccttaattttaaaaatattttattgccaaaaactgctttccttcc

SEQ ID NO: 13560 - DNA, 725 bp, Homo sapiens
  misc_feature (1)...(725): n = A,T,C or G
ttatcatcttgaaactctagagagatctctgcgcaaaagggtgggattggaaccatgcaaggagctgcctaggacagtggaaaccacccccgcatgtaaaggacaccgtgggctcctcccacattcctcgatcataccccccaccgaccagantacaacaacagaatcatggaacgtgacggaggacaatggtggacgaccgttctcccccgcagcgcacgatggctggttaggggacaggcgaggggcatatctaggaacgaatttcccggccctctaaataccggactaaaagggccttaggcgctnactttagttacgggaaaaaaaatcctgctcttacagggactaaaaaaagggangcccatcgncttcaaataaaatcttaaaagtgaggttttctctcagacagcattctcaccatcagcatcaagtacacagaggcctgctggacctagatccacacatctggaataccctgagtgtgcgagtggcagaagagcgaatggagtaaaggatatctctccggctatctgcatgcacccatgacattgaagcctgtatgggccctacataatgctaagcactcttacttgtctgtaacttgggggaaattaggtaaagctctatactgatcaaaattgggtttctcgctccctgatagaatttgggttcaaaatagaaaacaataaaattttattttgtgcaaaaaaaaaaaaaaaaaa

SEQ ID NO: 13561 - DNA, 762 bp, Homo sapiens
  misc_feature (1)...(762): n = A,T,C or G
ttggcccaaccctaacaccaagttctgaaatgacaggtggaattcccatgacaggacccccagcaatcgcagcatcggtgccactgaccccatcatcgccaccagccctttcccaggaagagtcagctgacacggaacaatccttggcagtggggattggggctactggatgactttcagcagcctgagaagtcaacagtgtgaagatcaccaatgcacagaacctaaccagaaaggttttctttagcttatttatttttgcaagtagcttcaaaaaggaataaacttctagaggtcctcagattctctgttatttttatttcaggtgaaaatgtttccttgccactaaattcaggaaacactcactgatcactgataacctcatgattacggaccatggctggagataaaaaaatgaaccactgccctcaggtggggatgcagccccaccaacttataaaggtcatttgtgctctagataaaagtatgccaaggaactgtctttggtttgtttttgtccctgagaaatcaaaatgtttcaaataataactttaatcctagttntaaaattttaacaccaagactttgtacttgtattcccttctaattctaacctgctgttagaaatgtttgttttcaactaggactttctataagaataatgacgtttctcttactgaaataattcagccttgatcatcttattttatattatgaaggggaccaaaataaaagctgggtcccatgctaaaaaaaaaaaaa

SEQ ID NO: 13562 - DNA, 1638 bp, Homo sapiens
  misc_feature (1)...(1638): n = A,T,C or G
aggcgcgataattgtatctgcgacgacgtgtcgaccggcgtatcgacgccgtggcgtgtcagcgaggatatcgnatagatcttgagtacatgtntatacctgacgcgcgtgtctgatgcgcgtaggcgtntttcaggtcgagatttgggcgtacgtacaatatatcggcacactattacattcattcgcggcgcgccgtagngggcattacacgattcttcgcatcgcgtgtctaactgtgcggattggctctgcgtgatatattgcgtaattgtctctatcttactctctgtcgctctgtcgtcatctcgcgcgttggctcggtctatgntcgntatatataacgcagctgtcatcgagcgcgttcgactgtactcgatatgtctatgcnctcggctngcgtcgcgtcggtcgtctcgcgcctcgtgtgaggtatcgcgcgcgctacttacatgtattcatgcagtacgtcgatcgggcgcgcaggacgtgcgggcgtgcatatgttgctgtcatcgtgcgcgtcgagtggatatcgggtattcgncgcgtagtgtctgtctgtgcgcgcatagcggtgcgcatcgcgcactgacgcgtatactntatatattaactctgatactcacatcgcgcgcgatatcgtcgtctgcagcaggtactctacncncttcncctgctcctgtgcgcttctgtagggaatantttgcgcgcggcagatagtantactcggcgcgccgcgcgcgagcgctgtcgcgngtgcggatgtcatntcgatgtancgtgacgngcgcgcgtcggattcgcgagcgccgaantctatctctgcgcgctgcgngtgcgngcgcgtgcgatatgacagacgagtagatcgcgtctngnatactcgtngngcggtatcatcggggggacgtgctgtgtctagtgtagtacagactggtacatcgagtatttatatgtgtgagcgcgcgcgtgcgttccgtagtatgatgcgcgcgagcgagacatacatcacatgntcgcgcggcgtatanttcgantgcgtatatgcggccgtcgcgcgtanancggtcatctgatatgcggctgtgttattgcgcgacgtgctgggtnttgtgattatatcgcgncacgtctgtgactcttatatactacacttngcactgttcgtgctgtgctactggtcatcatctatctcatcatgctcggcgtgttgttgtttatgtggaccgcctgtggtcgcgtgcagccatgtatcatcagtgatcatggtgcggggggagtagacgattggggagcggcgtgggcgggtatcgccggcgtgacactctagtatcgcggtttatgattcgtcacatctctctcatcgtattcggtagaacggttctcttgaaccctctccgtcgtctgtatatctatgcgacgcgcggtgctgcgttttttcgaatattctctctcttaacctcctcgatttcctctgctgtcccaacgccatcgcgcgctttttagtacctgtactcaaaacnacttgtcgtctgtgttctgtctctccctctactaaaggctntcgctccgacttcttgtctgatctctcctctagcgttaggtttgcatgatcgtctctcactcacactcctc

SEQ ID NO: 13563 - DNA, 1106 bp, Homo sapiens
  misc_feature (1)...(1106): n = A,T,C or G
taaaacaaagggaacttcgcggggatctaatagggggctagagggcatggactctccctaggtagctagggagtgagnngctccctctgcttataacgtacgcggtgggaagccttcatctctctagtgagctctgccggccgggtactanacatcatcccactgagtcttggctagtcggtgtttggacttggggtaaacctggggaggcgagagtggaaggacactctggagtgtgtggctttcggnncatgttttgtganccttagactcctatnacacactttatcctagctgcaaaacatgggcgagcataggatataaaatagtactatgtcaactctagaacataatancctaaagaatctttaatacaataactctgcgccccccttggtcctctcctcttcttgttannnnnatgagcgctaaaaacatgatagacggggaaccgatgtagnaagcgtgtaagaatacataatagacaataaacagtggactaggaacgcaaagacataattaaaagcgtctanaggattcctgattataaatctttngacctcttataaatgaaactatcaaaaaaatactccttacaggagccctccgagatcgtgtattgcgatggtggtcacctgccaacaaaacacattggacgagccggnnggccgctcttcccatgcatctctaaacatactactacgtccggaccatggnnaaagactacataatctcgagannagctaaanaatacnnatcggtgaccactnggcataataaatatagnaaatgattctgttgcatcccccaataaatnaacaatgganaacatctaaacattaccgacgtccggaactatcgaaatctattnnncactttcttttctncctataaaccttttactatcaaactcttccactctctctnntacccaacatcgtgcactcttnnntacatcccttcttcttctatacctttnacctttctctncctcttcccattnnncccttnnactttttncactncttnnnnncnactctctcctcctttnccctcncacttatttnnnnnncctctnnnncccctncccccttnnccctttcccc

SEQ ID NO: 13564 - DNA, 788 bp, Homo sapiens
ctaggagagagtgcatctgaccattcggaacacgggttacgtgccctaggctccgggaaccagccctcactggccgagggtccgcggggccgccaggagggctccccaggttcctcccagggatggagcagctacgccttccgagtgtgcccattccaccgatggagcaaaaactcaaaagctcccccttatggcaaaacagatcttcttttattttgtccaagtgtttaataagtcaaaacatgttagcaatggtggattacaagctattaattaccaatctattccaataagatctttcttgagagctaggaacattgctacacgcttcaggaagagagaaaaccaaggaagaatgtttgttggcaaaagtatgacgatttgtcggatgagtaaatgactcagacatcccctctatgaaagctggaatgcgatatatgcaaagattatggaagctttctgaaaatgggagatctcagattcataccttcctagtttagaaagaagttgctgaatagtcttagactaagaacgtttgaactctgtttctgtagtcataaaatgaaaatagcacaataccctaaatgtgtttccagagactggctggaggaaagaaatcttgggtgcacaatgtcatgaataaagaatttgcctaagcaaatctttgactttttgcaactccaagtcatctgtaaaaggttgccattggataaaagagagctatgttgaacacataaattgtatcattcaaaattcccccttctcttcaatagagggtggaccatgat

SEQ ID NO: 13565 - DNA, 732 bp, Homo sapiens
caggctatgatagatagtgacctggtccagctcgtacgagcaggtaacaggaagagatggcggtgttaagtctggtatccgcccggacaaaaaacatgtgtgggtgtccgcgtgaggcccacacgaaggcatccctgcattgccgcaattcccacctcaaatttgagcctggtcatgcaagcctgaagacagatggttccccggagacagcctagcccagcatcataatgtgggctgctgtcaattaaacccagtctggggctccccaattaatgagcccctagactatccaaaatgatctgccacagtggcttatgttctttccctggcttcatctttatagctgtcctcagtgagatgagcactgaagaagaattaaataaggccatgagcacatcaacaatgagaatggtcaatatcacctatgctgaggcttcacctggggccagaggccaggatttgtccagaaaatttgtacctttagggtgccagcaaggtggagaacttgtccttgtctgcaccctatttcatctgacttgctctaaacccttcatcagaacctgaaccagagctgaggttcacatggataatctctcccttgaggcagagttaactctcttcggcctacagacagcaaaggagaatgatattcaatggaaaaattcaatgttctcaggctactcaaaacttcctgttaaaaaagaaaaaaactatgcaaaaaaaaaaaaaaaa

SEQ ID NO: 13566 - DNA, 636 bp, Homo sapiens
ataaatgagtaatgaagaaagggagactactattgagaaaatcgtaactagacactttctggaaaagtattctaatactgatggatcacaatcatattttactataacatcttcatagacttgtgagctatactagcatatgtactgatagactgtgacacatatttacatatatatcatagtgtgcttagatcaatgtatattgttgagcaggtgagctctattagagcttatttttcagagtgtgaacattctatgacatggtttcatcattagcatattgaatgattgtatgcagaaatgtatactcgtcggagttcaaagctaaatctattcttgaaacgagatcccttcattatgtctttatgccccagagtaaatcccagatggatcatagatctgagcttattctctcgtatgtaaagaaataagagctttagtttgagctccaccttcccccattgattgtggagcctccccagccttgtggacctgtgaagcccattaacttctttcccttaattcggggcctgtggggcctatggggggatggccctagcggtttacctttggggggggttacctttggcccgggttaataatgaccctggttcctgactcgggggggggggaggg

SEQ ID NO: 13567 - DNA, 2187 bp, Homo sapiens
  misc_feature (1)...(2187): n = A,T,C or G
taatttataanttataatntaatnntntnannntnnatnnaananntntnantnatntntntntatntntnatnnaagtatgatttngtnntgannnataatanntatatnanataatntantangatntagattattntatattnttnttntatnatatatatttatataatttaatntnnatatatanntnatnnatatatnattntntttatatnntncannngtatatatnnannanganntatttagtatatntantnaanntnnaaagnnganatatnatatatgagtctaatatatgtntgtantataataagtgattngtaattgagaaagtaatataaatngtnttgtngtnantngtatgantatgtatgttnatgatnagtagtgatatanntgagtatangntnatgantgtatgngatgcgtncgtataagtangnnantnatantagncantatngtnagcgnntangatgacgagantgtcgnggcnctncngtantacnaggagtcagctgacgnngctatggnttgcngtgatgtgncgtccggtcggntgtgtngntgntcgnttnnanntcngatgntgcacgcngctgtggacgancanntgagcggtgncnngaactgtcagacacgtaggganantcatatngatatactntngttgntaantgntggatnactgccttatgantcctcgnangtatagttgntgatgtnagcagntagtcgnananatngagatatgattnnatatgntagtatgttgcagcatcgnagactacagcaatacgnantngtgnngagtagtgacgtcgagctcantgtnatcntgcagtcacacanctcgncgagntactcacnctgacgtggaacagcgncnnagcgngacgacatgtcatggtacnctgacgtgtctgcgtancttttattnactccactcncngcatcagtgtccgagtcgactnttngtnanntactctgcntcggatcngcnctgtncncgntactatgtcactgagcagtcaacancgtcngnacgcggancggcgcagcagnatgtccgcacatagtaaacaanantnatcaaccatgcacacgacgacnaatctgncanntatcanctatctgtcttcctgatctaccgcntagtgctcntagtgctgcgacgaagacgtcgagactactgcganctntngcnatatgnactactgtccgtctcgcatcctatgctgcgcctcgcaccgcagctcactcttcctctatcagactgtgtgtaatatccacgatggacgtatatgtctagtnangcgagtgcatggaagtcgtctgaatatanactacgtgntatcagagtacgacgtgcgagatctatatcnatantgaantggcgaagttgtgcgcggtgtgctatangtggagcagcagatcggtgngtaggactgacanntctgagtagnctganctcgaccgctgtcatnagngccgactacgtatgtgatagntatgctgatgangtacagtngngtacgagtgcatagctgngacgctgtatagaagaganatntgagtgataaantagnancacgcgcgcgtncgnctgcatagtcgtgaccgactctcccgtgtcgtagtttcgtggactaaccgatnancatngcattcagtgtcgcttctgcagcngantggnatgcaccgccgngatanggantgagtggcgacacgtcctagcatacatcgtcatctcgntgcagcttcatncgctcganacngantcactacagtatcgcactcggtancangccgcgcgcgcgtccaccgtaaccacgtcgntacgtatagtactcgctatgacggaggatgcgcgcacacgtcgatgcgcagacngtatcgcactagctgccacgtgcncgccagatacgagtcgctcgcgctcgccgctacgtcgtangcgcagacagctcatccgtncgtctgccgcatgatagtgtcttctcagcattgtggtaatgcagtctcatgagtgcanaatcantagtgtgacgacgcttcgtgcagatcgntagcgcgcagtcgtacgtncgcngctagcgtgctacggactgcacgntcatcatgcatcatgntctactgcgtgtcgttgagaactctgctgtatcgcgctancgcgtcagg

SEQ ID NO: 13568 - DNA, 1102 bp, Homo sapiens
  misc_feature (1)...(1102): n = A,T,C or G
gcgaggtaatgacggggacgcgagaaggctacggaacgaataagaggatcgacataaggaaccaacgtcggcgggaataccgatgaaaacggcggagacgggacataacatccgtaaaagaaatatggggtgagggggaaagactataggtgagcgtgccgcgcgaagcgggcgaaatggttagaggtataccctccaggcgtacgctcgcgctcggatcgtaaagtaatatggagtgcatagtgctgacacacgatatatgacaacgcggtgacttccacagattgtggatcagagcaataaatataaaggagatggaggcgcggcgggatgcggaaaataaacgtatgggggcggatagaaacggggcgtatgcggaactgcggcgtgcgtggcgagatataaatatggaaggggaaggagcggataccgcgtctggaatattgggacgctgcggcatantaggggctaattatgggggaggtgaggtgagcggacatatatgatcaggcgagtggaacactggatatatttgggacgtcggcgggttacgcgatgcgtagaatcgggcgatacgcgacgtattacatggatcgataccaatattagatggcgcgagcgatatagcgcggggaaaaatttaggggcaaattgcgaatgggccggcgaacttatgttgcggcagatggggcgggcgatacaacaggggtcgaaggatggttgtataaaagtacgtagtagggagggctatatagatataggtgggattgcgtggatattgtgggagtcataccgaggagggggcgggaacgatcgcgggcgaagaggactaccggaatctacacttacacgtcaacgcccaccacacaccatacttctacactccgtccataatcgcgatattacatatgatctgtccgcgcgtcctcggcgctatcctgttatatcggtgttaaattacatcacataacaaaaaatgagattacaaaccgtcgtgtgcaagacattgtgtgtgtgtagtacacagaactagacgcagtactacggctaatgcgctacaccgagcacaactctactttctgtgcatggagtcatcgcaaat

SEQ ID NO: 13569 - DNA, 1301 bp, Homo sapiens
  misc_feature (1)...(1301): n = A,T,C or G
tanttcgttggatttggagtatatttggtggaangtatgctagtctgagattgtgtgttggtnataggtngatactttanctgatcggcgcagctgatggntgtgtcggtggnccttggtgtgtatgttgttcttgttttgactggtgtgtgngangcaattgtcgtctgtgtgtattgtgaganaggctggtgtagtgtgtatggtggggggggcgatgctgagtttggtgtcgtgtggggggtgggcgtgggcggggaggtggtggggcgtgtctggtgggagatgagagngaccgtatatgtcagtttttgctatcattgactagtgttcttgtgtttgtcaggtctttggtaatcttcacatttcgttactatagactgtttgnatgacgttggcgtctgtgatcgtgctagaatacctgtagggtagcttctttatatnacattgaatcaatactgtcgtttactcgtggggtacgttgtttattatatctttatatttcttattannnnaagagcgaatgctggcatactgtgagacgatgacctgctaggaagcngcgttgcanngagatgaanntagtactagagtgcagatncatgaacggnnctgagttagaagtgagtgtctcgaacggtgctctgnntgcggctctcctctctactcttccttatgagactgctggtgatgtatcgttataatgatttagtgtatgatgtcttttgttgtgtatctgaagtggcgtgagcgcgtgtgttgcgngggcgctggnggagtgatgattatataggtgattgttggtgtgggttgtgtgtcgttattgttcgtgtatattnactctgcgtctatgttgtgggtgggttggtcgtcgaattncganttatatgtgtatgtngattctagttgtctctcggtggccgtgagtgatagagaatagagttgagactatatgtnanactatataatgctcgagtgagtagagagcagaataatgaaggattgtgatanaagaatagtaagtaatggagaataataacaatacaaaatataatactaaattatatataacaatatacaatataaaatactaacaacaatatatatgataatgtaatagaatatanaacaataaannaacanatgtgattctgctgttggtgtcatnacnagtctgtgtggctaggttggcttgcggctgtcggaatctttnctttttctnnnnntattctgcttattattctccctcttcctcttttttttnntnctctttnnnctttttcctctttnncccttttccc

SEQ ID NO: 13570 - DNA, 881 bp, Homo sapiens
  misc_feature (1)...(881): n = A,T,C or G
atatatatgtgtggtgctcagccttctcccccccnncncacnttttnnngnnaccncnnnccagggttgcggcccccaccgcctcctgcgcctcattcctcagctgagtgcatcttctgccggatgccattgntttgtgaatgaggaacgaaatagataattcctatttctcacgcttgagccagacggtntcttgctcaggcccggtgcatgacctcatttatctcacttaaccccaggccattattatatccagatggtcttcagagtctgctttatatgtgaattaagttatattaaattttaatctatagcacaagacaaaaacaaaacaaaaacaggttcatagctttctgggaatgagacatatcaatgactctcggtgtgttgggtcactatacgggaacatcatattacagccaccggtactggttgccctttgttttattattcatattagagtttagctaataattttagttcttcatgtgcgtggagtacgcgcagtagtttgtgttgtgccctcctgttatttctgatacggcatggacgatacatattctctatgggcccagtttctcgaccaacccaagtgccttcgttagctccgtgtcacttcacagaaagaagaactattaatccttattcgccgcttcttcatccactctctccactgtactcatccatcatgacctctatctgttctaatatataaattgttcttcgctgtcgatctatgacaaaatctattctcttcttttctactttttttcgtgtgctagtctccattcttgttttattttatctactcttatcaccacaccagcctcccttctcgtctaggctactcgttggtttgtgttgcttttttcgatggaaat

SEQ ID NO: 13571 - DNA, 2252 bp, Homo sapiens
  misc_feature (1)...(2252): n = A,T,C or G
tttttttattaaatntnatttnnaatnnatntntantaaananatnatatatttatnatnatatataatactaaattatatntatatatataattanatatataanatatantataantaaatataatattnttatntnntanaatantantatattataattatnttnttagattntnttntnattnttatnntatntttttatntntnttttttcatttttgnnttngtatntttaattgtacncccngnnnntattnttttatctatgattcgagtaatatntnagtgatatatttattnatttntaattatgcttatatgntatattagtattnatattataatatganntatattatacnctattagtttaatatacgtatattgtagtatgactagananacngncaganatcgagcaaatgnngtcagatgcaagagagtcacattanctagcaagtgacacgccacgccaatcgacnatatcgancaatcgccgacgagancaggtntgatcgatagacagacagatnctagagatagacgtcaacgtacgcggtgtacgaagcnaccacgtagnatagtacncnctganatactcacagcgttcacanacnanatangtatanaatntatctananactagagacacagtgccacgcagcatcagcggncgctganngnatatactnntgacgtnanatangtananangcntgttacgtacgtacgaactgacgtntgcactatcgaancgncacgtcacatnatatacgtagtatcatntgcagctactatcnttaacgcncttgctctctgcagctagtngtacngngacatagcaccgagcgtcagntgtgagtgngcagagcacgacgtgtnagtaggagtgaanctcngatgcaatctcgtcatctcntcgcgnatcagcgcntctcagtntacagcatagcttcatntanagantgnananancacaatggaaaatcagcacgnanataagtatatggcacgancnacatcctatactagctcgagcgtcgantatcgtcagagagacgcgtcgcgcggtacgtcgcgtagttgcctgcactcgactagtcgctgccgcntacgcgcnctcgcgcgcgcgctactcntncactatnatccgncgncacgagcgcagcgcncgacgctgacctcggctgtcagccctccgcagcagcaacaccanactgcagcgacaccacacagcatcacgatatcatctacantantanacgacgagcatcccatacacgagacggacagtagngcactctctcgangtatgtgaantntcgcttcgcngngcgtgtntgctggnactggcgcggcgngntcgtatgantnngatgtacagatgacggagtagctgtangcaccgagtaatnagtacgangatgagcgcgatgcatctnanaccgatcgtctaacgncngcaacgcgcntccatcgcgcagctcgtcangcacgtcagttatctgtgagctgctgtaccggcngcgcgcatgactgagcgncntcnggtctcgtctgcgtactgcgtagtacgganngtcgtcgcgtcgatggnctagcatantcgtcactcgctacgantcggntgancgtatgtacccngactctcgagcgttactgcagcgtagcgacgatgctcgtgctatacgcgacgaaggtgacgcancgtcngtaattctncgnctngntgcggcatactgcacgactcgtctacgtgtacgcatangtagcagcgcgcgcgtgtgagcgatccgcngacgtgagacggtngtgctcacgacggtcgatagcgcagacgtcggncagtgatcgngnacgccgangtagacgtgcgctaatgngtgnatcgtcctgncnngagcgcacagtcgtcnactgcactgatgacgacagcacgagtctatgtgtnagtgagtgctgcacggangcgtgagacgtcacgtcgcagccgntnacgtgcgatgctngcagccgaacgcgncgacacgtagctacagcatagnctagacagaacgtgtaggatctgantgtatgacagagacangtgcgatagncngaagagcgatgagatatcgcacacgtgcgtgntggttcagnangacctcgacgatcngcgcgcgcgcgcngtgatcgangacgtcgtgagatntcacgatcacgattacgatacgcgctgcnntagcgacancagcgactgtgcacgtgt

SEQ ID NO: 13572 - DNA, 474 bp, Homo sapiens
  misc_feature (1)...(474): n = A,T,C or G
ggatggaggggtggagagggaccccccccccccncccctctnntttggcagagaccccccancnnttccncnnttncccccngcccccccgcgcatgaagaactactccaacggtgatgaccctcgcctccctctcgggagagcacagtgacctttgccccaacacccccttcccactcccaggtcccccggcaaatgcagaagaaccaatcaagcctttccaccaaagcagccatgaaccccattctcatcctttccaagaactctctgctataccagataggggtttggggttctgttttccattttttaaaaaaatcatttcaagactcttgaacagtgtgtcggtttacactattctatcttcttaagccaccatatcaacatattcactctgcttcctttcttttcatttggcagatgccacacttttaatggcagcaataaaaggtgtttctatcaaaaaaaaaaaaa

SEQ ID NO: 13573 - DNA, 788 bp, Homo sapiens
  misc_feature (1)...(788): n = A,T,C or G
gttagcnatcagcataacctgatatttggctatgaagtcacatctcatctttagacctgacaaaaacaaaaagagagtaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtccacaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcanactcagcagaactggaaaacacggcctttcagagagcttcaagttttagtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagaggggtatctggttttatgtcaccctacctaacacctgggttagtaccaaccttc

SEQ ID NO: 13574 - DNA, 749 bp, Homo sapiens
gttatctggttttagtcccgcccaccaaccacctgggttaggaacccccttgcctttctggccaggtttggattaacccttccaagggatgataaagattcttcccccctttccaggaaggcctcaataattgtggcacgctgtctttagaccaaatcaggacaaccgtaatgtatagcccattctctcttttggaggtttttccagcaaacaatacaggcacgggcccccacatacccccacatccattaatatacttcagtaagtatgtgagtggattatgaggtcttagaaagctgggtttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaaaaagttattcaaagtatttttaaagcatttgatttgcagatgggtgattcgtaataaataaaacatttgagcattttgaaaaaaaaaaaaaaaa

SEQ ID NO: 13575 - DNA, 254 bp, Homo sapiens
agggagaagccatccgccatgccatgaggagactcaagcagtcccgtaaccagtaaccaactcaccagcaccacattgctagccaggggatgagccaccttagatcttccagccccaaattttgaactctaattaatgatatgtaagctatctgcaacctacttcaaaatgcgtttaaaaagatgaattgatggatgatacagagatgtatacgacaaagtatagtaaaatgttactgatgaaaaaaaaaaaaa

SEQ ID NO: 13576 - DNA, 334 bp, Homo sapiens
caggtacttgctcctcacttttgacatccaccatgcatcaattctacctacattctacccctggctaccttagactctggataaagaggaccaccaggccctgtgctttctaccgaaaacttgatgctctaggccagaatttccaactgcaagctctaaggattacttatcttcgaaaaattattaaggaaaaaaagagagttcatagttaagtaagtttacatattagatcctcttcttagagaatttactcatcacattcctttattaaaggctctgagaagtcctgtattagaaaaacttattaaaccttaatttcctaaaaaaaaaaaaa

SEQ ID NO: 13577 - DNA, 772 bp, Homo sapiens
  misc_feature (1)...(772): n = A,T,C or G
cctcctagacctgacggatgaaggaatttcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaattgtgtgccccagacatatttcaatatacctccattttactccaggtaaaaggtttcttgcatccatttaactattgtaaatgaataaccatgtgaccctcaagaagattccaagccaaattccattggtttctaaggtcttaggtttgcttgcttttggcaaagagtgtacttatcttttcatgcatgcctttaaagagaccatattttttctctgannnnnnnnnnccnncnncataannnctaccnncntnaaccaccacaaaaaannnnnntccctgggcctcttggccctcagcggggaacttttggggccgtttcctttaggggggtaaatcaggagcctc

SEQ ID NO: 13578 - DNA, 683 bp, Homo sapiens
aggcgaaagaaccaggggtgaggtattcgcccccctatagggcgccaagcctcagggaataagaaaaggtcccttttttggaggggggaggtccccataaaaaccccttgggggggcacaaggccccccgcctggggttatccccccccggggacccccaaaagggaggatccccgggaaaaggccttttttcctttttccaccccccccttttgttttccaaccgccccaggaagttgaaggtttttttttttttcggcccccccttaaggacaaaagggaggcaatggaggggttttaagcggggtaaaggggccccctaattatggtcccccaaaagggccaacctttttataagtttttggtgctggtccctaaaacaaagactgggtccccctaaccctatggggccaagttttagtcccaccccctaacccgcaaaatttgggatttttaaaaaagccattgtgtgccccccacatatttccaaaaacccccctttttctcccgggaaaagggtttttgcccccccttaactattgtaaaagaaaaaccctgtggccccccaaaaaatttccagcccaaatcccctgggttttaagggtttagggttgcctgcctttggcaaaaaggggacttttcttttcatgccggcccttaaaaaggccctttttttttttttg

SEQ ID NO: 13579 - DNA, 721 bp, Homo sapiens
gtaatcatcaggggaatccaaattaacccccaataggatatcgcctcacgttcattgccatggctattatcccagccacaaaagataacaaaatgctgacagttagctggtgaaaagacaattattcagtggagtggtagtaaaagttattttataaattgaaagtaaaactattacgtgatctggtgatcccacttctggctgcgtattcaaaggaaataaaatcagtaagtaaaaaatatgtttattacaagattattcataatggcctagaatttttttaaagttagtgaccgtaggtaaatgggtgtataaagcaaatgtatacacatacaatggaatattatgtgacctctaaaaataaggaaattataacatttccaacaacatggatgggcctggagaacattatgctaagtggaataagccagacacagaaagacaaatgctgcattatctcatttatatggggaatctaaaatattcaaattcttagaagcagagagtagaaaagtggttcccagggctgggaggagtggaaatagaatgattcttgtcaagggcataaagtttctgttgtgcaggttgaatgggttctggaggtctaatgtaaagcaatgggactatagctatcaacactgtattgcaaacttgatctctggtaaagggatagatctcaggtgctctcattggacacacacatataaaaaaaaaaaaaaaa

SEQ ID NO: 13580 - DNA, 123 bp, Homo sapiens
tagcctccttctcccctacccacaaacattaccaatagaagagtcaggatagaaacctttctcaacatggtaatagctgttctaatattataaaagcaaactattttcccaaaaaaaaaaaaa

SEQ ID NO: 13581 - DNA, 207 bp, Homo sapiens
tttatatattatcatatttaatattatatatcttaatataataaacatgatttcaggtggacctgatagcttccggggcaggtagagtcggtggcctgtggcctgagcaggatgtgtcttccctgaatgacaggcctatgatcccattaacatagaagcagaaaataaaaaattaagacactttacagagtattaaaaaaaaaaaaa

SEQ ID NO: 13582 - DNA, 788 bp, Homo sapiens
ctagatctcactgtaaggtctggctgacagaggagttacagagacctcttcaaggaagaaaggactccactctacaaatttatttctcacagccatggcaaaagcgaagaactctggtcttagaaaactacctagatcacagattccagcatgaaaagacatctggaaactgatgggacacactctgaagaggaacaataaattatttagcctaaccaacagcaacgtccccagaagcaaaactatacagaaatagacttctccactggaaggacatatggaaatcaggaatcaaggcaggaggtgcctctgatgaaaaggatgtgggagtcttcggctcactgataactgtgagaagatgtcataaagatggttttataggaaaaagaaccattctctgtttccgccacagccatgagggccggtcatttggcttgaatttcaaaggctacacacaattctttagaaatgcagggagaaactttgctaaataagggtcaagtatgctcagtcagaatgcatgtgtagtatcaggagcaaatgttggaagctactttatcctatcacataagaatgatgaaactattaagaatatctctgtttgaatgcagttatagtctcttaatgtaagaatattcacacggcatatgttactcaatggtttatcagtttcacacttttccagcaagggtgaactttttcttctattttattataaagggaaagcaactttttaaaaaatattttagttgtttgcacaattttcatccccaaggaacaaaaatcta

SEQ ID NO: 13583 - DNA, 795 bp, Homo sapiens
caggcaagtgtattcaaggctcgtgaagtaacatgactttgaaccctcttctaagtgagtcacttgctttcagatcattctttcattaatctcttcatcatgcattcattcattcattcactcaaccaacattcactgaaaatcaactcattgccaagcatgaagaaactgaataagggtggtccctatatgaaagaggaaacatctttctataagccaatttcctggagaaaacttcagctggagaaggtagttctccccaaagacttgaaagtggagcggccctaaagactacacaccacaggactccagtcccagctatagaaaaaacctacttaaggaattaagacctattaaaactcatattgcaagacaaaggccttgtttccatgctacatggcctcctgaataaactccatttcacactggtattcagttagcttatctttacaacaccaaactttgtagaattcactgggtttctatgggttaatgaaattttctgaggtcttttatgggctagtgatatctgagcatcacttggaggatcaaatggtttaagaatgagatttcccaaaactcaagggtcatttattcattttaatattctaaaccgtgaagtaacatattacttctactcaacaattggatttccctgaactcaaatgtgaaataattcctggaacacattatctccaaataggcgtggaatttccatgaaatatatacgcgctgaaaaagagatttgatttggggagaaacaccctggggaaggaaccataacttgctaaaagc

SEQ ID NO: 13584 - DNA, 795 bp, Homo sapiens
  misc_feature (1)...(795): n = A,T,C or G
ttgcattcgacaggccaagtcacagcctcttgactaatagtttattatgttaaattggaagttttgactgaggcgcccagatacaatcttgaccaagttccgagtgaaatagacaacctgggaagacttgcaaaaatcatgaaccaaactggctgcaggactctcaagtcccttcctcacaccgaagccataaaataagtcagaagtggatttggtgaggaaggatttgtgagaccagtttctctggagagagctgttttaggaggacctccccgccaagcaggaaaatgggagatgtacttgcatcagcttgagtcaagagaaggtggcttcaggtgaccccttggaggccttaaaaggtgtccctggatataggagggtggcagacatggctgactaaactagtgtttgactctctattgagaaatctaaatgagagtgacagtctggccagctacagttggacagatcgaaacaaaggaagaggccctgggacctgtctgctaatctagagtttgctggagcaaatgaaaccacacacttgccagggctctgagccagtgaagtcaccctagaacatgcgaatcaagctgccagaggggtgccctggcctcgctttagagggtatggaaggaggtattgaccagttaagccggaggacgacccccccaggaaagaacctaaattttggtcctgaaaatggactcagttttgaaagacgaattactccttgcaagttcagttggtttgagccnaggtaaacaaaagccttagaaaaaaggggagaacggaacg

SEQ ID NO: 13585 - DNA, 723 bp, Homo sapiens
cccgaaaaaaaggaattattacaatccattcagtcagtaaaatgaacctctaatcaggagaaaggcttgtattgggaattggagaaaaattggatacaaaaagcaggtgtggcttgtgttcttatcgaacgccaagcatttataggaaaccacatcacctctggggagccatccaaatggtgtgctaagaaattatgcatgagatccttatagcgttgggacgtaacaatttaaatgcgaaaaatataaaaaaggtgcatagggcccaacccggaggctcacacctataatcacagctatttggaagaccgaaacataggatcaggagtttgaaaccagcctggccaatatagtgagaacaggtctctactgaaaatacaaaaattagccgggagtgatggcgcgcacctataatcccagctactcagcaggctgaggtaagagaatcacttgaacccgggagacggaggttgcagatagccaggactgcaccactgcactccagcctgggcgacccagtgagactgtctcgaaaatgaataaatgaatagaaagataaaaataaaaaaaagaaaaggtacgtaggtaggaagaatcattatgtcaatacatggccagacgtaagtgacaatatttagatcatcactgcctgaaccacttacactcttccagcctcagtttcctctttattactgggcagaaataaataaaatagaagctaag

SEQ ID NO: 13586 - DNA, 987 bp, Homo sapiens
  misc_feature (1)...(987): n = A,T,C or G
ccccgcgcacgcgcccaccgcaccgcaaacccgcgacaaaaaaatgagacctcgcgaccaactgnattcagcggtgcggggctggacccagaatgcactaggngccctcaaagctcggccttcggagggggcagagaccccaggcagccaggcagcaccccaacaaccacagaagagccaacacccggcagagcagacgcccggccggcggcaccccacgacacgccgcgccccaacaaccagccccgggcacacgcncagccgaacccgacgcgccccgcgcgaaccccgagtttatttttgaaccggagcccggacaccgccccgcgacaccgccggcgcacgagatttttgtttttcccgcgacgcgcgccgccgggtcgggcgccccgcgcgacccgcggggggcggccacaccacccacacagcgccccgcggccggccggagcccgcggaacagaaaacacgagaagcaggcacgcaagccaccccacagcccccgcgaacgacccacgccggcaccccggggcccgccccgaagcaaacggagggccccaggaggcgcgcgccacggcgcacgggggcgagcacagccggcaggaacgcgcgcacccacgcccaccaaagaaggcacgaaccgggcgcggcgcccgcgcccccgccacccaacaccagaaacagcgagagaccggcgccagaaccacggcgacacggcgagcgcgcgcccgcaccggcagccgcgggccccgtggcgagccggagccggaagagcagggagcccgccggcaggaacgcccaccacagccccacccggcgccgcgcggccccagcgaaccgcagcgcgcgccccgccacgcggcggccgcgccctcaacgacgaccagcggccgcgggggccggcgaggcgcgccccaccgggaggcgcccgggaccgacgcgagcgggcgccaagacgcacaagcccaacggacagccacccgacacggc

SEQ ID NO: 13587 - DNA, 1649 bp, Homo sapiens
  misc_feature (1)...(1649): n = A,T,C or G
gagtgggaaaaagatgaggngangagngngnaaaanangngggagagaggggnnnnnnggaggaaagngnnnaagaggagaggnnnnagnngatatgatagtggnnnnagatagagtnnnnnnnngagggaggtgnnnnnnngangaantagnagagagagngnnnagaaaggtgtgnnaaaggtaantnnnnnnagngtgtgaggtgnnnnnnatngaacgangngnnnagatagagtgtngatagatannagnagagtcgagagaagtatatgtgnatgtgcgagtanaaantatatatagntnnnnatagtatggnagtggtgtanangctatatagtgnatatcgtagagtaacgtgtnnntntatgtagtgcnnnnangacatatgagcgacgagatatcgtnnggagtcagctgtagtactgacgagcacgcctgacgntnnnngcacgtctgtgcgtacttagtggtcatcgcatcagtgcatagtcatgcagcncaaggagtnttacagacttgcacacaagctgtattannaacatagtgtgtgtnntcnataccacgctcgacgncnccacagcttctcggctctnctccatccctctctctcctagctctcatgctgtnccctctaacgcacgtttccttctgcccatcnaccactacccncccgcactaccnnacgcgaggtactantaaccgtcgtcccacatactgccgccatatactgccccggagagttgtncngtcgcgaggtgnncgtgacaagcggnaacgcacgatnnnnnnacttctgtgtatnntcgcgatcgatcgcctctgacgctggncatcagatggagtnangagcgagtgtccncacacatccacctccactctccaatacacagccccactatagcggcctacatatacttcctctatatgaatatcgtaagcacttcatatccnatcggaccaccgatagatactagcncccctctgtgtgtcttcgttagtgtttaggtgcgtctcttgcatatccncgtccatataatttctgttggtccngaccgacgccgcnacactcacacgcaacaccnatgagtnnctgtctncgctcncgactccatcagtcgtgcgctcactctagtntctatccntacccttctctacattctccgtactctcttcctacagcgcancatctctatccttncgctgttcgtctcatgctctctcacgacgagcactatcttctgttcgatctcccaacttatcgcttgcatcccctcctcatctcgtctcccctgtatcccgtccctnccnacttatcttattcgtcctacgcagtcacctgcgcccnnnccttaattctctgagtcacttagtatagagtgctagctntatgtggtgagtctgccgcatcgaatncacggcgtgctgatnccttacgtatatatctgctctccnctcatcttctattggttgttncatgtatgtgggtcncagcgtagagttntcacaatgtaggtgtnnntgagtgtggcggcctgtctgactctcatgagtgtcgtccncatcatacattgttncacatagtagaccacaagaatagcgcacatatgggnnncaacggagtgaangacagtgggtgttgattcggt

SEQ ID NO: 13588 - DNA, 925 bp, Homo sapiens
cccccccgccgccgccagcgcgtttgaaaacacttaaaatcaggttgaaactgtttctcatctccaacaccaagaaggaaaaccccatttaacacagacttaggagaatctctggtattggaaaacccttactaatgctgtggaatctttagatgaagaagagaaagattattactggtcgaactctgcatttgcatactccagcgacgagactggatttactgcgatcctcaccatataacccgacagtgcccgcttatacaacttctgaccctgcctgcccctccgtcaaaccaaaacaccggcgcaatttctttttctcccgcgacgcgccccccataatattcactccatacccaatcacccccccacctccacccacccccctccgtgcccggtcaccacacatccgtccaaccaccccaccctctcctaccacagtcccctatccatcctcccgaatatcccatcacctccccatttatgtcgctcgccatccacaccccgcccgcccgcgcccatcaaacatccgccttaccccattcgataacgtttttattagcctttccagtacccccgcggcccccggccagcgacccagatcctccttatggcgcgcttccccgtcggtctaccgcgaccgcactccccgacccggcctcgcgccccccccgccgtccctccgcaccggaatagcgacctagttcaccacgcatgctccgcgcgctgctcctacgcggcccctagtacatctcgcccaccatccacctttctcacattacccatccgcacgccaacacgcatgacgagcggcatgtcggcgcatgtgcggtgcccgccacatccaaacgagtgatcacaggacaccgcgccagccagcaaactatgttacgtgccggcccgaccgaccgcccaccccacccac

SEQ ID NO: 13589 - DNA, 989 bp, Homo sapiens
  misc_feature (1)...(989): n = A,T,C or G
aggaaagagggagaggaagggagggggagnngaagaggnagggaggnnagaggaggagggggnnaagagggnnnagggagggaaggnagggagnaatgggnanatggggnnagatgggtngtaggtaatggaaggttgtagtatggaactggntgagtgnnaaatggttaggacgaggtggaggttatgggtntgggcggngatgcagtagattgagccgatggggagaggtgaggagtcccggggagttctgnctgagtggaagcggccgagggaaggggaaagagagctggagggtatggatgtggnctagtggggncgcgcgcggcccgccgcccctgagcccccgtgcctcgcgtcgggctttctcgtgattagcagtatggcgacatcggttcccatgtgcttggtgtctaaggtctgccgccccttggtttttttgggcccggcgccgggggttgtggtctctgttgtgctgcggcccctcgccttagtcatcagagtagcacggcgtcctgtgcgnccgtgtgttgtgnctgtgcgccgtctggcctgcgtcgagggncccggtggccaagaggtccggtggccaccctttcaccttcagcggttcctgcccctccctgaggtcttttttttcatctcttcttggncatggggtgcaaggactctcggtccattgtttccccatagggttccgcacgctgtcctcgatggcgccacgcgggcgcttcttgagcccgtgagcacccctaggcccgcgccggtgtgtgtgggctgcccccgtgggtgggtgagtagggtncgaaaggggtcntcggtgtgggaggcatgcgaatgtgccatgcggggntaggtgtagnncattcagtgtccctcggtcggtnncttcagggggcgcaggggccgtgggtggtnncgagagaggggcnccaatgttcnccagggtggagtcgagtggttacgacgggccccggtttggcgctctg

SEQ ID NO: 13590 - DNA, 816 bp, Homo sapiens
  misc_feature (1)...(816): n = A,T,C or G
cgccatcctcacccactgagcgacgannnttcaaacaancatataactcagcaagtcagcaccacttttgatggggaggagacggatcactcttttctgctcctacattgttcttatgagcaactcaaattacagtttgataaaaactaaatgttggaaactcatctatttgacacggagggacaatacctgcaaatcgaacaccaggaaagaagcattcttcttcccctctgagtattcacacccagtcctgccgtataaggatattccaagttatgccaacatgcccatttcagtatctatatacaagtcattcgacacagggcccatattatgcctacggatctttcgagcacacaaccatcccgctctccattgttcctgacccccttacataacaacagattacccacccttggccttaattctgcgtttttcctcacccgagataatcatacttcgcatcctcgtgctcattctcttcactactatccatatttcgcatcatacactcattttatttatcgtgttaataaagctcgccgcaaactcaagcaatttcatagtaaggcacgtcagccgtctgaccgtcggcatccacgaaaaaataatcgggatcacataccctaaattcagataccacaacgtcagatgttaacctggtgtctcatcgagcccactaagtacgccttcctttcttcactttctagcccgtacatttcatcagcgagttaaagttacttctgacccatgctagatgagccatgtcctccaacttacccacacctggtagttctagggaatttacaccacaat

SEQ ID NO: 13591 - DNA, 742 bp, Homo sapiens
gagtaatcatggggtagaaatcgccggttatggaaggaatagtagtccagggagagggagtgctcgcttggtattccaggggtctatctaagtcaactttcaccccccaaaatgttaaaaatggaccttttgcctaataaagaaaatgttaaaaccctccggggaaaatggtggcctgaaacaattggctcattgcaaaataatgcaccttttaatgctgaaggaaagaagctgttccttcgagtataaagacttgattctattcttacatatgccaaactctaacaatggatgaccttaaagttttgatattttacctatggttctcatttaaaacagaaaaaaatcattaccggataataagtcagactgttttcttatctgccttgatcaagaaaagttagatgttgtcagtgtctttgaaagttctgctaggaagcaagatattcccagcagtttacttgagcaaatggcttccgtttagcctaacggtttcttaggtttcacttttaaatcctgtgttaaacagaacaagtcactgtcattcaaacttttcccaagctgtatggggctctattgctgttgtttaacgaaattcagaggctagtgtaattagaccgcagggaaggtaggtcaggcagtgctgttaacttggctggcaaagttgatgggtcaaaaatgttttatgttattcttcttttttcgcactaaataaactcggtgtaaaaaaaaaaaaaaaaaa

SEQ ID NO: 13592 - DNA, 940 bp, Homo sapiens
  misc_feature (1)...(940): n = A,T,C or G
ccccccacaaacgcgcgcacaaaanaaatttgcagaagacagggcaangtaacaagaggcacgtggcgcagcttatacagcaaagacgcatcagtgacggttactaaaggagacctgaccttcacccagggcgaccagagaccagcagctcttcagagtcttacgatgctagtccctaggcggcaagtacatcggacagacacaacccacgagcgagtacagaacagcaaagagacaaccacaagcaccaccccccccgccccgcgtgatcgagacgacgctgtcaagtaccgaacgacacgaccacagcgatcgtgatcaacaatactataccgaaatcgacgccgcaaagcaagaccgaagcaaccgggacacatcaaacacccacacaccccgcccaacccaaacctgcccaacgcaaccgacacccacaccgaaacatcgggcaacgcgcagacaaacgccccgaaggaacgacaaaccgaacaatagaccgctgaccacaaccccaggcgaagcgcaccgcgagaggaagaaagcccgaccacaacacacgccacaaccaaatatatttgtccttctcatggggaaccacacagccgcaagcacaagggatcaacggtatgaacgcggaactaatcgtctaagagagggggtacgttccgcaccacatgaacggatgaacggacgagagaggcgagtgagaatgtgtgacaagaaagatgcgaacagtggcgacgcgggtcaaataaggacgcccgtccttcgcggcaccacgtgacgaagatcgacgattcagagcacacgatcacgagaaaccaaccgccatgtaaaacacctaaatatctgcagcatacactcagactcgccagccgaccagtagccgccggcgcagccgtccagccatacgccaaatgccgccggtccacgctcgcccacg

SEQ ID NO: 13593 - DNA, 944 bp, Homo sapiens
  misc_feature (1)...(944): n = A,T,C or G
ggtaagtaagagagagagnaaaggnaaagaaaattgaaagnnnagatnaatgagagaaagtaatggaaaagtaatatnagaaattaaagttaataaagtaaaattgaataaatanaaatatttttagttaatcgttatatacacatccgagtacgtaataacctacagtgttctaacgctcttatcaacgtcgtttctgattntttttcncctgttcccggtcttcctcattaccgccccctcgttctcctattcccgttcctatttccttatatatctttcctgtcttcgtcccctatttatattccttttatacatcatttattatattttatatctcacttctttaaccacttgcattaatatttaccattttctaagcctttttccattctttttttttatatctttgtcccttttcattcncctattatcttcgtcttctcgtcaacttgccccatccctaattgtttctatgatcgatatacatcttcactagtcttgtttnttnattcttcattatcttttcttctctcatcctctgtttttctcttatttttttattgattatgtttcttcattctatattggctcatctttgtctttacgtttgtctatcatgatattatctaaactgttttattccagggatatatccttacaatatctaagtctcattagtatcacccacatccccacttttctcttatcattataatatgcatcgtcccccgtcctaactcgattatcgtcccactcttattntcctctcatattgctctctccacatattcttatatttcccaatttatattncctattatttcgccacttgttttnaccttttattacatttgtatactactatannncattataagttgtcgttgttacctagaatatattccatcgtgantgatgttatccgataatagttacgtgaa

SEQ ID NO: 13594 - DNA, 890 bp, Homo sapiens
tattttatcacatatacacatataccaattccaataacataacagaaaacttgaccaccattttttcctactgttttatagaaataactaaagaagaaggaagagttatgtgccttatactatgatgaagaaggacacccacaccttacctaacatgtacattaacacctgcgttggcaaaaacctaaaaaataaaatatttacttagcaaagaaaaaaaaaaaataaaaagaaataaattaatattaataaatataaaaaacaaaaaaaaataataatatatatctagccaacataatgttacctcctaccggaataataaacgagacgccaaaaaacaaaataagaatatctcgtgtattattatgatgtcgtaacctcataccacctatcatattattaaagacaaatagcagaaaccttacaacgaacttgaatcttcaatttctcgaagacagaaagtgataatccagtaacaacccccattttatttcaggacaccattacatcataccaaatcccaccccggaaatcaaatttaaatttcatgataaaatattactctccttaaactccgcgcctttcttaaatagtcggaccaaatcaaaattatatctaatttgaaaaatcttaaccgtacatggtatatatatcatcaatcataacttaattcttttcaaagtcacaccacaaacacgcataatccaaattattatcgtataaatgaaattttttcttaaatacgtccttctcaatcacacaaaaacaccaaactcaaacctatattccaatcttcctccctataatcatcatccttacaatattatgattacctaaacctttacgactaaccccatattactaacgctcattaaccaacataatatata

SEQ ID NO: 13595 - DNA, 1318 bp, Homo sapiens
  misc_feature (1)...(1318): n = A,T,C or G
agatgcgagtatatatgctatcagcggcgtacgccggtgatatcggcttcatccgacgcggccgctcataacgngacaattgatcatctatctgtcattcacacaacacatatgggcgacgaatacgcgcgatcgacactctcgcgcgagatcgtggcgtgacgattatacatacacgcatgcaagatcataaatactccggcgagccgatgggcgctctacgcntcgatctgcacacgtgagcgacaatgacgcacgtacatcgtgcgagcattacatttatangacagcatcgactagcttgtcgcggctctttcgnttcgccagtctcagcgtatccgatatatatattaacatactagctgagtatacgtggagtctcatcaacaatatctatcaatacacatgacacgctgcgtcgcatcgctatgctctgcttccccgctcactatattattatgcgtaatgatgcgacgggggagaggtagcgaatattaggaaatggtggtcgctgaatgcgaaagcggatttacgactgcgcaatagggagcacgtatggggcatacatagaacacgaatgcgcgccacagtcaacagcgatacatacacctcatgataccacgaacgatatcagaccgataataacgcgcgagcgcgcgcgacgcggcgacacaaacgattccgcggcgaggagacgacaggattatttgcgtgcgcagccggggcgatactgcgccatcgattcgaatactcgnccgacaatcgcgtaagatctatctcgaagcgatggaaacgatacatatgctagcggccgcaacaatataacgcgggggacatagaaccatcggagcatatctcgggaactaccacatcggttaatcgttaagtatcgggcgtcctctcgcgcggcgtgataccgcagactgccgggcatgcgtcatatcaacacattagctggtcggagcgggtagcgatcttcctgctagaatccgcgcccgtatcgctcattcgggtgagatgacaactatcggcctatgctggtcggaaatctaccgtcagccgagacggcctacaacgcgaacaataaggggcttcagtacctattccacgatctgtcaccaacccttacacctctctattcgacttgccctttcggcccgctcctgtacttctctccttttcctaccccttcttccgactaaaaacaaacatacatgagctctactgtggcatcacacgcggtgccagcgctacagccccaaaatacacagctatgtgaacaacacccaccactcctctctcaccttcatcatacaca

SEQ ID NO: 13596 - DNA, 747 bp, Homo sapiens
ttattttaatttccaaaaatcatccatactgttttctgaaagttctgtaccaattacattttccaacaacagagtacaagggttcccttttctccacaccattgccaacacttaccttttggctttttgatagtagccattctaacaggcatgaggtgatatgtcattgtgattttgatttacatttccctaatgattgatgatattcatcatcttttcatgtatctgttggctatttttggtcttctttgtgaaaatgtctattcatgtcctttgcccatttttaacttgagttatttggggtgttttttgtttatttttgttacttgtttttgcaattaagttttatgagttgcttatatatttgggatattaacaccttactggatatatggtttacaaatattttcttttttctgtaggttgccttttcgtttcttcattgtttcatttgctgtacagaagtttttagtttgatgtagtcctgtttatttttgcttttattttctgtacttttgagatcaaatctaaaaaatcattgccaagaccaatgtcaaagagcttttccttcatgttttcttctgggagtgtcatggtttcaggtcttacatgtaagtctttaaaccattttgaattcatttctgtgtatgatataagagaaagatctgattttaaggtttgcttgtcaatatcaagtttttccaacaccatttataaagagtctatactttcaaaaaaaaaaaaaaa

SEQ ID NO: 13597 - DNA, 797 bp, Homo sapiens
cctagggctggagtgcagcggcgtgttctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattctctcaattaaaaatactatagccttcagaaaagaatcaattcaagcgatgagaaatttcaaatatattaacttaccactgccactttgaccaatattgccggccatctttattaagcttctacagggaaatgtcatccacctggtattacaaatctccttcccctgattaacggattcaagtttatcattatataccaagacttattattttcgctcctgtacttccactctttggaaaactatcctcgcaaagcccggtccctgaacatgtttctttcacccccattctccattgtcgcacattctcccgactttcttattcttaaccactcgtcaactgcgccccttactacctctcgctccaccagtcctatatttgggcctccaccctcatgatctccgcattttcaggccttcaacgcgctgccatcctccccctcctcctttactccggtccattccaattcatctcgtgctgccctattcgtcgtgttctacccataacccacatgataaat

SEQ ID NO: 13598 - DNA, 847 bp, Homo sapiens
  misc_feature (1)...(847): n = A,T,C or G
cacacctagcctaggtcacatcgcgcgtcctatccacacccgcctcataggtgaacgcgacagcgatccagaatgatccacgctgtgtgtggtggtatatctatgtatcagcacactgcagcagaagaggtataaagatgttgtgatcgctgtgatatagcgctgacggcgagtaggaaagaatggatgagatcgatcgagcgaatgttggaagaggaaattgtagaatagtagaggggagacaaacgaaatctacgttcgcccaacgcgtcgaactattactccaaccaccaccagcgcgccccacatctcacacctacgtaagttaactccttcttcatcttatctcacaagcccacgccatagctttctcctacaaaancaaccgataacaacacgccaactcgcacggcccatataatactatacatgcgtgtgaatactttgcgtcggggcgtgggtgcggccgtggacgtcaacctttaaaaaacagacaaaacacaggcaacaacctatcatgcgtgtggggatcgtacagatcagtagccccgagagagccgagcagaaaaacatacaaggcacggctactagcagtaaaccacctcacacagtactacacaggagaggagggaagaagctaaaagaggccataggaaagcaggaggtggggtggagacagtatgggaaaagaaaacatatggctgctcacgtctctcgacattgaccaacaataccttcgctttataataaagaaaaacagcaggggggggcgaagtatgtggaccctatataacaaaaaataagtgacgcccaaacacggtcgttcctccccagaaaaaaaaaaaaa

SEQ ID NO: 13599 - DNA, 978 bp, Homo sapiens
  misc_feature (1)...(978): n = A,T,C or G
ggaggcacgtcttgcccgtgattctttcctaataacggtagccgctttcagactccctctcatggaagtagaagcacgagactttgaaaagctacacatcatttggagactcttgcgtccttcagctcctgcagaatgaaacatcacatgacaaaccaaatcttcttttaaaatattaactactaggtcgggtgtcggatgccacgttatttatttgccagacagttggggacctgtttgcatcgccgcgtgctgacataagacatagcgcgacttcgttcctcccttcgcactcccattaattttatctcctagtgtaatcatctcaacacgccatattgctgagactcgcgcgcatatacttcatcactccctccctccctctctcctatctcgttcatctcgaccctctattgctattcgcctgtcgaaccgactcaatttcgcgtcattggaagggtacgcggttgtagcattaccccacctctacctcgccttattcgtatgtaacttgtgtccgcttcgtccgtgtccgtgttccagcagccgctatactaccattatattttaataattacccctattatcgccgttcaacaccccgtctactctccctccaccattctccacttttgtttctcggcctgaatgancaatagtatgataaggtctttcctcacttactccaccccaagccgccacttcaattatgcgccgcctcaccatcttaccataatccgtatcgtctactcagtacccgcgctctccctcctttcatcgcataactaatcgcggcaaccactaatgatttccgcgccatagtggcctattttacccgccacgtattcccgcttactcagatgccatttccgcacgcttcccctttcctctttaccactcaacccacatctcgagtcatggtattcagtcgtcgtactcccgactcaacgatacactgtgatatccaatcttcttggt

SEQ ID NO: 13600 - DNA, 824 bp, Homo sapiens
aagtggtaatgtaagggacacaggaaaggtatgctcggcgttttgtccaccatgtatgcgacaaatagcagggtgaaaagggatgcgtattgcggaatagggtaatatttatcgataataaaaatagggagtggtgggtggccgacgcatttgttgatgcgtatcgggctatatggaatagttatgttttgggcagattgatggttttgggaaatattaaaaatggtgggattagcgtcgagagttatttattatgtactagtctttctcacgattattaaatgtaaaatatatctgaagattgggggtcggcggagatataagtaatggtggggataggaaggggttagcgtgggatcggtgaagagggcaaaattatcgatggcgaggagaaatatacaataattattgtatgatgggaattggagtataattggggtgggtgtggtgaatatgaatggcggtgatgaaagaatatacggggtgtggggataagggaacatataaatggggtaagggaggtatttcatcgagatatgaatttaaatgggggagatttagggggggaaataaatgggggaatgtggaagtaaagattcgtataaggggtactgggatgggaattaatgggggtaggaggttaattatatttatgatgaggatgtagattctgattattggttttatgatccttatcgggatattacaggtcgtgaaacccccgggaccatgggtgggaaatcatattttgtaaataattggattaagtaaatacctgtccccccttagcccgaaaatgaaaaagaataaatatttgtgaatat

SEQ ID NO: 13601 - DNA, 371 bp, Homo sapiens
ttcatgtccttagcaagctactgagtttcatggcccctattgaccatactccaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccaaaaaaaaaaaaaaaaaaaaaaaaaaaaaaa

SEQ ID NO: 13602 - DNA, 959 bp, Homo sapiens
  misc_feature (1)...(959): n = A,T,C or G
gcaacacaggagcgcgcgcggggacgacagggaacaaacgcgnccgcgcggtcaggggacacgnaaagcaaaaacttgccaagggacaacaggagacnnagaagcgncaagagggaaaggacaattacaaagacagcaccgcacacaccggaaacccagcagaacacaagcgacaacgcccgcggccagcgcaaccaacagaaaccgaggacacacagaaccaccccggccaaccgacggaaaaccgcccccacgcgcgagggagcacgcagccgcgcacncaggacgcacgcatgcgaggcaggccacaacaccccgccgcaccaccacaccgcggaacaaccgggaccgaaccacaaaaaagcaacaaacacgcccccagcacaaaccaaccgccgcgcgccccccccgggaagcgcgcaccccgccaccggcaaaacgcgagacccggcgcggggcgcaccgcacgcgccccacccgccccccgccggacgcacagaccccggcgacccccggagaacgaagcgccgacgacgcgaacacgcaaacaacccgcgaccccaacacaccaaaacagacgcacccacccgaccccgacccgccgccgcaacccccccccgagccgcaggccgcggccgcccacgcagcaggccggcgggggaacgagcacaaccaggaccaaacccgcacacacaacacaacacaaaccacccgcgcgcgcaccagcgcgcgcgaccgcccccccccggaagaagcgcagcagaacagcgccgaaggcgaaacgagaccgcgacgacaacgagcagccgcccgcccggcaacaaaccacccacccaagaagccggaacgcagaacaaccgcgaacccctacaaacgcccagcccccagcgcgccgcgcagagcctccgacgcgccacaccccgaccaccacaacgacgagaaccccagcaccaacgcgg

SEQ ID NO: 13603 - DNA, 1178 bp, Homo sapiens
  misc_feature (1)...(1178): n = A,T,C or G
ggcgggtcatgattctgcggccggcggcggtcgagtgtggccgccgtgttntgcgcggatacgtgacatcgggctcctgacagctgggggcgccgcntggtgagggtcatacggggctaggggcgtctctcatctcgcatgctaccgctccatcggcgtcgttgggccgctgtctgtaaccgccggtggcgttctgcgcgatacggcgggtgtatacgcgtctcacgttccgcggctgccgggcggcagcgcgcgggctggcgtgcttgtctattatatggcgtgcttgcggttggtgttcgttacatctacgggggtgggcgggtgcggtgtggctgtcggacccttgtctgcattggtcgccgggccggtgcgggcattgtcgcgtcgggggggggtgcgttgggtggttggtgggttggggtcgcgggggtgtggatgtgtttcgggggcggtgtgggtttgcgtcgtctgggtggtgcgggtttgggggccttttcgtcgcgggcggcgcgggctcttgttgcggggcggtgctcgtgcgtttttggggggtgtgggtgtgtcctgatcgtggtttgcgcggttgcggcgtgctggtttggatggttgggtcgctttcatacgctggggcggccgttgtttaggcggggttctcacccacgggctatccgggggtcgcgcggcgcgttttgtcaggtagtggcgttctgtggggtggctggtatctgttccgcgcgtggttcggcgtgctcgttctcctcctctggtgcgtctggcacgcggtaggcgcgccctctccgcgatggcatcggtgcggtgcttccttcgcggcctctcttcgtngtgtgtggtcgtctcacttcgggctctcgctcggggtcgtaatggctcggtggtgtgatcgtcgtgccttccgcgccgccgttctcttctgggggtgctcgctgctcagccgccgttccgtagttcgcctctctccgcctcgtcggctcctgcgtttcttgcactttgcgtcctcgcgtattgaataaacatgtctctcgtaattttactgccacgaaaacgagtaaataatgggtcctgcgttggcctacacgcggtggcagtcttcgcgggccagccactgttcgtctggtgcggccacctcatccgtctccttctcgtactcttcgccc

SEQ ID NO: 13604 - DNA, 800 bp, Homo sapiens
  misc_feature (1)...(800): n = A,T,C or G
ctaggcattcactgggtgctgctgntttctgaaacatctcattgcccactgcaaccagatagtcctgactcactacaattcaaagctgtttcttggagctcagccccacacagcccatcaccacccaggtacttcagacaccctgtcttcttttttgccccgaattaaaccactacacttatgattttaataatacccctctattccctcccatactttcacctcatttttttccgcaccaatagtcaaaatcgtaaccacccaccacgatcgtacaccccgaacgatgctaaatgggctcagctctctccatgttatcgcacccccgcccacggccattacgctaaacgcctcccaccccatccgtttcgatcccccaactccccctcccacacatcagccatcgctaacacgcgaaggcaccccttcctatcacaacgtccgttcactttaaacattcctctccctcctacccacccatacactacctcttatgatttccgcgacgcttaagcaccttttcccactaaatcgccacaaacaatcgatcaaattcaggtcactcccaacacactcgtcgactccaaacgctcaccaataagtctcgatcacatctaccacaccccccccataaccccacataatcgtctattcgcacccggccttccgtgccccgcctcaacacccgaatcccgttcatgacgcaatccgatcctctccctaacgtgaaaacgcagcccagtccgttcaagtcttccccccgaaccatccccaacacgccatcacaccctactagagat

SEQ ID NO: 13605 - DNA, 734 bp, Homo sapiens
tctataataatggaaatagaaataccgtatgctcaacatatccctattatgggaaaattccaaaagggagaaagcgcagtgtggtaaaatgaatgacttctattctcggggttagtgacagcttttttacaattaccgcaagataattattaaacctaagtgttccgtcaaatgccctcagggagaaatttaatatatatttaccatggaatactttccagtcataaaagaaaatgaaatcctgtcattaaaagcgacatggataagcttggaggacattatgttaagtgaaataagccaggctaggaaagacaaataccacatgttcgcattcatatggagaagctaaaaacgcttattccctataagtagagagtagaatagtggttattagaggctggaaggtgggggagcagaagatagaggttgatgaatagatacaaaattacagctggacaggaggaataagttcccatgttctaagcaccataaggtgactataattaataacaatttattgcttactttccaatagctagaagaggagactttgttcccaatgcaaagaaatgatacacgtttgacgtgatgaatatgctaattgccctgatttgttacttattgtatgtgtatatcaaaatatcatactgtaccccataaatatgtataattattatgtcaattaaaaataataataaaagcaaaaaaaactagcaacacaaaaaaaaaaaaaa

SEQ ID NO: 13606 - DNA, 1317 bp, Homo sapiens
  misc_feature (1)...(1317): n = A,T,C or G
agatgcataaagatatggcgcgagcagggtatgcaaatacgcacagccattgaagcgcactcaatatataatgaaaccataacaacgcgcgcgcagaatggcagacggaatcagcgcgtgaactggtggagtatataatacacccatgtatacactatatatgcgcgagggatgtcgggatcgtctcgactcgcagcgatctgaatagcgcgtacgtgacgcgccaaattacgtatgtgctttctattattacgcggctctctcgtatgtcacaactctccacgataaagatattaataccacctctttacgtcaattggctccagaatacatctatagcccacgtccatactagctcgacacttcccnatacccctcatacaatacaaatggcgatggagcgcgagcgctcggccggcgcgatacatctcttgaaggagcgggcgaatggaaatgcggcatatcgcgtaggtgtcggcacgattcggcatcaatcaaatcagtagcaagttgcgatgcacgcgacatctctatctcgattgaccgacgtactatatgcggcgttataaaagcgggggggcgggggaggtggataaatggtcgggctcaggcatcctactgaattaaatgcgccgggtccgccaaacatccgtatcgtgaatatgcgcgttaccgagatgacgtaatcaatggatcaatcgccatatacaatcgccgccgccacataatcagccgggggataaacgagtatcagccggatatctacagaatacgcgcctcgccactacctaatcatacggccgtgagcgcgcgcgcgggattaaatcattcggggacaacgcgtcgtactactcatttctcgctgtcccacagcgtctccgatcacacgtcaaataaatnctcgtaccagcatccgcataatcagacgcgcccaaagccaaaaatagagggaataggacggcgacgaacggacatcggcatggcgacagagcgaatcacctgcatcacaaccatctactcggtatctaccacgtctcatctttcccacattcacctcctatcaagtacgcatactctctggaaacaatacaattagcatttttctctcccgctgcttcgcgcgcacgtgagtatntcgttcatcatcacattctatagacttatcactacacaaaccgattagcgagtacgcgcaataaattacacacaaacgcactcactggtgttatcacnacccataacacatcctattacacaccatattcaatatagaccacctctaccctatatacctttcttctcccattcattacacca

SEQ ID NO: 13607 - DNA, 746 bp, Homo sapiens
cttattaataattaaggtacaggtactcagtcaaaagggggatatattctaaactctggcggccaattttcgtaaaccaggtagtttttgctatagaaaacatctagctgtgggtgtgcttgtaatactcagtatattgccttatttcatatgccatgtattttttctttatgaaaatggtgtcattcatctttattaatgtagttgaaattcataaactttctgtgtgaatcatttaatcaagaaaaatgtgttacggggatagattttatataaatgagaatgaaatgaaatgtttcattaaaatatgtaaaagttgcccagtatatcttaaggagaaatcgtatgtgtataatattattgtatttttgtaagataaaacaaatgttgtaagaccttaaaaatattgttaggagaaaaaaatacacgtatgcatagaaaaatgtctagaaggataaatgctaaaatgttcatcctggacctctgcaagatggggctatgggtgattttttaccccttcctttattgttcacctgtattttctaatttttcaataacgttcatgtgttacttatttagaaaagacaggagatgaatgtttaaagtgatggatatggtaattaccctgacttgatcatgatacaatgtatatatgcattgaaacatcacactgtaccccataaacatgtatggctattatgtattagttataaataaaatattaataagaaaaaaaaaaaaaaaaa

SEQ ID NO: 13608 - DNA, 830 bp, Homo sapiens
cctaggacatcgaatctgaggtgttagcacacctttgatgaaagctgcaagagctggtcatttgtgcactgtgcagtttcttattagcaaaggtgccaatgttaacagggctacagccaataatgatcatacagtagtcgcagctggcatgtgcaggaggccacctggcagttgtagagtttctcttgactcatggggctgactctactcattaactcaacgatggttcaacactgacccatgaagctgcaaaggggagccgtactatatcaccttcccatctatatcaatacaaccactaaaggtttgcaaagttaccacccccgtacggcctcgactaccctatccctaatcccaatcccctccgccgcctacttatacaacacatacatccccatagacattacaacactctaccccaaacctcacacaacaaccaacatcacttactcctcccctccccataccctattccaactaccctataggaccggacctcccggctcacccctccttcccctatacgttccaccgccactaacacacgtaaacattgactgcccaaccagaatcacatctttcccccgcgtcctatacaactagctctccaaccgtccaacctcccccatttctttccctaccgaccgcaacataacaacataatccacgtgcaccccacctgctctaccacacatcatacccccctccacttctctctatccataccaatccgcatacacttaagaatcgcaacgcaattccgattcatacacctctaccccataccaccaccacaacaaataccccactaaaccaaaacaaatcaatag

SEQ ID NO: 13609 - DNA, 750 bp, Homo sapiens
aaagaggagagaaagtggctgggtatctcaccttgcgccgtttttccaaggccggggaggaaatagtgagtttgctgtcatatgcgcatgacaagttgttgacaaagggcaataagggggggctaccccctcaatggaagaagccttcgtggggaaccgacaagtggaagagattcttttttataaaagagcagcatgttaatatggacccgtagggctcgccccaaggaagcttctttcccaagtcccaccaccaaaggccccctccaatttttgtgaaccctggattcataggggagccccattatgtttggaacaaaaagggaatatcgcccctttggggggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccctctgatatagaatgcatgagatacatagcaacaattacagataaggaactgtataaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaagaaaaaaaaaaaaaaa

SEQ ID NO: 13610 - DNA, 128 bp, Homo sapiens
  misc_feature (1)...(128): n = A,T,C or G
gctaaggagnactggagctctcnttaaaaaagaatgccttgccctcttacccatctggatgctgcttgaattaaatgtggcctccaacgcacagaaatacagtatgttttctctcaaaaaaaaaaaaa

SEQ ID NO: 13611 - DNA, 940 bp, Homo sapiens
  misc_feature (1)...(940): n = A,T,C or G
aatttaacatatcactagttaannntttgtgcaccggcagggccaattcgagatacacccggtgctacttgcctggagccagcacatcccacggggcaggctgctgcccccctattacttcctcagagagcgaacacaccgtagccgtcggaagctgggactaccccacagggtgcctcacgcggggcaacggaccgccatagtgcgatttgcgagccctctaggctgaacgatgacgcactgcgcgagttgactgaagctgaagagacgtgtggaatccatataggcacctcaacagtgactgcgtcaccgttctccgcccactccgaaaccccacccaccacttataaacattgactcacccccacaagaacattagctccgccccccctcgcattctattcttgccgggcgggccccactcccccatcccttacctcgcccctacattttccgtataactccttatcacacataacacataacctagcccattacccacgattccgtctcatcaactccggatcctcatttcgtcatccccccgctcaatacctgttattaaagagcggccgaattcgcgtggcaccaacgccacctcccacccgtattctcactctacggccctcgcgcttcaccactcgccattttccgtcaacccttcgcgcgcattgacccacagaacagccggaccgcgccgaagcctcggatcctatacgaacatctccaccgtctacttcctagcaagccgaagaaaattcagtaaaaaacattcgtggtgatagatatgcgagttgttaacgacaaacataaccgccgtcgcgcaacactgtgccgttcggtcccgctcaccttattgttggataactgtatcgcattcgtaatcagcatccacaatacacatttccttctatcaccgtcgactaccatccggcttccg

SEQ ID NO: 13612 - DNA, 1448 bp, Homo sapiens
  misc_feature (1)...(1448): n = A,T,C or G
aggaaaagagagaaggnagaaannagnnnnnnaagggnnaagagnnnnnaaggtggcgcgagagaaaaagaggnaaggctgangaaccaaactctagggggcaaccatttgctagggcccgagtcacaatgccacacggggtgcagcgctgcgtgcactcccgctcattgactgtgccccgagaagacgcgaacgacccaccggcagcacagtcggcagtagcgtcgggtacgtactccgcgacaacggcagcctacacgcgggcggagcacagagacggcgcacactagtcgtagacgtgtgcggacgcgccgtcgtgcgcatgaggcgacggtacgcgtctctnctgctgactgtggccgcagaacatgcaagtagcacgttgtggcgagtcacccgtggcacaccgtgaactctgtgnaccgcgcgtcgaccgtgggtatccgagagacacagggattgcgnatggtgtaggaatgatgtgcggnctctgaggcgatattctatcgatggtagctcgccgcgaaccacagatgagantagtaggctnagaaacactaggagaggctgtggtnatagcctgcgccnaggtagcgacgggcgaggagcgctnatagagagaggagagaagaggagncttaggaagaggtgcaccgcagaggaggncncncgcgaggcgagagatgatgcgcntcgaagagggcgnagatcatgcgacacacggcagagcagacagcgaggcncctgaggccgagcntccacgagaggcgtcacagcgaggtnnagagcgtagnacgcctgcatcacgtgacaagagggcatgcgagtgtgcgcgagcgtcggtggtgagcgacggcacgagatgtcgaaagtgcgcgcgaaggagagtacagcgcgtgcagagacacgtggcggtcgattagagacggtagacagaatgcgggtgngagctgcatagagagagaagagcagtgcgcagcggagcagacgncactgagcgacaggagcgagctctagncgagagagacactgatagacacagtagcgcgcaccgggaagtagcncncacacggcgcgacgcactgagcgagcaggagcacaangagagagcacgtgtanncggggtgggtagtgcagtgatacgtgtagtnagtgntcctagagaggagaggagtgtnncanttgtagtgagaggacgngnacacaccgagatcagagacgcactagagacanggntnacgcgcggcagcgtagncaccacgcgaacaggcgagcnctacagcacgtgcagatcnnncatcagagagagagtcgcaatagtggagcttagacagcgcgntnncnnncaagagatgagatgcggngacgnggagacgtgctgcagagaggagaggcgcaggtgaggcgntnagagagaggagtgtcgagagagggagagagaggagtgg

SEQ ID NO: 13613 - DNA, 474 bp, Homo sapiens
atcacaccaagggctagctgggagggccaggcagctccaggttgtcaggggctgtttccctctttcttcatttgaaagcgaacagcatggagccctggaaagctggccgcatcgcacagggtgctcatgcggggcaaatgtcagccatgtgtcatttgcgagccctcaggctgcggaggaggctctgccgagttcaggaagctgaagagcctttggcatcagatggatcctaatcttgactgctcacgtttttggtcactttgcaagtcgctttcccctttgcaacttcattctctgaagaaatacttagtgaacagccactgtatgccaggttttggggaccttgggccagtgccttaactccctgggactcagtttatccctctagaaaatgagactattccagcctggacaataaagcaagaccctgtctctacaaaaataaaaataaaaaaaattaaaaaaaaaaaaaaa

SEQ ID NO: 13614 - DNA, 433 bp, Homo sapiens
caggtccagaggccagcagtgcaaggaccaggtgccagcagagccacactcctgctgcagcctctagtggagaatcctcccttgcttccaccttctagtggctgctgccactccttgtggctgcatcgccccaatctctgcttccatttccacatggccttttcctctgtctgtcagtcttttcttctgtctcaaaaatttgtcatcggacttagggcccatctggacaatccaaaaagatctcatttcgagtgtcctaattgcatctccaaagacccttatttcaaatagtgaaattcataagttctgagagttaggccatggacatatctcttcatagaccaccatgcaactcactataaccattaacaaattatactatgatagtttaactttaataataaaaagtcattaaaaaggaaaaaaaaaaaaa

SEQ ID NO: 13615 - DNA, 111 bp, Homo sapiens
gatgacacatgactttggggaaaaagagaaaatcactttggaaccactcaaaagaatccattgcttttataagttgaattataataaataagctttccaaaaaaaaaaaaa

SEQ ID NO: 13616 - DNA, 782 bp, Homo sapiens
aatggtgcagacaccatacttcatagattttatctttttctacttggaaaggcaaaaattattcactcatttgatctgtgaatggaccaagatagatatcataatctgttaaaatcaggtagttgtcgatcaaaatcaacagtgctttttttccagattgattggcgataaattcctcatagcttaagaaatttgacattttatataagaactcaaacagcatggagccacaattttattgtcgattataacatgcctgtaattgacaagtaagtaagtaaacacctgtttggtgtgttccattcatcttaattccattgtggtcccatgcttttgctttaattttatgcttgctatatttagacctgaaataactccccacaagcctttctgtaagcaatattaaaaacaaacttctttggttaactttctgtatttctcagccagatgctaggatcagatgcacagccacaaacttagtttctcacactatacatgtaatatattaattacataatttaccctatgtatatttggttgctaccaaatgttgatgaatctttgttagtggattgtgtgctttttccatatgtaatgagagtttgcgacactgcttctgcttggaaagtatgctatagttaatgcatttattttattaaacaccaacagaactacatctagttatttctaatcacttggtagctaataaacattagcctaatttaataaaaaaaaaagaaaaaatggcctcgttggctacagcggtggagctctgcggccag

SEQ ID NO: 13617 - DNA, 1182 bp, Homo sapiens
  misc_feature (1)...(1182): n = A,T,C or G
aaactagtaaattanatagatttggcatgtgttagttgagtgagagagaacagccaaagaaaaaatagaccaaccacccacaaacaaaaagttattttttccttcgctgtctcccgccagtcatgtgtgttcttttccgcgcttnactatttgatgtgtgttagcggaactgagtacgtctgtcattcgcgacgacggaggcgtgactcgcagctcgaatcccacatatctacagagtaattgagaagaaccgtctcaccataaataaacnataccatagatgaaaaagctcaagagcttataattaactttataatttttgtgggagttatattaataatatagatttttaaaagaagagtatatttttttttttttttattctgtgtataagagagaatcagcaacgaataatagtaggtagggagtcgttttctattaatttattcagacaccccacgcaggctaaacgccgaacggaaaaaaagcccccgcccccgtccgaggagacagcccacaaatttttatagaatatgatttaagtccattcgtcaaaaaacactactaataaatatgaatcgagagcatacagggacaccataataattaccaatttctgctagcccccacccacacagacgtgtggaccccacacaaacttccccgcacgtaattcacaataaggttgttcataacttcttaataagatatactgcgccagtaaaaccaacaaaaataaacgcacctgttacactagtttataactttactttatacccattattaacaataactaatatatttaaaaaagtgtatcggtaaaacagtcactaatcgtttctccctcgaagcgaccattgtcgcacatctctaaaacggcgcgactatctgtgttcggccgatagcgagctacataagtaccctcacgatataatattatattagatgttctctctaacatccttctctaaacttcccgctcagatacactacaccttaatattatctcacaggacttctccatcgcaggaatgttattacnccaccccacgtctcnaccatnaacntatcagtattcagtactatatatacatttgtctaactgtcagaagtcgcacccgccctcgtcacgcgccgacgcatatgatattagccactcacgcaaacgcccgccacgcacca

SEQ ID NO: 13618 - DNA, 848 bp, Homo sapiens
  misc_feature (1)...(848): n = A,T,C or G
ggaccaccccacctctgcccacccccnttttgcatcacaaaagaacagtttactagtacanaattgcagaattttgcatactatacctacaccatgtgtcaaaagaggcgaagaaaatgccttggcttgtattacctgacaaggccactgttttgaagctcaacggcgttgctaccaacaggaacttttcctataatgtaacggaatgaatcaatagatttgttttgcgtcatttgtcaaaacttcaggtctaaataataatattccataatataataattacagcacgccaatatgaactaaccatggggattcataatatttaaaaattacataaatacgctaccacaggatttaatgccctaaaaccacacactgccttgataatcacccatccctacactcttttctaggaatgctctaccaaatacctgaacatactttcaaaattagctacttgcttaacccccagctcactatgtggtcaatgatctcctgagcagtacaattcctacccaccactgccaactaaaacagcccatactttccactcaaatttcaaatcagatcccctacccgattagccttgagtaacacgtgcgtaacaacgcaacacatccactcagcaaatcccaagaatctataggtgcgtccaccacaatttctctttttcctaatctctcccatctctttccaagtataattacaacttacttatataataccggaactttacaatacccaattttcactcacctataaactgaaacacatctcactccccttgcgcctctactcattaccttctctcgtaaacaaacacatcatacgcaacttccacctacagg

SEQ ID NO: 13619 - DNA, 1108 bp, Homo sapiens
  misc_feature (1)...(1108): n = A,T,C or G
ggggaaagatggtaggaagaaaaaaagnaaagatggnaggaggngaagtatggnagaagtnanaggaggnnngaagggagggnaaaagggaagaagnnaaaagggnnagattatnaagtgtgattaaaattggaaagtatgagnaatggttaagtaaggttnggtaggtaggtttagttacgtggnttgattggcacgccccgttgaacgcctgagaggaagaaacaccatcccaatacacccatttcgattttaatattcacgtcccagtgtgtttatttctttctataaacttcccacccgcccctccctgccgcgtcatgccacctgctccgattctctccctatccctcgctttacgtcacccactctgcagtttgcaccattttttcttatatcttctcaacttagccatcactcggcacaatgaatgtattgtatagtcaccacatttatatgacttnatgtgtatcnactttatcattcatcactcccgtcctctaattgttattatcgtccatattgttatcgagtgttctatattttgnactcagtgtgccgtgaatagatgctatgncgttgcagcctcctcctcccccccgctcccctcggttcgccctcgtcgtacaatgacaacctcagcactcgaattccttcctcccnctgctcacagcatatatattactctaccttctttttgttttctctgattcatcactccatattatgttaacagagtttcaactgtgtcctggtgttttcagtatattattttccactcagttgtactacgacgcaatactcccttatcccgttactttccttcttcatgtgtcttagacactcttcatcctcccccaatatacaccacagctgagtcgagaccttcaccttcacaactgtacgtattccccatcattgttcccttctaacagtccctcttccatacctctacatatncatctattcgtctccacatgattccattaatttatgtntncttatggcgttacctggttgcgtatctacttccctatattgtattcttgtgatttcgcactcatgtccccaaactccnnnctgcctctgccatcgctatcgcgtaacg

SEQ ID NO: 13620 - DNA, 781 bp, Homo sapiens
tatccttgcataatcacgaagagagaaagattttctcaagccaagaaagagatggtcaaggctggttggaggctcgctgatggcggccatcaatgttgattcagaagtgaagccaaaacataatttcctggcactattctggaaggaaaataagtgagataaagtaaaaatgactacatagccaattagaaaaagcaactaccacctccactccaaaaaagtcatgtaaataacttctagtctgtgactcgtcttcaccattctgtgcactggatttaaaggagcgttttacactcaaattaaaaattctgtttgctcaaaactctatgattctaatctctaaacatgcctctgaaaacaaataattttgctcgacgcctttttcctgaatcaaatccttaaatgtctattcctcacatacttattaaacctaatcctcactgcttccaccagatacagccgacgcccccacaccattttatccaaccttttcccatttatcctcctaccccgtcctttttattaattacttaccctccttccatagccctgacgtcgatcttaactcagacctctaattgagtcccgtttttcggacccaccccgcagtcatatcctcatctatctgcggtcgatcccgcacccgtgtatactacttcctctattgacccctattacccaacgcctgacacgtcattcgaactcaaaatacgcaggacgatattatcttatacataactccacaactcattcaacaaactcccacactccctcaacttcg

SEQ ID NO: 13621 - DNA, 765 bp, Homo sapiens
gagcggtttccactcgaattacatattctctttggtccaaactctatgattttaatttctaaccatgcctctaaaagccaaagaattttgctgatttgttttttctgtatgagatcttaaaatgtctatttttcacaaattgataaaaattaatcctccatgaaattaaaaagattcagtcccacaccattataatactgaatcttctttttttctcatttttatttctacttggtccttctttaaatttgtaaaacgtctttttccaagatattgtttgattctaaacccatacactgatatcaaaattaattacttaacaaaatcccaagaatgaatcttacatccttaaggagaagaacattaatctgactcagactgactgaatttaaaatttatttgcagttaacataaaacattcagttttaagatcattgttacattttcaaacaggcaaatcttgaaagacttgcctagatttgctctcagcataatttatatatttttttctctaagaagtagtttagcttccacttaaaatgcatgatgtacatatctgccatattttgttttattttagagatctaaattctacattaagtagaatatgcagttttagattaaaaaaacagaaaaccttttaaatgacttggtgtctttttttatgtcctttcaacaaagtgggctttagtcagtgggatgaaagtagtaaaaaaaaaaaagaaaatggcctcgttggctacagcggtggagctttgcgccgaa

SEQ ID NO: 13622 - DNA, 773 bp, Homo sapiens
taggtcttccaagtttataagatatcagatttccaagagcaatttacccctttcttcattctgttaggcattatttggaatggcttttcttcgatgaattcaattaacaggctggagtgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccaccttcggcctcccgaagtgctgggattacaggtgtgagccactgcacccagcctaaagagaatattttctcaattaaaaatactatagtcttcagaaaagaatcaattaaagggatgagacatttcaaatatattaactacaaactgtaactttgaaaaatattggacgccaatttattaagttctacagagaaccgccagccacgtggtatcagaaaaaaatctacgctcgccaacagaatcaagcctatgaaccctctaccagcaatcattattctgctcacgcgtcccaccctcggaaaccatctcgggaagcttgtcacgtgacatgatttctttagtgactttttcccccgacaggctccgcgagttccgcgccgcccccaccccagttagccccccacctcttctccctaatcccttgggaggaaaactcggaaatttaggagggggggcg

SEQ ID NO: 13623 - DNA, 967 bp, Homo sapiens
cgctgtgacgttatatcccccaccatccgcgctatgaattaattcacacatttcgagtctctgcaaatttctgctgtaatggaaccaaaggagaagccggttcagttgctttttcaggctttgtaagaaagagaattattaactcagtaaaattcccactctgtttgacatatataatcaaaactcaatgcaatctcgaagtgttcttctactttatctacaatactccactcggactgcacacctatagacgatgatcacggacacgcctccccactccttcggtatgtgatcacgcccaaccctagatagaacactaattccctttacctatccaccaccctcagaacactccgtcgatcttgtctccctctcttcacggccacctcatccctctccatctatttatcctgcttccttacccatttctatcctaactaacctacaaacttatctccataccccccaatccgaccctgtctctcacacccatcacacccacgtctctacgtcacgttcgcatatcgctcatatctatcgtctctatctacacattatgcattagatgaattaatcataaacccgcaagcacatcttttacatctatatatcatcccctcattcttccccctttctcaatataccgtacgtccacctcgctacccccaactatactatcatctctctatgccccgccacctcgcactgtattccttgtcatctatccacagtcacaccctaccaacgaccttggttcgaacttcgcatcttccactcaatcctctaaaaccaactaaccctcattgcatatatcaccacccaaataaattcaatcttctactataatactttttagactcatcaagatcttcataatctagttcttcccctccatacactctattcttctcatccatcactccaacccccttctcgccccgccacaccctatctgcacatacataat

SEQ ID NO: 13624 - DNA, 207 bp, Homo sapiens
  misc_feature (1)...(207): n = A,T,C or G
agtaaatcctgtggaagaaagaagaagnaggaaagaggattgnatggaagaatctccacttctcagtaatttgtttatttactttattagtttacatccatgtgattggcatctaaattattattttaaagttagatgacttttgctaatatccttgtatttaaatttttaaaaatacatctttttattcttctaaaaaaaaaaaaa

SEQ ID NO: 13625 - DNA, 928 bp, Homo sapiens
  misc_feature (1)...(928): n = A,T,C or G
gcccaactcacaccctcccacccccgcctcaagaaaacacgagggaaacantttancactaccaggaatgaatttttcacatcagccacacgaatgaccttccggcatacaagacacttcttattttgtaatgcaagggaaacaaaagctcaggtacttcaataggatgttggaaaagaagactcccactctactaggctgaacaaatgatcatttaccccacatcataccgattcctcttaactgccccacactccactaccccgacccactccctctcaccctattaccccctacttatctgtaccactatctaactaacatccacctccagcgcccatctattctcactgatctctcccattacataccacacctccacaagccaaatacaaacaaaaagcacactacctccctcccacccccacacccactcccaccactcccgccacccctaccctcttgccctctctcccccccacctttccttacttcccactattaaaacataaacacgtacagcaacccctctccccccgacccacctctaaatacaccccgagacctcacttaccaacttcacaacacctctacccacaatacgctcctcactgccatcccccacccccccccccaccccttcgccactaaacccatcatcttcccccacccaacccgacctatcccagacatgagcatatacagtattcgccaactccacccctcctcccacccaccaccccatacactagcactacccgggacagcccgcttgcagactcgatgaccctatggatgcgatttacgccaccacggccgcccaacctcgccactccacccaagcctgttcccccccctctcacaccctccaatcccacttccccgacgtcccaccaactcacctacacttttgacatttctctcactt

SEQ ID NO: 13626 - DNA, 963 bp, Homo sapiens
  misc_feature (1)...(963): n = A,T,C or G
aacccaccaaaaacaaccacaaccacaaaaaacaaaaacanaaaaactttcaggancacgagagaaggagtcattggaaagaacaaacctcatgaggaacctcttcgttctgagattttcagaggaaaatcaccctcttagtccacctaatcatcctgtgaaagtggattctctatggacagctctgcccgcttactacaaatacatcgctcatctcttaaacggacgtcgcccgacctatccacggaatacataaacaaaaaccgccaaccaaaaatctttttcttatacacaaaaaaaaccaacacaaaaaatacacccaaacttcatccctcccgacaacataacaacaataaaaacatccaaaccaaacacacacaatcgcagcccaaataacatcccaactgaaccatctcaaagcacacctacatcgaaatcacctactaactacgacaaagcgcacccaccatagacagaaaacaccacaccaccagcacaacacacaaccaaacaaaacaaaaacacacaccaaacacccctgcgcccgttgaacaaacaatataatacgaaactcaccccaccacttatcaaacgcccacacttcacgcacaaataaacacaataacataccctactcacgtagcgatcacacacattccccaccgacaacactaacaacatacataaaataacctatatgtgccgaactcgtcttattcactacgaaccatactcaaaacaccaaccacccaccaacgacaattccacccccaactacaatacctcccctccttgacccccaccttaacaccacgcctacctcaacgccactaccccccctcacatacgacaaacacctactaatactaagtccaaattcatcacaacaccctacacaaaccaaccagaccaacaacaccgcaacacccaccgatcgcatacactaggcagtatcagttaaat

SEQ ID NO: 13627 - DNA, 1190 bp, Homo sapiens
  misc_feature (1)...(1190): n = A,T,C or G
aaagaaagataggagaggaggaagaaaaagnnngagagggnnnnanagggnnaagagaaggnnaagagnnnnnaagagtnnaaaggagggagaggagagagtnnaagtagnnaaagaggggnngggagaganaagaaggtgaagnagagagagagagagagaaaggnagagagaganngaagtaaagggtaataggtgagtgtgaagagtacaagtgnnaagagaatgtagatgttcttaggggacaacgacgaggagggcacagcggagctagcnnacggaggggacgacgnnccgacggccacggctcagacggtttcccagtcgnatcctcgatgacnnctcacacttttntctaccgctcatcatctcactacatgactcgctncaatacgttcntccagacaccatgatgtccatcgatntgcaatgctaaacacatcagggatagccgaatagcctagtatacaactatgatgctatcgcagtctcttatattgtcaccagagcgcccacacgccataattgcnctcccgtgtctcgatgcatgtttgaaccgaagtgctataggcccgattatgncctacgagacaggaagcaaagacgtggcnacgggaagccccgcgcgaatgtcagaggccaccactgtcgcacgcgccctgccctgagcatgcaccggagcgacnataacgagggcacgacgcgnacatgagcnntgtcttaggagtcgcgaatgaggcataaacatacgtcagttaantgtagtagtntaagaggggagacgatgatagttgctaggtgaggtanaggtagggttntatatttaagtgcgagaagtaggtcgttaagcctttatagagnacaagattatcaatctcncggaggtctcgaganaatgagttattaagatcgncgcgctgagtcgagacaatgtgtgaagtagtcgctctgcgatgtcaagttattataagttnccngacagatcgtanancgtaatgagagagcgatgaatcgggcaaccaagtattataccacgcgagagtccagacggtacgcgcgccgcgcaaggagtnncatacatgtgttcccgccgagtcncctgatgcgctcctccgcgatgagcgctctcctcagtgncgggccgagagatgagagagttngacgaggagcagaggtaagaattatatcag

SEQ ID NO: 13628 - DNA, 1080 bp, Homo sapiens
  misc_feature (1)...(1080): n = A,T,C or G
ctcacgtactcccccacgcatcaatactccataatctcatcgggcaagcttcctcttcttcctcgctactgtctatcaatggcataattatagacactgcaaggtcgatagatcaggcagtacatcttataaactacctacactgacacaaaaagccaaaacacacgggactgcctgacttagctacacttcgatccgcccaggatgagtgcgtagatggaatcaattatatcgcatattcttatatgactacattgtaacgccaaaatagactagaactccacaactgtcttcatggccaaactttggacctattctacattctatcttatcagacagccgtaacatgcgtctctgaaatactcctagctccgcacggcatagctaagcctcatccatcactgtcatgtctgtattatagtccgctcacgatcaacgtcacagagaaagaacaagactacacctacctatctcgaccatcccgtgtatgcgtggggcatccccagcggcattaaataaatgttttgctaagcgcacaatgcctctatgaagataagcccctaatacgatctgacgtgtcgtattaaggcacggccgcaggcaccaacggttataataagtctgttaccccgtcgcacaccacccttttcatccgcactctctcgagattcataagtctttctgcactgcgaccgtaccccctccgtcactatagttactaatattagatacaccataaagattgatcagatcaacataataatcgtcgattttaccgtctcgctatgcagctaagagtacatcagcaacccagtgcatctgcacctctcccatagatcactcaatgtccgcaccccaacagataacgatgccaatgcgtacctcacacgcgccaagccgagtcacgcggcacattcgtaaagacttcacatcttcctaaaagtacaagctcacggactgcgatgtatacangattagtccgagcgatatgtatggcaatattatcatattatatttctctctctgtattattaaccatcaagcaggtctgactccgatcacatatcgcatacaagaacc

SEQ ID NO: 13629 - DNA, 906 bp, Homo sapiens
  misc_feature (1)...(906): n = A,T,C or G
gctagaccctcggaacaggtgacttacactaaatgcagataaaatgtcactatgtattggtatactgtttaagaaagaatctaaaggcctatggacatcagaacgttagaataaactaacatggaagacctgctactccactctctgcctaccagaggaagctccaggccacatcgacctacaccaaggccgcgaaaaatctgctcgaaacgagaaccatgacacccatgatccaccaaccccaacagagacaaatactccataccccccctattctaacacacatccacccgcaccgccaccaacgcaccaacaacacgccggacccgcccaatgacagttcggacacccgcgaaccaacatagacaagacgggtacacacatcacgatataaatagtaccagccaacgataaaaaacagcgaagaggccaatgagaagacacgacacaccgacaagctaaccgccaccaagagagaccgacacacccgcctctgcagacgcacgccgacactaatgtcgcactgccacccaccgaacgcaccccccgctcactgtacccacccgctacccaatactgaatacatcaaaccaatcgcaccgccaactaatcctatagaacaccaccatacccacccagaaccgacgacacgagagagcacgaaaacccacgcagatagcgaccgaccaacgttaagacaaccgaccagacgcatgataggacagcgctacacaacgactagcaagtcaactatatgacgacatacccccaccgagctaccaggtccgcactaccgaacagcacagcaaagacatcaccgacacaataacgagacgatcgccccacaacgctgatgccgccaacccccgaccgccccccacagcccacaccagacngccctcgagg

SEQ ID NO: 13630 - DNA, 846 bp, Homo sapiens
  misc_feature (1)...(846): n = A,T,C or G
ttttttctctttgtttctctatcaacccanaaaaaaaaaaacgcgggacacctttgagtgctacatgncagcaaatttaanaaaaaaatacagaaaaaaaataatcaatgtgaaaggcaatcagtatctttaagacatccactgaacacggagataaacgggaacaactgcatgaacacttacacatgtgggatggttgttttgaaaatatccaacatacagttgcaggtttcatcccatacttcaggactgaacttcttccattggatattactaactttttttacaattactaccttgcttcaccgacttgccataatatatttatctaatcctacatctttcctctaatttaccccccctcttctttttcgtcctatcttctttatcattcactatctcttgacttatgctcattcgacacctttatatatattcttatcccacctttatattacattttagacccacacataatatgcacactccatctcttcactccactttacttttttttccctctcaatacttcaataccttaacacattctccactctcactgtttcgcattttttccctccccattaattcattacaacgactatccattgacataccctatttctaactattcccactctattctatacacatttcaaaacttactcctctactacctacattatcccccttctttccaacttcactttcttctctttctaccttactttatatctcttcccactatatcctacttcatatttctcatatatactcaccttatccctcaatatcatacaactatcctcctacccttcttccacatccccaccttattattttctt

SEQ ID NO: 13631 - DNA, 873 bp, Homo sapiens
  misc_feature (1)...(873): n = A,T,C or G
gatggtagtgttcggtccctttnttcgcnnnnnnnacccccccgcgccctttcagtacggctagagtctattattgtatcatcaaattccctgatgttttcctctctggcctgcattctgctgttaagcccatctccattgaggtttctattttggttctatgatataacagtgagcctggaaaactggccagaatcaaatgagaattaaaacctgccggaatgcttaagcgaccatggcccggaggtttctctccagctctgcttctccctccctgcctctggaggctgctgcacctatcagactcacgcccaagagtgaaggtattgcttcttacaggacaagcttcggacctgtcacttctgatcctatcaacaagatgatatatcagctcctctgaggaaaagcctggcaatcgtcctactcagcaatgagcacagggctcagaaatctgacagcaacatcctaatactcgtctcccccgcacaagcgccaccgctaaaaccacatatatttcggactcccatgacacagtactttccgcgctacccttttttggctatatccccattccatacacccccatccccaaactttgccaacatgttccctcacaggccagtccattatctcacctccaccaccacataaaaaaccccctcatcacaaagagagatttttccaaccgctgataaccccgcaatacttaattagaccaatcgacaatctacatccttacaatcaatacaccctaccacatcactgcacctacgcgtatgcctacctcatccgtaccaccattcacataaaagatccaattataatatccacctactacaacaccctctatccccaatcccctccaaaccccgg

SEQ ID NO: 13632 - DNA, 1056 bp, Homo sapiens
  misc_feature (1)...(1056): n = A,T,C or G
caacgtttcactgtgtgaggcaggaaanaaaannnttttttgtcatggtattgttcattttgcgccaaaatttgtggggccaatttttgtagcacctagcanacccacataccgcacccaggngaaaanctaatttttcacacggcggtataaagcgcccagaacgtgaatcgctcaatgccatagacatcgcgatcatggagcaggtgcactataccgagcaagaatagctcctacacgcagtcattagtaccagagaacagcgatctagtgggagacacagaaatacagaacttttcttcatacatagcaacaataagcagttagaaagagtcgtgacgcgcagcacggagtacagattagaagaaaatagatatagaacagtaaattacatcataagaaatatagaagtccagaacgagggaatagagaagaactaggcatcagcgtgtcaacgcaatactaacaaaatatgagatatntcagaatgaacaataataatataccacatagatcaaatcatacatattgcgaatattgttatacattacattatttatataagaatgaattgatgtacttactacgtactatagatgagatgctcgaagaaaaaccgtcacagtatttgataatgaaatgtaagaaggttgatggatgagagacaggataggtgctgatccgacatatgaccattgctcatctgcgatgatatgagtatgcactatcgagtaaattatcgatcttatgatacgctattgaccgagtagttgtgatcgatgcttgatataaggagctattgacgcgtccgccactcctcaatgatactatagataagataatagaatataaaagacaccactaagtgaataacgaccccaaactgaacggactatgaccgagtacatatctaataacctcgtcacgtaacagacacgtaacatatattcgatacatgcaacgaacgcggaggtggccgatcgtattgcacagatcgtcagtgttacccgcgtcgatgaaggtcagctacgaccattcacgttcaatctcgcagat

SEQ ID NO: 13633 - DNA, 784 bp, Homo sapiens
catcagagcttcctgcagctcttcccagacccacagaccacacccagtggaaaactaataaagccacaacgtatcgaggcccgcagtgaatgctcaatccaagacatgcatcagggcggtgcacatccggaagaaagctttacacactgtcttgcaccaagaaagcaactatggtttggaagagcagtctttttcatcaggcccacaattaacaatggatgtggctaagagtacaccttctgaagcaaacttaaacattactgtaaatgctcaagagccttattatttggcaaacaatcaaattagggacatgcagtgtatacccactttatctttagacacctgctcgagttaagttcagtttaccaggctaatagagttggaagaaattaatcttcggcagtgggttatatgttatattccatgttcttgtattttgtaaagacatacatactgagttctttgtgaccgtctatagtatttttaattatttttcatattgactcccacttttataaagttacctgtgttttcataattgtgattaaataaatcttcttatataattatagtcatacttataatttatatttcattatatcgttattaacttttatattcatccttccttctatttgcttaatgatatatttcatcgtttcgtctttttttcttattgtatattttttaatctcttcttattcttttactcttttttgtttttagcacttcttaattcattttagtccccaatttgttagcgcataagtacgagtttatagat

SEQ ID NO: 13634 - DNA, 629 bp, Homo sapiens
aggagttcaagagccacattttgcttcttgttggccacagcattccaaatgaagcatgagagacaggatcacatttattgctctgaagagagttcttcttaagctttatacttttctttggtgaaattcctgcctcggggctacagggttccaaatgttgtcttgtatcttatactatttctgcctggtattcttgtgtatcaatcttgtgttccttagtttgcattcctgaagccagttcagattaacatgagaaaagttttctcatcataggatattaggaataaagcatatgtatagatatatatagattcatgtatttacttaaggaaaatgaacaaatggaaaaatgctagaaacattttgttctagaaaaagcaagtggttataacaacaatggaaaatttaggaaaaaactttaaattttgaaaatgaataaaaactagaatgtacatttttaaatctctgtgggcccagaggtaatatcatactggcacaaatctttcatttaaattgttgaaaatataattgccaaagttagtcacagaactggattagtcctaaaactgtaagagtggttcctgtctagaccatataaaaatgaagtcatgcagtaaaagagaagaaaa

SEQ ID NO: 13635 - DNA, 879 bp, Homo sapiens
taatttgtaaaaatatgaactcgccagatacagtacgacgacctagcctgacctttgtggggatgaaggggtctttgcccaggaagtcactgagcagtatggcttctagaagatgcctcccctgccccgagctgccttaaccccgtttgacgttcaaagacgcaggtgatgtcaccccctcccactgacaacacagtaaggtccaagttctctgaggcttcttgggccgtggcccagggaaagcaggtgacccacctcccagtgccgagtgggcaaggaactctaccccgagtaaggaccaagcgtgacggtgagctagagaggacctacatgccacatttttagagaaaatcccttaatcagaaaggaagactaagagaaaaaggaagaaaagatctacaaaacaactaggaaaaagtaacaaaatggcagtagtaagcccttacctatcaataattaccatgaatgtaaatggattaaattctccagttaaagacagactggctgaacggattaaaaaacatgaccctactaaagttggccattgaacaatatgagtttgagcttcacgagtccaatgtcatgcacattttcttccaaccttgccacttcgagtcagcaagaccagcccttcctcctcctctttccacaaacttcttgttgtgaaaaaccacgaggatgaaggcctttggcgggacgatcacttccactggacaaacattaaatatatctcttccttcccttaccggaaccacaagtaatccgcctataaatttatgttccatgcttaatacccgctatcctcaaccatactactccggctcactcccacctcctgccacacgtcgaccttcactctaataatccacatcacttccg

SEQ ID NO: 13636 - DNA, 740 bp, Homo sapiens
  misc_feature (1)...(740): n = A,T,C or G
ttgtggggggtaataaaggaaggggtagcccccccccccctgtgaggaacaaaaggggaggcccgggggttggggggtatgggggggaggggcggggggaaagagggtgcccaccacccccgggggggcgggggggggggaggtggacccccagggaggggacgccggcggggggggggggtacaagaggggngccggccggggggttttggggggagaggccccccttgagagaggggggggtggtggggggagaggggggggagagattcctccagccgcggggagagggggaccaaggggggggggggggccccccgctccgaaaattcgcggggggggggaggggggggattttcccccaaaaaaagagcgggggggggggggttaaaaaaaactccccccacaaaggggggcggggggcaaaaaagggttggggggggcgggggcccactggcacgggaatttttttcccccccgccccccggggggggggaggagagggctttttttttttttttcacggaggcttagagggggaagaccccgggggggggggccctggggggggggccccccccccgggaaaaacataaaaaaatttttttttcccccggggaaaaaaaaaaaaaaaaaaaaaaaaaaaaaaaaaaaaaaagccccaaaaaaaaaaaaaaaaaaaaaaaaaaaaaaaaaaaaaaaaaaaaaaaaaaaaaaaaaaaaaaaaaaaaaaaaaaaaa

SEQ ID NO: 13637 - DNA, 243 bp, Homo sapiens
aatgccgccctccccccctccccccccttcacgcctgttgtggtgtacttgcgtgggggcgggtcgggggggggggctctccccctttcttacccctttatattttttttttcccccccgcacgaaaaaaaaaaaaaaactaaaaaaaaaaaaaaataaagtctccaaaaaaaaaaaaaaaaaaaaaaaaaaaaaaaaaaaaaaaaaaaaaaaaaaaaaaaaaaaaaaaaaaaaaaaaaaaaa

SEQ ID NO: 13638 - DNA, 965 bp, Homo sapiens
  misc_feature (1)...(965): n = A,T,C or G
attagtatatttatatacttcaaaattagacaatgacagtaaggcctcctttcacgagtaccacaagnataagacttgaaaaacaagagacacctgaaaggaaatacacactaaagattggtcagccaattcttcaacaatcagaacattgaagctcactcagttgaaacctatttatctatgtacttaggcaactaatgcctcctcactgatctctttccttttttcggctcttcatttctccgattcacagaagactgacacacatcctgagtactggccgtgactaacagaagcacgattcggcatgccctgagctcctctcctcttacagattctcatcaccctaactggcagcccctccaattaactcccccctgaacttctattccccaccgacctcttcactcctctactccaatccatccacactgatgccgcccccccccaccccacctatactcacctcaagacgaccccctcataacatcaacaatagcactcatcacgcgtccgcgcatcatcatagccccagaacgattaacaataacaggacaaggcccttcccccccatcctgccaccaaatcaagataccccccgacgaccgtccacatcccactaacccccccatctcacacctcctcctactactagtatcctacttctcacccttcccctcaccacacttatatcatttcactctcacataactttgactcacacacatatacgtcgtccctcaccccgcctcccagcgttgcccattcgcacncccctaatcatagtctacccgaccatgtattcactcatcccttgtagtcatcttacgtcggtgcnacagcgtgaggcncaagaccgtggtccgtccgtcacgtcgtgtagcaccaactagctatcctcccaccgcgcccaccgcacgaatacctgtaccctcaccgccacccttcatccccctctactacac

SEQ ID NO: 13639 - DNA, 730 bp, Homo sapiens
  misc_feature (1)...(730): n = A,T,C or G
taaaggttaacagaaactcaactggtcccacncctttgggtccctgctgttttctcttgcagactgtgctattattttaataacagtgctgctggagtggcggtagtaatgtagatggcaccatttgcattttggacctggctatatcagaattctgatgtcaaagaccgagcagtgggctgtagagtaggtttattaactagcaagtcttccataattaagacggtgaatttggctgaagtctaaaataaatttctcaaagactgagctggagattatcaacctgaatatatttcttgagtagaccaaatatgttttgtaaaagtaactatttcttaagaaagtgaaagtagagtttcagttgctccacactgagctagaaatcagagagagcttatgttctccacagtttttctgtgtgaatatgaacaaaagatttcactttattacttagtttcccgtctgtaaatggggtagactaatgcctgctctttattctcaaatagttcagtgaaaataaatgttttgctttacaactgctcttgtatgtggataaatactgttttctgtatgccatgtcccatgtcagttatggttgtatgtgatggatagttaggaatttaagttattatcaaagcattttgaacccttagaagaaaagatacagtatttgaaaggtagtagtagtctgtgatgattataaatgagtcaataaatatctgagaccaaa

SEQ ID NO: 13640 - DNA, 619 bp, Homo sapiens
ctaaagggaatattaccaaccttcacccatcctaacagaactagaactcacagtccttgaaaatatcaatgacagaagtgaagaatccctacagctattgccattttaaactgagtgtgttccaaatggccctggtagctgagaagtagagattctttgattcagtttcctaaaatagctcacttctctctcatctctgtgttgctcttgctgtccaggttgcccgcaatgctctatcacacaggtgtcattttccattccagccttctgtttgtgcagaagcgtaagttctcttccttcccttcttcccttctccattcctcccttctcccttcctttcttcctcccttcctctctattttttctatcatattaatatcatattgtacacaccattttgtaccttacttttctggcaaagcattttccaacaccatcggtcttctgggaggatgtcgttttagtggctgatactcacccattaaactttcctcattcataaatttcacttattcctttcactcttgctttaaaaccaggacatcttttcatggggctacctcctgacccttcttgaagcgaggctgtctctcttttttttctcagtaaaagatggcct

SEQ ID NO: 13641 - DNA, 821 bp, Homo sapiens
ctagcttgacattcaaggaaattctgtcaagatatctaaatacacaggagtggaaggaagagagactttaatgatcatacacgccaaaaaatagtgtgtgcaaaaatggcttagaaaattgtcaaatagattactacagccttaaaaaatttaaaaaaaatcaaaaactcgggaaaggcggaagaattttatttccagaattaccacattaaaccaaaggccccatttccaacagcagcaaaattacaaggcatacatagaagcaggaaaatgtagctcattcaaaggatgaaaataaattaagtaaaactaatccaaaggaaggccacatctcaaacttaacacagaaagatttcaaagcaactgtcttatgtatgttcaaagaactatggaactatttgcacaccccacatacagacgtctagatacactatcgccattcagcgagatcattaccacctcttcgaaattatccacaaggcccaaacacaaatccttacaggtgaaaattttagtacctttactccaatacttcatctcaggaatttacacccacctctacacacaatatcttgctctcccacctattatgactcccttctctcccactttgccctctcactacctaacttttttaatttcacacttactactactgtttgaattcccgtggccttttatcccccatcctcatacgactggccctccactacctcctaccccttcatcacacctcatcgtctcacaccacccatcatctttctacctacccctcccccactcactcctcctctctactcacctttcttccatcaacactt

SEQ ID NO: 13642 - DNA, 735 bp, Homo sapiens
  misc_feature (1)...(735): n = A,T,C or G
cctaaaacatttaaaaatagttacttttgttttctactgaatgccctgaataaaagttttgagaaaattattttgtcatagtcataaattagttttaagtctaaatcttacccactggtggctcaagtgattttagatactggtcatagtcatcantgcttcttatctcactaacggtactaaattacccccgccactggtgtcagaagcctcctagcaggtctcactgatgccaatttctgcctccccaattcataactctttggctctctgcttagattgttgctttttgcaggttccttccatgcttaactgcccacaacaggtctctactgcccttcatatcaagtgcagactatctggctggtattcaaagatgctcataagctgtttccaccctccctcccttcccttctttgccatcacttcccaacatgtacattccattctaatccaaagagtcatttctttatcttgaactatgttcccatgttcaagttttatttttctgctgcttcctcttcttggatagttcttcttccattctttcaactggcccaagtactaataatatttaaaatgttactcaaatccagcatccttcttaaagtcttgaatgagttttcagtatcaaccatcggatctctattgcagtggctgtaatttcattgtaaagatgttttatccatttaaagttaactcatatttgtggggcaataaatactacatagaaaa

SEQ ID NO: 13643 - DNA, 1459 bp, Homo sapiens
  misc_feature (1)...(1459): n = A,T,C or G
taatcataaatgtacattaaagcatggaaacaagttacacagagacgaaacactttcagtagaagccctacttttctcgcaagtctaacttcggcaaaaccatcgttctgaaaatatccatccatcgaaaattctccccagcactctgctacgagcagcgccaacactaccacatttcacgggaacatgcatgactaacccgctcgcgaagaacactcattacagagatcgacacatccccgcaagcacaccatatgtgctctcaagatctctttccacgcgctatgcaaatgtagaagacatacaatatgctatcagtgctagcctctgtagcacgaagacggtccacgcctctatgcctacctcactatggcatacctctcatccacctgcatcaccacccgacctagcctctttccacgcatcgcatatgtctccacctccgcaacatatataccatgatgctcgtcgtgtgctcatcatctaatcactatcgctattctctatgtaacagtatatatacgtacaaatttgtctgtagtcctccgagtgattcttgatccattcctctccacggtctgantatcatacaacgcctctccacttcgtgcatcgacgcgcgaacgtcagatncacgacacgtggcttactttctctctacccactngccgataatcgccttagactgcgacgaccttctcactataatctccgtcgccagtcacgacccgatcgtgtgacctccagaacagcgcacttactgatacggctggtatgaagatatcaacctcatccgcggtatacattcgacatctgtaactctgatatatctggtgactcatctctcttctcattacttactcctctccgctttgcactgccttctntctaatgagctacatctcgctcttatctaggtctgtctgtactctcctctcgtactaatagtcattatacagacacatcgaccagcacagtntaatgagcgacacgtgttncnaggacggacgttagtatcacacacgtggacaccntgtctgtcgctcttgcatgtactcngtgcagatcttatgtgtgtagtgcctctataagcgatatgcgtgtacacgctctcnatgacntntatcgcgngtanagtaatctgctaagtagcgcggagatcanaanacatacagccgactcactntcatgatatctntntntacgtatctatantncacanactatgatgccacactatagtattatatcntactgtgagcttntantcantntatgtacantattngtaagatatatgagantatattgatgatttgcatacnantacntgtcacntagtccacagtgatacatgattagantatacagtacgnttagttactatgagtnactntactatatataatactncnacatagactcaatttactctatatatgtttgtgatatatattat

SEQ ID NO: 13644 - DNA, 481 bp, Homo sapiens
ccgcgcacccgctcacacccccaataccgacccgccccgcaacacctccggcatttcctttcataggatatatgaaatgaaggctacctgatagacatatgtgtccaagagaaaccctcctgggatgcagaaatctgaaggtctctctcctctcttctgcaggtcttttagaagatctaagagacactaagggttagagaggtgccctctccccaaaaacttcagccaaagagcacagagcaatgtaaatccctatgctcactttctgggaatgaagacctttatacacattttgcagttctctgcctggcttccctcattcagagaacctgacctattcctcctcactgctatgtctctgcccaaacttctctctctgccaggatactctgcttgcagaaattaaacccatacttcataacctgattaacaaataataattccgctcaacaaaaaaaaaatcggccctcgtcggccctca

SEQ ID NO: 13645 - DNA, 930 bp, Homo sapiens
taatcatgcaacaatgagaatggtgtgatctctcaaaaaaaaaacttcatgtaaacccctacacaaagttacacaaagcactcaagttcaatgtgatgcagcgcaactctgatctaactacactgaaacaaagagtcacaaccaaggggactgcctgagtttgctacccttgatccacctgattaacgccacatgcagaaaatatgttatccgctcacgccacatggaccacaagactaacagggtacaaaactctgatcgattcgggcactttttcctcttcttcaccttacttcgcatgtgcaccgcatctataaccaacttcgcctcgagcacaccgtcacacccaccaccactcacactccaacacctccaacccacctctccccttccgcacctcatagcttgtctacccttattaatatgacgtcttcttctcctttctccctcttttactcactcccacacccatgactatccatatactatccgcacgaatatcgcacacaaacatgtagcattcactacccctcacttttatccacgacagacggaatacccagacacatacataggaaaccatataaaccgccacgacaatctaccaccacctctaccaccactcacaccttcacccttcctcccactccactcccactaccgacccgcacacattcatcctctcaagcgcagctatacattctccgtatcctatctatactatcctcactcacctcacctacacacctaaaaaccttaccacttaatcccaatcacacaaccaccctcaccgcccagttagacaaataatcaatcattcatcagcacctctacaccctgccaccattcctccctccaattaaattcatctactcaaactgttctgccacccttcactcctcgcacccgtaaacgcaagtaatacaatag

SEQ ID NO: 13646 - DNA, 734 bp, Homo sapiens
cacacatggcctgtagtattggacagtgctgttctggcaagggccaagccttagaaaccagctgtcttataaaatgcaagtgctctgccatccttggaaacttctttgaggacgtctaagaaatattattatcacttaaccctacagtaggtttggtgtatctaccaaagggaaaggactagctctgccctccagccatcataaaaccgacacatatgtttccaaacataaaagactgagaaaaaattaatgctctgtgtataacattcttagctttccttttgagtggctgtttttaattgaatgttaccatttggtttctataatgggtgaaggactgaaggtagggagtgaggaggaaagaagaaaagaaagaagagtgatgtggtgccagagcaaagagaatactaaaggcaaggcagaatggctgaaggctgagggatgagggatgaagataagtcagggtttcaagtcttggctttgacactcactagctggatgattcagttactcaactctttaagcttgtttcctcaattgtaaatgggaatgatactcaaacctaactcaccgggttgttggggggactgattaaaatcatgcaggtaaaacaattaactaaataattcctagcgcatagtgagtgatcagtaagtgatctagattattatcacaatagtagtgatgcagagattaaacaaaataaaataaaataaatgctaaaaaaaaaaaaa

SEQ ID NO: 13647 - DNA, 145 bp, Homo sapiens
  misc_feature (1)...(145): n = A,T,C or G
gtgtcacctcctggaacntggccacagttgtcaacagctcaaatcctagagaccttcttcattaggtcaatgagtatctaaactttaaaaaataaataaaggggtaattattagcttgccccccatcccaacaaaaaaaaaaaaa

SEQ ID NO: 13648 - DNA, 206 bp, Homo sapiens
atcatctgatgttgaaagctcccctgaactggatttcctggaggaaaagcctgtgaccatgggcacgtagggagtgtcctcctatggctgtgggccctaacacccctcactttcaagcttgtccatacccagtctccagcaatttgtcaaaaacaccttttggttttcataccagcttatgacatctagcagcttctgtttcaaat

SEQ ID NO: 13649 - DNA, 835 bp, Homo sapiens
  misc_feature (1)...(835): n = A,T,C or G
aatcaagtgtctgtggataggtatatatatataatagatatataaagacgatatagatactaggtaacgagtcatgaaagggaaaaggaggtagtagatttaagacgatgaagtataatggcgagaaataacagaatgnatgagtcaaagcgcatacttacgaagattattattcatgagagaagcaacatgaagaaatatagaagatggagaaaaaataaatgaagtggaggatagtgtagtataaaggaatataaagcatataaagaaggtgactaaggggggcgcgggcgtaaaagcggtctggttggcctgaagttaaataaaactgcaaagtagattgatatattgaaagtactattggattgtgaacagaactgtataaagagaaggttatagttgagtggtaacaaaggaccgtcaaatggagagatactatgggagaggaagagaggtggataagagtacgagacagaaagagaagagagcacagtggataagagaaatctgtataaaganttgagactcgggatcacatgcttataaacgttagatgagtatataacagttaagaagataaaaaatttgtagtaantatatatataagaggaaacttagatagaatcgataatcgataataaaacagtgataaagtatgatatataaatagatgatataacgtcagatcgtgtcgtaggcagaaggagaaagagatatttgtatgaatgatggtgataatacagaataaaagtgaatgtaatgaggatatatttgagatcgtagtgagatagaaatactgatcaaggtaaggtgcgcagacgtatgagaaagtang

SEQ ID NO: 13650 - DNA, 553 bp, Homo sapiens
  misc_feature (1)...(553): n = A,T,C or G
tagaaattggccctcatccacactacaaaattgcatgcttttttaccggagtggacaccatcaagaacccattacccagaccactacatacgccatagcccttgtcccctaatgtacatgaggttcataaagagaaaactctnccagcctttaaacctgaaaaagtgtctactttgtcaccccccctcgagtaacagagaataaaagtcccctaatcccaaatagacccacaaatacagaccctatccccacccagtcctacaccaactaattccgacctaggaagccaagagctgaccacacgatccaatctccacgtgtatctatctccacaattacatccaagacaaccaccaacaacccatccaaacacttaaaatactcacttaactccacacaaaccaaaccaaacaaacatagatattgaccatccctacgacaccaataataaaaacccaaatcgagtaaatcaatagaatgnccaatagttgcttacgtacacatggataaccccacacatgtaccacagaaaaatagtgcaaaccacaaatat

SEQ ID NO: 13651 - DNA, 2071 bp, Homo sapiens
  misc_feature (1)...(2071): n = A,T,C or G
ctcgtcgcgcaagacngacacgagtanacntatatatagacacgactcgtcggcagtaccagctcacagcgttcgcatagtacgcgagngcgcgtaatgtacacacagtatgttaacagcactgtcctgcggtgcgagagtaatgcgacatggcatgcgagcataaatcttcgtcgtgacgatcgtcgacactctagtcgcgagcatgagtncagncgactgataatgtgatatcagagtactaacacataatgtcnggtgatgagnatgctgagatagtacattcagcatatacatagagagtacactacctagtgtgctncacatgaacgtatcgactcagacnctatcngtatngangntcnctactaaagtgtgaatcagacagaatcgacacgcatacatgatcaatgcatcaggcatagtcgtagcncactctatnactcantanacctacgatatataatcagtcactcacagtacncgtgctgacagccgtatgtgcgcatctacgacgtgtgngttatgacgctgctagcgtcagtcgtacatatgcgcgtaagcttatccgtgatgcgtagtagtatacataggtgagaantataagatantgaantngcaagntagtagcatgagacgatccgtcagtcgatctangtagtcgtacancagcgatttgtcgcacagacatacgcagagnacagtatacgttatagacgcgatgatctagantcgccagcacgagcgatcancgacgcatcacatcatcgactcgtattctcacgtattctgtgatgatcgtcactgtgcctagcatgcgacatgtgtgtcgtctactgtcgcgagataggctgactcanacgtaagcactagctacgatcgatcgcgantnanagagaagtagcgatgacactcgtcngnactacatgcgacacatgtcgcacgacgcgagtatcncgatactagtctcagcgtantncgancngagtaacctcacgatngnagntnancgagcagcgctgcgtcagatgnctgacagctcgacngncatntgcnacagatgctgtngtagactggagtcctgatgcgtgcncatactagatgcagtcacatcatgagcgatcgcgctcgnggnagcgagcgactcgagccgatgggctcgctgctacacgtagttaagctcgcgctagactgtagatcgtttcgtgatgtacgctcgcacagtcgctctgagatctccatcacntcacgtgtctcgaagacatatagtgacganttatacgaacgncgccgcttcgcacgctcatgtggtggcatantacgtcagcacacagctgatgtagcgcaccgttacatcagctgacgtancgtgatancgggctgacatanatcactgactagaccgcgtggcgtccagcatatgtcgacgngcagacagatgatgactaggcgactccagtgatagtgtattaatgatagacgtcaggctcggcgcgctgtgctcctgccatagtcgactgtatcngtgctcgcgagtccatgnctaacatcgtngacnctgtcactgcacngtcgagcgcgcttatngcagccacgctgcgagactactagagctgacgncgcgagcgcgacgcagagcncgcgtgcacacgtacaagctgacgtctnatcgatnactgcacagtcggacctcacgtatcgactcagacagntcatacttcatacgtctgcatactacgcgcagtcgnactacatcttcgtgtcacatccangtagtntcnagatgtagatatcatagnactgtacgtcctctgagtatgcacatcagatgcatcnagttacgtctantatctacgatatcgagtatacatctctntcgtcatagtctcttacactgcagttatagtacangtgactctacancttcatatgtgcagcgtatgtatgtgtctntgctccgncncngcatgtggaggacttacncgctcgtancgcgacagctgattcagacgcactcgtttacaacatgcttncgtctcgctcccatctctcgtgcgtcgtctctgatacg

SEQ ID NO: 13652 - DNA, 540 bp, Homo sapiens
  misc_feature (1)...(540): n = A,T,C or G
aaacagatgtgagggcagtgcctgggccggctgggccgtgcgctggggcgctgtgggggttccatgctgggccgcggggggggggggggagttactggtcgcgcgccccgccccgcgggtgggagctgggggggtcgcttcgggccggtggccccttacggacgtatttgtggagcggccatcggccgttttttttgtcgcgtcgtgtggcggggtcgcggactgttcgctcgggtttatttcccctgctggcggcttcgggcttttctggttgccggtttgccggcgccctgtctttgccgtttcggttcggtgtgcgtgtgattttctgcttttgcgtgcgtctggcatggcgttgcctctcgtgggcgggtggttgtgggtcgccttatgcctctcgcgtggggtccttctgagggtcggtctatcgcgctgnttgtatggcggcggagtgcggcgcgggtgtgcggagtgttgttacatgccgtcgcaccccttgggatcggtttgtcggctttcggtgttgataccgtgaggcga

SEQ ID NO: 13653 - DNA, 569 bp, Homo sapiens
  misc_feature (1)...(569): n = A,T,C or G
tnnaaaaaaaaatccncntccctaagaggccaaanggggaatatttnccacgnanntnnnnccccccatttnttttcccacntggcaanccccccnnacagttnagggtaaaatagaaaagatcccgcccatttgttttgnncccctgggtnccaaatnaactttcgtcctntgtgtcttcgaaccnagacctcaccccctgggaaganggcatggggcntgaaaaggcaccagccgcctctgtnaacaatggtntttgttnntcacactttccctatcaaagcctcacagcagggatggccttcagaggcgatgggcgatgtgataattcctgtgccagggctgaggaggggggcaggaaaggaggggtcaggtccaactntgacccagttagttactctggggtctgcggtcctgccctggtaagaataaactcttagcagaggctatgaanagcttgggcttantagctcatcntgtcttctgtgaantgttctcctgntatcttctgggagtagcaagtctggaaangatgttggtggacagggaatattaataacaataataat

SEQ ID NO: 13654 - DNA, 748 bp, Homo sapiens
tacagttatttgctacgcatcagagcttataacattataatgatttatactgtatgactctttatctactatctttctagtgtcgctttctgaggtatcagtattctttaattaggcctcatattattactctaatctagtccttacgtccatttttattctctcactcttctcgaacctcctctattgaactatagcttatcgcactcattttttctatataattttatcgtttcttcttttttttctattcttctccttcatttttcttaattttactctttttattttttttctaacatccttctttttttgttttcatataactttgttattctgtatcgtcattctcacgcacattccctcttagcccttaccctgtgtctactttctcaaatccgatatatatcctttatttcttctattcttcataatcttacccgtgttcactcttatagatttttataagttataagtatttgtacctccttcattctatatatttttctttttctcttaactttttatttacatgctatattcattttatcactctattccgttctcgtttcattttcattccagcgttttgttataatttgtattgtccgatatatcactaaattcttatcgtctttctacatttgcactatatgaatttgcccacatctattcatgtatcttgtgcttctcgtcttaatatatccgcaactagttattactacatagttgacttccttttctctat

SEQ ID NO: 13655 - DNA, 598 bp, Homo sapiens
  misc_feature (1)...(598): n = A,T,C or G
cttttttnttgaggnccaanatttagaagaaggccnnancccganatttctggccaantaaanttngnnngtaattngttttttaaagcattggtnaattttttngccctttnnatatnnaattttaagntaggggaggtttagcnaatgnntgttttcagggtttncnatccaaaatttttccgtttcaaatnggaaattntatatggcncctttaattcggcggtaacaaatactttcacagagaatacaaagttgaattatgggcagctcaattcatccccccaaaggcagacaagagatggcaggtcccaagntatgcctatattacacagtanaggattattttaagtgttttgttattgcttccaagttcacactaatgcttcttantaatttatattggtcacantcactattctnatttggactcattagtgactttgtactctcttaaaganaataaacctccagatnaactaaaacatttaaatatgaattgtacataggctttattcatttataaaatgcaaagaaattaagattaaaaggaaaaccacatcaaaacccagagncataaataaaatgcgatgcntta

SEQ ID NO: 13656 - DNA, 1221 bp, Homo sapiens
  misc_feature (1)...(1221): n = A,T,C or G
ggtgggtggaatgtggaaattaaatctattaataggaaagtatattaaccgataagtattatcagtagtagaaataggtggattggtatttgttggtctagataacagccatgtacctactttgtgttaagtctgatagggttgaatggattattgtgatatgaagcgattcggacaactaggtgagatcgcagttgaatttcgtggagagaagaggttgtagatctgccgttaatgtcgagatagttgattatgttgtgagctatctggattaggttttgagtcggaactaattagacccgttgggtgatacagctgaataaatgcgataaatgtgacaatggtacggtaatacggtagtgcgttgtgtggatatagtataatacgaggtatacgtatagataagtgtatagggcgcgtcaagttattgcagctgggaactcctgcagcttcttgagtgatttcgtgtgaatgttttagtgagtatgagtttctagagagatgtggtggaccgtgtatatggatgatgagtataagacgactgatatgattagtagtgtggatatagggtgcagctagaaattctactaatatcgtaatacgcaacagtattatggtgaggaagggtaagcgtcttttagacgccatgccaattgagataatgtttgattgattcatgatgatcgtatatgaggtagtgttaagtgaaatccacaccaaagttccattgaagtgggacgggtgtattttatatatagaatagtttaatacctgacgctgagacgtatacttatataaacacgataggaagacgaatgtgaatcagaggttagtgaagtaacggagtaagtaataatatagaagtatcgtcttgtatatcacaacgattgcatacgtttgttgtatcattacgtgtactagtgtaggtttgtagtgcatggtagtttagaatgtagtaatattgtcgtgtagtatcgatacgtatcatctttgcgattttacattatctagtgtggatgcgaagagttgcagtatgcgacgtataggtgtgcgctgtgtaagcggattgagataatcagggatgaatacaggcagaaagtccgactaaaaactagtgacatatgcagcagaatggaacgcgctgtaattgtatgatgagagcacgagcaagatatgagtgcactagataacagatattcaacgagatatgtatnaagtaat

SEQ ID NO: 13657 - DNA, 963 bp, Homo sapiens
  misc_feature (1)...(963): n = A,T,C or G
gcggacggaaggcccagacaacccagaaagaaaaagaggaatctttgtggacaccaaagganttacagggggaacgcgaggcgcgagcggaggaggaagaacagagagcgcacaaacgggggggaaggaaagaacacaacgggaggaggccgcgcccggcggagaacacagcgccgccaccaacagcacgcgggcgcgcgaaggggaacaagggaacacggagcgccgagaaagggagcgcgcggagagggacgacacccagacacaggaggcccaaagagcagcccacgcgcacgccgcgcgagccaggccgaaaggaggcaccgaccacccggagcgacgagcaccgcgacgccgcgcgacgcgagaagagcacggaagagaccgaacagaaagaaccagcgccgcgccggccaccggccgagacagccgccccggccggagcgagggggcgagggagggaggggcgggggcgcggaaagacacccagcggaacgaacgcacgcacgagagacggaagacgggggacaccgcagaccacgagcacggaggggcaggggcggcgcgacagcgaggaacgagcgtcagaccagagaccgacgaaagggcacgaatagaagacagaagcgaccacagagaagaagaaaaaagcaagagaagcgaaagcgggagggaggacaacgccaacacgaccgcacgcgcggcgcggcagcccgccgaacccagaagaggaaacagagccgccccgaagagagaagagagggcccgcgcgcaacgagagacaccacgacgacgaaacgacacaaggagaccaaaaaagcggcgcaagccgcggcgaggacgcaccaccgacacacgcccacggcgcaacgacgaagccgaagccgcgacgccgacggacagaacaaaagaggcccgcgcaaaccacagaccccggcaaccaccgcgagccgaagcatcaac

SEQ ID NO: 13658 - DNA, 1478 bp, Homo sapiens
  misc_feature (1)...(1478): n = A,T,C or G
agcagcgctgacgatgtacagagagangacagaggcggagagagagagattaagnaacanataggctcgcgatcgcgggtcacgaaacnaccaaggaccagacacgcatgaaggtaacgtgcgtcaccaccatatatacggtccttattngcactcgcgacagcaaagaactcctagagtgtccctacggcgcacagccctcgacagagactcgacacgatgccaagcaagacatgcccacgacttactcatgtatgcgggattctgtaggtgaagcaagcagtccagtgtagactgaggangagtggaggacgaatgaacagagacacatccaccacagacgnagcagagngagacacncnacacaagcacctcatctctcgtgtaatatatgtatgacgtgtctatcnacgccgtattcacacgcaacaagagcaatncncaccataagacggagtgtctgtccacaccacgcgactgggccttacatgtgtgacatgtagtacgagcatgngatcacacacaagtaccncaacgcagagcgcnacgaacgcgagttagacacagagaactctcgtcgccacacgtagttctagtcgcaagcgcngcagtatgtgagaggagcgcgatagctcgcacacagagacctanacatagcacacagggctatacattagatatagcgtgcgcgcatgtgagccagcttcgactaccacgcacgacgangagacacagtatcgcncgcggcagccgaggtacacgatactaatgtagaccncatcgacgcacactnctgcgtctcctagcgtaccagtcgcatancaggagtatatcnacgctcgacgacatacatagacgagtncgacacgnctntctcacgtcgcacagtaaacnatagcagtaggagagangatgaggntacagggatagatgtacganagtacgtancnacagagtgcaagtatatataagcacacgatgcgcgagagngnanantagaaagctgcgcacgagcctcagagtatagtgcantgacacgcagcgacacgncangtagcagtagcagctatgacgcgtctnctcanancacagtagtcnacggagagtacagcgatncacgaagangctangacgcaggngacatcacgtgcagtacgatcggacagacangtacagacgctntgatcgcagcgcncagtcacgcgcagaagctcgtcgcgagaccatgagacaggagacgagtacgacantagcntggcagcgaaagncgacgcngcacgntcgncgtcagatcgatacgtagatgnntantgagagaactacgnatngacgcaatatgcagcagctcgacgcnanncatagtatatacgatacatctacntagncagantcgactgggctcatcgccacgctcgaagtgcacgcaaacgaagtatgantgtcanagtactgcagatgacagtctcaatangaagagg

SEQ ID NO: 13659 - DNA, 427 bp, Homo sapiens
  misc_feature (1)...(427): n = A,T,C or G
agaagggtgttgaanaagaagttttaaaagtgggaacaagagcttttagccattaaataatgatgattgttacatgactattgaatgatttactttttattaaaatctgtattaaaatttctggaacttaaattttaatttcttagtgacagatgaagaaattgaggcatcagaaagataattgagttaccaaagtggacacagctagaaagtaagatcatctagtcctgctttctcttcctcaaagcccagtctggtaactgctgcatggctttatctgcacctgatgaatataaatctcagttttttattcttaaaggttgaatattgagatatcttaagcacaccattttatgtctgggaagaacaataaacgcaagctttaaactaatttgatgcttcagaatgataaaggaatggagcaaat

SEQ ID NO: 13660 - DNA, 1622 bp, Homo sapiens
  misc_feature (1)...(1622): n = A,T,C or G
cgcgctgcgcgcnagtcagcagtcgactactgaccaccagtacagtcgcgatacacgcnactctctcatgcaccgcagcgtcagacgcagtacagcacacnatcgcgtccgacttactttttctctgatagcgcgcggtgtacactcagtctcagtatatctgcntnacacaccacagattttttcngctcggagngaatgacngcgcgactcnactgcatcgctgtgcgtagctgcngctatgcangcactagacgagaatgacaatcgacgctcntanagcacacgcgacgtacgacgacagtcgaatagctcgcgtggcgtctgcagnantgccgnaccgatagtcgcgactgatacagtacatgtagagtcgctagcgacgctcagagtgtagactgcgnaggtgcgcagcnctagacgtgcatattagcgtacagtgggtccgtatgacacgtcgacgacgctctcacgctagcacgcgttctancatcgccgtacgcgcacgaggcaggcgcnagcgccacagagtgcgaccatgcgacataacaccacgcctcgagcacctgttagacgcgccgcanggccgctngagcgacggtctgccctanaaactccaaagcgtgcattatgtagtgctccgantcggagtacgtagtgcgtgtagttgtcgaatgacgaacgcganacgcgactacgatcatagtctgtcatgtatacgtgattacgtgagtacagacagtgcacgtgactatactgcaggctctgcgagcgcacgtacacgatggtcgagtgacacaccgcggagcatgtccgcgacgtcgtaacttatcgaagtccacatcntcacggcgagtgtctgtcgcggatcagatactactcggcagcgactcatagctgtgttagtgttcgacgcgtacagcttacactcaggtcaatcacgagacgagagatccgtagttagcgtcgaggttgaggataggtgcggcgtgttgcttcgttcgtagatcatccgtgcgatatatcggcagtccancaacacgagcttagagagtcctgggcataggaggtggtgtgacgatctagacatgacacgaacatcgtctgtgtgtgagtagggtgccgaggtagcgtgtgacttatctgaagtgtgattcagactcctaagagggcctgatggaggacgttccgcgttttatgcggcaggagtgcgattaggaattcgtgttgntacngtctcagtctctctcactctatacgtccatactactggtgtgcagacacgtttatactgaactccgcgtcgtcgtccgctgcgtgtatacgtctctatacagcggtacgtgagctgaccaataatagatgatctgggtaagttgacaaggcgcgagctcggcggcagggagggataagacactgcgagatgtaaggctcgaccagtgagaaaggaatcgaatgtacgctcagtgttccgtcccgtagtactaatacgctagtcatgacattggtcttgagctaaggagcagcggcagagcatggttgatccagagcgtaatctctgttgtgacctaccaactgttctacatatcatatacttctcgcgagaacgcatgtattgtagt

SEQ ID NO: 13661 - DNA, 535 bp, Homo sapiens
  misc_feature (1)...(535): n = A,T,C or G
aaaaaaanttgcaaaagnccaggttccaaaaccnantnanggccccnaggnancangnataatangtncaaggccangcaaaagagcttgtccattntaagcaaaccacanccttttacttaccaaatgtgcaaaatccacacattcaccctcagccctacaactcccctaattcaaccgtctgacccacttcacacgatgcaagcatttctatttttccgctttgtagattacgctattaatgtttcttctgattatttcctcaacacaggttctatcggagccaagatttgaccatggcaatgaagctgtacccgtgtggctctgcaagataacccacctctctaagtgaacataggcaggggctctcctgaggacagacgataagtgttctgtttcctgggccatgtttcaaggttttgtgttagcgatgggatttcctctgttattttggtcttctactcaagaaatacaaaggctttttgttcataaaactatctaaggccattttcacaatccctaaatcgataaaaat

SEQ ID NO: 13662 - DNA, 568 bp, Homo sapiens
  misc_feature (1)...(568): n = A,T,C or G
ccaggaaagaagggcccggaagcccttcccttccccnnaaacctcnaaattcttggntcaangcaatcntccccnccntnagcntcttgagtagntggantanaggcatgccccaccacattcgggtaaattttaaaatttttttgtagagacagggtctcantatgttgtncaggctgctcttgaaatcctgggataaagtgatcctcctgcctnagcctcctgagtagntgggttagatcntggcaaatgaaagggcccccagctttgaactacctttggggaagatctcactgtgttccctttggggattgaagatgtggttcaagagagaanagtgcactctaggcaaacctgctaattctgttcctcaaaagaaggcagggagaggagagaaaatgcatttctgtttgctgcctaaaggtttatttgcttgtattcctttgggaaatggaatgattctgtgtgcctgggttatagttgatggaataaagcatcattttatgcgtgtacctgagaaataatatcgtgaacctacataaaaataataaagtgcgatacntccgcc

SEQ ID NO: 13663 - DNA, 837 bp, Homo sapiens
  misc_feature (1)...(837): n = A,T,C or G
tttaccnnccccnnttgcanngaaaatacnttancaantttttttttatgatcnnnngntngaccaagataanacccccctttctctaaantggagatagaacanaanaacngggnnccccccnaatatanagggggnattntcttntcaagggaaaaatacantntncnattaatgtggaccangtntttttanaaaccagnantggtntgnaaatgtgttnagatttggttctntccnacccaaanggantggaagntaaggcaagantnttaaancttggtgcctctccaagtatttaatttgttcttncaaaatnttttantcaacgtgnccctaacntctttgaattgatcaggtgtanaatcagannnggngttcattcatagcctnactccaatngncctggggctgtgnatacncagantataccntacttaagataccatgcctgttctntttgtctacacattaaataaaggaagnggnttaattccattanaactgttcccaatntaagctcaacaatntgccttcagcttgcntagattntaggtgtgcnttttttggcttaaaaagagtncnaaaaaaaaattgaacanatngagactttnncgacngncaccacggtggancttaaannttttantnnnnttnagtgatgnntaatangnngntggagatnaatcaacncncntnannnaaannannnananntnnananacngnatnnnntatnanttanacnnnnntannnanannnnnnntgnnnnnntanaanantnaantttantananantnaaanncantnnntganantnannantntanannna

SEQ ID NO: 13664 - DNA, 170 bp, Homo sapiens
  misc_feature (1)...(170): n = A,T,C or G
aaacngcaagggtttttccccaagtcacgngnggttgntaaaaaanacgggccnaggngaatttgtnaanaacgacctcccnaaaagggggaatttggggancgggnccccccccnttnnaggttcnncggnaatcganaagcttcatatgncnaataaaggccctttca

SEQ ID NO: 13665 - DNA, 798 bp, Homo sapiens
  misc_feature (1)...(798): n = A,T,C or G
tttttgcattagaattgggagaaagacaagagaaggaggaaatctaacgaaaccaaaggacacaggctcctaattgaacaccaggctaaattgcctgcaacatttcagttgtgctgtgtctccccattgccatgttgaatctgtgtcttgaggacccaacaaaatcaagggtagagaagatcttagttgtttcaactaagagagaaggcacagtatcctcatcaaagaggtctgtaatgatgctgttatttaaagctgccagtgcaatgatggcttccggtttaaaccattggtgaatgcagccacaagacccactcctttctgcaagcagcttctctcacacaaggtatcaatgaagtcaaggcatccattccttcaacatgctttactacatgtacagaaaccacagcaagtcaagattgttcacagttgaaagaggtttctggaggtgtgtgaaccatctgaacttcatcctctttcttcaagtggccttcaagatttgtgcccactgaacgaatgctatggaaactgccaacagatgaccatctggtcacgatgttcaaaggctcaacctangcaacattgaaaattaccaaaactaaggcaaagggagactcttgttctacagtgaagttcgctcaatgaaaccacagaatgtgtgagcaaaggctgatcattaagtgatacggaatcatggaatctaaatatgttcactccacttggatttgagctggcctggggatttgcatcaactactagaatggggcagcagcaatggtgtgccaacttcaagctaac

SEQ ID NO: 13666 - DNA, 455 bp, Homo sapiens
gctaggaagtcaaactactatcagattgttgtcgtgtctggcactacagcaagagcaatgagttgcacaaaccatgaagcaaacagactgttcattcatccagcacgtcctggcctagagctagaaatacagcagcgaacaggagcgatcagagtccagactggactctgaaaagaggatctccttgccccaggtgctgtgcagtatggccccagttctagctttctctggcctagacaatgcctaatggagccctgcaaagattcacttcactgacttttttaaaaatatttttatataacataaaattttcactttaaccattttaagtgtacacttcaatggctttaaattcaaaatgttgtgtaaccatgaccactatttccaaaagatttttgtcatcccaaacagaaactctgaacaagtttgctttttaaaagtgaaaaaaaaaaaaa

SEQ ID NO: 13667 - DNA, 898 bp, Homo sapiens
  misc_feature (1)...(898): n = A,T,C or G
gacgactggtacacacctgttcctagatctccttgcatataaacaaaaaaacctgaggagtaaacananagtaggntnctgcacagaacacggacggaaagatgccatcgtgatgacaaaagctgattctaaagtattgcctggataaggctcatgatggcactgattgctgacagctaccagaagtatgacgacttgtctgggaatagagacatttcaccatggagaccactggcaagggctctgagtgagccactgaagacggatgaggtgctggaagatgcctactttgatcctctgaaagggaaagcacgtttggatgcctcatactttctgcaggacaggcttagcaatctaccggctttgtaactgcctgtggagatgtgctgctactgttccacctccatactctgtgttcctcgtgagaaagccacaaaattggcagaccatctttttcatatgacctgatgtggctgatccctggaatgccatggagctcttctaagagggattatcggggaccactgagattttgcttactgactttatgaacttctaaaatggaaggatgcacctggttcccatgctcatttgtggcccccaatattctcaagattcatttgctaatactgccacttttcttttcctcacatgtgtgtatgtgttacaaaaatgcgaacaacccattccttctttttaaggttcctaccaatgattcttcctatgaactctaatgggattctcatgtgactccctcttgtactcgcttttttaatgtttgcattccgtttactctttagcgtctacctttcaccgacgcttcttttcttaattggcatggttcctttttcctttgaggttatttgtttaatttcctttactctctttaatagagcaa

SEQ ID NO: 13668 - DNA, 1954 bp, Homo sapiens
  misc_feature (1)...(1954): n = A,T,C or G
agtaaggaataaagaggtatgnnnagngnnnnangnanangnaggagnnnnnnnnggagaggaaagannnnnaaggaagagnnnnnnaaggaagnagtangnnnaaannagtnnnnnnnnnnangagnnnnnnnnnnnanagggngncnnnnannnnnnnannannaggnnnnnaagaangnnnnnnnagnagatatcngnnnnaannatgtaantgnnnangaatngtatnnngaatgtannagagacaggagngaaatagtgcngtatagngtggnanagagagtaagtannnantatngaaagagtggatancacagataagagangaatgtggagtagcgngatgaangacaacanagacnanataatagtatgatactagtatagtgttgtcgcgtgatactgtgtctgtctggatgtagcgtagtctctaagctgcggtgtgtctgctgctncngtcagctctcgacgtgatattgtctccncacctgcttatanggtcgtctncaatcgtgcgtattgtcacctagactagacnntgtgcacgagtcagagganctagctatgggcgatgatcnctatactcatcgtctcttctctcacacttccacactatatgtccatgatgcgtcagcgacgctgtggcnttcgcgtgccngtntcgagatggcgnntgcgttgtctgtgangtacgccgtangnntaatcagancaggcgnggtctcgtctgngcanctctcgtacgtgtagcttagaggatgtaagcagnctgtgtgtgtatacagcccatcgtatgggtgtnntacggatgctggcatgatatnanataattatnancgtcntcgantgatgatcantttgcagcagatanaantangccgatgatgtgtcgacacatccgagtgcgcgtctcgtacnnncacaggcactgcgcncgtcnatactgagtcacganctcntccatcacacatcttcgacatggtgtctnatagcgctntntctgttcacttgcatgnccgccntacagtcgaatatatctgcancaccnacacgagaagctagtacatnctnnnnacctaccgcgcggncnaccctacactgacgacccacagagcgcgcntatantgangagagcatanctgcgcctacacgcgcctcacatatgcgctctgtgctgccgctttcgcttnccntctatncactantntcatattcgatatatatactagtactgcaatnttacgagattnantgtatacngtancntagtgacgagagttaactgagtntaangtgtgnattgacatatatacnacgataaggcacacgtatgntataaatngtgtngcgtgtgtagtaggctancatnccaatagagaatggtntgtgtagagtatatgaagtatgacacactgctgtattgtggtacgcgtcgacgcgtcgatangcgngatagtgtacacanatgtactattntgcntaacngtctatgtncgagtgccncgaatgtgtgttagtgagcgagagtatatacggtgagncncnnctactatcattattcattaatgctagtagtagagtaagtacngtagcactagccgactcntgacgatcgnacaatangaatcgagtgtatcagtcncnacgctactattcgcttctcnncncnctcatgtgtntgtctgtgtatcagactgctantnagagatcttcngtgatatgtagtgcncagagatgcgagatgtagtgtcnncgagacgtgcgagcgagncgcagagtcgatgtatgatnntatatgtgcgcgagatgatgtactgctcttngtccgtcgcatgttgccnntcatctgatactatactatactctctgagtgtantccctgttgtatgtacgtcgcgctatgtatcannttccgatagtgttccactgacttagtaagtaattgatagag

SEQ ID NO: 13669 - DNA, 1204 bp, Homo sapiens
  misc_feature (1)...(1204): n = A,T,C or G
cggtggtgtgcctgcgcctcggtggtcgtgctatttcgtcatccggggtggtggtctgcgcgcgcgcttgcgtgtgtgctctcctctgtcgtgtgtgtgcgcggggccccggtgaggtgtggggcactggtcgggcgctactcggcttccgtgtgtgtgctctcggttgctgttctctgcggcggcggttctagtcgccgtccgctgtgtcgtccttctcgctctcgcnggcggtggttacgcggtgtgctggctgtgtgggctcgcgccgcgtcacttcgccgcggcgngcgcggcgcggtcgtcngcttggtccctggcgccgtgcgcctcctctcgtggtgtgttgtgccgctntcgtccgcgagtcgcgcggtgagctcgtggtgcgcgtctcgtagctgctgtctctcgtctctgttcgtcattgcggagtggtgctcggctgggctcgtatgccgctatctgcgcgcttgctgggttcgcgcttgtgtgttgttcggngcttgcgctctggtacgtgcttctgngcgttcctctgcgttctctatttcgctcgtctcgcgctgtctgttgcctgtcgccgctcttccgttcggtcctctcgcgtcgtgttctcttctgctgttgcggtctctacctggcggtcccgccgcgtgcttgcgccgtgcctccgtgttctcggccntcgtccgctctccgcttgcttgtgtcgctcgtctctgctcccttgcgtctggatctggtgtgcctgttctcgctcttggtctgtcgttgtgggtcgcgcgtctggctgggctgtacagggtgtcgttgcttgcggtggctggctgctcggttgggggcctctctcgttgttccttcgtcgttttgtctctcctgtcgtaggtctcgtgtcgtgctgtcgtgtgctcctgtgtgttcgggggtggcgctcccgcgcgctggtttgcgcgcgccgcctccgctgtcgggtgttgtctgctttcttgtgtggtgttggctgcctcgggctgttgcgtcggcggggcggcgcttgggtcgttgtgccggctgtgctgcgtttcgtgtcggttggctggttgcgtttgaagggtggtggcgccgcgtgtctcggccctttgaaccgtgtgtgtcgcttgtgttgtgtcttctgcggtcctttgcgggtgcgcgtgcctgctcgttctantctgttgtccta

SEQ ID NO: 13670 - DNA, 1680 bp, Homo sapiens
  misc_feature (1)...(1680): n = A,T,C or G
antcgtatctatatgttgaatgaatgtatataattagtgtattatcacgactagtcagagacgcgaggctgatttgtgtgtcgtattgtgatatntactgagactgagtaagtatacngggtggatctattgtggacagcttatcatgacatagatactgtctgcgtctgaccagctgtatagcgcgcacgctcggcggtgaagcgatctntccgngatactcgcacgctctgctggtatctatatcctatagtcgtcgcgtgcctcggcagatatgtcagtgacgcacgcgccagtcgcgccgcgtgatgtgtgttgcagacgtgtcttggaatgctgtctgcttgaagtagcgcggtgtcgcactcgcgcgttacataanttactacaccagtctacagtatcggtactaatcgtactgagcaatactatgtatgtctgttgagtcctcgctcgatactgattatctaantccacgcactcgaactcacatgacgcatcatcgtntgtcgaggtgcngtgagtgattaaagcaatacgtcatcgctctgaacncaaacgtagcttgcgtgtcttanccctctnctcattcatnctactctcactctcgcgctgcgcaacgancnanatatngcgactccattgtacacaatacgaaccacttatcccacaccgctctacgctctcgtctacgctacgttangtnatgatgtattctgctgantgcgacggcggtggcgcagtgtcagagtgnagataactacttatgtctntatatcntntgattagttgacgatcgtactgacgatcggctacgtcttcttgcgcgttagtagcactcggtaactacacactctatgntngcggtgtcgaacacacagaacgcgtgtgctcagaccatacgtgcgagcnccgatagattgtacgaacatacntatagtacgcaagcgcatcgcgcaatanggnagcgccttcattcgtcattctgacatcgcgctctctctnctactggcggcgcgtgcctncgcgattctcctnctgtggattgaggaggatcggtggnngngagagagagagacacaacttaaaggtatntganatnatgtnatcgatatgagtgctcagggacagacaaagacggcagnagagcagccatcggtcncggtgctgtgagagtaggtcgagtactaacatatactcncgttgcgatcacggcgctgtcantcgtggctctttctctgngcgtcatngtgantataaactctcctcatcactctacactgcacgaggacggaacgcaatgcgagtgcgcgtgtgtgtagtgaacagacgncgaatgtcgctggtgtcgctgagataactcataaattagtagtacgtacgaacttagcacagatctnntcgtcacttcatacacgcacacatgcaggtccgcctactgcgcgggtgcgcgtcgccgctgtcgcgcgcgtgcgcgggcgnntcttcactctantggtcctgctgtgctgtgccncgcncaaggngagcgtctgtctgtntgatgcttgttctgtcccgtntcgtgagggcgcgtcacctctngcnctcgtcatcttagtgtgacgtgccacgcccgcgcagtagtcgcgcacnccctcctcncttctatnctccctctcctnttctctgttncctctc

SEQ ID NO: 13671 - DNA, 790 bp, Homo sapiens
taggaactccaggccagtctcaggccttcactctgactgtgtcttccttaaagcgtggtgtgaatccacagataccagaatcagctgggcagctctctgacaatgcaatttactgggccctatttcaagcaaacaaagtcaaaaccttctctctggaattcagaaatctgcattcatgacgatcttccccaataattactatgaaaaaaaacgaaacgttgagcattcctgcttcagagcagaggtcagatggctgcctgcattctgtggccttcaaggcacatgtttacagatgaacattttcaatcaatttgatgagagggagcgctcactttacaacctaatgaagtgaaatgttatagcctgaaaaaaattattccattcttctcactaatagacctgtattgtaaaagacactgtactcgattatgatatcttgaagttgttcaacaaaattactgtagaaatttatttttgtattgttatataaatacacacagaatatccttgattttgcctctttcttgtaaaggctgaaatgtttactatctgggcttttacagaaaaatttgtcaaggcctgcttgaaagcttaatatcttaatacagtaaatctgtgacaatcaaggcttgaaaaatatatcttatccacattgtaaaatgtttaaaatctgtggtcttgtaggtatacatagttcacttcattccccttaaagaaaaaaacaacacctgtcatttttctcctctggcctctagagcagaggtttgggtgagtctgaagacataataca

SEQ ID NO: 13672 - DNA, 733 bp, Homo sapiens
caaaaaaattgattatcgccattgtaaaagtttaaaatgtgaggttctgataggtaaacaaagttgacttcattcccctagagaaaaaaacaactcctgtcagttttctcctctggcctttagacaagaggtttgggtaagtctaaggacataatacagagcagaagagggaaccttaattcaggctatgctaggtccaacaaagagatgaaagccagtccccaaaaatctcactttgaatattctaataattcaaaaaaagactcagcatttatacaaatattttgaagaaagttgcaattgaagaatatgcaaatgcaaatgactttattttccaacaagtaaaaacaagcttgagaaactttgaaaggtagatacctgtggggaaatctaccctatgaccagggcttttcttcataatcagaagacttgattttgattctggaaaaatggtacctactgaagaaggattttaatgtccaaaacgtgacttgttttttaaaagatgcatgtttagtactgtcttcgttgtttttaaacaatatgtaatctgtgatatttgcattgatttccatcaccttcccccacttcctgtgagaacttgatctccagggccttggttttgctaatcaatgcatttttcttttgtttgtttgtattttttatttcttgttggctagagttaattgttgaaaataaaagtcaattctgctcttccaaaaaaaaaaaaaaa

SEQ ID NO: 13673 - DNA, 550 bp, Homo sapiens
ctagtttaaaggacaaaacggaactgggctgctgctgtttcaagaacgagactgctaccacaccagggaaagagtgaggcgggaatgagaaaaacatcacaaaactctctgaccattttgaagatggccttttcttgactgggcatctgtttggttgatgtaaacctttgactctttcccaaagctctgacaaagctagttgcggcagttttggcttttaatggtttctgtaggggaatgagcagttggagcttcctagtctatcactttgctaacatcaccctacccctagttcttttatgttatttcactgtgtttattagcaattttggatcttcttctaatgtagtggtcttttgaacctaagtgcagaaatctacaaattaactcatattaattagtctattggattttcctcactgtagctttcggatgatctcatccaacatgttctatatctccacaagcttcctatcagctacatccagtaagcaaaccttccactgttctctaattctctaagttttaaaagaatagcataatcaagcgt

SEQ ID NO: 13674 - DNA, 798 bp, Homo sapiens
  misc_feature (1)...(798): n = A,T,C or G
atggttccctgaaccgcgaacggaccttgtgccgggtgggggtagtcccatccacctgtgtgcgcggcactcggtggctggatctgtgggtcggcgacggtgtgttgcgcactcgcctcgtcattacacgggtctgtcatacccgcgggtccaatttctcgatatctcaatgcgtttcctgggggcaatcggcggggatgagatacctcgtcgcttctctggcatggcgtgctacattgcgcggcccgcccccgtcatttgcgttctcctccccccatctggttgcccgtgtttctttgcacttttgcccggttggcctactgtggggtgtgtgagcgtggcttgtaataatgtgtgatggcgcgcaagcggcgtattcaggcgtgtcgctctcttgttctttctcgtgttctttcccgttagtgtaccgcatcgtacgtcccgtgcgcggatgggtggcctttgggtgccgtgctggtggttcgaagtcctaccttcatccatggtggcgcggtcgcttgctcatggattgtgagtcgccctgtgatctacgtctggttccgtcgacgttgtcggacctggaacttctcatgtctctttgcagggtcgcgggtttcgcgcccccttccgttctgttgttaaagatncctggttccttcctcgacggtctgctcgtaggtcgtgctcgctccttggcttgcttttactgtgtaccgttctgtaaattctagtatccggtggctgtctggttgcgtataacgcaagacactacgattgataacctaaagacacatacac

SEQ ID NO: 13675 - DNA, 770 bp, Homo sapiens
ctggctatcaagctccaaatagtgatgcaaatgaaaccacacatggatgcacctttcttccaaggactcttagactggcctcagtaggaaccctaccagctgttccccacacaatccccctctccagtagaaagtagctagaaggatcatctccccatttccctaacagcagttatggtcttcactcctgaggagggggaatgagagaggagaaaggaagaaactggtgaggcaggcagttagggtggattctcagttaaattctttcaaacaaaagaactgcccaaaaaacgaagctgcacagccattgcagtacattcagctccatagagacagtgccggggcaagtgagagccagatgggctctcacttgcatttttttgtgcaaacttgtctggagaagcataagagaagcatccagatgcttcagtcaacttctcagagttttctaagaagtgctcagagaggtggaagaccatgtctgctaaacagaaaggaaaatttgaagatatggcaaaggtggacaacgcccattatgaaagagagatgaaaacctacatccctcctaaaggggagataaaaaaagaggttcaagtatcccaatgcacccaagaggctttctttgacccttttcctgttctgctctgagtatcgccaaaaatgaaaggagaacatcctggcctgtccattggggatgctgcaagaaactggaagagatgtgggatgacattggtgcagatggcaagcagccttctgaaaagaaggctcca

SEQ ID NO: 13676 - DNA, 804 bp, Homo sapiens
  misc_feature (1)...(804): n = A,T,C or G
agattcgcatcctggagaaccattggagagagtagagaaaatgccacggatgaaatatccctgccgctcanactccacggacccgagtgaagttggccacggtctaacaagtgggatactgcagcggggttctggttctgagacagatctggtgaatggtgctcgaagtgatcggctgttgaccaggtgtggcttctctgttgatgttccaaggacctcatcagcagaggaagaggcgttattactaaccatctttggcaggatgaccttttgttgttgtcgttcaaccaggtctcctttattactctgcaatctctcccttttgttccctttccacctaaaactcggatgtctctgccaccgataagcacccagtggctttcccagattggaaacagcagaatcatttttcttcctcttgcttttcactggaccacaccatggataactctntaaacttgttcctatctctgaatctgcataagcaggtttccgacaaagatcttcgatagcttggaggacaaggtgatgtttggttcttaaagatgctcatcttccctgactccagtccttancagtctctttaaactttaagattcctctactctgcagtctttgcagttgaaccacacttggctgggcagtccaaacatttgactggttaagcacgtttctttgtggggtttccaaccacagcagatggtgctggttaagagctgggggcatgttattaccgccttttccaaaatctcaaaacttcaacaggacctaaaaacccttggcctgaaccaagtttctcagaat

SEQ ID NO: 13677 - DNA, 739 bp, Homo sapiens
catgcaggatcttcaggaatcaaattactcaaggggatatgatactctcccgaagaagaaaaaaagccgtggcgactgtggggagtgacagttttttcataagagtctttatggcttgcctttcagaagtttaatttctagcaaatcaaagctatttatagtacgtctttcagaattaatactgtttttaacccaataggtaaaattcaaatgggtcctgtaataggagaaaaaaagccaaaagaaaagccaacaccactttttagtgtaaatatattaccctatgaagaatttaaaaagcataaataggaagaaaaagagcagaggcagagggtatttgctataaccttcagcaaaggaaaaggaaaatcttgaggcaagatcttgtggcaactggaacataggaatgtacatacttaaaaaatttctggaagaagaaagtttgctatataaatccaattgggataagttggctggaaaaatattccctatctgtttaaccaaagaaattcctttattcctctttgtgctccttacaactttaaaaaagagctgactacttaaaatttgttaaagcaagtaccttatactgaaccaagatcatgaatgccaagttttcgctggttaagttcttttcaactgcctgctcataaacccctgaagataggggtttcaaatggaaagcctcacagacttcagactaccaataaaacagatataacagtgaaaaaaaaaaaaa

SEQ ID NO: 13678 - DNA, 851 bp, Homo sapiens
  misc_feature (1)...(851): n = A,T,C or G
tagatgcttaaggtgggaagagaagctggaagcctagaattatttcaactcaatcaccagccattcactgactttttaccgtgtataaatcctgatcaacctcaaaaagagtaatattaagtttgattcttacactttttaaaaaaaatatatccaagatacaactatcaaaagatggcccagaatcaactgccagattaactatatggcccatagataatgatagaggagggaacttaaaaaactactttcttgtgcaaaaattacacctgtcacaaaataaagataaagtggagcactagaatttatggggcattaaaatagctcattattttctacagcctaaaggttttttttttattttttccgaaagataaaagaaagtgaacatgtaagggttaatcaagaacctgaacaaacattcaacagacagtattctntataaacttcaaagttcaaaagaatattgtttttgctaagtagtaaggggagaaaataagaattccagttaaacaaagaataaaagatagcctgcaagttaaggagtaaacatacccgagggaaccaagagnattaagcttctttcaaatttggcttcccaaggttttcattttttcggaaaatattaatggaaggtcaaggaaattaatatttttgaccatggtaaaaattacttttctttttaaaaagcttgaatttgagggccgagaatctctggaaatttaccagtcccacacctggaaaattagttaccactttaagcgcagaacttattgggttctcaggagaaaaaggcaagataataatggcagccctacctttgaggggcgttctcccaatggggattctgg

SEQ ID NO: 13679 - DNA, 715 bp, Homo sapiens
cttcgagataaacttgcaagggttttcacttttggggaaatataaaaaagattgaactacaataagatgtgtgacagggcgataagacttttcttatcaagagctgatagtgaggcctgatttctttggagtttaacagtccgcacctggaaatgaggtgaatacttagaccaaacactaatggctcttaggagaaaatgcggataataatgcaacctacctctagagggttttttacaattggaattaagttatagaggttccagacatcactccgaggtaacacttgttttgaaaggtggtatacaggtattaagataacttttgtttggagagactcatgcctgacttgcttttccaaatgacaaatgagtcttcattgatcttcaggcataatttggtatttccaagtcttttttttctttctttttgaaaaaataccaattgggaactaggtatttccaaatcttaactggggttatttaccatctctggtgccacccaagctgtgagctccttgtgtgcccattgtgcccagcagcagacacaaagtcaggcatagaagcaggcgacgaggaaatgtgtgctgctttgaattgatcctctcttttagttcccaatgatgtttagaaaatctcagtacaggatgaagctgacaataataaaaatgcatttggcaaaaaaaaaaaaaaaaaaccaaaaaaaaaaaaaaaaa

SEQ ID NO: 13680 - DNA, 779 bp, Homo sapiens
ggtcttgctcgttccaggctggtccggaactgctggtctcaaacaattccccctcctcaccttcgaaatgctgggattgttgggtctccctctaatgtccaggctggagtgcagtggcacaatcatagctgactacaactttgaactccttggctcaagagatcctcctgtttcagcctcccaaagtgctgggagtacatgagagagccatcatgcttggggcgttttattttatttaatatgattaagtggttataattttgtaaatgtatctattcaaccttagacataaggtcataagaaactgtatttagaggtaccttatattaattaaacttttgtctaaaattaatactgccagttataagaagatagctgattacttattattacatattgtatataatatagccaattatgcggggaggtaatgtttgctggtttagaaatgtgatgacagtatcaccttatttcatgtacctttaatatgtaatttgacttttattggttaaactcaaattattaaaatttgctcaattgaaaacgcacaagagcaacactcatgtattgatgcgtggaaaggccgtgttcgaagggctgggcttgggctcgcgccgcactgcgcgtgggcttgcccagctaggccgggcccggcgcgtcttcgcgggggcccttttcgcgccctcctggggggggggggccggggtcgcccggggggccggacgcgggggccggggactgtagtgtgagaaggggtaagagagtaggagggagggtag

SEQ ID NO: 13681 - DNA, 750 bp, Homo sapiens
gggatataatcaccaaaaagtttataaaaattttttcctttaggcttttcaacatttcccagtggtaagcataaataacttaaaatgacaaaacaactctaatatgtccttttaagttaagaaaaaaaacattttggagggtgtttctgtgtttctataattcatctgactctcagaaaagagaggtatttttgaaacaatcccttataggctgggcactgatgtggggtaacaaagcctatagtgtcttgtcttgccaagtattctctttctgtcatacaaagagccaatgttttatataagatcatatttttatagttttctaaagaaatttttaagagaaagaatatgttttcattttgtctttttttaatggagctgtacaaaattggcttcagagccacctttcataaacatgtagtgttatgggccgaatatttgcgtgtacccaaacttcctgtgttgaaatcctaaccccaaagttgatggtattaggagacagggcctttgggaggtaattagtcataagggtggagccctcctgaatgggattagtgcccttatgaaaaagacccggaagagctctcacacttctttccaccatgtgaagatacaagaagtcgcagtctgcaacccagaagaaggccttcaccagaactggccatgctggcatcctgatctcagattccagcctccaggactgtgagaaataaattcctgttgtttataaaccaaaaaaaaaaaaaaaaa

SEQ ID NO: 13682 - DNA, 801 bp, Homo sapiens
cgcctgagggaggagcagctccacctgtccttgctggtgtccagcggctggagaacaatgcagcttgcgacgtggtgcccgtggtgagaaggaagcttggggcgcctgccctggagggggtgcagcagatgcccggattccctgagggcagcttgagaaggatcctcactcaaggggtggacctggtgccggccagcccccagctctggaggacctccgcgggctacctgctcacgaggctgctgggggagctgggctccctgcagggtcatcccctggacagcctctccatcctcgacctgttcaaccactaagagctgggcgtgactgtggccagactggacgggctgaccttttcggccacctcaaaatcgggctgctctgcgccctctgccctctcccccgccgcccacgccctggctccacctgcccgccccccccccccaccactgccagccgcgcctccccctctccgcctggaccaacctcatatccaccccccttctcccaaccacacacgaacctggctccacggcgactccgcctcaccccccggtccccgacgtactcccctaccgcctcaccacacccccttatactgcgcctctcgcgtctcccaacccacccccgctctccgcttctcctcactcatcttatcttccctccttcctctagctctttcgacctttaagcctcgccccctcccccccctcctccacatcaccacttaccacctcctaacaaactgttttctcgcgccatcgtcgtcggagcttgtcctactgctgtgctgatattgtt

SEQ ID NO: 13683 - DNA, 732 bp, Homo sapiens
agtcgactgcttaaaggaagcgacgagccatggggctattaccatagcgtgaagatattttcaactaggtcagtgcgcatgagcgcattctaaccacccacatgggccgaagcccgcctccaagaatcggttcatggcatcaaaacgctccatcagtgaccaagccagtaacccccctgtatgggccgtcagccataatacaacgtcctgtggtacaaggtccaggtttttcccatctaggataaggaccggatctctgccatgcagagcatcttccagaagaccagtaatctggaaggctaggagagctaagctgggccacctggtttcagccacctgttcttggctccccaacagaatatgcaatgcaccataggaggctcctgggatgtttggaaaaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctacactgtatgccattccttggtgacaaaatgctgtgtatttggttttgaaaaaatgaatgtgctgggtatacacagcaaagaaaaaaaaaaaaaaaa

SEQ ID NO: 13684 - DNA, 721 bp, Homo sapiens
tggttcttttggttcgttttagttaccactccattcgcaagcggaacaggctcgaaggcgatggccacacgttatcaaacctgtccgcgagcatacatgaccgtggaggcagaacacgacccccgataggcgccaggtctcttgcgagcaatcccatcacccgtaccaattagctttgcctctactctcccatgtgaggtccagccttcgcgtgggactccggccggtggaggtttctcctaaatccattcatcgtgccgaaacactgttctcaatagcaaagacatggaatctcctaaatgcccatcaatggtaggctggataaagaaaatgtggtacatacacaccacggacaaccatgcagccataaaaaagaatgagatcatgtcttttgcagagacatggatggagctggaggccatcatccttagcaaactagcacaggaagagaaaattaaattctgcatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgggtgatgaaatcatctgtacagcaagccccatgacacaagtttacctatgtaacaaacctgcacatgtacccctgaactgaaagtaaaagttaaaaaaaaaaaaaaa

SEQ ID NO: 13685 - DNA, 766 bp, Homo sapiens
acttgccgggatgttttctctcaggaaaccgatctggaattttgatttttaggaaatcctggatacatttctccagctcctcctcaattgagagcttttctttaacagctttttttttgctgctcatgttcgattccctggagcctgaagtcagagtccggagtaagtcgcttttccgccgcatctccgaccgttggatcagctggacagggcccttcttgatgggacggtccacagtctggatgttggtctggcgtgtcacggcaccacagatgaccgactcctgcggagagctggcctgaaactggctggcgcaactagatgtcgcgagcgcattgaataccgcgctctctccccttccttcgaacttgggcattgcggctctgcgtacgccgctgtgcggcgatcatgtgtgaggttgcctttaacgtaaccccacgcccgcaccgcgtcagtcccggccgcctccccgcggtctccggcccgcggcgctcggtgtataccgtgagccccctctcaccatcgggcgcaacttttgcttttcgccgcggacggctgcgtggcgggcggcgcctgcgcgggggctgaaggcagtggagcctagtgccgtgcgtgtgggcgtgacacccccgccggccccgcccgccgccgcgccgctacggccccggacgcgcgcgggggcctgcctcggttggtagaggtaaggcgtcacgtggacgatcgctgactccatgtgtagtggtgactccgtaaagaggtaagatat

SEQ ID NO: 13686 - DNA, 750 bp, Homo sapiens
  misc_feature (1)...(750): n = A,T,C or G
ctgtaagggtgacaattttctccctttctggagttataggaggaagttatataggtttacattttttagtgcaggtgtctctttcaccagtcaagctttcatataaaggttggccaattattccatagcttgatggaaaggctccaaagtggccaccagtcaaggtataacgggaggaagcctatgaaatcagaatgccagtaaccagggaaaggggagtgactttgtgcctgtccctaactgggtacccctcagctccttggttcttaccaaaactctgttaattcagtagttccaatttcagtctccatacaaggaaactaagaccctaagagtttgagaaacttgccagagtttgtacaatttgaaagtggcagagctgagatttgaatacagatcttgcaagggccataaccatgccaattaaccattttattcagcatccttgttagtaaaatcgttgcttctacttcaaaacaattttcaagttataacttctctgaatttcttgttaacctctcctcagaagtgtttgcttttttctcctctctgaattatagttctactttgtaaatacctctattattgcacatgttacattttgttatatatcatattagctactaggccatgagctccttagtatgagcatagtgaagtatccgttgttgtaataccagcaaatatgccaaggaacaatgtagaaattcaataaaagaccantattataactcaaaaaaaaaaaaaaaa

SEQ ID NO: 13687 - DNA, 829 bp, Homo sapiens
cacctgttagccaagatggtctcaatctcctgaactcgtgatccgcccgcctcggcctcccagagtgctcggattacaggcgtgagccaccgcgcccggccgatgaattccttttatttcatccatttatttattttgtcctttcatccaacaaatatttatgggtcatgtcttacactaaccactacagataaagaaatgtgtaagacaaagctattggctggaagaatactcagagtggaggaattgtctttagattctagatctttctcttcttaaatcatatttcttagaatataggtacaggtttggaacattgtggtaattccaaatttggttacctttagtgcttagtgctgaaaagagctaccaaaataataaagaccctggagacgcctctcaaaaagaaacacaccacgccacccccccccgaccgcttcccccccccacacacccccccggcaacacaccggcctccgccacaccctcacaacacaccgtgcccctcactgcctgcaacgcttgctctcaccgcccttcagtctccctcagtcatctcccccgaagtaaatgatcgtcagagcggacagtctgacagagcagcctacgcgtctccgcggcttctcgaatcgtcgtctagggctcgaccacagtagcgtccgacagctcactcgccccgcccccccgattctccgacgatccctgacggttcgccgcttctggctccgtaaggcgaccgcgcgctcttgagatcagtagtctatatggaacacctcgcatgcacgcatgacaacgatatctgccgcgcgtctaacgattagaccagtta

SEQ ID NO: 13688 - DNA, 1597 bp, Homo sapiens
  misc_feature (1)...(1597): n = A,T,C or G
atgtgcggtggcgcgtgttatatgggttgagggtctattctcgnctgtctgtaggtgctgtgatggtgttttatatattaccantgacgcganacagtatatgttgctgtcgtgtatgtgtctctgtaagggtgcgagtgagatttctgtagttgttctattacacttgctctctcttgtgacgtcgtgttgtgtgcactcgtgatagcatccgtacgtgcgcgcacggctgtggtgtcgatgtcatagttctctatcgcacgcaatctagccgtgtcagggatatgtggctgtcgtgtacttgtgtgcagacgtcacgtcacctgcgctatcgtgntttttggtcggtgccgcatnactgtgtcatagtatcgttcggtcacagtgcgtgcgtgtgttatctatcagtcatgtaactctcttgtatctactgtcgcagatgtcgcgctggtattgtgctagttcncncgctnttctcctctncgtcgctgctatctagttacctgtctgcgtcgcgagtgtgtgtcgcgcgngtgcgatgtgtcctgatctctcatcttgcgtgttcgtgttgtcgnctcatgntgttgacgtgatttgcttgtgatgattgtgttnttgtcgcgtcgggcacatcacacacaacgtgtgtatatangttgctgtgtgtgtgcttgtgttattcttagctgngtatgtggtgtgtaggtctatctcggtgtgtcgctgtgacttctatgagtgatcttgttgttcgtatgtttgatggtgtcgtattcttctacatctcctccgtctcgcatctgccgacgtaggtgtctgtcattgcgtgtatctactcggtcgtgtactccgtctatagtcgtcattgtatttcatcgcgacttgcttcgttgtgtgtcttacgacttgtcgctagatggatgatcttgtactcgtantatgtgaagtcgctacatgtctcgtatgcgtcattgtggttgtgtcgttgtgnttgngcttattgtcatgtcttcgttgacttanatatatgtgcatatatgtgcgtgatagcgtcagctnctgtgatngctcgtttantnttgtgntgctacantctgttgttntgtgtctcttgctggttctntgtggtntcatggtttatntctcatagtgtctcgnagctcctgtcgtgtagttttgcagtgtgatatatgatgtgcgtgtgtgngggctcgtgntggtgctctggtgtttgtatgtntattatgtatntacgatcgagagcgtgtcatagattctctcaganacacataganatacagatatacatatatacacacatacagacacatatatatatacatatananacaaacanacatatgtacatatatanagatggatacatatananagananananananananananatgggngnctctncnngtntggngtctctaacnangtctgngtggtgnaggcttgtncttcgcntgccgctacggacnncnctctttttnttttttctntcttcttctctgtatcctctcctatctggtgtgtgtcatacgatgntgcngtcagtgttcgtgtgatctctgtgtagctt

SEQ ID NO: 13689 - DNA, 720 bp, Homo sapiens
tccaagggataagccatggataatgtactctccagtgtagcatattcaataaattacatgagatcataaaataggtttgtgtcaagcgattttgcccaactgtaggctaacataagtgtgctgaacatgtttaaggtaggctacactaaactatgaggagcagaggagaatctgtattaccaaatacaactagtgttggatactaatggttttctaaatctcaagctttgtaccactttaaaagtagtcattgtcatcaacatcatcatcatcctatgtttatcttccaaataagtgtagcattgtagaaaattagtagtgtgacttagaagctttgagataaagcaccatctgtatcggtatactggaagctttgacaagtcgcttcacttctctgagcttctttgtcctcatgtattaaaaaaaataataacagtatctgacaaaatcataggcttgatatgaagataacaattaaaatgcacatcaaaataaatataggtaaactttataaacaataaggttatttgtttgcttattttttatgagtctcaattttgccagtaaaatggcaataataattagaacctcataggttttctgaggattcaatgagaagctatatgcaaaacacaaaacacttaccatagtgccagggacagaggaggacctcaatgagtaatgaatcgtggctaagcaaatttaaaaaaaaaaaaaaaa

SEQ ID NO: 13690 - DNA, 827 bp, Homo sapiens
tggtctgatgccctttcagaacgaaaggccctgctgtggggtttagagacgctactgatgagattaaggtgcgtccaaagatatgagaaggagcaggcaccatctctgttaacactttgtcgctggattgtcacccatggtgagaactggatgaaatggagaacaaggagtgttgttatggtaacagagagaggaggtcaccatcaaggaacccggagaagagggggtctgtccagcatactgaggaactccagtttgagtggcaagttgttcctgccccgggcaaaatatccaactggatgaagatctcacctctttgcattctaatcttccattctacaagcaaaacttataaggaaaggcatgtcctggccagtggggcaagaatttccctgttcactggaaacagatccgcacataaatggatttttctcgaagtctcggactttcacccaacttccatatctttctggagtgacctgatccataccgacggttttcgaccccaaagatgaaatcttggcgccctgcttgtatgaacttattgcccccatcaacctcgcctggtcataggggtcccaactgcactgtagggcctattgggtctcaattcgtgcccccttagattcctcaggaggggacttatgggccgataattataaagtcggcctttactggcgttgcgggcgacgcgcacgaccgcctcttttgtctttgtttacctttgtgtgggtacgatccggcggtggaacctgagtgggggatcgtttggttgggggagatgtattagactggctgtaaggggggttgttttggtttaagattat

SEQ ID NO: 13691 - DNA, 738 bp, Homo sapiens
ttgtagccaagaaagaacattaaagacagcttgaggaatcaatacacctgtggcgtgaactggggatgaggtacgagggactgagaaggaatttagatgttactgagacacgattgtgtagccagagaggaaataagggcccgatagtatagaacaccgttggatggttcagagaacaaatcagttgatgtctatgtacgtattgtaaccatgcatagaagctttcagcatgggaccaatagatgccccaccttcgttagtctgaattcctattcaccgttatggggcgctgacatgtttgtgaagcttttaacattcaatgatctcattgacacaaaataacaagcttgagcagtaggtagtataactgtccccatttcatgaatgagaaaaatgaggctcagagaagcaaggtgagttatacatgatcacttacctgtgccaaggcattcttgcttgatttctatatgacatggtagttatatcctttaacctctgatccacaaacaatttttagcctcatattcctgtgaaaatgtttctgtattccaaacataggtaagtttattcatctataaattgtaaaatctatgacaatgttcgtatattgagtgcattatagaagatacaataaaacatgttttaaacagataaaaaaaatgaaataaatgatgttttaaagataactctattaattaaaaattatttttgcttttgcttcaaaaaaaaaaaaaaaaa

SEQ ID NO: 13692 - DNA, 815 bp, Homo sapiens
tagagatgatgtcatccaccactaataaagatgcaaggaccttagatatgacgttgggattcattcctaatttgtcacaggagctgaaggcaattctgtctgaggggtagctgtcactgagaaaggtactactttcctgacaaaagagaagtgaagctgatgatgccggtaaactatgctgtgaagaatgttgtgacaaagggacttttctgaaagtatgcacaaagtaaagtaagggggagcttctcacctaacctcctatgtattctccatgaaacattcagtgatgtccaattcagtgaccactgattgttagaatgtgagaaatcattattaatgcttacatgtttcacttgctctgtaacaccatagtcttttcactattgtacttctatgaaattgatcttttttctgccgaaaagtctctttctcttttttattgagagtattatgaaatcaattgcttttgaatctcattgactatataatgatattaaaagctttattactttaacaacctgatatcctcactcccaatacctttctccgttcccgccgtataccattgcatggaacgcaccgggccgggagcgcccggcgagcaccttttctggttatgtttcgcccgcgagcgtgcttggccgcgagtgaagagcgtttggtgccgatagagggtaacgcaccgcctagcttcttggtgccgccttgcctcgtcggtcgcctcccatcgagcagtctgtatggggcgcagtgtggtcattccagtagaatacgagtttagggcgttgagggtcgaggggtggggtgtgagggtg

SEQ ID NO: 13693 - DNA, 736 bp, Homo sapiens
gtgaagctataaatctgtaggtttcctgaaaggccctcataatataaagccagttttgtgacccgattggctgtggttcattaattaattagagacccagtcttgctctgtcccccagactggagtgtagtggtgccatcttggatcacagcaaccttcaactctcaggttcaagcaattctagtgcctcagcttcccaagtagctaggatcacaggtgtgcgccagcatgcctggctactttttgtatttttagtagatgcatgtttttgccatgttggccagactggtctctaactcctggcctcaagtcttcccctgccttggccaaccaaagtgctgggattactggtgtgaaccaccgtgcctagtcatgataatttgttgagtggagttctgttcaagatgatggagggctaagagcagcaaaagccaggctcactggctcttgcctgtaatcctagcactttgggaggcctagatgggtaggtagatcacctgaggtcaggagtccgagaccagcctagccaacatggcgaaaccctgtctctactgaaaatgcaaaaattagccgggcatagtggtggatgctaataatcccagctactctggaggctgagacaggagaaatgcttgaacctgggggcggaggttgcggtgagctgagactgcgccacttcacttcagcctgagtgacagagtgaaattccatcttaaaagaaaaaaaaaaaaaaaaa

SEQ ID NO: 13694 - DNA, 775 bp, Homo sapiens
tagatgaaacgtgctcattatatcttcctgacaaagggagcggagtccggaatattcacaatgagtttgtggtactccttgggcccctgagtgactctcggatgaaggttttcattggccatctgttgctcatgggtctctgcccttgaaatctgcagctgttgaacacatggactacactcttttatctcgatctgagcctggagtcctcctggatggctctatcctatttcgtttttcatgtattcccctgatacctggctgtgattcccatttgacttctcatctggctgaggtcacactaggctgcactcatagtcccatttagtccattccaagacaaacttctgaaacactgacaagccagcatcatcagctacatttttatcttgccaagggttattcacaatcttaacagctggctccttatgctgataaatcaacagccaaaaaagtggcttggtgtatttgctgatttgaatgattttgatgaccaggggaaaatcagattgctactccacaggggggggtgaggaggatcctcagaagtgcaaaagatcccctgggggcctcccttaggactgttcctgggctataattaaaaaggttacattacaagctcaatccgggcaaattttgctagtgaccccccgccctttaagaatatagtttggaatgggcctccccctgaaaaaaaaaaccgtgggcgatccccccgaaaataagaatatacctccccaaagccgtctcaatcctcagtgcccctgggactact

SEQ ID NO: 13695 - DNA, 744 bp, Homo sapiens
atgtcctgccagcggtgggtgaaattacatactatggcaataacattttgggcctgcaacactgtcttccttttccgaagcataaatttatttctgtgacagtttacaattagcgtcatgttttaatatatcacataccagaatttttaaacgtatattatgctttcagggttcataacaattctctaaaattaaccaatatttacccgtgtatacaacattcaaaaaaaatatgtgcagtaggtggtctcatggttaaaactaatgtttataactacttccttttactcgttctagattcttcttatgctcagcaatcatcttggcttggttaatgccttctggggcgagctgaccaaaacttcatccctgaagtatgtgggtcactctcagatctgcttccattagcttgctgttattttactttgttaatcacagggcagggcaggaaggcactaagaattgccccaggggccaggagcggtggctcacgcctgtaatcccagcactttgggaggccgaggagggtggatctcgaggtcaggagatcgagacaatcttggctaactgggtgaaaccccgtctctactaaaaatacaaaatttagctgggcgtggtggcgggtgcctgtagtcccagctactcgggtggctgaggcaggagaatggcgtgaacctgggaggcggagcttgcagtgagtctgggcgacagagcaagactccatctcaaaaaaaaaaaaaaaaa

SEQ ID NO: 13696 - DNA, 759 bp, Homo sapiens
actctttagcaagaagggaaaaattcattttttcgcccgtccaaagagataaattcctcaataatttcatttatgaccagttagaaagactatgaggttcaaaaccccatacagggcaaaggtaataaattttaaagatctctggtcagatctggtgaaccctctatcaaggtttagttttcgtttgattatacataagctgtaagattttctgtcattgcaagtttaattgtctagtgacttattttaaatgctttttaatgccaacactcattatccaattgtcattcatgtccttctctgcctggctttatgggctgaatttctgtgcaggtgccttttgctgagaaggcacccttcccagtgctctgggccattctctgtgtggttccattgctatcccgctccaggtaccaaaggattcggcctccaaactctgctgcccaccttggtggttggacacatactcctggaggacctggagtcaaaacaagccacatacatcctgctgacatggagaacagccagctactgagcaaacatgcaacactggtgatattgtgcaatgttcccagctgtgaatttatctcattgttttcacccagtgacatttttatcttatccctccataagccaggcaaaagtacactaaacgcttgaatagattctctcttgtcattttggaattactattttcattttttatttgaaaatgagaaataaaaaggaatcttataacttcaaaaaaaaaaaaaaaaa

SEQ ID NO: 13697 - DNA, 845 bp, Homo sapiens
gagacttgaagctatgattttcaatgtagaatttgaattagaattaaagtcttgtgggattatttttataccagacattttccaagagtttgagaaacattgatttataatattttgatctttgaaattggaaatattattttaaataaaagatatccaaaaagcagtaggtgtaaaatatatagttgaagcacaacaatgtaaagtgtcaatggggattatgttctgttttccagagtctccccaactattccaggattattaaaaaacaaaacaaaacaaaataaccacctcatagttaaattcagggatattctgtgatataagacatacttttatatctgaaaggagtccgcgctttcacggaaagatatttgagtttctgtcctaaaaataaatgcttgaagggttggcggacctgtttttctcacttctagcggtggtaagccgaaaaaagaaacaaaactaccgctacgaaggccaacaacgttactgcaaagccacagactcgctttgggcccaaatttttcctttaggactttgcgtggcgactccttggtccaaattgtgatacttttttacgtaccacaatccaaaaaaagaagttatcccgtcttggccaaagagcgattgtggcgctctggagtccctcaacggtttggtgattttggcctcactggcaagaccgttgcggtctggtggaaggggttctccctaaattccgtgtctgtagcctccaagttcgttgggtcgtgctgtcagggtttgctgcctcccgagcgtcctattgggaagctgagtatgtgggcacgtgtcggcgagttagttaacgttgcccgatgtat

SEQ ID NO: 13698 - DNA, 798 bp, Homo sapiens
gagaattgtttccagcaaccagaaattactgacgtgaggattcaatctttcggcgttttacacaaaaggcaagaagtctattctgctgatcagttgaattgaagatacatgatgagcagtgtgggacctctgcaagaccagtaaatctgcttaagagccaagcatacagcctgcgcctgcagtcaggaccatgcttgtctccattgggaaaccatcacacagggccccatttactaagaaatcccaaaagactcttcataatattcagattgaatatcaacaatatgtatacaaaccctatttctccaaccaaaacatacgactacatgtctccttcagccttagaaactgaatgtgttgactttttttcctagcctcacattttgtatatttatagagccaataagatgaaagtggactcagcccagtgtccaacatgggcttcagaagtgatttaatcatcagtaacagaagagtaagggtggcctagggggcatcagagcatcccccaaaatgaccagggagggtttgtatttagcaaaccaaaagaggcttgaaaaaagaatgccctaattaaggaatttctatcattttacaatttatgaatgaagtttttggcccaaggccaaggggggtaaagttgaaattctacctcctaaccggggagcttttctgctgctcctagttaaccagctgcttaacctttttgaaattctctagaaaccctccggcttataagatggaccgctgggcaagcttttctggagcccggactggtttggatttctcaaaggttca

SEQ ID NO: 13699 - DNA, 743 bp, Homo sapiens
aatggtgattgagatggttttttatacacagcctacggtgttgtatatttataaaggcgaatagtatgagattggtggtcagatggagtgtacaacgagggaaaaaaacggtgtatttaattctgcagtgacataaaagtaaggttgtgcctaaaggaaactagaagaatccccaaaaatgggaaggaagttttttttatttagccatactaaaaataggctggtaaaaaagaaattactccaatcagagtcagtttttactcattttaccaaataataaatagagttatttggccaaggtcaatggtggtcaagttgagatactaattcctaaatgtgaagttttgctctgcttcaaagttaacagcatcttaacctatttgaaattctttagaaacctccaggatcatagcatgacctctggcaaagctttttggagccagattgatctgaatttccacaaggatacaaaatgtattcattatgtaagtgaaataaacaacagaaattcagatggctcactaaaattactacctgaaaaagctactatttgaaattgtacacatttcattttctccccaatttcaatcacttttcaaccataaaagatcaccaggaaatttcttacatttttataacacttatgtacttaatatataaaatatgagtaatatgtatttaagggaagtttttagaatttttcaaataataagtataatccctggtgaaaaaaaaaaaaaaaa

SEQ ID NO: 13700 - DNA, 830 bp, Homo sapiens
tgtgtaagttgtagttgtattaaaaaaagttaagttttggtgtgacttagggacaaccacagattcaaattgtttatcaaatcaattaccttggatgaccaacttctacatgacctgccttcagcttctccatgtcagtcacctacaatcagggcatacctgaggccatttgattttttctaccgtaaatattttctaccttcctgcctgctttcaagtctctgaaaaattatgcctggagaatacaccaagatgccatcggtgttatattctaccatggaacctgggtatcaactgggatgtggtacacatgcaggcaccctttgactcgttcctcacaacttgatgagtcttgattttcatgatacgtcactaccagatctaaacttcactctgttggcatgaagttccttggctacttattcttttctcactgctataaaagaatacctgatactggctaatatattaagaaaagaagttaatttgactaacagttccacactgctgggggaagccttatgaaaacccacaatccactggaaagaagggaagaggctaatttatacttttgcgcgactaccgacagtcgaatgtaggcatatgccactactttacatcccttaagctttaattaaacacctcccacttttcaatagaaaccatcccaatagcggaattcgtctcccataacccttccacctacagagacaggtcactccattaagcatgtaagagacaccatttactacatgatattatggaatgggcgcacgatgattcctttaaacgtgttatggaatgttagtttgctttttgatttaatatag

SEQ ID NO: 13701 - DNA, 759 bp, Homo sapiens
acacatgcagggcacccgtttagctggttcccccccaagctcggagaagtctttaattttcataataagtcagttcccagagtttaagcttcaattgtgtttgcatgaaagttccttagatacttattttttttcaactctttaaaggaaaactaaggactgggtaatatataaagaaaagaagtttaattgactcacagttccccactgttgggagggcctcagaaaacccacaatcacggcaggaggcaaaggcacatcttccattgcggcagaagagagtgaatgaggaagtgccacactttaaaaccatcagctttcatgagaacttactcattatcatgagaacagcatagagggaactgtctccatgatccattcacttcacaccaggtccctccctcaacatgtagggatcacaattccagatgaaatttgcgtgggggcacaatcaaaccttatcaccagagttttgttattggtttccatttgtttagcattggtggtggaggaaagacatttcttcttggcactttttgctctgtttcattcttccattttgttttgtgctatgtaaaagtgttgctttccatacaaagattaatgaggcagaactaaggcattagcattattagcctgttggcataggcctcacaaaccattgagttctctattctcaccacacagatgtccacttggataactttgctgtctgtcaccaataaagctggatatgattctcaaaaaaaaaaaaaaaaa

SEQ ID NO: 13702 - DNA, 813 bp, Homo sapiens
attgagtttcgctcttgttgcccatgctggagtgcaatggtgcgatctcggctcaccgcaacctccgcctcccaggttcaagcaattctcctgcctcagcctcccgagtagctgagactacagtttctcatgttccctcctccaatcaaccaaccacctgagtctgattcattttttgagcaaatgctacagtcttggacactactctaggaattgatcccctgtgatatacaagaagaaattcatgaaaatgaatataagttttccaaaaagtgactcctaaccagtttttatcattccattcagcccctgctgccaacatagggctactgcacagaatgagaaggtctaatgcctcacctgaaatcaacttcaccactgtctctaagttatttaaaaaacgaacacacagatattgcagagggccgaaccagatgttctctcaaggggcctcccagtaaaaactttaagtcattctcatatgatagttaggaaaatgtgcacggacaagatactagctgatattaaggatgtattatcaattatgttaggaatgataatgtcatggtagataactagaagaaagtcatcatttagaggtgtatatcgaagttgtatttatgagtggaatgacatgggatatgtgaattccattaaattactcccatttttaaaaaggctcagtggaaaacaaaacaagcctaataaaatactggtaacttaaagttggggggatgaacacagggggttatatggttttctccacacttttgaacctgtttgcaatttgtcacataaaagtaacataattga

SEQ ID NO: 13703 - DNA, 1114 bp, Homo sapiens
  misc_feature (1)...(1114): n = A,T,C or G
aatggagagggagnggtgggggggannttttgnaaaagggaaagatagnnaaaaaatttgaaacaaaaaaagtttgacaaaacttaaaagcaaaggacaactatagcacgactgttaggaagaacgaaggagacatagaaattatttgtttggaggggaagggagaagaggaggaggcgtttggggatagtagtggggtgtggagggagngtggggagaagattgaggagaaggagatacatggccgcgtcggaagggagggccccgggcggtgagggagccnaaaatcgtagacctcgcgcagcaacgcccgcgccacccccccccctcacggcgcgcacacgacaacccacccgcggagacgacacacgcgagggagagaaaaagaacccgccacagacccaccacgaccacgccttcgcgtggcgcaggtgaaataaaccgcaccacacccgcgccccaaacgcagccgccgcaccaacggagcccgacccggcggacacaccgaaagccacaaccaccgccgngccgcgacggcccccctcccacaccaccactcccacnccccccgccccaccccacgcacccacncccacgccccccaccgcccggaccacccgcgccaccgcgacacgccccccgcacaccaggacaacacgggaccgcgcccccccggccaccacccccccccaccaccacaccgcccccgagccgacaacccatcccaacaccccccccccgcaccccaccgccccggacccaccccgacggcgcgcaccccaccacgcgcccgcgacgaccaacccgagcacgcgcccgcgcgccgcgacccccgaggcccgaccaccccagaaccaagcgcccgcgcggcggcccggcgccccagccgccgcaaacgccaagcgccccgcgaccgatcgtacgcggcgacgagagaagccaacggacagccccgagcagcacccaaaacgagaccgcccgacacggcacagaacgaggccgggcggcgggagccgcccgcgcccaagcccggcgcaccacaacacaagaaacggacgaccagaggcgcccacgaaccgggacggaacagcgggagcgggcacacagcacccgc

SEQ ID NO: 13704 - DNA, 736 bp, Homo sapiens
atttttttccagcccgccgcccctatcttggggcccttccccgcaaaggctcatgcccttacccacacaccaaccccacctcaaatagtaattcttggcttgaatctcccgccccagcccaacacaggtctgggagggatccctgtagcaagggaagaagaggtaaaggtttcgaccatgccactgtcaccctcttcccattcattacaacaaggacagcagcctccaagtctccacactcctgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagtggttgaagtatttcttcattaggcctttaacataatttattagtgtaataattttggcattgtttctcatgagtgatactatttctaactcataaaaaataaacttgtagtactaagatcccaggtgagattagctaggattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaaaaaaaaaaaaaaaaa

SEQ ID NO: 13705 - DNA, 198 bp, Homo sapiens
gagagaagggaggagggaagttattttcgggcggaaattgcaccgctgtaggcaacgaggccattttttttttttttttttaataaaacatagacgttttcagtggccggtactgaaacgcgacacgacgctctgcattcgcatcaccccccccgcccgcacgaccacccgacccccctaacctccgctcctaccaca

SEQ ID NO: 13706 - DNA, 1829 bp, Homo sapiens
  misc_feature (1)...(1829): n = A,T,C or G
atgagagaagaggagagggggaggaataggggggagagaaagagaaatatgagatcaaagcaacaagngnaggagaggttggtggacggggggngggnagaacggcgagggaggcctcagcgaagacanacaagaaaanacagagaanacaacagaagantggtaggganagcnacaccgagaaggggacagcgatgtgagagatgtgcgagatgtgtgtgagaagcgcgaggacgagagagagacgagacaggagaggcaggatntaataaacacagagaaanaggcggangagccgngngcccaccacacaagcgcgaagnacnancgagagcacgcaggagnccgcgccncgccgcacgcncngngcgncccngccnancaagcgcaganangagntnccaggcgacgcgggcgaggagggcgcggcgngagtgcngagacgcgcgcgcgcgagagcgcaggagcagcgtgangacgcggacgaccggngaggcgacgngncgcanagcgcgccgaccacaccagcacgacagcgacagagaccgcggctgcgacgcacgcgcgccgcggcagcgcagcggcgccngacagcgaagccggccgctaccgaccagcagccgacgcgccacggcacacgccgcccaacccgcgcacgacacatcnccataccgacgcgacagaaacgcgcgcgtcgcactcgacccaccacgcacgccgtctcgccccgcgccggcgacccacggaccgccgccggacgcgcgacgacgcaggcgcgcgacgacgccacacgcgacccnnacgctccacacccgccgcgccgcgagcatcgtcggcggacgcgcacggccgcngcgtaccngacgaggcanaaatgcgaggcgacgcgcgcacatactcacancaccgacacgaagnganccgnggggcgacgacgacacgacgcgccgcccacgcacagccagtcgacccacatccgcgcgcacgcgcacgcggcgcgcgncggcacgcgnagccgccccacgcggcacacgcgcaccgcgcgcgcgcacagcagcgacgcaacgtcgccgcagagccgagcacacagcgcagcagccacgcgcacggccgagcgacgcgcacgacgcgcagacgtgtgcgccanaccnctcgcangcagcgcgacgacgcggcgcgaccgcagcgccgccgcgagcgcaacagccgcacgccgcacctgcgncgcggccgccgacgcggccgcgacgngcgcacggagcgtgccgctcgncgcncncngcagcgcgcgacggcgtgtcgcgcggcggacgcngacacgcgcgcgccacgcacgcgagcacgctnacgccacagcggacgagcaacccncgccngcgcgagaggcangcgacggcgncgaccggcggcgcaccagacgcgcgtgcgcgcaacgacgcgagagcccgacgaccgacacgacgacaccacgcgcgcggccgccncacgagacgaggaacgcagccggcgcgcccgngngcacagcgcgagagcgcggtgcgtgcgcaacgcgcncncgcgcgctcccgcgcgaccgcctcagccacgcgcgcngcaccgcgcgcgaccancgcgcggcacgcgangacgacacgcgcgcgcagcggcgccgcgccgcggaacacgcgcacgacccgcncagcgcaccgcacagacgacgcgnccgcacccagcgcaccgagcgtgcccggcggcggcgacgcgcgcggagcgcgnagagaggncaagagagacaacgacagcncacgcgccgccagctacgcgccgngggcgcgccgaccngcagcacg

SEQ ID NO: 13707 - DNA, 538 bp, Homo sapiens
tggttggcgtgcaatggtgcgatctcagctcactgcaacctctgcctcccgggttcaagcaattctcctgcctcagccacctgagtttctgggattacaggaatgcaccatcactcccagctaattctgtatttttagtagagatgggatttctccatgttggtcaggctggtctccaactcccaacctcaggtgatccacccaccttggcctcccaaagtgtcggaattacagatgtgagccactgagctttttttttttaatgtaaacatttgttgctgtaatattctctcttataactgttccccataggttttggtatgttgtgtttccattttcatttgtctctagaaatttttttaatttcccttttaatttctttattgacccattgattgtttagaagcatattttctagtttccatagatttgcaaattttccaaggtttctcctgttactgatttctagatttgtatttttgtggtctgaaaagatattttatatgatttcagtcttcttaaatttgttaaaacttaa

SEQ ID NO: 13708 - DNA, 253 bp, Homo sapiens
aaagagccagtttgaatgctcaacccaaactccctggctcttctgggttagcccatgtcccggaactgctggaacatctctcaccccatctcccgctattcggtcccacaagtgctgctgtcactcctgctcctgttaataccgcctcagtgtcatcaacagcaggaaattacaaaggaattcaaatggaaaactaatcccttacaggagacaaagagcattaaagacaaagcccattggaaaaaaaaaaaaa

SEQ ID NO: 13709 - DNA, 367 bp, Homo sapiens
ctagagtaagacaaacaatagtcacgtcaaagctcaaatcttttcccctgaatactctgactgaagttgggcgggaccccaatgaccatggagctgccagcgacatgctcattttttgaaatgaatactatactgaaactgatgttttcagatgccacctgcataaccctggaacttctgttatttccatgcctcctgcaccaaggaatcaatactcagaatgctactgttactgctctccacatgtggacagtaacatttatggtcttttcatgtgaatagcaacacatctttacagcatgcctgcctgagctaggccctgtagctctgaaataaacattttccttacttattaaaaaaaaaaaaa

SEQ ID NO: 13710 - DNA, 219 bp, Homo sapiens
ggtgtgagaaaaataatgtataaaatagaataaaaaagcaaaaaaatttcaaaccaaaatttcctactgttgtatagaaataactaaagaagaaggaagagttatgtgccttatactatgatgaagaaggacacccacacctgacctaacatgtacattaacacctgcattggcaaaaacctaaaaaataaaatatttacttagcgaaaaaaaaaaaaa

SEQ ID NO: 13711 - DNA, 265 bp, Homo sapiens
ttgcaaatgctaatgagttccataggcgatggaccttatctttgcatttccccttgcatacatcacacccagaagagtacctgacatccagtagttgctcaacacatatgttttcaatgaatatacaaacaaaagaaagtgttgagtgtgcattacttaataaaatctcattgccactcctggaaaagtggcaaagctaacctaaagaattttgtcttttgtaaagctttcatattaaaatattatattgttaaaaaaaaaaaaa

SEQ ID NO: 13712 - DNA, 968 bp, Homo sapiens
  misc_feature (1)...(968): n = A,T,C or G
ccccaactaaagggtgaacgcgcgccaggggtttttagacacaacacggcccgcaactctgaagagaggggtagttttgtccttaataaacaccgaccgcgtatcaggtggagcaccttgtttcttgtcacaaaaagtggacgagtgggccggaagattcacaagagaaaaacaacattggtggtgccgttgaaatcctcttatttgtctccccctcgaggacaaatggcggcgataccggtgcaaacacacacggggaagggcgggagcggcagacattccaatataacgccttgaagactttgccctatattggtgtatattctgggccacaacaagatcatgaccgtattgcgtgggttgcaccaaccgtcttgttaccatttgtgctctcttacgcggggagacccactccctgggtttggaggaacctaggagagatgtgtctccctcaggtttttagtgtgcggcgggggaatttcaaagggcgaggggcaccaacgaagggggcgtggtgtgggatgttgtttccctcctggacatgatccgcccgggagaggtgaatagaaggggaggttganccacgcgccgaccctaaccttttgaaggaggtagacactgnttatctaccgtcggtaacaggggaggggagttgtcgacttgtaaccacaaggacacgagctatatgcggtgggagaattgttgtcttcttgttgctacacaacatcagaggagggtgaagttgttgtcatgggagtggagtgcttactcggcccaagtagtgcactacagtcgagactagtattcgtcgcaggatgtagcgagatgagacaacgcccgcaggccgcgtccgacccctcgtctgtgatgcgccggagagacaaatttatacacgccacgcccgaccgtttttacaaagtgggaaatgtgacgccacaccggaaggagattttgtgctctccacagct

SEQ ID NO: 13713 - DNA, 1024 bp, Homo sapiens
  misc_feature (1)...(1024): n = A,T,C or G
agacaagggacggcggaggtgtggccgcgtcntcccccaggggtttttttattgccccctgaaacattttattgtggcttcctcccggattctggggcagtgcaaaaactcatgattataaccacgggggggggggtccgcagataaatggaaaccaaaaaaaacggagtgaacaccccccaacctcttttttctatgacataggggagattttaataaaacgcggtttaccccgcccggccttcgagatctccatatttcttaaaccatcataaaaaaatctctcagccgtggggggggttgtccatttataggagatgcctttctatataaaaatacaacacaccttaataaagttggcgttttgtgttacaccattataccctatgacgtttagagtagaaagatagaagagtagactttcctccctcactccatggacgaggcggccataagtaaaattaaaaacatagtcgtttccgattctaaataattggcaggcagcgcagctaatgagagcggtataaaagaagagaacgagttgaatatagatatattcgtaagatactgatatcggtcaagatataacaatagaagcttggaagcgtagacattctggtgctagcgaggtcacagagatcttagaggtcacgaccttcgcaggtattattaataatatcacaaatagcccattaacctatttgtttgagattatttcgtgagatctgagtatgaaatgatcactagatagtaataacattacagatacagggagtgatagagagagtaggtattagtgttaattaaggggcagtagaacggcagatacatagttaatacttgagggtagctaagacgagtcacaataacgaaatgctgtgcagagagacgggagaaagccatacttcgaccgccctctaaattcacggtgattcttaatatcagaaggaatagtaattgacataaggtaagaccgcaaataaggagaatcgtcagttcaggacacgagccggatcgcagcgcg

SEQ ID NO: 13714 - DNA, 544 bp, Homo sapiens
ccccgccacacggcggggcaccaccaaaggggctaaagttgtctgttcccacccaccccacgccccaccacaccacaaaacacggaacacctcttgcgcccaagtacaacactttcacatctccccttttctctctgttcaccgccagaggtttcccctgacaccccccaacgcggcccacacgaagggcaaaacacccctttggggcacccaacccaggggtgggaaaaaccccaatagtgtgcccctggggagatcattcacccccgtaccccccttgtgtccacattaagaaagagggcacccccaaaaacccccaagccccccctttgggaaagttttgaaaagaataaaaaagggcatgctacaagtttaaaaaatttttaaagccccccacaatgggaaggatccctatgtagcccaattaagtttgggttatttttccgcccccaaagaatacccatgtatattcccagggaaaaagtttccccgtcaatttcattttggaatttttttcatatgtccctcaataaaaaaaaaaaaa

SEQ ID NO: 13715 - DNA, 226 bp, Homo sapiens
ttgcaggaaatgtgtgtatatataattgggaaggtgtccaccagcaattacatcagatggaatccatgggatgcagcaattacagcagattggactaagagcaattggatgttcaataagtacttcttaatgatgatgatgatgatgacaatattaagaatattggtgtgacatttgtggtgaataaaagattgttttcactctttttaaaataaaaaaaaaaaaa

SEQ ID NO: 13716 - DNA, 1633 bp, Homo sapiens
  misc_feature (1)...(1633): n = A,T,C or G
gagagagaggntgtgngngngaggagatgagtgagtggaaggntnatataaanntaatantnnatnnnntagtaanatatatgtagtgagtgntgtatgagagtanataatccttaatananatggaagaataagaaagtggnagaganaggcttttaacanagaggnacgaaaagagagaaananagaaagagaaatanagnganagagtatgntatagtatgtgagtggagtatttaagtagtagagagatagtgtgatagataaangtagangcagngagaggagtgncgacgagtagagatacgggactatgtctggctgtgtcatgcctcgagatgatggcacgcggagtggtgtaccgtgtaatgtgaagagagacgagtagcagagctgcagggcacgagcgctggcgcagcgacgccgcacgcaagagaggtacgtagctcacgcacgatgatgagtgcgatctgtatgcatcatataaanaactcgaaactactgatactgctgtagagggcaggcngttgatngngtgagtatcgacgnanaagacacatatcacagatactacacgcgaccacagactcgcgagcatacagactacacgaccacacgaacacacagcatcctaacaactancagccacnacggcacagcataacatggagacacaagcacacngacagcacgnacacaggagcgcgcaccgcgccacngcctacagcgcaccaacgtcacangcgcacgcgtcgcgntccacacgcacccgccgcacaccanacccacgacaatgagcacagacgccnacaacacgacaacaccatacgancagacacgacgcactacacancactcgtaagacgnacgcatcgcgactnancncngacaccatcatcagacgcatgctccgacagacacgccgtacatacgcttcatactacatcaanctggtccatnncagtacatagagtcntatatataggaacacatatgcgtctacgacagaacagcngtaatataatagagtatntacgacgtgcgnncgtctcanttagttgngnagagcgtggatgtagacgangcgatgatgataaaagatganttacagagagagataatacaaagatgagacgactgagaagagcactcgaagcatcagcacgtacgcacgagagacgaaaggcacataacacacgagcacttcatccactcaacgcaggcgacgcgtgcggcgaagagtcacagctaactnctggacatcacatagagngagcactgaacaccacgacgagtatacanatcgcatgtcgaacggcaacactcagagacgcgaccagcaacgcggcatctgacacgcgncagcacgcaacgtcgaggaacgcgtcanataccacgaatgcacgacacgcgcagacgcgctagcagcagtcagacgcgacgtcacgtagcgaaanagntanacacaacagacgctgaccnatgaacgatcgacgcatctacgcaccgcgcgnaccaccancnangacagcgacngacaggagcacgancngcnagcacgcaagtcagcgcgctccagcgcancagcagacacgagcgcagcngcaagaagtcgtagtgatacagcaaaagt

SEQ ID NO: 13717 - DNA, 389 bp, Homo sapiens
  misc_feature (1)...(389): n = A,T,C or G
aattttagtggaatttgcaaggaatattttctataaaacattgttcatataagaagtcggttgaactcttanagaaaaggaaaaaagtatgccctttttttagcctccaaatattttcctaggttgatttgccttattgggggctgaagttattaaaatttgcatgatctccttagaatacatttaggctaactatttctgattgggtgaataatatagaaaatagagaacatagaattcttaaggctaggaatctaatttggtactaatttttaaagaatggaaatcaacttatattaatttttaaaaataaatggggcatatntttcttctttccacttctttatcctttatacagaaagaccaacacaatgatgaactggttttta

SEQ ID NO: 13718 - DNA, 886 bp, Homo sapiens
gtaagaaatattaaaggacatgtagtaggatcaaaaaattatagcgagctttgcctgttgtccaggctggtctcaaactcctgggctcaagtgatccatttgccgcagtctcccaaaatgctgggataacagtcttttgcaggcacactaagcatcatgaatataatcaccgccaagacacagttcctacatcatggactttctatgagtgtagggcctacaaacaacggccttaggacaattctagcctgcagcctgtttttgtgtgactgtgatcaaagaatgtgttaaaaaaatcaaaagagggatgcttatttaatggcataaacattatataaaattcaaatttctgtggggagaaataatagtttggtgaagaaaattagctagtcctctgtgatatagtcagtagttaccgaaagaaaacgtaccaaggtagaaccttgttcaccacttctcagatactactagtcaaataaaaacgttaagtggtgtgatattgtcatgaaggttctggcggttattctttcctatgctagtttcgttgttcctcctatcaatactcccatcacttcggcgcgacaccacggaagaacaagtgatttgcttcgtattattatgtcatgaaacgagtgaaagtggcctgatgtgtactatattactgtatgaggtgcaagtcgagtccatcgagactatttaatcgccttggatctgcttattagtgctgtttgttttaatcattgcgtatgttcctgctatatctatgttattcataccccactcccgtctcctctagtccatgtcatgctctatgtctcatagtgaagatgagtattacggctctaactagtcgtggtgttagacttttatgtgttatccgatcatt

SEQ ID NO: 13719 - DNA, 764 bp, Homo sapiens
cccccgcgcgccggccgcccgagctcccccccgcccactgccggccctcgcccctctatgcgtagccggccgccccgccagtgctgcgaacggcgcggccccccgcccttgtttccgtcgccggcgcgcccctcccacccctgcgtggcagttggcgacccccctcctgcctcctccgccgttcgccccctccttgtcggccccccccacccacgtcaacgcgcacgggggtccgcgactactcccccgttcgcggccgtccccctctcgccgcgcgcgccggcggaccccactcccgatgcccccccggggggggacaacccggggggccccagcgccgcccccccccccgcgcccccccgacgctcgtgaacccccctttcccccccccccccccccccccgttttataccccccccccacccgcgcccgaccgcaccggcccccctccccgggggcggggccccccccccccccccgttgggtttttctccccccccccccccttttttcgctttgggcgccccccccgtttgttgggccccccccccggcggcctcctttttgtcccgcccccgccgctgtttatttttggggggtgtggctgatgaaaaaactttttcttttgtgtgggttctttttcgtcggggcgccaagccaaaaaaaaaaaaaaaaaaaaaaaaaaaaaaaaaaaaaaaaaaaaaaaaaaaaaaaaaaaaaaaaaaaaaaaaaaaaaaaaaagaaaaaagaaaaaaaaaaaaaaa

SEQ ID NO: 13720 - DNA, 214 bp, Homo sapiens
tagttgatttagagaccttcaagggtggaagggaagtattcctacaacctcatatccacctctgtccatttgaagaaaattgttctgaacaattctgggaagaatgctgagaaaaagattatttttgaccacagaccaactcaaatatctttcttcttaatcctctgaataaatgattcatggaatgcaaaaaaaaaaaataaaaaaaaaaaaa

SEQ ID NO: 13721 - DNA, 630 bp, Homo sapiens
accgccacacctcactacatatgatatagacatgtcacatgttatttaacccaagacatgcccggcgcagcccttacgcagtaccgctgagctgcgtcctattgcctcgtagcttttgtgtacttatttttcaccacctttgtccccttgtcactgcctctccccaaagtaccatgaaaacgctaatgtgatttcgcatactattctatacgcccattatcttattcaaataccctccatctaacaccatactcatccgtccacttcaaataacttactcaccccccaagccacccacgagagatcaccccagccccaccgccggtgttccgcgcggcagttacgcgggtcacaaaaatgtaatttatgattctaaatggatccggcccacacccggcggcccggcggcgcggttctgatttaaatatgtccaagcattcgcaggtaagacccatactcatgttctgctcgggtcgagggaagataattttggaaaaagactggtgaaacccatctcaatcacccgagtctcgggttggtgttttggtgcggatccctccgcacgccagtgttttttttttcccccccccttcacacccactcgacaaaaatcttccgcactcttttttt

SEQ ID NO: 13722 - DNA, 273 bp, Homo sapiens
  misc_feature (1)...(273): n = A,T,C or G
ctttaggtggactgccgcgaaaaggtccggcaagccggcagttgcaatggggcagccggacgcaaaacgcggggacaccggccgggatccgccaagctagggggttgctgttgccacatggcgactgtggtcaccgtctctcctggacctgcctagatccaaaagccagccctggaaggaacacctctcattctcaagaagaagttaatgtctgccttacagtagatgtcctataaatcttctttgaacaattaanaaagaaaaaaaaaaaaa

SEQ ID NO: 13723 - DNA, 217 bp, Homo sapiens
cctaggtatagcagacctccttgatggcatccagaagtttgatcagctgagcgatgcaagcagctttgatcatccagaaatctcatgtcccgcattcctatcttactcataaaatccccagttatgttcaaatgcaggttgaatttgagagtttgcctcctgccccttcactttggccaaatcaaataaacattctctgctcctaaaaaaaaaaaaa

SEQ ID NO: 13724 - DNA, 213 bp, Homo sapiens
  misc_feature (1)...(213): n = A,T,C or G
ctaanaaacttccttgtagcagtagggtgggaactgagggaggtggtaccagcctagtaaaccatagtcaagccctctggagaaggcaaaaataaagcatgagaagggagaagagcatgaaggttggctgtatggttacgacaaaaagcaaacaaacaacaacaaaaataataaatcatattgcctgcaaaaaaaaaaagaaaaaaaaaaaaa

SEQ ID NO: 13725 - DNA, 525 bp, Homo sapiens
ctcagagaacgacttttaaaaccctctttgtaaggaaggagcccaggagacctccagcacttttctgcagagaaatactcacagggagagactgtcgattgagatggggccagggggctgcctgtgactggttatcttccaggtcagcaagagggcaggggccagtgctacacagctgtcttacaaaagattttacttcactttgaaaaatctacccgtcttggtacatacgcagctgcttcgttagttgtgactctgcacagcatgaagtttatacccacctgctccgatgacagacaggcaggttgcttcaactctgttaccgcatatcactacaatgattagtctcatttaattcactagaatgataaactgaaatgtcactgagggatattcctagaagtgggattgctgggtattagacaaaaagctatgcaaaaataaaaactcaatgcctgcagagcaaaatctaagaactatattttttaagaataaaatcctacttttattccaaaaaaaaaaaaa

SEQ ID NO: 13726 - DNA, 413 bp, Homo sapiens
caccgttctaccatgggactactgtctgaacccctggaggaagtttgtgactgatgatcaccaaagcatgacctgagattttcgagaggcggtaccctctaagccagcaagtgacagatgcaaaaggaactgaaaaagaggcagcaaaaatcctactttccaatgtaacgaaccagggttcctctgaatattatcattcccttagcatttcaaggacttagtaataaccacaaccctccactctcattatttttaagtttgcttaatgtctttacttagataaaattgttttaaaaagaaagtttatatccctgccacaaacaggaacctgtataatttgtcttaaatggaaagtaaaatatgaaaataagtaaccattacaataaaaaagacattcctgtatgtactaccta

SEQ ID NO: 13727 - DNA, 394 bp, Homo sapiens
  misc_feature (1)...(394): n = A,T,C or G
tagacggagtctggctctgtcgtcagcctggagtgctgcagtgtgatctcggctcactgcaatctctgcctcccgggttcaaatgattctcctgtctcagcaccctgagaagctgggattacagggagtgcattgaaccccatggcagcattgctgatattggatgcctgctctttctctcaagaagctacagtgcggtaattaattcattgttcaaatttcagagcaggccaggttttaatcccctctgaaattggttacatatgtggaagtcatagttctccaccttctaattgcaacagggagataatacggcattagtatcgcaattttgagcatggcattgggctggaaataaatatcatttaagctttgaaaaanaaaaaaaaaaaaa

SEQ ID NO: 13728 - DNA, 218 bp, Homo sapiens
aaataaatcgaaataataatgctatgttctgaatacaacaatagctctgcaccatacttactactgttttatagaataactaaagaagaaggaagagttatgtgccttatactatgatgaagaaggacacccacaccttacctaacatgtacattaacacctgcattggcaaaaacctaaaaaataaaatatttacttagcaaagaaaaaaaaaaaaa

SEQ ID NO: 13729 - DNA, 396 bp, Homo sapiens
  misc_feature (1)...(396): n = A,T,C or G
cgccgggcggctggttagtcgcgttggccgccctccggggtgtgacatacgctcacacatcgagccgaaacgctcanncccgccacctcgacacacactccgccatataccaaaagtgctatcaaaccgatctcgtaaattcaatacagccggcttaccatacgaaaaccgccatnccgccccctcnaccgcccctnctctctcccttccctcccgccccacatcactaacccaacctacacccatnaacccaccacttacccttcactcactcacacccccactcactataaatccccatnccaacnactnnccntctnnnncctctaaaancccctcctnnccctncannncaactcctcacnccctnnnccnccccccctccntacctttcct

SEQ ID NO: 13730 - DNA, 850 bp, Homo sapiens
  misc_feature (1)...(850): n = A,T,C or G
attgagacactccagcagttttcatgatgctatggatggaaaggagagttacacaaatagatacaaggagaagacggaaatctgcaacccgaaggatggccctcaccagaatccgaccacgctggcaccttgaactttgactttcacccatcagaactgcggagtctcgctctgtcgnncaggctggagngcngggacgcnctcgcgggtgatggctgggaagacctactgaagtgaggtcctggtcggtcgtgttgctgtgccagaggggggtgttgtggggtggcggaggggcgataccgtggcttcttcctggtgtattgttggttttggtggtgatggccgggattaggttggccgtggagtgggtccgttgcgatttgtggggcttgcagggttgctgacgtcgggctgaggatggtacggtgggtcgcgaggttttgagtcgagggttttggttcgcggggttggaggttgtcctggtcgctatcttccgtggttgcgggtttgaggagatgggggtgtagtttgtattgtctgtcgcgttgtttggtgacgcgcggcgttttgctagcggctaggtcggcccgcgccggttatagcctggtaacgttactgcggtgttcggccggttacgtcgggactggtgggttcggggttgttctttcgagtgtttgacgattgtcgggggtcgctggtggtgcggggagcgtgcgtggggcggcgtgtggcggggtgtgatgaggtgtgggcgaacgaactgtgggtgggttttgtgtatgatgtccggtctgctctcgggtttcgggcgcgtggtgtagtgcaggtgactcacatgtattatgtgtgg

SEQ ID NO: 13731 - DNA, 724 bp, Homo sapiens
  misc_feature (1)...(724): n = A,T,C or G
gagatagggtgattctgggtgggcgacaacccgtgggctaagggtcggtgtgtaatacatctgttgttactatttaactttatgagtctggcgcctcgatactctctgtgcgcgagatatgcggaataccaccataaacgggaagtctctggacataaaagctacatccgagactatctggaccgactttnttcttccactacatataattaaaatagatatgaccttcttgnacaacaatttaattgaatctcttgtccaaaagcggttgattcagtagttgtgacttcctcactggaatataggcgcattcggccatcataaggacagacagtaatanccatgatcaagttcttggccagtgtttcataaatcagaaggtcacccaaagtagggaagtcagagttgttaaaaataaataattggagtggccagcacttaagctagggtggctgtggcactttaaattgtgacatgtacaaaccaaagcttaatgtaaacagtaaattgaaagtagaaaccgcgccaattagaaaccaccatcaaacctctaactaaggactttccactctaatcaaaattgttctctttgtcttgattctgcaaatgctttataaaagtttctcctttggtttcttccagcagagtgctaggtccttttaatctgttgcttccctgatttatgaattgctgaaagctcaaataaactctttaaaagttaaaa

SEQ ID NO: 13732 - DNA, 1428 bp, Homo sapiens
  misc_feature (1)...(1428): n = A,T,C or G
aagtanattttcacgtacacaagagttagtagtgaaggaagcaagtagagtgacgcgtatgagagtagtgcttanctatataggaaaacagacagccgatgaagacgtgtgtcattagcgcagtgatactttcgacgatgttatggtgtgtctctgtcgcgtgtaggtgtccggtgtcgtactgtatatatananaggaggtgctgcacagccgcagcgacttacgctggatagtgatctctcgttaggtgcatatcgttagtcaccctatctaatagcagcgagcggagtcngtcnggcagcgcgtgcatgatatgcagatgtgcgaggtcagagcggcgcaacgacctagctgaagtatgatagtatagctagttagaacagatatatactcggtattctctacaatgtcanacncactactataacanatcttgtgctcttgtgtgcgacgtgtggagaggctgtgtcatgatttcatccgatgcactcgatctacacaccacataaaagagcataacgatctactcatagagagtgtgtagtcgtatgtttgcgctctgggtacttacctcgcgatctggtgatgtcgatggatgtatgcttgttgctgtgtctctaatcgtatgacgacacactcgcgctccgagtctgatcggatgagtagaggcgttctgctgcgctagagagcgcagtagtgcgatgtctctatccgagactgagtagcgatgctagtgtctatgataattggtgctcgttgtgatatctctcgctgtgtacatatatcgttctgccgaactctccaatagtagacttagtcgatgtaacagtagacattaacttctcacactaatagatctcatcgcaagtgaacgctgtaatgctactgctatataacagagtcggnacaacacgagcagtgatcagcactaacatcacgggcagattacttccacgcganattcctctaagctgtactacaagtactcgcctacagtcacacctagancatgtatagagacgagatgacgncacgacccgntcgttatcagtcgtctcgacacatcatcagtcatccgcgcatgattacggcatgaataccaggtctagtgttntnatgtctcgcgctattcctcgatacgattttgtatgatgcttctcatgngaccaaacgatctcgaccgcttccagacgacaggtgaatagaggagctacaagagatcgtaagatcgagaatagtactgcagncatatgcgcttgcgacgtgcagttaagcgtggtgtctgtcgtgtggtaatnattctntcacgttaccgtacctgatttagattatcagcacagagagcgcgattgtgcgaggcgcgcatgtgcgcagagactaatgacagcgtctcgtcgctgagtgaacgttctatatgagctgcgtag

SEQ ID NO: 13733 - DNA, 667 bp, Homo sapiens
  misc_feature (1)...(667): n = A,T,C or G
ttgttggttgacgggtgcagctctctgccttctgccagggtcgcatctcgtgtcgtctgtgatcttatctccggcggagactcgtcgtcgttgtggcgggtggaggcctactcggagtcgtctctatttctgggcctggcgcgtgcgtagcggtgaccgggcgccttatgtacgctccgatccgtgtttctcgctggtgctgctcgtggcacggagcccgcatanatagggcctccgggcgcgccggcgcggcggcctcgggcgagagagaggggttagtcctcttgttcctggggctgtattttggcccgtggcccctctggtgggagggaggggggcgggggagggcggtggggtgctgggggaggcgcggcccgtgcgctctgcctgccttgctgcctctccgtggtgggtccctgattttntcttgtcttgcttttgcacataaggctttatacggggagcgctgtttcctgtcgcttggcattccatgatgattgtggagcctaaagtaatttttggtggggatgaatctgggcccgccgggctgttccgggtgccggtgtcgcggacgggtggtggggggtgggggatggcgatggtgaggagggggtgtgggtaggcaatccagggtttgggctactatttacgtggcggacgaaccttt

SEQ ID NO: 13734 - DNA, 305 bp, Homo sapiens
  misc_feature (1)...(305): n = A,T,C or G
ctgntcatacagactgggacaccttgaggaccccctcatgggacacctgccaagactcaggcatcatgctagagtgtgcgacagagagctggactgatgtatgaggacaaataaggagctactctatttcctgctccaaacaaacgaggatggaaaaacattcacaattcaggcttttcttcactgtaacatccatttgttctgagggaggaaatttaagagctgttttgttcctttatttcacttttcttttacttccctctcaccttcattattaaagttgctacatcctaaaaaaaaaaaaa

SEQ ID NO: 13735 - DNA, 167 bp, Homo sapiens
gaaatgcagataattgatataataaagttttataaatcgaatataaatctagcaaaaagagctttttaaaaagaagtcttggtatttacccatctggatgctgcttgaaaataaattgtcctccaaagaacagaaatacggtatgttttctctcaaaaaaaaaaaaa

SEQ ID NO: 13736 - DNA, 326 bp, Homo sapiens
ctggtctatgaatgagcctgagattctgaatttctggcaaacacacaggtgatactgatgctgctgctctgcagatcacgttttgagcacaaggatttaagacacctggaaaagcctccaggcactggagtgacagcacagtggctccactgcatccaagggactccatcgttactgttaagtgatgagaagaaaaattttaaactccctgacctcaaactctccatcttttaagaagaaatagtaataatagtgactatattgttgtcatgaggattccatgagttaataaataaaattattttacaacactaaaaaaaaaaaaa

SEQ ID NO: 13737 - DNA, 226 bp, Homo sapiens
ctgacactagccacgtgggactatctgacacttgaaatgagtctgatgcaagttgagatgtgctagaggcatacaacgcatactggattttgaagactgaacatgaaaaaaacaatgtcaaacatctcatcaatattttcatgctgattacatgttaaatgacaatatttatttagatattttgagttaaataaaaatatgctattaaaatttaaaaaaaaaaaaa

SEQ ID NO: 13738 - DNA, 170 bp, Homo sapiens
taatttaaaatttataaaaataataatgcaatagaaaaaaaagattttgtaataaaggagctctcttgaaaaaagaagtcttggtatttacccatctggatgctgcttgaaaactaaattgtcctccaaagaacagaaatacagtatgttttctctcaaaaaaaaaaaaa

SEQ ID NO: 13739 - DNA, 806 bp, Homo sapiens
  misc_feature (1)...(806): n = A,T,C or G
cctagntggctaccgcattatggatcttgcagtcagaacacaaattgtcagtttggctcatcacaatccctgaagagcccagtgaacacagtgacctgttttcccagccatctcacaataaaaactaaactgtgccagcttttttaaggaacattctagaaaaagtcatggtataacctgccagctcagttccaggaaaaagtattgagtgaaatgttatgtgaagacattttttctgttgcatgattcaatactgtgatggtggggatgacctctaaattatggatggtgactacaaccacacatgccctcctatcaattctctagctagcttcttgactccgatgtccaacaccatcatgcttagtctgtaagaatattctactgtttttcttgttaatattttcaatgttagcatttgtttttgttgtctttaatgtattttttatatatgtaaaatacttgtatgattaaagatcaaaactattgttttaaacatactcatacaagtcttgcaaacttgtctaccctgttcttatccataatttttgttagttcctagtttgatattcagatatgtgtctaatgtgtggatatattcttatttccccttttttaatgtaatgtacacagtatatccctgcggtccctgctttgattgcttacaaatatatcctagtgatttcttcattctcaaaaaaataaaatacgtgtgcaggagttcttactagagtcgttcgagtgtgtttgaatcgttgtctttcgccgtctgcccgcaaccctaggcacactattgtcgaacgtgt

SEQ ID NO: 13740 - DNA, 674 bp, Homo sapiens
  misc_feature (1)...(674): n = A,T,C or G
tgtttgggtgtgggtgtgaggtcttcgtctttgactctctgcctttctancctgggcttgtggattcaaccctttgtgtgatttttcgtcgttggtggggtatggggcgtggctttgtggggtttttttctgctggggggtgtgttggtgttcctctggtatgttgcctgttggacctttctggagtgtggtgggggggnggtggtcctgtgggtggctggtgcggtagttggctgttggggtcggcggggggtggtgtgggttcaggtgtgggggggtgggtttcggtgtggggatgagtgcggtggggctgttccggggggctgggttatngagttttgtcttcttttgggtgttttggctttgtgtttttatgtttgggggcttggtgagcgtgggcggagttgtgtctatgcgtggcttttaatcttattggtgacttcttaactgaccttcctctttagagataagatganacatttttgtgttccgggtatctgttctattcncttctttctttcttgttgtgttgtttttttgctgggttttttgggtttggcgtgggggtgggggtctcggtgttgtgcttgcctttgtttcgccgcggcattgctgcggaatggcaggatcttgtggtggtttcaggagtataggtgtaaaattataagtgtatt

SEQ ID NO: 13741 - DNA, 303 bp, Homo sapiens
agctcgttcccgccccttcgccccctctcttgcgcgccgctctccctcgtgcccgtgccctgcgcccgctttcctttttctccctcctttcctccccccccttttttctccccctcctttcctcttccttcttttttcctccgccgctctgtctttcctccttcttttctctcgtgggggggttgctgtctttcttctttgtgccttggcttttgcccccggggtctttcctggtttttggtcgcggggccccctctgttgggtggtggcggcttcgcccctgccgcccgccgggtggccctg

SEQ ID NO: 13742 - DNA, 637 bp, Homo sapiens
  misc_feature (1)...(637): n = A,T,C or G
tgagctatgatcatgtcactgcactccagttggggtgacagaacaagaccctgtctctaaaaaataaaaataaaaaaatccattggcctagacataacaatttcatggttagttatatagacaaatatataaatacacacatacacgttagccaaaaatggtaagttcaagcagctgtaaaatgaaatgcaatcggacattttacggcttgtattttaaggccctggctcagttcaatctgtcttctcactggttcctgcttctctcttctttgttctacttctatttctcaccatgttttgacaggtgaggttgttcatgcaaagggatacaacaaaaatacaggaatgccacctttgtctcctcaaccaggacagagcaaccctccctttcctccttgcaacaaagcaagcaaaacacacattctcctaccgncccaccatgaaacagaggcacgaatggcagtgatgctattggtttgcttgcagggagggaattttatgcaatcaataaatcacctggcctttttgcccaggatcagctctccacccaaacccctgtgaggcttagtggtagaatacttaaagcttaaccagcacaaacatgttacagcaagaaggacagcgattggatttgc

SEQ ID NO: 13743 - DNA, 1076 bp, Homo sapiens
tctcacaataaacatcaaaaatcaaaaataaaaaaaaaaacttatgcggaacatgcgcgatgtttcttggctaccgtacctatgcctcttaagttaaagcgattcttctgtctcatcctcccgagtagcttggagattacacgggtgaatattcattgaaacagcactccaaatgaaacacaatatgtatgagtatagactcgttgcccaagatggtcgagtcatgacacacacaagttaagcacctgacacacatgtaaatgcagtagacgacatggttggcatgtagtctcaataccttcatagatacacaatctgagctcgaaataagccataacagtatgtgaacctatcacgtcagaaaatatagtttccatgttttctcttgttactgactgagcatatttcattaaatattctcaccatgtaggctagtaaacatgatagatccgatagcgattggatgactaaatgctcttcgtcatctaatgtagtagaaaccccaactctcgtctccagagacctattacgccctaacttaataattgttgacatgaataataacaatcctcgtactattatttatcacacacacagaaatcattacaactgcttatataatatacacatgatctcaatatagcgacatacaacaaaacaaatattgacaataaatattctaagaaacacaaacgctgaaccgtcgacttcttataacatacgtaatattaataagtaaataccttcaagcataatcctaacaccattttcttctgaatcactaccgtatatctgataattaagctacaaatcatcaatcaaatatctgcagtaaataacaatatagattgagatattataaactatcttaatacatatataaatagtatactttaatcatcaatcataagcaacaactaccatcatacacttcatcatatcaccacaagatgtagatactataaagtgatcagagaagagattatctctacgtatactgataaatagtgtatgcagtattgtgaaatatggcaatcggcttaatatacaccttaacacttaaacaaaacacacta

SEQ ID NO: 13744 - DNA, 612 bp, Homo sapiens; identical to SEQ ID NO: 7394

SEQ ID NO: 13745 - DNA, 1022 bp, Homo sapiens
  misc_feature (1)...(1022): n = A,T,C or G
ttactgtgcgtcttttggtccttgggtactgctcaattccttatcccacaggaacacgtcaggnacattatggttcgcgtctgtgccatcactatccacggcggaaataataggtcgacttgagaggttgagatttggcgtggactgtgagttggacttcatcgtttagacccgggacccgaatcgtgggattctacattatagaagctgtagctacatataaggacacgaaatgtnngctaccgacgccactactgcggaccctggctcctaggccatgagggataacgctccaantaactactccctctcgtaatatcctgacaactaatagtatctaccataaagtaaacatagagattactataactctcttaactctttgatcttgctttcttctttatatatacgtaataagctcatgaataatatagacaatataataataattaanacaatatatctcttccatcttctgacttctcttgtcagtagtgctgtcctctccatgtgctctcctcgtctagtccacttgcacgtgttcaaacactgganaccgtcataatgagatattgaagtcatgctagtgatatggcgctggtatctaacgcttatgtcggatcagagcacgaactagggaggatatgacaaagagaaaattatatataagaagccatcatcngatcttcactatccgtncatctttgctctctctacactgttgtaaactttcgacgtnnacttctctatttatnaactctcaacataaatttaatattatataaaaataaaacattttttttatttctctttttgatttattaattttctacatctatcattcttatnttatatttaattaaatgataaatatatgtnttcaatatctatatttgctagtttaatannttcttattttttaattatataattatcaacttccctctaaactacaaacacaaaactataaaanatagttcttctttgcacaaaacacgntatattgttnccaatttaaanaa

SEQ ID NO: 13746 - DNA, 390 bp, Homo sapiens
ctaggttgcctgtgctgtatggaagacagttgactttgctgataggaaacgtctcattgcaccctctttccacaccatcagtctgacctggacccattccaaacactacggctttgctggcagaatggtcttcctgctacagaagttttgtaatctgctaattgacaggggacatcgtctcactatattgccccaggctggagcaaagtggggctattcacaggtgtgatcacagcgtactacagcctctaactcctgggctcaaacgattctctgcctcagcctcccgagtagtcaattatttttttctacaggtgggctgaggacagaaaaatcctaaagatggaagtatcattaaaatcgtgctgatccagttgaaaaaaaaaaaaa

SEQ ID NO: 13747 - DNA, 1414 bp, Homo sapiens
  misc_feature (1)...(1414): n = A,T,C or G
aagcagtatatggactctctgtttatcatgccgtcanacactctagactgancgtctccgtaccgatgtgcgcggtcggcagataattgancacacctcgatagagtagtacgagagatatagatataatatatacgcgtgcatctcgtcttgtgacggcgcgatcgagactcacgtgtcgcaataacttggaggtggagaggcgtgcggggtggcctcgtctcgacgactgagatangtgngnngatgatgctagcgcggaagtgcttatatagtggtgttgatatgttatagtatattataaatagatatgcatatctgaggnnatactgaggttggnttatactgctgtatatcagtggagacaccgacggacgacggtatcgaccgaagccgagnngcactgagcgaccatcgcgccggtcgcgcgcgagcaagacataaccaatacacgtggcgctagaaatcggataacttcacacgttgaaaaacatagaaactgatatcataggagggacggatgcagatacattacgaatagggaacaagccagcatgacgaggagggacaggtagtatttagaataaaacatcgagtgacatacatgtaaaagatgatagaaaataagaagtagggagacgtcgatatcgattgtatgaacacgtgagcgcgagatcactccgatgctggtcgagctgtatgcctagcggtcaatcccgtggagggagtggaagtgcagtgagtggacagaggagcgcaatcattggccacggtnaagactatatattataattagctgatagcgctgataatcaacatcattccattctcctcactccaatatatatattaaaagacatgatagatagagcctagactcttagtgagtngtagcatttattatttgagtgtgtaccatattgcacgattcagtgggtatgctcggagatnatacgttacacgtccaactatacataactactcgatactaacacaagcactcaaatataacagaacagagataaagacaagaaataaccaacaatcaaagagccgaacacctcatcaccgaagacgacaaccgctaaacaacaaaccttcgactgttttgtttggtgctcatttagttttcgtnattcgtaattagttctagatgtnactatcggttctcggtaattagttcatgcatanaaattactnacatataataaatatccttataaatacataccctttaacgttcnccatctnccactctctcctcttcttttttccttatttcttcctttnntcaaaaantctnnnntttnttttgttttccnnttntaaaantctttnctttnnnntctttnnntnnntcctttntcttccttnccttnnnntnnctnnnnnnnttnnnntnnccccttttttt

SEQ ID NO: 13748 - DNA, 561 bp, Homo sapiens
  misc_feature (1)...(561): n = A,T,C or G
ctgagattacaggtgtgagccactgcgccagacctagacttctatctacttaccccaagtacaatgtcggcattgcttcattttttacctttttgttaatgagttgatattttgtgtgttcgttttctatttcattttatcctctattttgtagggccatttgaaggttttccatgaatatttatagtttaaaaatcataatatttttgtatttctgacatagcactgactntttgctaacattgtttttctacattntatttcctccactagatttggaacaatttgaaaagggcaggagttatgtctaatctaacattntatatcacacagtgttaatgtcttatgcatagtaagagctcaatttttattttcaggctgcatttaattgtttgaatggtgaaaataagtttaataaaccagtaggggtcttttaacactactggaacatgtatttgcttattttttctttaccataaccgganaaataattattttaatttctggaagcctttttttatattatcttattaaccggctgaaaattaaatggtctttata

SEQ ID NO: 13749 - DNA, 224 bp, Homo sapiens
  misc_feature (1)...(224): n = A,T,C or G
gtcggtttcgtncactcganccnggncctcctntggngaaacngngatttgcaggaggagagatggctagagaaatgatgagcctttttaagagtgaaacctactaatggaaccaccacagtcatagcgtctttttatttttcaccatggccactcagaggggggaaaaagcatattcaaaacaaaaataaacgattctcatttaagagacaaaaaaaaaaaaa

SEQ ID NO: 13750 - DNA, 779 bp, Homo sapiens
  misc_feature (1)...(779): n = A,T,C or G
agatcaatgtagatgaaagcacgaaaaggaacggaaaggaagtcgcgctnagccacacagtagagggcgacncanagagnnccactccagacnngcattcgccggggaggaacccgcagccaaggacaaggcgagccagagaccccaagaaaggggcagcaccccgcccaggaacacggaaaaaaagcacaagacagagaggcaggcccagcggaagaggcaccacggcgacaaagagcagattttttttaaaaccagactactctactatgtacttaagattgtactcaattagtctatagtctaaggaattgttttttagctatgtttactttgaacagctctttttctctgatgtattttatttttggtgtttttaattctaaaaatttattacattatatttttaattaaatttttatcattttatttttattttatttcttaattatattttcaataaaaacgcgtcgaaatcgttatatataatataaatatattctatctttgtttttttttaacttattatttttattcacatagataatagttttatttttttgtttatatgcggttatgtttgttagtaatgtaataactattatgtgagatataagtgttttatatgtcatattatatttttctcgtcgtgtattagtagatttaatctttagtgatgtgtttttctgacgtttatcttttgttttgtacgtcctaaatatattcttatacattattgtattttattcttttatttgttattcttattttatttggcg

SEQ ID NO: 13751 - DNA, 844 bp, Homo sapiens
  misc_feature (1)...(844): n = A,T,C or G
ggaaaagggggaaaaagaanaaaaaaaaaaaaaagaaaagaagnaaaaatgaaagtttaaaaaaacaaagaaaaagttaagggtaaaacaagaacagaaagagaaagaaagatagaattttgcagtgggagaagaccgccaaatgagtttagtttcttgcttttatagttcttccttatcctttttctatttctttttaatcttcatgttattatgttcgattgagtgatagtttcacctacacacaccccttacaaaaaattctttgcatcgtgttcgtttaactatcggccccacggccagctgttgagtctttatttgccaacttcttttctcttttatccctcccccttagtttctgatccctatccttcatcgatcacacagcacattccctcctacccccgattcatagcccccgtgtcccaccccgtctgcgccccccccctctcccccccttgtgttctcctgttctttatctgttctttcaaattaatatagtagatgtatttattatttttgttttttattttttggatttttcttcttttttatgaaaagtagatattgttatattgatttttatatttttgtttgtgtggcctgagagaaattaggggttgttcctcttaggtactacacctcgtatttccgtctttcgtaccctctcccatggctctgtttatctcccttgccctccctgatatctcccccccgtcagcttgctccctactcgtcccctcggtcgcccgggttgtttcaggtgtcggtggtgctgttgtttcttcttatcttcatgtctcgctcatctctctgtttntctctactccatgctttatatgct

SEQ ID NO: 13752 - DNA, 810 bp, Homo sapiens
  misc_feature (1)...(810): n = A,T,C or G
gagatcaggaatgaagaaaacacaaaaaaaaaaagcgccgccctcatgggacagatgaaccttanatcacataaataagaagctcctgactgatcctgctgctgctgttgccccaggaatcacactttgactggcaagctgctagacaatgcccccatacctatgaaatcactggactggaagggactccagagaccacatttcctgcttcccattgaggacagtaattcttcctgcagcatttctgatggtgggacagggcctgttttgcaccaggtgctaagtagatgttagctggcctgaaataaaattattttccaggaacaggaagctcttctggtacaggcagctctctcatggatagaaagctccttctgttgagccaacacaggctctcttaaagggccacccactggccttggcacaccccacaccgctccatccaccgggcactgtggcaaagagccaaggtctaacaaaatgtttgcatcctaaaaaacaaccaacatgaagacagaaaagattgactccggaaaataataaatggcacaatcacaataaatgttaactgtctgcaaaatgtaacacttgccaaataggcaatggcaatgtgactggtatgtagtaaaaaatagattctatttatttgagggaacaaatgcattttaacatgcttttgttgcctggtgtggggccttcaaagtaaatgggctgtggaccttaaagattttaagtgacctggaccactttcttaaacttaaaatatagcaatcggaacccccaagaaacccttcctagataaaacacact

SEQ ID NO: 13753 - DNA, 316 bp, Homo sapiens
  misc_feature (1)...(316): n = A,T,C or G
ccttagagtgcactttagccttgaggtcaatgagtcctacgatctcaagatgtggcataaagcttcttgttangtgnggttcaccttccacctcttttattgagtctaactcaaggaaagctgaagaagtgacaaaaggacaagttttgctcagaagtacaactatttccacctcaccttcttgtgccttttccccttgttgactgatgttcacctgcagttcctttgtttttattatatgggaaaggggtgatttctctgcctttacagctatgtactcgggatgcattacacttttctctgaaaaaaaaaaaaa

SEQ ID NO: 13754 - DNA, 484 bp, Homo sapiens
actagggacttcatttgcaaggggatccacctcgtcagtgctgagcagggggaggcagctgcaacccaggttgctatggcaatacctggccgatggagcgtggagccatgtctgcctagaaacccagcccgctggggtgggccgccctcatgtctgtggcagctttagggtaacacaaggacttgtccatatactttaggtgtggtgagccagggagctgcaagctcccagggaagccaggcccctggcctgtggtcctcaaggctgtatgtgtggctctctgacaaacaagaacaaaacatctgcgcttggccattagcgaaccatgaacaaatacagaaggaaggtgaagacctgagatcaaatcacttgctgagtacccagttgccccaaggagagcaggcagtggcaaatgccccaggctgaatcctacccccacctgcttttgtaaataaagttttattggaacacaaaaaaaaaaaaa

SEQ ID NO: 13755 - DNA, 541 bp, Homo sapiens
cttaggtctaccaaggatgggattatgcctgcccacttatggagagcagatcttctttacttcgtctactgattcaaatgttaatctcttccagaaacacccttttcacacatccagaactaacgtttcaccagctatctagaaaaccaatgcaggagcttcccttcattggtcttttatttgtataacatgttacttgaagaatgagtcaactcacttgtgaaatgttagaaaccatggctcactattggtggtaacgtttgggtgaagggaagcagtagggcagaaattactcattttttcctcagaatataacttctttgctatagtcacagtgtgttctaagtggtccacggtacttctagtaatgtgcttttccatttgataaatattgtaattgctgtaccttctcctccttccttggcacacattctttgtgcagcttggacttacaattttaatgaaaccacattatactgtactaaaaaccatttacctttataaataaacactgaacttagctaatggaaaaaaaaaaaaa

SEQ ID NO: 13756 - DNA, 447 bp, Homo sapiens
gttagagattgggtttatcatgatggccaggctggtcttgaactcctgacgctgtgatccacctgcctgggtctcccaaagtgctaggattacaggtgtgagctaccgtgcccagccggcaactagtgttctcatgggagaagaagactttttggaagaccctgtcattgcgtttgtgagactggctcctgctgtcctcctctcaaagctatctgaggtttctgttgctatgacataaataattagttccaattattctctcagtaggttcaaaaccaaaaatttttatctactgaatgaacaagaatactgctttatgtaataaaaactcatttaaatttttaatattcagtcattataccaaatactttgagtattaaagcataaaaaattatctttctttctggaaccaaacaatgaaataaatatctcttaaaaaaaaaaaaa

SEQ ID NO: 13757 - DNA, 461 bp, Homo sapiens
ctcacggctacagataatctgatatttcccagctcttttacaatggggccttatgactgagctctggccaatggaatgtaggtgggagagatgcatgcctggcctggctcatagaaaccttcctcatggcccttccttctcctcccttccaatgtgactcttgacggtgacatgctgaagatgggcgtgcaacctgggtctttggggatccagttggagaagagtgccctgatccactttggactatggtgaaaggaatccaattttaatgttgttaaacagctgagattttaggattgtttatgttagtgtgagtgtagaagctaatgttacttttactgactaacaaaaacacaaagcaaaaacagatgtagcccctgccttctcagagcctgaagcccagtgggtgaaagagacattaataaaataactacaaaaataaaagttgaaaaaaaaaaaaa

SEQ ID NO: 13758 - DNA, 275 bp, Homo sapiens
cgtcagggtaatcggtccagcagcattcaggcagtatcacctcctcagtggcacgagcaccaattccatgaggcttcttctccaagctcccagattctggtaacctcaatcttttcctttctgttttctggatggagaggtggtatctgtttcctccggatgaactcactgttctctttgtcctttcagccctccaactcccatgtaaccaattctccatattaaattcccttttttaatttaaataaattttattgtgtataaaaaaaaaaaaa

SEQ ID NO: 13759 - DNA, 172 bp, Homo sapiens
cccttgcgcgtgacgaggtcacacacgtctgtgcccgagcctgtgatagagtatatacaacctcagggtcaagactgaagatattggaagagaaggagaagccactggctcatttcccagtttttccatttttattgaaaaaatacaagtatctcctgcaaaaaaaaaaaaa

SEQ ID NO: 13760 - DNA, 856 bp, Homo sapiens
  misc_feature (1)...(856): n = A,T,C or G
gtggtttggagttatagtnnnnnnnnnttttgcagccacattggcactcttgcaaggaactaggggccacacttttcttgcaaaacgaggcacaaggagctgaagatgntcaaggagtgttttagggtctggaaagccaagatcggctggaaattaccaactgctttcctttccctcagcacacagaggatgatgctggctttgatgaagtccaatatcagatggaaatgatgcggagccttcgccatgtaaacattgatcaccttcacagtgggcttttttcagtccacgtactatggctcatacatcacccgggctcttttgttttctcatagtaaggaccagcatgccattagaaaatgtgacgctcgcatgcatgacactataacttgtgcctatggtacactcgaccgagtggtaaacggaggggacgccggcgccgaggggaaaataccaaatggaaggttatggtgcggtgggtagggaggcgacggggttctccccgggggttgtcaaactctaagcatgtcgcgggtggggagggcggggcagatgcccagtgggggccgccgggcagtcgtcggggctattccgagtgggtgcagttagttgtgcctcctactttctgttcctccccattaccccgactacatatatcacattgagagcgtcgtaagtggagacgacattggtgtcggcggtgaggcgcaggctctcactgccgtgccggggtgggtccttggtcgttcccgttatttatccgcaattcgtcgcttcgttccccgacgatgcatcgcgcggccagtgtgaccgggtggggggtgcagagaggcgtgccggagcgtgagcgaaggat

SEQ ID NO: 13761 - DNA, 1662 bp, Homo sapiens
  misc_feature (1)...(1662): n = A,T,C or G
aaggaaataatggnnnaagaaaanaannnnannnnnncanaagcgnnnnaaaccgnnnnnngaaagagnnaaaagannnnncnagnggnnnnnaaaanannnnannnnncaanntnnaagannnnntaaaaccgtnncaanatccgnnanacgaganantatnnaagattgtaaatagacnaaggnnnaaaaatgaaannanatattgtgatntaaaggagtaaagataanncggaanatcacatcaagnaaggcaaggtagaggtatgcctcaaagataaagaccatcgacgattatatactaataatgtatgactcacgacgtgccggaggtgcgtcgctcacagctcctaccgcagaagatactgcgcacgttagggtgcgcatacagaaactaaggccactgcgcggcagtgccgcgcgtctgtgcggtgttgcgcggcgagtgtggngctgctactagtgcgngcgcaggcgaccctgtgtggactcgcagcgagagcggcacagatagtgcgttgattcgaatntncaaaccacgtacnacgcacaaacancncaacctatatttgaagtacgtaattacgaccactcagatatggcacgcagatagcgtgannncntanacgtgtgttgtgcacangagtggtagttagngcatagtcggncaagatattaattannnaagagacgagtagctangactacacgcgctagatcgcganangncgacgacgncactagcgatgncgacacggagataancacagcgaagagcatagagacggaaggtcgtatgcggagcgaccngtcatagactgcgtcaccctcgtagcggaggggatangtgcactaagcgcgagtcgtcgtagacgcntcnacgacattgtatttgtcttcgttcttcttcagtcatcaatatctgtaccgttgcgcacacggtantgtntagataatatgatataagnagtaatcgcgtgtgcagtgntnaggcattagacgtggatanaagtagtgagtatgacgattacgagagatgcagangacgactaanagatggtagtgaangngatgantgatacatgngntgcgnangtacgtgaggtgttgtgagttaagatgagggtaggggtcgcagacatatatgtgagtatgantgtgcggatagatntgtgtgtcnccantagatgctntactgtatagtcggtcgaatatacgtctcactatgtgtantagtatatcgacttcngtattgacgtcgcacctacgtcagatgtcgtcgcgcgtacacgctacagatgcnatgtgaacgcgcntacancctgatgtacacgtagtaacatgtagagtactcncccagctagctggnctatcgctctcgacacacgtatgcgtntcgctcagccctacgtgtgtcacagtagcgaacagtgnaccacagagcagtgcgctcnntccgcgtccacgggcgcncgctgcgtgcattgagatncgncatatgagagagagacggcgagcgtagcggtgncgtcacgaatgactgntgantactagcgtatgacgtcantctcgagataggacgcgacacgacgagcatagcacagaatgagtgtntcagacgnagtagagagnngatagataggtatgagtatagtgatgagt

SEQ ID NO: 13762 - DNA, 180 bp, Homo sapiens
cctaggcttatgatatatcgtctctcagcaagaaggaagagcaaagcagttgtttccgggagccttggaggtgaaagtggcacagaattcacagcttcttcacctgggcctcaaatgttcagtgtgacaaatgccaggagatagggacatggggattaaaaacaagcaaaaaaaaaaaaa

SEQ ID NO: 13763 - DNA, 407 bp, Homo sapiens
tctctactaaaaatacaaaaaattagccgggtgtgatggcgggcgcctgtaatcccagctactcgggaggctgaagcagaagaatgcatgaagccgggagatggagcttgcagtgagcggagattgtgccactgcactccagcctgggtgacagagggagactccatctcaatgataataataataatatgtgcatgatgtattgctgagtatttgacatgtagaaacgtaacatgtctataacatattttccagtaacatcaaaaaggaggtagttggaagaaaaatgtattgtgataaggtaatccctctagatggtaaagtaataattactaaaatgtattgttggctttgtaactttaatagatgtaatgtgtaaagtgataataccttaaaatggaggaaat

SEQ ID NO: 13764 - DNA, 1076 bp, Homo sapiens
  misc_feature (1)...(1076): n = A,T,C or G
tgttatcagtatgtagtgtgagtatgtgaaaangaacagagggctccttcaatctattctcacactgctcacacgcgtacgcctagtattcctacgactggtggcgtaagtgaacagaaattgtcgtctataactaaataatggtttctatcgttctgttacgggcgctagttacacacgagctctgccatcgtactaacggtgatatacgttatcgctagtattagactatatgcatacttgttcgtaccgtgagtgttcgactgcagatatcatctcgagccgtctcgttcacataatcttgctggnttcagatcaatatatctctaagtcgggtggttatcgacgacgagttgctgtagagtgtaggatgcgtcacacaacttccagtaacctcttgctcagtctacntattttcaggcgcttttctcggtctatcgttcgtcacgtatgatagcatagacgcgttcttgtctacgcataacagcccccacaagtattgagatgaatcagagattactccaggacggatgcgtgagtcgtcgtttggcaaggtgatcaaggtaatatatgttagatgacaactcctgtcgctatgtcgctgtagtcatttatgcacttgctcgtacctatccagcagataacaatcgctgacgctagtaactaacgctcagtcatgtgctctgtgagacgacctcactatttactagcttatctcatgactgccacgcagcggtctacaaacaagtgtgtgatgtattggccagcgtcacaatgctcncatgattaactagcgaggtactcatcgcgcacgcatgaaagggtgttggttacatcatctgcatagcgatctgcccttgtgttgctcggtaaaaagatgtttcacgtgatcacgtgacgattgaggcttccctgtactgtagtatgcnctcgagttgctatagtctttacattaaatatcatgttgctaatgtatcagtgcgatcacagtaatcgcgaccatgttagcgagtcgctctcccaagctgcgcacacattgacacggtggacggatcaggcgggttatctgaacaggg

SEQ ID NO: 13765 - DNA, 562 bp, Homo sapiens
  misc_feature (1)...(562): n = A,T,C or G
gnacccaantttttnngttttaanantcaaacccaccnccctccccntttcnatngntgttngncaaatgnaccngaataaaaaagnnngggnggaatanttaaggccggttttagntcncgaaaaancaagnntggaanncaattggtgttgntnttgggctcactnncaacctntgcttnatggattcaaaacanattctccttgcntcanccttccnnagnagttgngattaacaaggtgcccaccacccatgcccaagataagttttgtattttnagtaganacggcagtttntaccatntttggcccgggtggtcttgaactcttgaccacaggcgatccacctgcntcagcctcccaaagngctgggatnacaggtgtgagcaccgcgcccagcccccattgttgtcttattntaagaaattgccacagccaccccgaccttcatccaccaccacttcgatcagtcagcagtcctcaacatccaggcaagaccctccactagaaagaagattatgatttgctaaagttcagatgattgntagcaatttttagtaat

SEQ ID NO: 13766 - DNA, 836 bp, Homo sapiens
  misc_feature (1)...(836): n = A,T,C or G
cctcccgctctacgccgcngnctcccctcgatagaaagataacaaaggggggggnccttaccattggcaatcatgttagttaaaatcaaattagagcaactttcttattcaagttcaaaatggcccattaagtagtggagacacctcacaacatcaactatgcatttggcccaggaactgctaatgaacatacactgtagtggtggttcaagaagttttgcaaaggagacgagagccttgaagatgaggagcatagtggttggccatcagaagtcgacaatgaccaattgggagcaatcatcggatgatccttttacaacaacacgagaagttgccaaagaactcaatgtcaaccattgtatagtcattcggcatttgaagcaaattggaaaggtgaaaaagcttggtaagtgagtgcctgataagctgagtgaaaatgaaaagaactgtaatttggaagggtcggcttgtcttagtctatacaacagcggtgaggcattggcttgattagatggccgtgggggatgaagaggggatggtatctcaccactgatgctcggactgccaacaatctgggaagacctccctatgccctagcttgacctctgaccactaatggctgctgctaggggatcgtcagcattattcgcgtctccatcttcgccccaaccccccgctcctcttacggcgtcgcctgtgtgtcgacggtacaaccgggacttcgtaatttatctttattacactcggaagcgatcgttggaattgtgcgctagcttttatctcacccacaggtacctgtgttttcttttgctcttctcccggtctgtggcgccgcg

SEQ ID NO: 13767 - DNA, 557 bp, Homo sapiens
  misc_feature (1)...(557): n = A,T,C or G
ggggccagcaaccggcccatccaacttttatggatnntntanttaagacttgagcctgtaaagaaactttcacttgaaaaaattttaanntcaatcattgtcaataaatttcccttatgancantgcaatanactgatcaaatatttattctaatagaantgantcaaanacattaaatgtctggtagtcatntgtaggtgttgaagctacataccctcttagttacaaacccctgataattttctntnatttaaaagtaggccaggcacagtggttcacacctgtaatcccaagcactttgggaggccaaggcaggaagatcacctgaggtcaggagttcaagaccagcctggccaacatgatgagacccccatccctactaaaagtacaaaaaattanctgcgcatggtggtgggcacctgtagtcccagctactcaagaggctgaggcaggagaatcccttgaacctgggaggctgaggttacagtgagctgaaatcaagccactgcactccagcctgggtgacacagcgactctgtctaataaataaataaat

SEQ ID NO: 13768 - DNA, 820 bp, Homo sapiens
  misc_feature (1)...(820): n = A,T,C or G
ttccactcattgggcttnccacgatngaangnngnnnngccttcggnactcccagctgcacttttctatgacctacacattccatgtcaagtgttgatcacatcaaacaacgcatacgctacttcttaaaggaccgaagtccatcactcgatcctttgcgtctactagtacaccttgcatccttgggtcatagaactgcctgattattaggggctctgaaacaccattagccctgcatacctgaaactgagactctaaccgagccactacccgctcttctataacgcctgggcgctaggagaagggcacaggctcacaccttaactgtgatgttgcaccttacgagatgacatgctactctgttagagatagaacggcagataatctaatttgaaagggcctggtccgtatgaatgctgagatgaccaataaggaaccattgtcatctatttgagaatgctgaatgtaacaaggctatcttgtacctagtataaacttaaaaagatcccaattctgcaagcgggaaccacctttctactttgagcgagaacagaatacagagggctatatacccctcgagactgttgataggaaagtacgtggtatttgcctcagaaatgcagtctgtcttatgttattatgaaaacaccgaattttgttcatattgatacagagacaagctactgcctccgtggtccatgacgttatacactattaagtctagttattataaagaagtttcatttattagtcatcacaacactgagttcggtctattcgtgttctagactctgaaaacactttaaatccgatacaaata

SEQ ID NO: 13769 - DNA, 259 bp, Homo sapiens
  misc_feature (1)...(259): n = A,T,C or G
ttggcattcaatnttaatgacacacntnctacgnaatctagagtagtagcaaccatgaaaactggactgtcaacaaagaagacagaagtttgatatccacaagaactacgaagaaatcactaaggaatatataatctaatttgtatttgaacaaacaaacgctgaaaattcactgacttaaagtgttaaattatttccaaaatgtatgtaaaatagtttctatatatataaaataaatgcatgtaaaacaaaaaaaaga

SEQ ID NO: 13770 - DNA, 315 bp, Homo sapiens
  misc_feature (1)...(315): n = A,T,C or G
tgcaaaantatataacactataaaatgaatgaagtacttactgaccaatgctacaacatggatgacccttgaaaactacgctcatgtgaaagaagccaggcacaaacaacagggagaagatgcggagcagctgctaatgggtaccatgtttctcgctggggtgataaaaatgctgaacacttacatattgtggatggttgcacaattctgtgaaaatacagataaaaagcaacccactaaattgcaccctttaaatggatgaattttatagtgtgagaattacattttaataaagttttcttacaagttaaaaaa

SEQ ID NO: 13771 - DNA, 209 bp, Homo sapiens
tcacattcactacgtgaatcacccaagtcactgcgtggaggacctcacagctcacccttgaggagtgccgctgactgaaccattttctaagcctaggtggcatcttggtgaaaggctttctctgccaccagagctttgtgtccgcaacttactcaggcaaagtggagggcaatgtcaataagaatttgaaaaaatcaaaaaaaaaaaaa

SEQ ID NO: 13772 - DNA, 626 bp, Homo sapiens
ttagaaacctggaaacagcatttctggaaaacgattctttgtgtacctcccacactcctggcatccatccttcaaatttccattctgaattccaaaactacaaagaggtttggccatgttggctgactttggaagatccctccatacaaaccatttcgcctgggtacggagaaatgatatcatgtcaaggtggttaaacaggcacagaattttaggggataaatatgaaagcatacagacaaaaacatacagacatcacccacagaactctacagggaaaaggcagcatgggatggcatcctaggaaagcagcaacagtttgagtggacacagaattctatttttgccaagatttgtaatttgtggcagcgggacatttatgggaacatgtcatacagggacaccttggcctggaaatcatctatttataaaacaggtctaggtttaggaccaagaataaggcaatccccgtacctttggcttcctgagaactttcaaattacttcgcctaataatggagaagctcctcaaagagctgcagtgagttgatcacttggctaatatttataaaccaagaaaatccacatgctatgaaaaaaaaaaaataaatggcctagttggcctca

SEQ ID NO: 13773 - DNA, 830 bp, Homo sapiens
cttaggaatgcaaataccaatggctaagatgaatctcagcagcagatccagttgaaaactcggaatattattatgttttaagaagctgtcaccaggaaaaaagatgatcttattgttttcttcaaatattggcattatttatgaataatattgtaaatatttgtgcttcttttaaaatgctaactcttcattcttctatgttgtatgaaaaatagttgccttaaaatcatattttattatttattatttgaactacataaaataaaatttcattttaaattctatcaattgtggggaataacttttaaagaataatcaaattgctttatttgttttaatcttcagttattaaaattattcatcacagctttcaaataaatttatattgttggaaaaaaagaaaaaataaaacaaaataaaactataaaaaaaaattttcggactaacaaataaaaatattaaaaaatcttaactatataaagagagagaaaaaaaaagtggaaatcccgcaacttcatcatagaatagacataagagatatattttgggccctttgtgcccttcacgggggagacctttgcccggccttctttctttaagggggggtaaataaaaaacacttcgtatacatatactcggtagtcacggtgttttcgctttgggcaaacggtttatacccttactagagggtcgttgtttcgcggttttccccaaaatcctcggggttacccgcaaaaacaacattgtgaagacaaaggccccgctaatgcgccgcaacccgataaaatgccggcggttgaggcgctgttctcctctcaggccccacccga

SEQ ID NO: 13774 - DNA, 404 bp, Homo sapiens
ccctgcgtgatacagttgattacggtctgctggttagcaaatgtgtctgctaacaaacagttgctggtacagtttctctgtaatgtgaggtaaaatacctataaaagcttagaagaagatgtaaactcagaacacagccataaacttggactgacaatcccctgaagactggatctgggaggactttttgccaatagtactgccaatgaaactgaaaagaaaagaacattctatgggtgtgggtgtgttactgaggaaatgctctgtaggcaagaggtaagaaggactattattttcattgcgcatctcctggatggggatcccctggatgatgggtcccctcaattgtgtatacttgaatggattctctggtgaaaattgatgaccacccaaaaaaaaaaaaa

SEQ ID NO: 13775 - DNA, 268 bp, Homo sapiens
  misc_feature (1)...(268): n = A,T,C or G
gtcagcgctgacacagnagatacacagttgtgcacaagttattgaaaaaatggcaacaatagacttcctcaacatttaattgccacaaaccttcaagcaaagtataatgaggaactgctggagataaaagcaaatgtcttagaagagcaagtgtgacatgtggtacgctatcaggaataaatttcttcctgccaagcaagactgtaaggcaatctggaaccagttactaaacaaacttgttttatttcaaaacagaaaaaaaaaaaaa

SEQ ID NO: 13776 - DNA, 314 bp, Homo sapiens
  misc_feature (1)...(314): n = A,T,C or G
tgcactgctntgcaatggtcgcggaagtaccattgcccttctagacgagagaaaacatggttatagagaaagctgtctctttgtttctatttccatctagtatcaggcctttatggctctggatcaaaatacattctagaaaacatgggtgttttacctatctttgtgttattacaaacactgttcatcataagcaactgtacaaagcagttccttttcagtggagatgcctctgtctctaacataatgtgtggtacagtaatataactatttcagaaataaaagaaccaaattaaattacaaaaaaaaaaaaa

SEQ ID NO: 13777 - DNA, 800 bp, Homo sapiens
  misc_feature (1)...(800): n = A,T,C or G
tttgacgagctngtcacatgtcaggcanacagcagaactaaagttgactggaataaaatgaaaatgcctaatttctgggacaaggctctagtaaagtcctgcctctggcagatgaaatttgccatagagaaggtgctggacaatactcagaagtattactcttccctgcttcatgccagagctgcagaggaatttttattaaatcttcacaaggaaaacttgatgaggcctctggagtcgaaattccacaaaactgttggggttgtctaaaaatacaaccctcaggacagtatttatcttaatcaattgtcctctcaagttccaataacccaacaaaattcccatttaactgttcctacctgttcacagcttatgatttctattcctgggaagcaattttgggctgtgattctctggatttacccattttctgcaatttggagtggttgtttgccctgtgacctctattccctgaagagtcttagtaaaatccttaattttagtttgttctgcttttatttgttgtaaggactttcttataacccttgaaaactgtgatttccatgctatttacgtgctggaactaaaacctgaaattcacagcttacaggtataagccacctaagctccactaatattattaaatatcttttcaactttcttggtaataaatagatgtatggattactttgaatgagtatataagtgaggtactgacagcctttacgattaatttatgccatattctattagcttcccaattnccatctgggtcctttggttacaatttataaaatccc

SEQ ID NO: 13778 - DNA, 814 bp, Homo sapiens
  misc_feature (1)...(814): n = A,T,C or G
tttctcgatctccatgcagactttggtgaagngaagtgaagtgaaggggtgtcatctttattcacctatagaaccacaaatcctggcgctggaaagtacgatccattcgacatgatggactatttcccacccggccactcactcgagaatggatagcctgttttcccgcctggggtaactgctttccatggatgtacagcttcaggcctcatacgagaggatctcacaacaatctcttgaaactttttctaacccccacactttccagtcttgactcaagaccccatccagtcttttgattctttgtagaaaattgacacgaaacccttgaatctgtgatctctttgggaaggtcccattaggaatagcgaatagtatctagcagcgggtgccgcttgtttatttgtccttctaaatgaaatagactggagtatgagtgtgcataactttaaatcatcatttatatagttatgccgttggataattattgttaattaatatttttagactacgtggtctgtttagaaggaatctaatagctatctgcgtctgggcgttgtaaatgactggaactacgttgtctttcaatgttgacggccgctgttaagggtgggtaagtaataatattcgtcaaagttatatacctggcgacggcattgtgacatctcgtgcgtaccagctgttatgcattaattcgtcatatgatattggacaacgttcgattctaccggttagttgtgagaacgcatggactattgtagataagatactaatctgacactagatatataacgctagtttacgaagggcaata

SEQ ID NO: 13779 - DNA, 802 bp, Homo sapiens
  misc_feature (1)...(802): n = A,T,C or G
aaagaatgcacgagtgtcatagaacgatgctctgtctccagattggagtgcagtggcacgatctcagctcactgaaacctctgctctactgagttcaaatgattctcctgtctcagcctcccaagtagctgggattacaggcacctgccacctcgcccagctaatttttatatttttagtagagacagggtttcacaatattggttagactggtctcaaacccctgacctcaggtgatccaccctccttggcctcccaaagtgttgggattacaggggtgagccaccgtgcccggcaagaactgttttttaatatcactagtgactcatttcatttgtgaatataaaataatttaaataaaatatcaagaaaatggatattagaatgtcttcagtaaatgtcacaggttaatgctatattctcttctctcacaataggaaaagaaatgaaattattttcaattatttttccttttacataaaagccaaggcaaataggctttctgaaggacaagacagaatttaatattaattccgctgaggtgttcttacagaactgggatggggggctttatgtcaatttcttgaagaacggaacccggccagatgactttattaaggacggcccttggattttattgtaacacggaatgcatatgtttttcctttcggggtttgaatgggatagaggggcgtggcagcggcggccggtgcgcgccgttagggttcggtcggtccccccccccccccccccacatgncgtgttgtaattataatagagtgagttgatgaaattatttttg

SEQ ID NO: 13780 - DNA, 786 bp, Homo sapiens
atagggcttcccagaggcctgtctctcacacagccgtgctaccatgctcactgtgctgctctgcccctgtgctgcttatgagttgccctgtacagcagcagacggccagggccccaggacaaggccacctgctgccacggctctggaatagagtgtgaagccattggaaccagttgtcccttgagagaagtggcactcacctgtgtgcagatgtcagttttttggttgtcatatgtgaatgacatcactagaaaaactttgacaagaattaaatttctatatctgtcttcactgtggcctctttgactactgaaatggcccagggtggggttcctggaccgagcctgtgcagagcaaggttggcccttctgctgtggatctcatggggaggccagttatcacattcaggacaaatcctggatgggagcatttcttttgggccaagttggaagtccttgtggctctgagcatctgaggaaatgataggaggacatgaagctgtttctccgatagactgcataaaaatctcattaattttgaacacaagagaccagacaatggatttgaagttaattagatttgcaatacatgaaaatattgctcagaaatacaggacatcttgttggccgaggaatccccatttattctattaatcaatataatatttaagtcacatttcctagatgagaggacaatgatgagcatgacatgaagagatgtgctctgttttttcttccacgttttaatccagaagagcagagccaccgagaaatcttaaatttatcg

SEQ ID NO: 13781 - DNA, 349 bp, Homo sapiens
cctagtgtacacgggtttacatgatgatttgagatgagaaaattatcctggattattcaggtgggtcctaaataccatcacaagtgtccttacaaggaagaggcagcaggagatgggacacacagtaaaggtgataatgaagatggaggtggagattggagggatgcggccacaagccaatgaatgcctgcagctaccagaagccacagagagctccgctagagcctctggagggagcttggccctgtcaacaccttgatttgaacccagtgaaacaaatttccaacttctgtcctcctggactgtgaagtaataaatttctgtttttttaagcttaaaaaaaaaaaaa

SEQ ID NO: 13782 - DNA, 579 bp, Homo sapiens
ccttgggaactcatgctttccagtaaccaggtgaactttaatagagataaaaccattccactggtgctgttatgatcaagaagctacaatcaatcttgttttcttcaagcatgtcataaaaagacccttttccttctgattagcattcttgaacacagtacaagctgatgacttgcttgaagtcattcactgtagggatacagcacctactgcacgtgataaaactttttaaggcatatgaactgctcattacaatctaattaggttgggcttctcatttcgttttatgtcctgaattgaacctgattcaatatgattctgcgctgaagttcatcatatcttctccctggcatgcaagttcatgatgcctgcttgctagatcccatggttatagaaatggtttctcttttttttagggactggttagatagaaggtcattaataaaacatcagaagcctttcttattatttttttcctctgcgagattttgatttgacttagcacacagcaccgtatttaaagtatttcaagaaggtttggtcattataataaacggacttacctgaaaaaaaaaaaaa

SEQ ID NO: 13783 - DNA, 787 bp, Homo sapiens
ggtaggggcacgaagacaatcttgcctggggtaacagaagatcacctgctcttagctacctaccatgctaacactcctgagaaagctcacagaggcccatgatgcccacctggatctgaggacctagaaagccacaacaggcaaccataatctgggtcttctctcagccaactcccctgcataaagtgaatgaatgaaaaacccatcttatattaatcagagttctctagagaaaaagaaccaatcagatgtgtatatatagaaagagagaattattttagggaattagcccacatcattatgcaggctggtcaatcaaaaatctgtggagtgggctagtaggctggagacccagggaaaggctaaattgcagtttagatcagaaggtcatctactggcagaattccctcatcttccaggaaggtggatctttttctaccaaggccttcagtttattagattaggcccatgaacatgctggagggtaatctgctttactcaatacatactgatttgaatgttagtatcatcaaaaagaccttcacagaaacatctaaaataatgtttgaccaaatgtctgcataccatggccaatccaagtttacacataaaattaattatcacacatcccacgaacaccatccccaacagatgctcatgagcattgtggttatgatttcaacttcagaataggcagaaatgtgtacaaatcctgaccctttgacttataagctctctaaaaatcattaattgtcaactttctagactgtacctgaaaacaaaacca

SEQ ID NO: 13784 - DNA, 480 bp, Homo sapiens
cctagttgctactgaattgattgattgactgactgaacaccttgttgcataccaagagatggttcttcatggagttgtatctcattctgaggttcctacttggcaaaagacaggctggtaacaggtgtcctgatgtctactgccacttggattattcattttgtaggaacagaacagatgagtgttgtgagaggccacaaataactaagcgattgttgagtaggagcttctcactgaagtgaaacagccgcttcccggatttctccgtcttttctgtttcccagtgtccatgacgccgatcataaaatggtgaggccaacagtgagctcaagacaagtagatcacagtatattcatgtttccttttgagttttgccattagactgtgatgctgatttggaattctgtgggtttactaagagctagaaataaattggtcatttatatgcgcctgatttaggctttctgaaaaaaaaaaaaa

SEQ ID NO: 13785 - DNA, 834 bp, Homo sapiens
  misc_feature (1)...(834): n = A,T,C or G
tttttttattctttaaaaacnaaaattgtaagcaaaggcaagttagggggcactggcagcagatttaagatggaacaagagatttctgcttctgactctgacagaagggtagttgctggagattgctaaagcggtttcatctggctcattccggatttctggaattggcagcctgagccaattccagacatagctgcagcggtacctcattggttctccctgagagcactccttcaatgactcactcaacaagaatcctcattccatgctctgcttctagggagcctggcctcatctgtcttcaagaagctttctgcctaatcgagaaccatacctgcaaacatactaactaaatgttaatcatagtgtgaagtcatgaatgtgaatgtacaaaacacgttatagcccaaatcaacatttaattatataaagaagaatcatgtttattaactggttctcacaaaatgacgttcatgatcgatgtggaacattaagacagaatcagtttcagaatgctgatatctatattgactgcgtctgcaaatactaccggagtatacgtaccatttgagacgtgcgatatgggaacacagcgcctttaataaatattctccatctctctatccccacgctcaacgccggaaacgatgttagtttacagaataacaaattctccttatacttatcatacttgcaattcatactcaccgcatcatacacaatccctttcatctcccgcgcggacctcctatagactagaaatagtgggaatttatatatattattcctaattgcctaacgtctaataatactaagactggtcgaattgggatt

SEQ ID NO: 13786 - DNA, 552 bp, Homo sapiens
caactctagcgaattgaattagcatcctgtcatggtgaatcccaaagcttggcgagaatttttgctccaaaccagactgatctcctggaaccacaattctgccaaaggtctgcctgaaagaacatgcagctgcattctcatgaccagagcagactccttggatattgtcaataggccagataaaatgccatttcaccacatctgtttgagccttcatttcatctacagccatgccacatggaaggttcaaccaagttctaaaattctgactcatggttgtcaatttactttattgtcaccactggccactacatcagtgttcacagtagacatcaaggctgaaatagtccaatatctagcataaacaaccaatgaccaccatgaatgattttacctagtaccctggaatacaaaattaaaaaagtgtacttcaagggaatcaaatgagttttggcaatatgtgtaatatattattaaatacccatgtattcatcaaatattttatcactggtctatcataaaaatgaattcttaccaccaaaaaaaaaaaaa

SEQ ID NO: 13787 - DNA, 792 bp, Homo sapiens
cgtaggagatacacagagcaacagtactggaacaacttacagatgactcattccttcgtcgccttgagctaatcatgtggggccacaactggactcctcctctggtttgtagtccagacatagcagctgaccaacattccttcctgataacagaccatcaacctgggagtggttctggccagtctatggaggatgcgcatatagagtgcggtggtgcgatcatggctcactgcaacctccgtcatctcctgggctcaagctatcctcccacttcatcctgctgagtagctgggactacaggtatggtggatggaagcttggatgggaggaaagagtcattgacaagtgtgctctatcaacaaaactggccgtaagtatctggaacaggcacaggcccaggagatgtgtaccttatcacaaacccgggaaccctgtattaccaatctgtgttgccaaattgttgcatttgcattaagatacacatttcatagctctttttaccttatcaatgttatcattgggaatctttacctgttattctgaggaacagatgttataagaaaaactgtaaccaattgaattttaggaagaatttaatacgctaaagacaaatggcctagatggcattaagtagaggagctttatggactgttccattttatgagggttattaaatgatcctagctcactcatctgaagcgctacggtggtttgatgagaaggagcgtagcaactcactaaaggcttgaaatctgtttactattaattatggggatactcagtgaagagcag

SEQ ID NO: 13788 - DNA, 807 bp, Homo sapiens
  misc_feature (1)...(807): n = A,T,C or G
attaattacacacaatatacagttataaaacannnaanntttatggnaacacggaacttttaggggcancacctgcatgccatcnccagagcccagcaagagattctaagaatgnccaaaagcagaatggcctaacacaacagatgcattggagcaagcctgccatctgaagtaggctgagtctctctgcaaacaatcccatcacccctaccaatgagctttgcctctactcacccatctgagctccagccttcgcgtgttttttttaacggaggagttttctcctaaatccattcatcttgccaaaacactgttcataatagcaaagacatggaatctactaaatgcccatcaatggtagactggataaagaaaatgtggtacatacacaccacggacaaccatgcagccataaaaaagaatgagatcatgtctttagcaaaaacatggatggagctggaggccatcatccttatcaaactagcacaggaggagaaaatgaaatactgcatgttctcgcttataagagggagctaaatgatgggaacatatgggcacataagaggggaacaacatacactggttcctatcaaaggatggaaggtggaaggagggagaggatcaggataaaaaacaatgggtctaggctaagagcctgagtgaataaatcatctgtacaggagaccccatgacacaagtttacctatggaacagacgagcgcatgtacccctgaactgtaatgaaaagtttaaataaaaaattaacgattatcatacaaaataaataattataatatattctcatag

SEQ ID NO: 13789 - DNA, 1044 bp, Homo sapiens
  misc_feature (1)...(1044): n = A,T,C or G
ggtaagggaagggngangggannacgcgcnaaagnnaccgaaccaagaacacacttagacgaaaacacgcgccaagcttacacacaccaccccacccgggccacacccccagcgcgcagagactttaaacggcaccgaaaagcaaagacacacccgagagaccccttccccgccccggcctgggccgcagaaccaccgccccaacccgaagtcaacaccgcgcaccaccggaccgacgggcccccgcgctcccaaaacacccaccaacctcacccccaccccgccccgcgggacgcggcgcggggtgaggggccacccactacgccgcggaagacggcgcagccggcgcaggaggcaccgcagcccggagagtagaccaggagagcagcagcggggagagaggggaggcaggagcagccgcccgtcagggcgcgggggcctaaagatccgggaagtcagagcggagtactagatagcgcggcccaggcgagctctcgggcgcgtcgaatgttcgggccagccgtcctcgccgagacggcatcccgcgccccaccgagacgcgggcccaggnccacattcgttcgaggtggctggggtggctgacggagtcaggtgaaataattattgtatacagctaggagcggcgcaataagatgagacaacggtagagaatcggaaaagggagtgggtggaatttaaggaagttcggggagctagaacnccgagtcagaagtgtactatcgcttagcacgccagagcccaccgaatactcccccccagacccgccgcacaccggaggtcgtggtgatacgccgctcgccgctggccagcacgatccgcgcgctccgccncgcactacgggcggcggcccgcggggcggngtcgagagaggacggagaagtggtccagnagggagcnccgcacggcgcgatncatagacgcagccacaccgggccacacgacggcctccctcaggcgcgcccaacacactcccgactcgacgcgcccgtagcctgcgcgtgagccgggcggaagagccggagg

SEQ ID NO: 13790 - DNA, 777 bp, Homo sapiens
ctagcacttaaaaggaaaaacttatataacaaaagaagatatgcaaagtgtccaagggaaacagggcattctagttcccatgatagatattttctaagtgtaaatttattagtagtccatgtcactatttagatcccctttctgcctaattagttcagattctcatggcctgctcaccctaggcactgacaagctagtgtctttgggcttggaaatgaagactagggtcttcaatatagtaaagaatttgagatactaccagtacatctttttcttcatgtaattttacttctttcttcaaatgtacaaaggcactggtctttgtgggtgggcaaagtccaacgcgggatagacattggagttcaagcatcatagatatttactctagaagaatcttgggaagaagattgacataattaaagtaatgttgtaggactgagcaaaagaatgagtagattgttcttactggacatgggtaacagcagcagaaatgatttaaagaaagaaatagcagaattcttaaactaatcccacttcctgtttaggttccattttcccatattttgctccctctactctattgggaggaggaagaaattaacatgtattggaaatggaggaaattaacatgtattgagtgatctgggtgttaatatctgctctaagttgcacttaagttttgtttagtcgatctaacagcttagaagaagaatggcactaccaattttacagaacaaaaatgaagtctcagtagaattcatttgcttaggatcggag

SEQ ID NO: 13791 - DNA, 858 bp, Homo sapiens
  misc_feature (1)...(858): n = A,T,C or G
ggtgaccggggacccagtaaaaaaaannnnnccacaacannnttgcaattccannnnnnncnnnnnntnccgnangctcttntaaggactgggatttcttcatattcgtacaggggaagagcaaaccaaccttcattgaaaaagcctataagaaactggatgcatcttagagagtgtttttttttttagattggcccatattaattcaatgatcgtgaatttgtcaaactagctaacctatgatcatatgtaccaaggctaaggctttttcaggaaatatctacaatgcacggtaaggactttaaaacgatttttttttagggccgcgcggcagcgtgtcgcgggccgatgggtaatggggctctccaaatgggtctcgttgcgtatacttgctttgaaaaagctcgagttaggtataagtttgactatatcctctattttcagataaggcaacgaacgagctaaatcattataaacgagtaggctggcgagatgattagtttgcattgcgttgactatatccacgaaaccccgtcctaatttctgtccgtcaatacagacgcgcttagacacaaaagttatgacacactactaatctcgatttgctagcgcgacatgtacttttcgatcgctatctttcaatcttttaagactcacatccatcactgtcacggatgtgaggaagtgtgggttgggtgatattgggcatgttggagtacacgtatacggtgtgacgagttatcatctcatgtcgtagggggccggttaattcaaaggactagggaacccgctcctgtagaaattcggtaccgaaagtgtggctcgcgactcgtttgaccatatttacataatgctgtt

SEQ ID NO: 13792 - DNA, 379 bp, Homo sapiens
  misc_feature (1)...(379): n = A,T,C or G
gatcagatatagacgagtacatgtactttattattacatagcggatattgtgtgatgctgaagtttggagtaggtancttatcacccagatagaagatggggaagtcacagaatgacacaaggggatgtgttttcagggcaccagtgacccaaggactagaagaaacagacggaggagcttggctctgaaactctgtcattcaacctagagataattgcgtttcattggacctgttaatcagattctcatctgtcaaatatcactggtgtagcattcatttgtcaacagtctgtatccatgttttcttcctttattcaaatcaagattgattttaaaagagaaacaagttttttcttccagcagtcaaaaaaaaaaaaa

SEQ ID NO: 13793 - DNA, 808 bp, Homo sapiens
  misc_feature (1)...(808): n = A,T,C or G
tgtcactttcagcatcaagaagattgagaattgaccagaacctgaacatcagaactctttaagaaatgacaaaaaagggtggtaagataaccccagagaactgaaagaggatcctttgaaaaatccacaggagcatgtttcatagctaatggatatctacaatcaaaagacttgtgatttaagtatcaagataaacaactatcacaacatttaaaacactcactatatttcctttccagctttttaactataaaatcaatggcatgttaatgactcaagcattagcttgctcactaggaattccagaacttctatttttgaagcataaattcctaagttgctcaatttacccagtttgtcagaacaattgccattagtaaatataaatatttaatgaaaatgaaaactgtcataagccgcttctcttaagcatctaatgacttactggaagaaataaaaaatattagtgaattatgtcatttactagtttccatcatatagcaatcacctgcagatgtatttgcttattgtaccttgctgtgttttggagtgggtttttgttgtaatatatttattgggttgtgggtttttgcttgcttaatgggtaacaaagaagtatcaatgatatacagggtgtttcctagatattaaccacgtggcaaatttttttaagttttctcaaaaccttcattgtgctattngntccctgccaaaatccactggaaataaaataattaaanttgtgtatgtaagtgaaaattacagttaaatacctttacccttcattttggggcttgagaaagccctt

SEQ ID NO: 13794 - DNA, 783 bp, Homo sapiens
gttcctcacacgaggcttgtttactaagtaaactaagagagggcctgggaggagagtctgatgagcaaggggaaggtatccaaggatggagtgaaatacaaggtgaggaaattaaggttgagagacactaagcaactgccccaggcttccatggcagaatgaggattcaggtcgagcctgtctaactgttaaccccatccctttccatcacatttttatgcctacctagcatgggcctggttggcagggctcttgaagtagagcttctcaaatgcaactgcacctgtgcatcttgctaagatgtggattctgatgcaggacttctgggtgggggctgagactccatttctaacaagtccccaagtcattccaatgctgctggcctgcaaagcataatgtgagaagcaggagttcagcccccgccctcctcattttgcaacagaagaaattgaggttgttgaagtcaagtgacttacttcaagtggcatggcacgttagtggaagaggcaggatacagacatgggaatgctaatttccagtccagagccttgcctttaccatgtgtgtcaggtactaggctattggtcttttgctccaaccccattctttcgcacttactttgggatgtgggggttgagcttgggactgatatttgggtccctccccaaaaccattgttgaagcctattcctcatgggattgaattaggaggtggggaactattatgtcaagaaactggagccctaaagtgggattagtgccttactaaaacaaaaaaccgctt

SEQ ID NO: 13795 - DNA, 366 bp, Homo sapiens
actaggtgctctacgtgtatgaagttatttaatacttataacgactttatgagatggaatgatccattttatctgcagagagtgcaaggatcaaggaaaggtttgcggcactcttgaattgagcaagatcatcaacaccattttactaacagcatgtgcttacttggtgtctctgtgtcatattttagtaattcttgcaatatttcaaactttttctatattattgtatctgctatagttatttgtgataagtggccttcgatgttactattgtaattgttttgtggcatctcaaactgtatccctaaaagatggcaaatttaatcaataaatgtgtgtcttctgactgctctaaaaaaaaaaaaa

SEQ ID NO: 13796 - DNA, 884 bp, Homo sapiens
  misc_feature (1)...(884): n = A,T,C or G
ttttgcaggntttgcatgctcgacngagctntgtggcagncttttgggcacctacnatgcactcatgggtccacagcagacgaaaagcctggactggatcagacagacacactcatcaggactacttggctatggaaaggagatagccactatgggtctcctctccattaagagccggacacttgtccttatgacctgcctacagaaagaagctacccactgtagggttctctgctacgcaaaattttttcttttcaaaaggaacacaccagccagccgaacgtcggcggttttttttttttgcgccgagagagcgaggacggaagccacaatatttgtggggggccccccctataataatatacagtgttatttgaaaatataataatatgaagcgcaaatgatatctaattttctataagacagcggaatttcagcatatcgttctttgcttcaagtctgtttattatttcctcctctctttaggttgacgcctagcatatttctgcacgttaacccccccaacccttcattcccacatttcttcttactacatgtatttcacgcgtatatggcatatgatggaattttagtcttatatggctgttagcggtcccaccaaacatgtatgttatctctgctacaatcagatgatatagatgttacagtcgtagtctctggggtcatagtgataagttactcctacgagtttagcatatgtcagaaattatacttttatctaaaccaaaccacaatataagcaaaaactttgatgctctcatcatgtactgaaaccgaatagtcaactgattccgtgatagatagcgcgttttcgaagagatttagttttattagttttataatcgttaattgtggatgtgttc

SEQ ID NO: 13797 - DNA, 775 bp, Homo sapiens
gtcaggcatactccacagaagcttcagacaacagacagagagcagcttccctgtgtgtcccatacccacctctccacttctgccactgggcatggactccttttgatgaacaagttcctctcaccacgagctcactctcttcacacctagctttagacccatggaaaaagtcctgctgagtcaagtcaagaagttcttcttctttttttttctttttttgagacggagtttcactcttgttgcccagggtggagtgcactggcgcaatctcggctcactgcaacctccgcggcccgagttcaggtgattctcctgcctcaagctcctgagtagctgggattacaggtgcctgccaccacgcctggctaattttttgtatttttagtagagacgttgtttcaccatgttggccaggctggtctcaaactcctgacctcaggtgatccaactgcctcggtctccgaagtgtttggattacgggcgtgagtcaccgcgccgggccaagttcttcccgaagacccaaaccctataccctcaaaccagaggtctctctgtctcttctgcacccactcccaccatggtgccctgaacctcaacaggggttattgctgggtgaagaggctgctagatgtttaaagacaccgtaatccatggcatgactgtggccaggaagaaatcggggcaagaaaaagacgctagatattaacttcctttttcttttattctcctaaagatgagtccaaccgccaggttctggggtaccttgtacatttag

SEQ ID NO: 13798 - DNA, 817 bp, Homo sapiens
  misc_feature (1)...(817): n = A,T,C or G
gagaattaggcggtttaatttaannnnnnnnnnnggccccnnnagggcancngnggcaaagggaaaatgactgacctagttcaagaacctgaccatcggtggagtgctgtgtgccctgtgaaagcacaagcagactgcagaggcgcaggtgtcctgtctctggagatcaggccactacacttacgacaacaaaggcagatgggggaggacccagagtgtgtcaaagtctcattcacaaggccagagctacaccctgcttatgaccaaagatatggaatgaacgacatgacacctttacatataaactaattataaattaacatcatacgtaaatggcggtaacagtgcgctttataaaaataaaaatcgtgctcggtggctctcgagaggaagaactaatgtagtcgcttttctttaatgaggatttagagaagagcctcaatcacagactaactatatctattacattggtctgcatcgagcgaaatttagcggcttcaaaagacgaataatctagttccgtaggagcggaggtggtggatgaatgaaagctgctagcgagagagtatggacaggttcagagctaggtataggtcgggtgcttgattagttatcttttatcgtctaacaaacaagtgcgaataagtaaaatgtgttttaatgaattatgtgcagatagatgcacttgccataaagaatacaagtcctccgcagaaatgatttatcagaatacgaaacaataaaataactatagatatctaaatagatttagaagcataatatattctcgaattttataattatttagacttaatat

SEQ ID NO: 13799 - DNA, 192 bp, Homo sapiens
ataggcattacttttgatgaaatttagacttaaagatttgcaaagaaaggttcatggatttggaggttgtttcgtactttataaaatctgttcctaaaactttgttaatttatgaaagataaactgtcttctgaatgaaccacacaagcttgctataaagaatattcatgaatcctttcaaaaaaaaaaaaa

SEQ ID NO: 13800 - DNA, 460 bp, Homo sapiens
agagccatagcacaattaaaattggcgtactaagggacatacctcaatgtattaaaagccatctatgacaaacccacatccaacataatactgactgaggaaaagttgaaagcattccctctgagcactggaacaagacaaggatgcccactctcaccactcctcttcaacatagtactggaagtcatagccagagcaatcagacaaagaaagaaataaagggcatcatcagtaaagaggaagtcaaactgtcactgtttgctgatgatatgaccatttaccttgaaaaccctaagattcctccagaaagctcctagaattgataaaagcattcagcaaagtttacagatagaagattaatatacacaaatctgtagctgttctatataccaacagtgatcaaatggagaataaaatcaagaactccaccccctttacaatagctgcaaaaaaaaaaaaa

SEQ ID NO: 13801 - DNA, 787 bp, Homo sapiens
cctaggactatgataagcacatgggtattgactgggaaagactctgaccctaaggagctcacagcatttacagtgtgtgagaaaccgttccaggatctgaggatcagcagtgaacaaaataaatgagagatccctgccctcatctagctgacatagacaagaaaagtcagacttgaccttttcttcaatgcttccccaaattccaaattattttctgcctgagggaaggaaaagcattgcctcctgccagagacagccaagatgctgcagaagcaacagctggccagaagtgattttctgtgattttcccttcctgtggagcatgccagtcatagaaatggagcattatgtttctagcgaatagggctggtctgtgaaaccagctgaatattgcaaaaacgaagtgtgacttctgaggtcaaaaaaaggtgtggcttctttcttttgaatcagacactctggggaaatccaactgccatactacaaggacattcaagcaaccctctatagaaggccaagccgggaggagttgggacttctcatctgcggtcagcaccaacttgcccatcatgtgagtgagccgcattggaagcagatcctccaggctcagtcaggcctaccaacagctgcagccctggctgacatcttgatcaagaccttctgaaacaccctgcatcagaactacccagctaagccactctaggattccagactcacaaaagccatgaaataataaatgaacattgttgtatagaaaaaaaaaaaatcgggctcggtggccttagcg

SEQ ID NO: 13802 - DNA, 627 bp, Homo sapiens
  misc_feature (1)...(627): n = A,T,C or G
gttagggtcttgctgttacacaggtctggagtgtagtggtgtgatcatagttcactgcagtctggaactcatgggctcaagtgatcttcctgcctcaacctccccaagtgctggaattacaagtggtctctttctgtcacccagcctggagtgcagcagcacgatcatagctcactgtaaccttgtactcctgggctccagtggtcctcctgtcacagcctccctaagtgcttggattataggcataatccaccatacttggcctgcggcattaattcagtcttaaaatcaggaagtgacctccagtacaaagctgaatataactgccctttctggccaggcgcagtggctcgcgcctgtaatcccagcactttggaaggcccaggcgggtggatcacaaggtcaggacttcgagaccagcctggccaatatggtgaaaccccatctctactaaaaatccaaaaattagctgggtgtggaggcgggcgcctgtagtcccagctactcaggaggctgaggcaggagaatcgcttgaacctgngaagcagagcttgcagtgagccgagatggcgccactgcaccccagcctgggtgacacagtgagactcaatctcaaaaaaaaaaaaa

SEQ ID NO: 13803 - DNA, 774 bp, Homo sapiens
  misc_feature (1)...(774): n = A,T,C or G
ggtanggagaactgccaatctctgatacccatcttacacaagataaggaagaacaactggttatgaactatgtcaaagcctcaggtaaagtacaagttcttctagataggggaattgagcttgcagatcctaaaattcctagagaacaccgcaggatgcctgctgcaccatttgccgcaccgttctgaaaaccgacatttgttcagcctggagcatccttttggtgctttaaagtaaagaaatgctttaaaaaggggacagggggatatagaaaggacacaggagacagcctgaaagagctcctaatggccaagattgaagaatttgaacaaaaatatgaaatgaaggtattggattataacacaaggaatctagtaaatacccatgagtccatactcctaaaaataaatgaaccaaaaaataaaaggaggaaaagaaactactcttccttatagactgattccaattaatagttgttgtatgaatgaagaaaatagaataatcaccatctgaaaaccgcagtattaattgctacagagaagatccactgatgaatgctaacgttagtggttggaaatttaagctgcatattgttaaagtttctccccgcaaatacttattatgcgatagggaaacatggtaacagtgcggtagaaaagccaagacgacgccaccttaaccaagtggtcagcactaacatcatcagtaacaagacacatagatttctggtgccccgatttgacatagggcacgtatcctctgagattctttcga

SEQ ID NO: 13804 - DNA, 339 bp, Homo sapiens
ttctgacgtgactctattctgtctttccagctggaacgcagtgtcgtggtcacagctcattgcagcctcatcctcccaggctcgagtgatcctctcacctcagccttccaagtatctgggaccacaggtgtatgcctccacacccagataatttgtaaacatcttttatagagacagagtcctgctatgttggcccagactggtcttgatttcctgggctcaagcttatttctcaccttgacctccgaaagtgctgtgattacaggtgtgagccaccacacctggccaattgtcttacaatctaataaaatcagtgtgttgaagacaaaaaaaaaaaaa

SEQ ID NO: 13805 - DNA, 1368 bp, Homo sapiens
  misc_feature (1)...(1368): n = A,T,C or G
ccctcccgcatcctcccataaaacacaannnntgccacacccctcggcgctctttggagtgtgctgttncagatagaagaatggacctaatgttgaaattgagatacaccgtactgaacccgtacagcgtccatttgacgccagtctttggaactactctttatccgcgtacgtgcctccggcatagggactgagaaaaatgcgtcatcaagaacatggctgagatacacacccccccgtaccacctttggaggtctctcgttttattgatatgaatttatcgtgatgatactactgcgaagcaccaggatctgtagtcacccataaatagtagccttacaatgcacgtactactttgatggtactgaaagacaaaaaaatcaagtgtacaatcaatgaggctacaatcttagctctgtatatatgtagaatcattttatctcttactacactgatagttgaggtcatgactatacatccacatgcatgtttgagatcactactgctagtgacttacttgataccttaatagggacacgtccctgatatagccgtccacatatctccaacttcaagagtaaatatgtaatgtatagacttattgattagttaggtcagcatntatctctgatatatcatattcaacatcaaataatataataactatctgtgtatatatcatattatgcgagtcttgcgtatatcagttggtattatctatatntatgctgtctacctgctcttatcaccctatgtntcagtatanactctaggctgagtccgtccagacagagacactcgtcacgatcactgtactagcgacctcttataatgcataatcttcgnggtctctccgtttgacgctgtcgattatggtttaaactcgttgatcatatatgctctatactaagtcataatctgtctacgttcgataacatcattgttagtctcctatcacatgagagatagcgcatgtgaacgctacgcgccgtatactatgtaatataacacgcatatagtatatgagactatntcgtagtcccatgtacaatactcgatccagcacaatacacgacgaagtaataatctctcacgacgccatgaaactagatgtgtcaagttgtctatgagnacgtntgactctgtctaccagctacatgagaccgacttcacgagagctgtcagttaagtntgtcatatgtaatatcatgatacgtgcgtgagcgcncactacatcactctantcagtacgatgtaatgaatacagtcggattagattctcagtcactcatgtaatgcgctatgtnctatgtgactcgagagtnctgactatagatctctcacatctgactatatatattgtcgtgt

SEQ ID NO: 13806 - DNA, 429 bp, Homo sapiens
gctaggtgtgacttcatatgaggattgacctatggtagcatgagatccaagactgaagccgacagctccaatgacccatcttggactaccttttgcggtacttcctccaaataggactgtgaaaagtggtcatcagtacatggctggagacacaccacacgtcaaaaaggaggtctcgtattatttatatatacagagatccttgtaagactgattgataggaaaatacctttcccacacttgtgaaaagcaaaacaggaaaaaggtaaacttcttatattaacattcctatcttaattggcaataataattctttagaaacacatgtacttactataaaagccttttcggcctatagaaaggaatgatgagctgtgtatagatctagatatactagtaaaaaaaaaaaatcgggctcggtggcctcaa

SEQ ID NO: 13807 - DNA, 197 bp, Homo sapiens
  misc_feature (1)...(197): n = A,T,C or G
atgcgtgccggccacctgagcgaagcgnagagacacgtacttggctctagccggtgaggtcacagcgtgaaggccctgtctactagccaggaaacgccttccccagaacctgaccatgccggaaccctgatctgcgactttcagcccccagatctgtgagaaataaatgtctgttgcctaagccaaaaaaaaaaaaa

SEQ ID NO: 13808 - DNA, 198 bp, Homo sapiens
  misc_feature (1)...(198): n = A,T,C or G
ttgcatgctttgcatcttggcananatatggggacaaatacttctctctgcccggtgaggtcacagcgtgaaggccctgtctacttgccaggaaacgccaacgccagaacctgaccatgccggaaccctgatctgcgactttcagcccccagatctgtgagaaataaatgtctgttgcctaagccaaaaaaaaaaaaa

SEQ ID NO: 13809 - DNA, 769 bp, Homo sapiens
  misc_feature (1)...(769): n = A,T,C or G
ttgacgntaagatgctagcataacttgggccacctggatggaagactggtgtggtctcgaactcctgactaggtgatcacccggcttggcatcccaaagtgctaggattacaggcgtgagccaccacgcccggcctaatatgctttttgagtaagaaaaatagatgttcagtatggctatagaaataaagaggaaaaaaatcagtatttttcatcagcactctaccaaactttttttgggccataatctaggcctgaaaaaagtcaaactgttacatgttttaaaataatatgtgaaaagctttagaatgtttttcaaagggtacatcctagacaaaatgttgcttagctgggccaaaaaaaacaaatacgtaaacgaaaagtcaaagctgttatgtcgttaatgagagaatcggaagattagataaatttgcgggggaacggtggcttcacgcttaataaaagaaaagagggtatacaaagagaaatggcgcgtttagtggtagtaggtgatcgaaaagatttgatatgtaggtaaggaaggggtaatgtattgataggtgtgggttataaagggtaaatggtaggttgagggcaaagaaatagaggggatatatatagtgttaggtttagggaaggtatggagtagtgggatcggaaaagacatagagtgagaacaagtgataagagataccgggcggatggttaagaatacttagatgagtgagattataatgttgactaatgatatgtaggatagttagtttagg

SEQ ID NO: 13810 - DNA, 1228 bp, Homo sapiens
  misc_feature (1)...(1228): n = A,T,C or G
tttttttnnnnnnnnttnnnnnnaannnnttnttaatgtnntttngtnttnntntatnnnnnnnnnnnnnnnnnaatttttnanntantnnntnnnnnatttttatacgcgaatctnattaanttatcaactgtacaagaacaatacccgagcacacataaaataaatgatagagtactattacaataaacacgaacggccactgtgttacgctgcttgtcgtttttagtttgtgagaaccgcgactgatatgctttttctcgttagaattattcgtgataggtgaacggtcctcagagcagcgccatgcttccnttcttctacctgcccacctcncatcgcacacgttcaccatatacaacgaacctacacagataatcaacaccagccgcgccacgatcctggtacgccagaccgcgagcgtccgtacgcatgagcagagagagaccgccgccgtaaacacgaaagacgactcccgcgccgcaccgcacgacgcgccgaacgacgacgaggggacactcgccccaatgacatcaatgtctcatctgctgacggataccgcgcggcacctccgcctccgcgcctacgcccgcctcgcggctcgtgcacagatgtgctgtatcacagacaatacagatgtacatcgcacttcctctaataatacccctaatcatcgattcgaatatacctactttacagacacctacacaacgcacttcgtcctcagaaacttaaactataattaataatagtattttaaatactagctacaagccgtgagcgatataatatagataacgcgaaacaatgatgaacaagcctgatagtgatctcacgagatgttcacccgcncgcactagatcgaatacgtatgaagatgtacacaagagtcgatgcacatagaataagatacacgtcgagcaacagtggcagccacaagaacantcacacaggtgtacatcactatgatgttaccaccgtacagtggagtaacacagcttacatcggacnacacagtaaccggcgcnactcgacacgtagtatcatgctcaggagcgcacagtcagcgacacgagatacgtgagcattataatcatgtcgacgatctgacgtacatgtactcacacgtgttcgantcagcgcgccacgccaaccgacgancacggcaactcactcagcacaagagtggtagcacgatgacacacgcgtagtaagaagacgccatact

SEQ ID NO: 13811 - DNA, 784 bp, Homo sapiens
gagacgcaacatattcttgcacaagcagtatctactggtggatactgaaacaggtagatttgatgataaacttgatatgtacttaaaatcggaggactggactggctggttgattgtcgaagaatttaagtgacatcagggggtcttacatccaatgtattgtttggaaatggatatgcaagagaacaaaaacctcagaccatgtatcctgctcagagcattttcttacagctcctgacaatagcttcttatagcagacagaatttcattcattgagttacaacggcatgcctctaggagaaggatttggaaaagaagatctcatgatatagatgccaacaacttgcttagatatccttttccagaaaattgaaaagctatgttctcttactttaagttaatatatgaatattttatcatattactatagaatagaaatatctcctgatcaaacaactcgcactattttgcaaattgctgacatttactacactgttcaattacaacttcgtcaaaagcctgatatagcgatgattataatcgacattcgactctccaaattcgataaaaatcttaaatatgtagagagagaatcaataagtcacgacaaatccgttgtaatgtataacatgtaacaaaacatctaaaatttaatattaatagcacaaaattcacaaactactataactcacttctttaacatcctcctgagaacaataacatatacataatactccgccctacaatacactcaacatcacgtttcacaaaaaaacataattct

SEQ ID NO: 13812 - DNA, 870 bp, Homo sapiens
  misc_feature (1)...(870): n = A,T,C or G
cgacggttataatggatgagaggaaagannttccagacttcagaaacganactaggacccttaaaggagctgttgggccccataagacccttgggctggatggaaccatttctacatcatcatggagctcccagaggctgcctggattccttggctctcggctccttccttcctcttcaaattcagcaatcgcggcaatcggatccctcttccatcctcacatttccttccctctccctgcctggcctccctcttccagcttttaaggaccctgagagtgcgatggactcatccagatcatccnncgataatgtcctcctctcagggttcctgatcacatctgcaaagtcctgctgccatgtaagtgccacattcacaggctgggaaggaggatgagggccctccaggccgagttattctggctgtgctacacacctgttgaacgtcgatgagaatgaagaggcaatgctttcccacatccnctggtcgggtgcatgactaacccagtggacagacctcggtcctctgtcctgcacctacctggccctatttgggaagttgcatcaacaaaccgccaattccttacgcaataattaaaacgcgatgatcctcacctaccgtagctccacacccctgcttctactgttcacagggttcgtggacacaaaagtcgattgtggtttaagtcgcccttcagagggaagaatcgnaagatgtggaataagaaatgccggtncaaaagtaaatatttnccctctaagccgttctcgtcaatccggaccataactattttgtatatgggtcnngccgtggccggtccggcgattgttgtgaatcgggaagtgggagctgcttggncgacctagatag

SEQ ID NO: 13813 - DNA, 335 bp, Homo sapiens
gctaggctccagctcagctgttacttcccaggaatgccttctctgaggactcaagccaaaatacccctacttacagccactggccactctctatcgtgtttccttggtatattattcttcatagcatttatccctaatctggtgtgatcttatttgcctgtttacttgtttattatctcttttccctactagaaagttaatgacaaaagagcagaacttgtctatcttgttcacttctggatctcagcacttacagcagtacttgtcttacagtttcatattttatgccaagcactgtcctagaggctaagaataaagaaataaaaacaacaaaa

SEQ ID NO: 13814 - DNA, 874 bp, Homo sapiens
  misc_feature (1)...(874): n = A,T,C or G
aggggaaatagacgtcacaaagaagtggaaacagagaaaaagaccgtgaatggagaacagaangaanaattgacatgcgaagagacttcagggcaacctccagccatcagccagtgagttaccaagcccttcaattcaacatcccttcaagaagagaatcctgtcaccaaccaagatagataggaaacagattattcccgattcaggcgcttagatgagacaccatccctggctgacaccttgactacctcctgtgagagaccctgaaacaaaagacccatttaggctatgccgatcactgacccatggagacccatgccataaaaactttgtacgtgcgtgtatactactaaaagtaggttaattcttgtattgcaactctaaataccatttgtgccctatcatgcaaattctgctggatgtatcggactggtacactatctaggttcgaatctcaaagaaaggattgcggggcggttgcgttcacgggtggaagttagcctacgctgatcctgcgtagtaggatagtatttgtagttgtcattgatggtgattctagtcgttatagacggcgaatactagagcgctcataactcctagaataagatatgagtaactgactgtgattcgctcgcacctcttgacaataatgttcacagtttcagtgtccactatgggcattgtttttgtatttttgtcccacccccttgatagttacattattgtgttatgtctttggtctcttattttttatctggcggtgtggtgggcgtgtagttttcgagtagttattaaaattcccgagggggatcccacgtacgctcccaataccatattgatgacatatttagctgtttgggcacccgtcgcctta

SEQ ID NO: 13815 - DNA, 1357 bp, Homo sapiens
  misc_feature (1)...(1357): n = A,T,C or G
gaataaaaaaaatgaaaaaaanagagaaaaaaaaagtggttaatagagagaagtggattgaanaganaganaaaaaggataaaatttaaatgggagaaacaaaacaagatccgcggctgcggggtgcggggggaacgcgcaggtgggggcaccgagcgcgccggcggcagggggagaagaataggacagaggaagcacgtgaccgcctgagacgttccacgtacgcctgcatccgtagcaaggtccgcgccttagtcttcgaacaaacctacatatccttttatccatgacgtagatcttgtctactatagtagaactcacacaccacgccgcggagggcgacccggagtgacccactcggctgaactggcccgacggcgcgggaccacgccccncgcggcgcgcgcctgtcctcaaacggcacganaacctcgggccacgccntgacccctcctctttgcatgtgatcattggctttgcttagttcttgttctgttgcctcagtatgtatcgctatctactgaccgcgctacttctgggtaggactcgagtggggaagataaccaccacaggggatatagttcgctgaagacnataattatataaattaagaggagagatcatgtgcaacacgacttcgaattttgtggaggagtggcagcgttgtgagacacgggagagctgcccagctatccgctgatgaggtgctgggtgctggagtgcgaacagcgttcttcttgagagtccgagctctcagtgactgggacgtgcatgctacgtatatcgccgtgattgacgcgtgacacgaccttgtcgccggcagtggagctatcgcagtgtcgtgacagcaggagttcactcaccagtatgctagggaggcgcggagngcatggcgtggttgttggacagcactcatgctatgctcacccagggacgtcgccgtggtgatgagggagacgatgtgcacgtncacgcatctgcgcgcgcgtctccataggntgaactcgtcggggtatcgagcaccatcatagtgtgaatggtggcgcgattctacgtgctctcacactttaggatgtgcggtgactgagtgacgcgcgtatcgtatgtangctagacatgagtcgaactagatggagaatcantagcgctgacntggttcntagtccagtgtccgcgacacaaatcaaatatgactgtacgcgcncaggattcagatgaatgacgcgtcanatgtatgatgtaatagagcgcagtaatgtgagcagagaaggtagnctacgcagagatcgagagaacttgtccacgtatagtagangttcacaaaaagacacntgcttatactgctctacactggtca

SEQ ID NO: 13816 - DNA, 816 bp, Homo sapiens
  misc_feature (1)...(816): n = A,T,C or G
cgtagtgtgaagctgtgctcctcctatccaanaatcatgcatcagaacccttctttcttctacatcctctgggacttcattctatcaatttgctcttctttttttttgtcttcaacctccatctttttgtgatgataattaagtactcacatgtacacacattcagaaacacagaaataaggtgcttttgttttgtggagacacttttccttttccaattctaacaggtatgcatgtttgaactgctttatttcaaaagaataaaacaagattttcaaatataattaagcatattaaaaaagcgtacaataatacttttaataaaattcatatcatatttaggtacaataaactgtatttgccaaatatgttaatgtatttttcatctcatttttctattttatgtctgtaatttaactattgttagtactctagcacatatatgcattttatatattttttattaatagtggtgcacaattgaaattttggtaactattgaattaaagaagattggtttcatataatatcttcctgcaatatttgaatacatataaaaatccttaccaaaagctaagacataaatctatgtccctttatttttatcccaagtcattgtataagttgagaaagtaattgaaaatgtatttttccctgaaagaaatgcactaagcatttttttgatataaaatttaatgagtcaattggtaagccaatattaccattggggggggaaggacatatgagtcctatccgaataatttcttataaccggtaatgtatctacaatatcctaaaataaaaaggtaatattag

SEQ ID NO: 13817 - DNA, 807 bp, Homo sapiens
ctggacttggtgcactgcaaggtggtcagggaaacagagacagagaagctgcttctccaaacttcagtgaccacacctgtgttcctgcagctgagtgtctctcagaatgggtgtctcttagggacacactgctgtagctcaacacaggagcattgccaacactttgagctggagaataacacaaaccacagatgagcctcttggaatgaccactgtggggacctgaaggtgtgtactggaggctggacaagcgttgaggggctcccctggcgagcatctgtgacaggtttgatgaggcctgttcccagcagtggcagtgagactggcatgtctggatgacctctacccagaggcccagctttattgcaggctggctctgaatcctttcatctctggccgcagccggacaaagtgccagagctgagcagctgcctcagttctccagcccctgtgctctgagaggccacacaggggacagagatcagaggagccgacaccaaagtgatgcaactgccctcccaggaatgctgttctcaacagaggaaaaagagtggtgaaatgggagccatgggccttgtcggggcaggacaggcttctagacctcatcctcgtgtttaactcctttatttgacgtatggggaaactgaggcccaagaagggaagggagttgcctaaattcacacagctggacacatttttcaataactccacttatcttacagtaggtttgcattatttttctcattgttaattttaatcattttttttcagatacctatgacttcacgtccaggaccctccaattat

SEQ ID NO: 13818 - DNA, 214 bp, Homo sapiens
ctagggcctaaatccgtaattctcattcctggagtggttgatcaacatctgaaagattgatctggagtctacactatggaaataattctgcccagcccttcacataaacctgtttaacaacaatggattctacctgaatgtaatctatttgattggattattttattgggcatttgttatgttgctctataataaaaacagtgtaaattgaaaa

SEQ ID NO: 13819 - DNA, 792 bp, Homo sapiens
  misc_feature (1)...(792): n = A,T,C or G
gccctgggagagacttgcctattctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgttgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaaccatttgccgaagggcctgtatggtgcaaggtaaaagggccagggtagaggacttcagagataaattaaggctttccattcattaggaagtctctgcgaaaaaggactagcatgtcgcgattccagtgtttntattataattgaaagatgtgggtttactgggatcaatttggtttttggtgttcgttggccctaaggggggggattcctggggcgcgttcccttttaagggggggaaaattaaagagacccactcaactgaacattctttgccttggtctttagtgtggggggaacgcggtttaacttcctcttaagggggggaatacgggttttcccaagataggtggtaagccgggaaagaacattgtggaaaa

SEQ ID NO: 13820 - DNA, 319 bp, Homo sapiens
cctagagctgacagatcaggggatctgtatcatctgcactttcccaaacatcaaaggaaggcagtttttcacaagggggtcagctgtactcatatgccccgttttacgtgtgatgatgatgacgctgttgctgctattgacaatgaatttatcccaccagaagatacacatttcagtaaaaatgaggcagatataccatggagactaggaaaaggctcccaaaagaccatcttctccaggaatcttccataccacaaatatgagacaacatttcccttctcttttctgtcaataaaagatcttttgaaaaaaaaaaaaa

SEQ ID NO: 13821 - DNA, 709 bp, Homo sapiens
ccctgtggggaaccttattatgttgtcccaggtggagcgcaatggctattcacaggcacaattgtagctccctacagcctagaactcctgggctccagtgatcctcctgccttagcctccggagtagctgggacaacagacatacaccgtcatgcctgcctaacttcagaaattcatttcacctatcatcaataccacatacaacattttttttacttctatatactctactgccaaaaaaaattttaaaaagaaagaaagaaaaagaaaacatggaaacaagtgacaagaaatataaatttaacttagcaactatttcatttttggtagtctgctgtctgacagttttagcaatcctgttaattacaagaaagcaaaggcatgaagaaaaatacctactcttcccctcaaacaaaatcgtccggaccatgccctgggagaagcactcaggttgttattctagtccaaagcaatgagaaataaagaagaataaagaacaaaggaagtatttaagtgtattcagttgttattaaagatgaagcagaaagcaaattaaaccaataggacataaccaaaaagccaagagaagaaaaagcagttcaaaaacactagctttgggcactttgacatcttccccaacacctgcttattaaagccctaggactccacccctttatttctaaataaaatcacaagagtctttcaaaga

SEQ ID NO: 13822 - DNA, 823 bp, Homo sapiens
  misc_feature (1)...(823): n = A,T,C or G
tggctatcatagatcctcaagatagaagaatcacttgctaaaggaaaccttgggtggtgatcagaaattcggnttccatcctattcaatcttgagaaactcactgtctacaaaactgcttgtcaggaagcaggagagtttcagaattagataatagagaagttcagtgaactgtaatgtgcattaagaaatagagaattacaatgctaccttcggggaaaatgtcctttgattccactatgataccctgtcattgacctgcattaaacataaaatgtaatattgaaaaaaaaagaataaaaaananaaaaatncaaaaaaaattaaggtaattaaaatatacaagattttaaagttggagttgntntgtcctcaacntaagaaggtttgcgcccttttcccttaaaccagggttcattttttcatctttnccttgtgaactggggacattcgcctccctgcctatggccagtcacgttgttgtgtcgcaagcgggcgttacaggtttctacatatctcatgggcgagagactctgttatcttcggtccccggtgccttcaagatggcagcggttggagggaagggcccctataatgcctatttcaataggcatggccccagtgggcgctttgtgaaaaatnccctcccaccttgtanaagtctatatcatacggcgttatatcccatagggactgtaagcccatggaacggaagagcaccactggtttccctacagattgtgctttgtgggttcctctcaacgctaccccccgtattgattcgtttacttttgttatttcaacttggcgaactcggcaagttc

SEQ ID NO: 13823 - DNA, 787 bp, Homo sapiens
ccctagctgaaacttattgctatcgttgtctaaggcaacttttcagtgattggatcatccattgcttcaggtccattgatatccagtgtcttggtctgtttgggctgctataagaaaatactttatttgggctggacaatttataaacaacagaaatgtagtcctcacagttctggaggctgagaagttcaagatcaaggtgccggcagattcagtgtctggcgaggattcagtcctcatagatggtgcccactatgtgtgctcacatggtggaagagacaaataggttctctcaggcctcttttacacgggcattgatgccatgaatgagggcagagccctcatgacctaatcactccccacaaagaccccacctcttaatgctatcaccttaggagttggatttcagcacagcgattttgcagggacaccaacattcaggccatggcatccagcacactagagaacagccttcctggatggtactgaacaatgatgttcttgtgagcgaagattaagccttgtacgcgtctctagatccagttctgtggtccacggcttgtgggaaatatttgttactgactggttgagtaactgatgcatgaataaaaggtaaaagggtgggaaacagctaggtgctgcctaacagcctcaagagtgaggtgggaaatggatagaagaaaataagctcagtaattatgaagaacctttgaacccacattccctggaacatagggcattgtgggttaacaggagcttccaaaattctctttagaggtaggtagga

SEQ ID NO: 13824 - DNA, 814 bp, Homo sapiens
  misc_feature (1)...(814): n = A,T,C or G
ctagatggtcctgtggtttcacttcctatttggtttctgaactctctgagcacgagacttggagacgtggagtcctttcactgcagctttcaaaacctttcttagggctgatatgacaattgctggcactgtgtaattgctgtgtagctacttggaaacttctccactagagactcactgagagcacctattctgttgaatggatttggcacaaggaggaggagagaagacaaatggcctgggctgattagcccagagaccatgtcccaacaaaatgccaccaggaactcatgtgggacggagctggaagatgccagcggttgccccttccccatgttagtgcctcttttctccgcaccaaccctcagttcacaccagaatgagactgcctgcattcactttctgctcttacttcagagaatgtggcttattctcaggcaatgaaccagaggacaacagacattntctttgagggaaatgcaactttntgaaattaaaagggcattttgttntaattgaagaacattcagatcagaaactgggttaaaaataaacactgcagagccagacacagtggctcangcctgtaatcttancattttgngaggccaaggcaggtggatcacttgaggccangagttcaagaccagcctggccaacatggcaaaagccatctctactaaaaatataaaaattagcagggcatggtggcatcggcctgttatcccagctacctgggaagccgaggcatgagaatcgcttgaacctgngagcanaagttgcagtgagcccagatcatgccacacacttcagc

SEQ ID NO: 13825 - DNA, 819 bp, Homo sapiens
  misc_feature (1)...(819): n = A,T,C or G
cctgggctcaaacttgatggctatgtttcatatgatgttgatcccaggcttttatgaaaacttcctcaagatgttgggtgggagaaagggggaagaggaaaccatggacagtcaaagctacgggtctccagctaccagcagtacattagcaaaacaaagcagggagaaacaacatcagaccacctcctctgaaggggcaggagtgcctgggaagcagcagcacaggaggtcaagcccctccctgagcacaggcagctgaaggggctgctgggagagactgaggctggcaggacggacactgctgtatccctggtgtgctccatcctgaagcacaggagaacttcccatggtattaaaatatgcctcaaacaagcagggataacattgtttcagggcttctaataaaacagaaggtgagagagcagagcccaggactcacagtcaaagctactgaactgggggttggccagcttctcacattgcccagtggaggaccgcatcctgtgagctctctgtttaaaagattaaatcaaggtaactaatcattacatagagtatggtccatcacctaccttaattatacaccttcataaaggcaaagtcaaggatgcttgcaaacccttagccttcgcatgactgaaggcttgtgaaatctcaaagatgactgagtgactgcacgagtctaggcgttgtgttagtgcggtataggccagtaatacaatttacataaatcttcctacacttattcatgaaagtatattnttggattattttaatgaaatcactggatggtgttttgcatttaggattttcacctga

SEQ ID NO: 13826 - DNA, 792 bp, Homo sapiens
  misc_feature (1)...(792): n = A,T,C or G
ttccccnnngcagacttgctctgnccccagactaagccagtggcntgatctcagctcactgcaacctctttctcctgggttcaaaccattctcctgcctcagcctcccagatgcaggttcagaataagatgaatatatttgctgcaattacagactttgttgaataactgtgaatcatccaactcttcacaaaccatcttctacctatgtgagccaaatatcttctcactgctttagaggctaacgactaaatatacagaaaacagctttttttttcacgaccctatcaacacaatcagcagcattggtgtggggggccccccaagaggggacactgctccccgggcaaaaaaaaaacagggaaaaaagatatagataccaaggcaagctagtatgctgtcacgcgccctcacctgtaacccccccacttagagagacacgcagacccccacgagacccaagtaagtttcgactgaatgtcctcacccccgccccttcacgaccaccgaggaatacgggcggggagaggagacggttcgtaatctgttcgtgcggacctgttcatctccaaaattataatagatggctaaatcatagatactgagatattgtcatatcagcgaggagtaatgctgttctcacggggtggagggcacaggcgaagcgcagagaaacctaccgcccacgctacataacctcattcgaaagaaggaccgatacacgacgccctaacagtgttacaagatattgagtggtgcatgacaccagcggaaacattagaatcacgtaaat

SEQ ID NO: 13827 - DNA, 799 bp, Homo sapiens
  misc_feature (1)...(799): n = A,T,C or G
aaatgactttacataattgacacagnactttganacncaattngtggcattagcaggggctaagacctcacaagagatgctnntggttagctggttctgaaaggcacacaatcacagggattattcagtttactctttggatgcctctaggattttttggnacagggggggtgcaaaaatangnnnnnatngnnannanggncnncnccacnctnnnnnnnnncntncntgggnnnngnnttttttttttgnggggtgggggcgccgggcggggggggagcgtttttttttttttggccgngccggccgcggggcgggncccccccgggggggggcggccnnnnnnnnnnncncnnnnnccgcggcaaaaaaaaagccgaagaagaaaaagaaaggggaaaaaacaaaacacaacaaaagaaaaaaaacaagacaacacaaagagggaaagccgaaaaagagagaaaaaaaaagggcaaaccaaacgagagaaaagcaggagaaaagaaaaaacaaaaaaaaaagaaggaggaagaagaaaaaggagagaacaaaagaagaagaggaaaaacagaaagaacacgagaccacccagcaaacaaggaaagagaaaagagagaagaagaaaagcaaaaacaacaagaggagaagagagaagaaaagaaagaagagaaacaaagaaaaaaagcaaaaacaacccaaccaacaaagcaaaacacgaaaaagaaaaccaagccacaaaaagcggagaaagaaaagggagaaacccacagacgcagaaaaagaaagaagaagaagg

SEQ ID NO: 13828 - DNA, 1115 bp, Homo sapiens
  misc_feature (1)...(1115): n = A,T,C or G
agggggagggggaggnaaaggggggaagtagaggggggnaggatagggcggaaggggagggggggggggtggcggggggaacgaaataagctcacttataaataagcaacggactatcaaaggacctccttantcacccacacatcagaagaatgaaggatccggcgacaggtacggtgggtgtagcgcagaaatcacacagaaatagtactatttctaggtatgtgcatcaccaatcacacatgattttgttttttgcgtgatgcgcgtgacgtccagttagaatgactttcatcttcgcatccctcggtccgcctccccccacaccacccacacttatgtcaattgctcaccaggncaaaattgacggtatggaggggagggggataggtatacagatcgtgtcagtgatgggtgtttgtcgggtaggggagactgaagagaaaaagttaagacgaaccgaagctgtaattaaaagcacactaaatggcacaatccctccatacttgtgtgtgatgaaggtgccggtgttccaaatgaggaatgattccactcgcccccacccgcactcccttctctcaactacgaccctccgcgcacccgtgtacacgttcgcctcctcctccttctgcacgcgcatgtgttggcgagtcgaatcactttgcgctgatctacggcacgcgatcgtgagtgagtatcgtctttgtcgatacagcgtgtgcatccatggattcctgcgacgcgtcgtgagctcgtatggcgtgcacgttcttccgtggtgccaagacgtcgtcaggtcgcgcgccgttactaatgctagctactgggcgcatcatattagtcacagtagaagcaccgaggtccctgtagtatataagactatagtggtgtgaaagctgtcacgcccgagctggacaacgtctgagtgaggcagaggaagaagcgtgtggcgtcggcgacggttgtggcagtcgatcacctgacagcatatctcgtctctctcttattagtctccgctgctctatatcggtggatgtagatcgagccgagcctgcgactagacgcactctacgccttcgagatcacacgtttacccgcacgcgtcgaagccctag

SEQ ID NO: 13829 - DNA, 820 bp, Homo sapiens
  misc_feature (1)...(820): n = A,T,C or G
gatagggacggggggganacaaaannnnnnnnnnnnnaagacaacttcaggaccacctgagcacgcccttanagggaagacgnacagagctggggganccgcccaccttgcctttctaaagggccgataaaacagcaaaacggccacaggaaagaccccctagcccgggcaacgatacctangccggacgctgcaggggcaaaaaacccacggacgcccgagcagaacgggggcaggggcgcagcgaccaaagccagacacgacggaattttttcgccactggaaagaagctatatagatacgcagcaccttttttttttacaacagaaaatagtaaaggcaccgacgctcttgtggagcgcccacaccatgccagggaaataagaaagagaagaccaacgtacaccaccaggagaacaacgccgcgcgacgaccacaagccagcaccaccaccgcatcagaacccccaagggcgtaagtgccaggtcacgaacctggatcccgcgcagaagatggaaacgtcacccccaacgatccgcaaaaagaccagcgaaactaatagtaacagactgtaaaacgacatagtgcgagtcgtgcagcgtgcacgccatgtcttcacaacacaaccagaagaaaaactaaaatgtaaacgaaacaaaaccccgcgtaggcgaagagcagcgcacacgaggcggatgcaactaggttagaggcgtcggatcgaagtagagtagttaatataaccataaatcaaaaacaccccggcgaactatacaataccgaaaaataccccgtcgccgacctcaaatttaataataac

SEQ ID NO: 13830 - DNA, 1712 bp, Homo sapiens
  misc_feature (1)...(1712): n = A,T,C or G
tagtgaggnannnanagaantnnganananaagtnntaaagatnntnnnngnangannngtgtgggtgtgtgagtggggtgagatngnaggatgtagaggatatagtagggagggggaggntaannagtaataaagaaatgcccttanagtagatagagaagagaaccanaagaagannaanatangtgaggttttttcgacagcgnngagaggagangagcagcggagagagagagnnnnagnngcgngannnnnnacngacagangngnggagactgatcgatgtgcagagccaaatagagtggatantgatgagagagtaggaatgagctggtgtacggtgagatagtctcagcaggtgagagagatagtgaggtatagattatgctacacancncnttatataataatagtctgtatggtntctantcgtanataatcagnaagatcaggtacgccagacgtgnctcagacncgacancaacgtcagacgtcgantatactgganaataagnagagcacacagtagatatancgtctccgtgcccctgactgcgtgcgctcctacaggtcatgagtcatcccantcgattaatntctcganatncagaagnatanacgagacgcgcgtgggcggagaggcgtactcgcgcgngtgctgtgctctctgtggtggtgtgtagntgtangacggtagtngntgccttcatcaacgagacnacagtcaccctanacacgcatcngtatgcgccanagatagacacaggtacnggcannaagcacagcngcgcgtgggagtgtcagaagcatgatatnctaactcgtacgacgctcgccggccacacgacacaagagcgngtcgactgcgtctggtcccgcgcgcgcanancncactcctacgttctgagcactcgtctnancgccacagnaacgcgcccaaccaacgataacgacacacacatccnctagatcacgctgagatagagccgacaccacagcacgcggagcatgcgcgcagatgccgcgcccggcgtncgcgtcacgcctcacactatatcacatntcacatcagcacacatgacgacgacacgagacccccacatcacgacgtgacggcacgacgcggcgaggcgtgagtgagtacgagcgagagcgcggcggcgcagcgaccgtagcgtcacgtacgcactgccgtatattcacgcctactgctcatcagcgttgcgacgatcgatgtgaggacgcggttggaaggacagtcatagctncnggagcggagacgctaggtcagagacgatgaganaccatgtcgcgtggagagcggaggatganataacgtagagatncatgcacatataatgatgtcacctacgaccacacgcacccacctgtgagtttaagcaccnccttgtagaggcaccgagttcatagcgcgaatagagactctggccgcagcgatgtggtcagagcttcaacccatacgtctgagcatctccatcactacgacactgtgtagcgtcacacgaccgcagaggaccagagaggcgggtcactgaagcgtagtaaggacgacgtagtagtccgcgaagcggcgacacgccacacgtgataaatntatgacacgcgcgagtgaacggctcgacacagggagagacnccgacgcagagagcgagtgacgatacgagctcgctacatcatatangacagatat

SEQ ID NO: 13831 - DNA, 800 bp, Homo sapiens
ttatgacagagacaaatagagcggcagttaaaatgcttggcatttcgaaaccctggaccacaggtagcagactttaatcctgaaacaaggcagcagaaaaagaaagcccggatgtcaaagatgaatgaatatttttctaccaaatacaaaataatgaggaagtatgacaaaagtggcaggctcatctgtaatgacgctgatctgtgtgattgtccagagaagaactgcctgttctgcttctacccatgcccgaagtgtaactccaacaggtgttttttctttagtgccgatgcaaccgacggtgggtttacgatgccatggtcactgagtcaggagaggtcatcagcacgctggcataaaatgtacctgactaagagctattatatgtggactgagttggtttttctccgcgcgaatttgtaaagatctcgttcttttgggccatttatagggttatagagagtaacttcatattcattctgtgtgctttggtttgtctatcttatgttttgtgatgatagtgttataacgtatggattatgtactgctttcttcttgtctctcgcgctgtttttagtttgtaactattagatttttgtgggtatgagatttataagtcgtcagtattaatactgttgatggggcggcacgtgaaatactgacatagtcataggaggttccgtccgaaattcagaatttcgtatatggtgtgtaacaatgtacgccacgccttggcgtggtggtgtgttatctagcaggatgacagctttatgccgtcataaattttatattatgtaaag

SEQ ID NO: 13832 - DNA, 860 bp, Homo sapiens
  misc_feature (1)...(860): n = A,T,C or G
ccacccgcaccccgtcagcannnnnatnaaanannnctcaaaactaggccccactgtgtgatgttttccttgggaacaacgaaggggatttcgtttcgattctgatgttactattagccggaagattctaaccggctgggcaaactcaacagcacctacaggataaaacaggtaaacttacaggcagtcatctcttgttttacagcaggaataattcatgtttgtcctataactggtgctctttcctgaacgaaattagtgccacctaatattctttttctgcaaaatacagaaacattatacagttagtgtttttttttttagaagtaagagaatgatagcgttgccagggagagctgtgtggggaagtagtagtaaaaactggctataacaggaaggaattaatgaaatagcctggtgtcccaaagagctcactacacgaaaatattgctgatagaactgagggctcccaaattagcgttgactcttgctatgaagtaagacttactcccctatgtgcgttactgataagggcatctctaatacggggggtaaatcgttcaaagaaagcaaagccctttctgtagtcaagagcaactgttcatctttggtaaaaattgcagatattttagatagaattttcaagttcaagtacacaatcttcgctataaagtaaagacgtgtacttaataatcaagatgcgatctaagtgtgggtatgttagcatctgaaaaatagttcgtcaacgactaggtcagattatttttctaaatggtagtatataatgtcgtgaccgcggaacgagtacaggtctcttgacaaatatcacgcctgctcaataagataaataaatagataat

SEQ ID NO: 13833 - DNA, 1248 bp, Homo sapiens
  misc_feature (1)...(1248): n = A,T,C or G
aaggtaggagatagagaaagagaaaganaaagagaaagggataagagaaggagagaaaatataaaagtgtaagaaagaaaaggaagggggggttttgtgtcgacacgaccccgagganagaacgactttctcactaagtggacactagagacacgggtgtgtatatggtcagtctcctcccatactttcgcatagtaatacgtagtacatcgcgcggttaatgtatatgctatacctagtgcgtagcggtcgaacacgttgatacatggtacttctgatatngaattaataacnagtgtcaatacatctactagagcgagntagatactattgttgtgtgttgacagttgagttaatgtagttgcattgtcgtagtagactatgacacatgattgctcttctcatacgtagtaattcacaaattacttgctcattctctaccattgcattccactaatatcataaattacttaatattatctattaatagcatatctcgttttacttcatattttgcaaattatatgacaatattgataatacattataattacgcgtacaaatgtttcatgaagtgttgactgttgatgtctttaatataacttagagagtagtaaacacgcgaattgtaanatagaacagaataatggaagtaggactatcctctatactaactatcactaataattataatatctattcttatattcaatcactataaatcactctgttctctttacgctctcttcatttctttacgtctggacgtcgaatctaccctcctcgactcatatgctgcgaatgatttcgtattatgttatgtatagtttataaactcgcgtgttgtgtaagactcatccttaattactataacttagaagaangtatatctacaagtagttgaaattcattagtgttatatttgccagtgctgtttatatttgttaacgcattgctcgtatngtaatatagatctgttcataagctcgacgttgcccaatatattgctnctcttactacaataaattaagttcaacaatcaatatcaactagtactggaaatcaatctaataattatantataatatcatctgtacacttcgacacatctaatctgatataatacactcagaatcatagtttacacagctctatataattgttcgataacatgaaaatatcattgnactactcgtaaatgtctatagtatatgagtcgtatagaaaccgagtatatcataaactgat

SEQ ID NO: 13834 - DNA, 855 bp, Homo sapiens
  misc_feature (1)...(855): n = A,T,C or G
gcggaagagagagcgcgcgccgcaggcgcggagaaaaagaaaaaacaaaacacaacttaaagggacaacaggaagcanccgctcaagggggcgaaacgaaaanggagagaccncacaagagaagccaacgttcagcggacccagaacacccgcnccaacacagagagcagaacggcaagcagccaagccaagaaacacaagacacacaaaagcgacggaggacacagaggacaggcacggcgaaagcagcaacagagaccgaggcgaccaagggcaggaaaggaggagctgggccgcgcggaacagaggaaccaagaacggaacaacgctctctggcgaaggaaaagacagggaagccaacccgccacgcaggggggaaccagaccagaggggaaagccggagccgagcaagaaagacgagacgagcacaggggccagggacacccacggagcagggggagaaacacaaggaaaaagagcaagacgagcccccgcccgaggacaaccaaggaaagggccaagagcagcagggagaagaacaggggggacacaagcaacacaggacaaagaagcgacgagggcggggagacgccagagggacaggaggagggcagaaggaggggaggccacggacgataacacgaacgagaaacaaacgccacaccaaaaaagaaaaaaaaagaaaaaaaacgaagcgagaggaggagggcgcgcatgacagagcgccacaaaaaacacaacaggcgaaggagacagacacaaaacagaaacagaaaagaaggacaaggcccgagagagacccacgaaaggagcaaaacaccacgccggacaccaccgaaaaagaaaaacagaaca

SEQ ID NO: 13835 - DNA, 1775 bp, Homo sapiens
  misc_feature (1)...(1775): n = A,T,C or G
gggtggggnnnnaaaannttannnnnnnaaaannnnnnnnnnntnnntnnnnttnnnntatnnnntaatgagtatantnanannantnttnggtnntagntagnangannnnaannaanngnngaannnnnnnnnatnnntatttttatanntggangtnganaananatnanggnnnaataatatcgcncatgtatatgtcnatgcgnacccacgtgtcacagagnntatctatcanatcnctgagtacgacgcaacaagcggctngacagagcgnctacagcnnacagtntcnagtacgagcagtgcattgacggcgacaagnaaagcancaccacataagatcatcagncncgcncgcannatactgctgccgctcgtctctagcatccacctccgctctctatctacactgtagactcgaccatcagcctctcacttatatcgcggntnctagcgcagcccngcagtgtcagagtatcatccccacacactactactctnatgttcntgtcacncccatagatctatagctctcacaacaactcacacgggtgacntacgtggtcaatcgcaacgtataggcgnacacgacctgccncggcnctcctcccacacgcgtcgactacgccnagcgacngctcntctgccgtacactcgctgatatacgcatacagacccgcgcnanacnatggcgtgatgtcagtccacgtcgagcgtcagcaagcagacgaatgtggtgtcgaatcatccacagcgttgagngcngctcagaggtagatatnaggtgtcggtatagtgtatgaatatgagtgtcgcgagcgcatgcgctgtgacgatgtntgtgtatgcagacgcngtcatcgcgctgtcttcanactgagagtcatntcgtaagtagatattagtcgtngtgtatagagcggtgtaatcgctgtagtatcacgaacagccaaangatactatacgcgtgcgagatctcatacactccgtagcatcggtgtctctacagacagtatgtcgtgtgcagtactatcgcgcggagatgcggcacgcaggatgactatacgtgtgctgctgataatgacacactacagcccacatacgacntcnctctatcctatcatcactccatgtactctatcatcacgatgagntgtcacgtcgtctcatgatgaccgacaccactaatacgcanccacagtatcacactcgcagttcatgcgagacgatagtactgaacaacacacgtcataatacatctcnactcgctaatacccacgcatcatgatagtacacgcatntnagacgccggcactgcgtgtacanatgcatactcactctagtagagtcagnctctatatacnacgtcattgatgtgtagacattagggtganctaactcgtcgcgtcacagaaagacgatatgtgcgatatgctacatcatagagcacgaactgcgctatagatcgtagcgcagcagtggctaagaagctacagtgagatcagttgcaggatctactccgtgtagactcttgacttgttactcgctgtattagcacgttcggcgctatgtctcctgttgagntaagctgagcgtggatacgcatcacgagtanagtgatagtcgtacgtcgtactatagcagaggaagctcccatacaatcacgtgtagaatcgactgcncacgagtattccangcgcagatgagactatgcatcgcgtattgttacaacgtgccgcgttcgccncgagacagagcgttatangacgacg

SEQ ID NO: 13836 - DNA, 326 bp, Homo sapiens
taggactccctagacaaacaagataggcgttgtgagctcccccaactctggagaccttgaagtaggaggtaacaagcaccagcagggcaaggaaaaggaagaataatagcagtcactgtggctacctgcatatccattgaaaaccctagtcatggttgtgattttttgtttaatatccaactttactcagtgcaaggtcgaagacagcagaaactatatttggctcgttcactggatgtgttctcagagctcagcccagccactgccataaggtagatggtccataactgttggtgcaataatggatctatctaaaaaaaaaaaaa

SEQ ID NO: 13837 - DNA, 782 bp, Homo sapiens
  misc_feature (1)...(782): n = A,T,C or G
taggtcagtgaagggttgatattataccagcacatagactgtgagacactggctggactgcggaagattcctttacattcacggcctcctccccatcagcagccctgggacccgaggaattctgtattactatttcatatgatatcaatgagcctggtcagcagagttgtctgcttgcaaatacagagcaagtccacccaagccagaagctgactttcttgaagagatatttaatatcatcatctctccaggtaatattattataatgaccaggcaccagaattaaagacaaaggggcttcagttgaaagtactgcagggcagtaggttggctgcgggacctgaacatctgaaaatggaagatctggacagtcctccagatgaaatcagatatatgatcatccgtaatcctaataatggctttttggcaatggcttaccttctggacacagctgttcaccattttacacaagctgacattgataactctcaggtgtggttcatacaggatggaagcccttcctctggaatgttctactttagtgtgacagatggtgcacaccacaccctctataaactcttccacctggatgtcattcccatctccatcagcattgtgaaccttactgacctacttctcccacaaggccagacaaccatccccatcaccaatgctcacctgtcagccatgaccaatgggaggaacccncaaatcacttacatgataacatggcccctncacatgggcacctgctgattgaaaaccaggtggtcaccaacttt

SEQ ID NO: 13838 - DNA, 783 bp, Homo sapiens
taggtctttgatgaagcgccacattttgaaaaaaagctcaacatcactgatcattagagaaatgcaaatcataaccaaaatgagataccatctcacactagtcagaatggtgattattattattattattattattattattgttgttgttattattaactgtagagacaacagtctcactctatgatcttgaactgctggccttaaacaactctcctgccctggcttctcaaagtgctggaattacagctgtgagcctctgcacccagtcaagtactatatcttaatctgaggatattgcttctgccttgcagtcacctggggagagctaaagagaaaggacactctgaagctgtaatgttccccctcaactggattaatcttcacacaggatgcttcctgactctaggccccaactccctctttacagaacatttactctagaaaacttgtattgtaaactctttatttgtccctttgagatgtaaatatgtttgaaagcctctttcctattttacagtgcagggctttctttctgaatgccctaggagcaatctctttgaaatcaagaaaggtagcagcctaactcccagtctccatgagagggtaggagtctaactttgatgggcacaattagcaaacacactccactccagcttttaaaaccttctgaactccactccttgttttaaactcccctgaactccactccagcttttaaaacctccccagctttttgtctcaattaagttgagcccaaactgagttccggctggggtattt

SEQ ID NO: 13839 - DNA, 782 bp, Homo sapiens
ctgactcttcagtgctctgatagatgaaagtttcacagtatggacaagagaggatttgacgagaccgcccattaaacaggactctcggagccaagactgaggaatataatagccttgtgatgttagggcagacaaaactttctcttatatgcatgtcctggacagttcccctgcttcatctcaagctctgtatcaagaaacatgaacagcttacgtgcatactttctcatctctgtatctctgcaggtgctatcacatgcattaggaaccttttttttttcttacaaaatgggaaaaagcttcctgttccctttaaaaggcacctcaatgaccaccgcaactttaaagctatcatacatttgctcctctgtcctttcataaggccctaggatagcatgttattccactggacactgacgttaactcatctcttcgttagacagtagcacatgaacaaacgactacccctggcaaagagccgcgttcttctcgtactcaaaaaactaataaatcgatcctgaacaaactgaggcgcaccccgactccccagtcgcgaggacatgtcacgcactctcatatagtgagagaagaaagctaaaccgtccttaatttcgaaaagccctccgccattccgctgtactcagcgtaatcacgcactatcaacgggagagtcgtccccgcgagctatgggcgtatacatataaccacgcacggccccagcccccaacccgtatacgattgtaaccatacacccgactctacactaatatatgataataatg

SEQ ID NO: 13840 - DNA, 1291 bp, Homo sapiens; identical to SEQ ID NO: 7522
  misc_feature (1)...(1291): n = A,T,C or G

SEQ ID NO: 13841 - DNA, 1382 bp, Homo sapiens
  misc_feature (1)...(1382): n = A,T,C or G
cacgcgccgcgacccgcgccccaacgnannngagnagngggaacgngaacnacggcacaaatccaaggacaccaaaccacaatgcggcccnttggatgcagggaacaaccagnacgctnataagaaacaagcgcacgagggctagcgagctttcacatgcgacggcgccagaaaagcaccccagcngacggagggcgagagaagagaggcaaaagagcagagaacggcaacgtcacacgagagcaacccgaagacacaacaccaggccagaagcagggctccgcccaacacacaccacgcggacaagaggagcgcacgcaagcaaccgcgaacaaacgcacggcgcgcacgacaccaccacggngaggagngcaaagcgtagcacgaaacaaacaacagagacacacacgagccctgggaacacacagagcacagcagacaccacaagtacgcatctacaagcaaaggaggaagaacccaagacatcgcgacgacacagcgaccacacacaaggacgaaccaccgcggngtggacactcagcatgagcacgaccacagcacaaactcgacacaacatacctacaccacaggcacgaggcagcgcaccacacacgcgcgtcgcccaanagacacaacggcaacagggacgagccgccgacgagcaggtagacgcacgagcagcaacgacgaccancacgcagcacgacggcaacctacagacacgacaacacgcccgcaaccacacactcacgcacaacgtcacgcangcacacaagaccncgcgacacaggcgcgacacagcacaacagcacagcacgacnacagncantccacaccgccacacacccacaaacacacacacagtaatagacaagcacaacgcaacaggccaacacgaggacgcgcaagagcgcacacaccaacaaaccacgacacagagcacacagcgaancaccacacaccgaggacacgcccaacacatctncgccacgaacgcacgaagaacaacacacacagangacggaaccaaggagnacgacgaaaacaacacaccgcgcacccagaacgagacaacacagcaatacggcagcaagncggccgcacaggagacacaacacgacagcggaccaacgaggcacagcgagcgacacccaccgacgcaaacgaccacgccgagacaaaccgcggcacaacaagcacaccaggagaacgcacgatncaacacacacangtatagcacggaanagaggacgcgcngcccggcacgcgcanagagctcgacgcacagatgagagacgtcngcacgagcaatctatcaccacgacacgcaacccaacacgcgacccaggaccanaacgacaaagcagacgagcataacagag

SEQ ID NO: 13842 - DNA, 1015 bp, Homo sapiens
  misc_feature (1)...(1015): n = A,T,C or G
gggggaggggggnnnagnntngagnngagaaagagaaaagaaaaaaagaaggagggaaggaaaaaaaattaaagaaaaaaaaaaaagggggggttctggggggggggaacccaaacnngaggaagaagagagagagagaaaaaaaaatcttaaagagaggggaggtgaaccccgggggccgcaacgggcgggccagacgggggaggcggagggaaaaaaaagaacaggggagggaaaagcaagcagcaaacaaagaaggaggagaagcgcgagcgaggagaggggagcagcgaacaaccagcaccaaccgcaagcccagggaacgcaccggggcgagcaaagcacaggggaaaagaanaagaacagcgggaagagaaggaagacggagcgggggcagagggggaagggggaggaggggaggggggcggaagggggggaaacgagaagcagacacaagccacagaacaaagcgcaagaagaaaaggggggagcggaggagcaaggggggagggccggcggacgaacgggcacgaagccccccacaacaccacaccagcggcaggagggaggggagagcaaccgggggggcaaccgggagcgcggacaacaacaagacgaagggccgaacgcaagcgggcgaaggggcaggaagacagcgagagcacnagagggggcgcgacacggacgaacaaggcgggagaggaggacagagacgaccccggagagcgcgcgacgcgcgcagagcgagagagcagagcgcgaggaggcggagggggaagaagcggacggacagggaagacgggcgggcgaccgcgacggtggcggagcagcacgacggagcgcggaagagagagagagagaagcgcgaaccaccacgaccgagggagcgtaggaggggcgaagggggagagaccagaggcgacgacgcgccggcgaaggacggaggcacggccacancgcgcggagacgggagcaccggagggaagacgcgagggagagtagagagacaggaggt

SEQ ID NO: 13843 - DNA, 789 bp, Homo sapiens
  misc_feature (1)...(789): n = A,T,C or G
ataggttttattagtccttntttattgctgatacagactaactgagactggacaatttacaaaagaattaggtttaatggactacacagtttcacatggctggggaggcctcacaatcatggtggaagatttccataggattgacaaagatgcctcttcatttttgagaagagtcccttcattgcaatattttatgaaaagttctatgtgtaactatttggtacattgtgtaaatttatgtcttcttaaagtgactctacccttaaatttttttgttttcaagggtcacgtctcttgggtaatgactaacgttctcctattgattagtaataacaattatgtagaatggtgattcttggtgactttctgtcccactgaatgaaacaacctatttcaaaatcaagactctgggacattaggttattctaagacacatttttttccccacgtattgaaggcatatttctatgccgctgtattcaacttgtttctacaaagaccagttattggatttccaccggtatatttgcttatgtaagccttgtttatacatatgggagacgcttcggagtgtgttgtgtattgcttttggcgttcgatccgaatcaactcaaaactccgcgagtgtttaccctgctctcgtcgagacccgggacctggtcaaagaatcttacgcccacctagcctgagcagagattatattctcgctctacgcgtctcagccgcgcggaacgttatggtagttttaatgtaatcccatacggtccttcgcattattaatctattatt

SEQ ID NO: 13844 - DNA, 801 bp, Homo sapiens
  misc_feature (1)...(801): n = A,T,C or G
gctagctggactacaagaccaccttcncatccgaggggacccagcccagaatcccggggaccgtcttcattcttccttcggcttcaacataccctcgtccctattcccatcgactcaggccttcaggcatctctccagcctgccctgagctctccaacccaagctacgagccctcagccttgcagggcctgtgctcgcacagcagccccccagccctggcactggtctccctgcctccagacctagcagtcattttctccgacctgctccgactggaagccactgatcatacgatgcatatgatgcatacaacgcaaagctgatcatacgatgacccctgacccaactgaatgccttccccccatccacagaagctgtaataacctttctgaatcctggatccttttttgtccttttaaagatatgaacccctccgggcgcggtggctcacgcctgtaatcccaacactttgggaggctgaggagggcagatcacaaggtcaagagttcgagaccagccctgccaatatggtgaaaccccatctctactaaaaatacaaaaattagccgggcatggtggtgggcacctgtagttccagctactcgggaggctgaggcagcagaatcacttgaatccgggaggcaaaggttgcagtgagccgagatcacatactgcattccagcctgggtgacagaacaagactctgtctcaaaaaaaaaaaggggatatatatatatatacatatatatatacccctctacccagagatataaatgcacatatatatatacaccctggcca

SEQ ID NO: 13845 - DNA, 778 bp, Homo sapiens
  misc_feature (1)...(778): n = A,T,C or G
cgtagagggacacttttaaaggagnttacaaggttgtactttctgttacacattgtgatgttttgtatttagtaggtctcaaaaataactacagaatgtactgggaacgcaacatcttgagactatgaggaactggccagagcagtctggtcttggtttgtctcacctagaaacagaatatttttcatttagtaagtgtggcatgtcatgtgacccctaggacataatctctaggtgggctgcattttggggtcctccttttgtggtgcaagtggggacatatgcagactgattccatctgtgctgggaagcttttctgagcctcgagaaactggctcaaaatgaaacctaggcttctgtttccccttgctgcctatctttaagcaataaatctgcttcttgtaatttgtgtgagttttctgtctcacaggacctgtgcaagtgataaaaattggcatggtaaccagtgcacagtgaacctgctttcattccttgaaataatactatatcttcatgagcagaacatgtcaattacaattttcagggttctgagaagaatgtgatgcatagtaacagtttatatgtatattttatgggtttctttataactctgggtgccctggattatttgaaataaaataatggtgattcttatacttttaagtctattttcaaataccccatagtcttcttatacatagaatatatgtgggaaccacggcttctttctggtatcttgatagcactttttgggaaccatggaaaacccctaaatggg

SEQ ID NO: 13846 - DNA, 1318 bp, Homo sapiens
  misc_feature (1)...(1318): n = A,T,C or G
cntcatacggtcgcgtcctcgttgctgctgctctccgctgcttagctccttcgggtcgcccctctcgccggcgctcgtcgtcatgcgcgtgtcgctcgcttgcatggcgcgtgctcgtcgtcgttggctgtttctctttgctcgtgtgtgtctgcatccggccgtcgtgtgtctctgcgtccggctgtcgctcgcggtgtgcggctctcgtcgcgtctatctctctcgtcgctgtgtngcgctcgtncgtgtcgtcagtcgcgcttgagtctcgtcgggcgtacgcgctggtggctcgctctcgtttctctgccgtgccgcntcctgctcgctgccgctctcggcgtccgcgcnttcgtcgctcgntggttggcggtgctctgtgtctgccctgcgtcgtcaccngcntcggccgtcgcnccgcgtccctcgtggcgtgctcgtctctactctcgcctcgcgcggctctctcgccgtncggctccgctggtgcctctcgcgcctccgctcgctgccctgcnccgctccgacgcctgtgccgcgcggccctcgcgcgcgtcgcgctcgcccgtcggcagttctatatctgcttgtcctagctcaccgccctgtgcccctccgtccgtcgggctgggcgacgcttcttccgctgtcgtcgccgctggcgcctgcggcgtggtcgccgcccggctggcggctgtgggcggtgtgcgcgcgcgccgggcggggctgcgggctcgccggctgccggtctcgtcgcgcgttggcggtgcgtcgtcgcgtgcctgtgtgcgccgcgcgctgcctgttccgctccctccgcgcgcgcgccgccggcaggcggcngggggggtgtgttcgcgttctgccctgcctgctcgttcttcccctccgtccgtcttctgtctgtatttgccttcgggngcnccctgtcctcttttttttctgtcttgcctcttgtccgccccccgcctccctccgtccccccgcccccctctcttgcttctgtgctgtgctgtgtgccgtctcgggcccgcctcgcntgtcctcgccctctctgcgccgcgtctctcccgcgccgncgcccgccctctgtgcccgcggcggcgccctctcctcttccgtgcgctctctctcctcccttttttgaggttttttttctctttctcttcttcttctccgccgccgnnccgggtttgctgcgcgctttgaggttttttttttnntggtttntccttttgaggctctctttctctttcctcntctctcctcccctccttcccntctntcctcccttcccccccctctctccctccct

SEQ ID NO: 13847 - DNA, 1631 bp, Homo sapiens
  misc_feature (1)...(1631): n = A,T,C or G
gctgtattgttacttgttctgtgttcggattgcgtcatacgtgcgtcccgctatantgtgttagtgaccgacggtacggaatatagcgtgtgcgccatcatttagttggctgtgcggatgtgcgcgtagtgcatatatcgtcgtagtcactcctacantatcatnttgcgatttcgtggtgactttaatattgacgtgtatgtctcgagtggtcccactcgtcatcggtctgnttcttcactggtgtttgaccatacactctgtggcataatctcgtgtgctttggtgagtgacaatagatacactagttgtgcggtgcacacaccnaacatacacacacgcaatatcatncgtctcgcgcgctctctcgcgctcactgggcgtagcggnagagaggacctgtctgctgcttgtgcgctgtgcgtctactctgtgtgtcccatctacggcgcacttctagtgcgactggttctccacatcgttactantcttgttcgcatcacaactgtcgtctntgntgacggtgtcatatacaatctggtgtctcttctctcatcgtaccctggtctactgtgctcaacactacgatgacgctgtggttttaccggcgntgtgtcactcgctctgaccttctactctgcgagtgatgcgatntagtgtgtggctgtcgatgtgctcttcatgnacagcattantgtgtactangaactcgatcatactaccgtctaccagtgtgtattgggngtgtacacctaanaacatcgagtgncacatgttgggtgtcgagagtgngngcgtgtgcacctatcacaacactgagcaagntgcatcaagcacacacgaatcaatataacaacatnactatcgactnctatgatggtcacgtcgtgtatgtgcgagtgatacagngtcatcattacatatagtctagttcgattgtagtgtctgtgtgagcacatggtcgtgntccactccgncgcaacatctagtngatnttgacactcactggtgtgcgatcattacatactatatctcacngtngtacgcgctctananacatctgttctcgttgagtcgggtgcgccgtgtgtctgtgcgctcnactgcgactaatnantgcgtgagtgacatatctgtgantctacacatggcgcntggataggtgcaggggngacatgctctggcgacacacacgtcgactgcgcgacggactctatgcatgntgtagctntcgtgctctgctctactcaatcgtggctgcactctctcgtgttctatacctgcgactctgcgctcgcttacgtgtctgtgtatactctgagcgatgntgatctggtgtgtgtcactcgacncgcgtggcgattgactcgagtgagagacgaacgtctgngtctgctgggctctgctgcgttgtggtatagtggtncactntgtcggcgtaccactcggtgcntggantcacncgctcatgagagtggtaatcacggctggtggatattntgcggngatactaactcttgagattgacataatgtggagaacatacagatgtgtatacatttgtgcgtccactgacggcgctgactacatccacgcactctcgtgctaccncgagtcgcacacgtgtgact

SEQ ID NO: 13848 - DNA, 781 bp, Homo sapiens
agattgggaaactaaggcccatagaagaaaaaggaagtggtcaaggtcattcagctaaaggacaagaggtgaattttcaaagcattgtaaccctgaggctgctcggttcagggtacagggtcaacagacaaggaacactcctgtgtttctgttctcaaagccacgggtgattctctcacctcagctaagtagtcctgacacattttggaccaatttgtttctctttctacaaatattttgtgattccttctcccttattaacttttttctaataaaattgttgttatgtataaaagaatgtgtgtagcacacaaagaaataaagtgtaaaaaaaaaataaacacaaatgatccaccccttaatttaaaaaaataggaactacacatgtgtgcttccttgaccccactccctacctccctgccaggagggatccactctcttaaattttgctttcttcattccctaagtttctctttcaagctttaatacatgcctacatatctttagacattgcatttttttgttccactcttttttagatgttatacaaatgccatcatgaagctggcggtcttttgaggttcatttttcacttaaaatatattgcaaagatttcacaaggtgagctcattactctaataaagtattaattggggaaaaattccataatttatggaccctttctactgtgaatcaagtgggaagggtttccagggttttttaattgggaaaaaattagctttgtttttttaaacattgcctggcaccatgggcaacagtt

SEQ ID NO: 13849 - DNA, 844 bp, Homo sapiens
  misc_feature (1)...(844): n = A,T,C or G
atcaagataaaaaactaaaaacggnnnngaaaaaannaaacaattangagnacacacagagaccctttgggggccgagccaaccccacggcgcgcctcgacacacgagacgttgaggaggaggcaaaacccgcgcctcgggacgcacttagcagaggacgtagccacgccgccacacagaacganccggaccgcccaacccagcgactcacatagacgcaagaactgtcactcacacacgacaggcacgacaacggaaaggagcggagctgttttcacggcgccgctatggcgaacagagacaaacgcagagatttttttttccaggggctgtgagcgcaatacaccggacagagagaggccgagtagagcggataacagcaggtatgttagcaatagagaaaaagacttctggctccttacgccccaaaggaggacctgtggtgccggttcaccgtagggaggttgaccgaccgacactggatcgctgacgccatggccttagtgctcccggtggtggaagcggcctaacgcccctgaaagcccgaaatactggagaccacagaatcaagggaccacccaggatacaactgttaagcataccgccgccaaaggacgtgaacgggcaaaagggaccggtgactggtggtaatgaccaggaagcgccgcgctggacacacgacaaaaacacgcacactcccaccaaaggagaaaacgaacagaatatcaatagaccggggtatctataggggaggaactggagggaaatacaccacggactagacgcaaaaaagaaggtggccgatagtatgatacgagaagcatgcggctgtttatatgtagag

SEQ ID NO: 13850 - DNA, 988 bp, Homo sapiens
  misc_feature (1)...(988): n = A,T,C or G
gtgaaaaaaaagaaagaaaaaggagggaaggaaagaagaagagaaaaaggaaaagagagaaaagggaggatggagagtgnggaggtnngtgattgttnagaggngagggtaagggaagagtagtgagatgggataggaaagaggtttaggaatggaggtgtaagggaggagtagaaagaagtgtagtctaaggtagatatttgtgagtggatcggaaggtaagttagtcagaggncagggtcgttgatgttttctattttgattgtctgatnttgtcctcctgataagtttttaattgagattntntgatcatagtaaagagtnnagtagaattnatattattatagagtatagcattagtaataatcaggacagagaaacaggtatcacaaactcgacactcctacgcggacatgtaaacaacgctatccaacagtccccnaaccgtagttagccgcgcgtccagaggtctaccccccactacctgagctcctccatccacccaaggaactcgcaggcagagacgcgggagactgcacgccgcgtcacccgtcagcatacgcttgctcaccgagtcgtctacgacaagatttcgtggggtcgaagtatgatnatgttgncgggtgtgtatgttgtatttatntctcgtttattnntatcgtgaaggaacagagagaacgaggagttggaaaaaangaaagaggagtccggagctgcccgtctggccacatagccccacatccacctaccaccccatgagcccctaacaccttccacagtaaagaagaagtgtcccatccggtncctgtttggccacgtgttttagagcacgcgctcagctgccagtagagancagacgaaggtgcctccgcggggtggtgcgcggagaaggagcgcccggagtcgccacgcccggttacgtntcgcgtcagtcttccctgtagtagtttatcacgttaaccagataagttgaacccacaattgcgcg

SEQ ID NO: 13851 - DNA, 780 bp, Homo sapiens
agacatccagcccttcatagacactgccagccgttaacccgaagccctgcacagccacttcctctctgtacagaagagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccgacatggtgaaaccccatctctactaaagatacaaaaaattagtcgggcatgatggtgcacacctataatcccagccacttgggaggctgaggcaggagaattgcctggacccaggagatggaggttgcagtgagccgagatcgcaccattgtactgcatcctgggtgacaggatgagactccgtctcaaaaaataaaaaaaaaatctatccccagatcacggtgcgcctgtgagacagagctgtcaatgtcctctttcccttccttctcatttgctgtttcatagggcttcatcagcctgagttctttattagaattgacctgcatcaatccagtgcccccctcataccacctactagggaaggctgcgttctacattacggtcttcagggatcctctctggggcccacatgcttccctttttggtaacctgtgctcggggcagttttaatctt

SEQ ID NO: 13852 - DNA, 791 bp, Homo sapiens
  misc_feature (1)...(791): n = A,T,C or G
ttcaaactacgatctcactctgtcacccagctggagtgcagtggcatgatcacaactcactgtcgctcaacttcaagcaatcttcccacctcatccttccaagtaactgggactacaggcatgcatcaccacacctggataattaaaaaaatttttttctacagatctcactatgttgcccaggctggtcccaaactccttggctgaggcaatccacccactttggcctcccaatgcattaggattataggcatgagccactatggccagccttgctgttcttttctatcgtatttgtaatttgtatttatttatttattgatcccccgctctaatctttattatttccttccttctgataactttgggcttagcttttcctagttacttgaggtgtaaagctagttgtctatttgagatctttctttntcctttatgtagacatttattgttttaaacttccatcttagaactgctttggctgcatcccataaagtttctggtttgagtttccctttctattttggcgaaaaaaaaactcgtattttccttgttgagttattctataaccccaccgattggttgaagaataatgttgggttaaaggggtacacatatcgaaaaatttttcatactctcccccttgatctttagattcaataaccttgagaaacaccaaagattcttaatatggtgttccttctcgtcaaactttttaaaaaccttattgcgggctaaccacatttacctgcaagaaataaatcccctttgctccagaataaaagaaatgg

SEQ ID NO: 13853 - DNA, 775 bp, Homo sapiens
ttttgctgagcatcttcttaaacatgaggtgggcaacatgagacccccacttctatcagtatccatcctgactggacccaagtggacagtttgagtttccagttcaatccagttcctgcctggcctctgctggcctctgggtttgcaatcccaactccctaccaccgccactactgctgagagcatcccctctacagtactcagaacctcactggctgcctgcaaccctgggggatcagcagaagagactctaagcccatctatcagtgcccagagaaatgcacgtggcccacggctgctgccttctgaggtcacctggccataccccaagtagtctgggaacccatgctgagcctggagaatcttcactctcccacctctccctccattcctcaggggaacgaggactccaaaagagccgtcggataaacctgggtttggatccaggctttcaaccttggacaagttacctaaacctcctgcatctcggtttcttcttcgtcaaatggggacaatacttctttctttaaaggctttactttgaggatgaggggagagggaagccatcctcctccgtaccccacaaggatcacaggccagtgagatccagctattatcacctttggtgatgcgtggcgccaacaacccaaggacccctgttactgaactctaaccagaaccctcctctaggatcccacacatactctcaaggggaacctacatcacccagaaagagggctgtcaggcgcagtggctcacgcctgaaatcttagca

SEQ ID NO: 13854 - DNA, 798 bp, Homo sapiens
ttaggttagacaccatcaactgatctagaatttgaccgtgtagtgatttataccacctgccttcgtgtggtccggacaacctttgaaagatgtgaactggttagaaagattttccaaaaccatcgcgtaaaatttgaagagaaaaacatagccctgaatggtgaatatggaaaagagttagacgaacgatgccgacgagtttctgaagctccttccctccctgttgtgttcattgatggccattaccttgggggtgctgagaaaattttgtcattgtttgaatcaggagaactgcaagacatcctaaccaaaattgagagagcgccgcatccacatgagtgtccctcttgtggaggaaatggctttcttccatgctccgtgtgccatgggaacaagatgtccatgtttcgaaactgcttgacagactctttcaaagccctgaagtgtacagcttgcactgaatatggtcttcaacagtgcaagatctgtgctggttaattggatcttctacccaagaaaaacctcgttttatcaatcaaaggcaccaccttcggtttatatttatattctgaaatggatttctatactcgataaaaaatactcttatttattcagacgaaaatcccgcttcctcgttggcccgataggccgcatttctgttgactccgacgccgtaggccggtccagatgtgctcgctcttctcgagggtcagttgtgtgggaggggacgagcgcaactggggtattaggtcccgcgaggggtctcgccatgtgcccacgccacgcgcgctagcacat

SEQ ID NO: 13855 - DNA, 765 bp, Homo sapiens
  misc_feature (1)...(765): n = A,T,C or G
ttcaaancgctattgacagggtnnncaccgnngnnggccaggatggtctcaatctcctgacctcgtgatccacccgtttcggcctcccaaagagctgggattacaggcgtgagccaccgcgcccagccagagcttgatcctttttacatgtactaattggccagtccagtaacacattaatttgcttaataattaaggtgatgttcagatattttttgtttttctacattaatttgtataaataatgtatttcaagaaaaatgtcgattgtatttttttttttttaaggcgggggacaaaaaattagttataaatttcattagtgcgaacctactttgttcagaactattagcgataacaaaaaaaattgtgaaggggggattagtgtttataattatatgtgatgtgataggtacatgtggttgttgatggacttgataagacttttgaatagaattttgaaagaaatatataattagtgcataagcagctttaatttgttgtgttagaatagaatcttttctcttgcaggtcggccttctcatgtgtgagtattagatcataacattataaaaaggaaaaagggacaactctaattttaagaggaggtaaagcgagtaatttttgataatacaactttatagttatttatactatattattgtttaatgctgatatcaggcataatcattcgtttacttcttccataatcgatataaatatataaatattagtctgcgtagcagcaacctctattttggacat

SEQ ID NO: 13856 - DNA, 804 bp, Homo sapiens
  misc_feature (1)...(804): n = A,T,C or G
tttcatcgcagcatacgttgcaggggcagacggcagtggtgacactgaaatgtaggtcaacccagattgtaaaggattttatgtgagtctgggcttcagtaagggaaattaaaagcagcatttgaagaacgcctgtgcgtggaatcagccagagagacagcaagagaaccccatctctgacaatggcctggatcacctatctcttcaaagcagagtggaaccaggccaggagggaggtgtcccagggtgagcatgcacaggagggagtctgcattgcctgngctgtgaagctcctgccttttgggcccagagacttctgagactcccgctctccctctgtgctttcaacttataaaaaaagctgttttgatctgaaagaaaaaaaaaaagggattcagctgctaggttaatgctggtggctaagtatttcagagacacttcatgacttacacatgagcagagaatgggcccgggaagccacagctgtgggaatcaaggctgcccactgaacctgtatgaagcacaatggtcttatctatgaaacgggagaaggaagccctggtccacatttgttttccaaggaggggaccaaagaggctgatcaaggtaagtttttttaccagacatctggagacacatgcgggatagggcacaaacacccgagaaccacagcggcgttcaggaaggacgtactggattaagctgtgggactcggcgtttgaaggcaaactataacttaaatgcattctagaattgctaggacgattggtttggcgaagccgaagggcagaaaagagggggggt

SEQ ID NO: 13857 - DNA, 867 bp, Homo sapiens
  misc_feature (1)...(867): n = A,T,C or G
aatacaaataataaatattccaccccntnnttttannnnnttttaataaaataataggaatagggacaancgcccgtgcggggttggcattcctctggagcaaatgactgacactttttgagcttagactaaagaaccaagaagagatagatgacggattcctcaactgacctgagagacaggccacatgcacattttaaaggcaattatctggaaaccagagagatgactcagtcttgttgaaggcatgtgttccctgttctctctgatctgctttaggaatataaggagccatgttaaacaaggcactctccagtcttttttttttggcaggctaatcttaatattttatgtctccaaggggggcgtccttctttctatttaatttttaggtgtgaaaaaaaactcctccttcgcatatagtgttattttattacctatgattgggaattgagataatatttatcttttgtttaattgaaacgattattgactacctttgtataccttattttttgatcttaaaagagccgtaataagggcttaggatttttacatgtatctatatttataagacgcaataataaaatttgtctaccagataccacccccatattatagtcattaatctaattctaaattataatactattaatcgagtatatattttattagaagtattctagctatataatactaccatttctcacatttattcttttgttttatcgcattattatatttaacaatccacgctgttatttgtgtatgtatcattgagaatgtagactatgacagcgtagcatcaaacatcgttctgcagctgtatttacgctatcaaccatacactcacataattttttcatt

SEQ ID NO: 13858 - DNA, 777 bp, Homo sapiens
  misc_feature (1)...(777): n = A,T,C or G
agtgcagttttgttacatggatacattacttaatgatgaagtctggacttttactgtatgcccacgaccggacagattcagagctgagttctataacacgcacaaagaagtaacggtacgaatcctactgaaacttcaaaaaatcaaagaagagaggactatttcctatttcattttctgaagccagtatcaccctgataccaaagccaggcaaagataaaacaataacagaaaactacagatcagtgtccctgatgaacatggaaaacaatcatcttcaacaaaatacaagcagactgagtccaacagaacatgaaaacgataatgtgagttttattccagggatacaagtatggtaaacattgcaaatcaataaatgtgactcatcacataaacagaattaaaagcataaaccatatgattatctcaatagatgcagaaaaatcatttgatggaattcaacatcttgtaatgataaaaattctcaacaatctaggaattggagcaacacacctccaaataataaaagctatacaacaaatccacagtcaacatcatactgaatggggaaaagctgaaaactttccccctaagaattagagcaagaaaaggatgaccactttcaccactctcattcagtgtagtactgaaagtcctaggccagacaaataaattattctctttgactaagatttatttgtattttatttcatatttntacattttgtcaaaaatttggtgagaaatataacaatgggtttagatgtaatttgaagg

SEQ ID NO: 13859 - DNA, 809 bp, Homo sapiens
  misc_feature (1)...(809): n = A,T,C or G
cctgagatgacgtctcactatgttttccaggctggtctccaattcctgaactcaagcaatcttcctgacttggctttccaagtgttgggattacagagacgagttctcactatgttgcccaggctggtctcagactcctggtctcatgcgatcctcctgccacagtctcccaaagtcctgggataacaggcgtgaacaccaagcctggactcattcattaaaaaaaaacaaaaacaaaaaacaaaaaacaaaacacttcaatgttttagagcaattttaggttcaaagtacaactgaatgaaaggtatagagatttcccataggtgacctaattccacatatgtacagcctcctctgctatcaaaatcccacgcaagatggtacatttgctacaatcagtgaacctacattgacatcactatcatccaaagtccactgtctacatgagttcaaagtcttttgttcagtggttgtgggaaacaactctccctgccctctggattctaaacttcgtagctacaacgaggcaaacagcccaaattactgctggcatccaccttgtcatcatgaagaagccaacctgaggacatgagcatcacacanaaggcaaagccaagataaatgcagagaaatggagtcagagtcttaaatgatgcctgaagcatgctctaccatntncttttctttnntttttttttttttttggagacagggtctcactctgtcacccaggctagagtgcggtagcatgaatgtgggttactggaaccccgactncttagctcaagcatcctcccactcaggcttct

SEQ ID NO: 13860 - DNA, 778 bp, Homo sapiens
  misc_feature (1)...(778): n = A,T,C or G
tagagtcatagggtcgagaacttaaagaatacctcaccatatctcttcacatatccatgaagaaactgaggtgcaaagaagttaagtgataaacctgaagccacacagccagttaaagttaagacttctaataaaatcccaatggttaacttcaggaccataaccaaaggtatcctagttgctacggggggcaaccttccacaggctacaattgctattaatccagacccatgtgcacagcttccttgtgattccctacacctttttatgagaacgtaatctcaactgccggaagttgccctgttgaccctgaaaaggctgccaagtgggtgtcccggaagcctactgagtacaagtttaatattttctgttaagcaactcacagcatttaagccgcagttgtggaaattctcaagaaagctcgttctgtatgaaccaaatttctgaagcgattctcttccagggaactgcaatcaatcctgtccggacttcactttacatagctcattttttgagccttcatcatacacaacattcactgcaagagatccaagggagccacactttctgaaggatgctattgttgctcaactggcaaactcaaatttggtttgaagagcataagttntaattttctaggttaaaacttatttttcttctcaagttccatttatcaaagaaatcgttttgttttgtttgtttaatcgaataacatcgcaagtgcagaagacttagctgggatggaggttgggggagtgtccttgcctgtttcagggac

SEQ ID NO: 13861 - DNA, 689 bp, Homo sapiens
ctagaaaacaaagatggatgattgtatccttatgtctgcagatacattcgacagtcatcacagctgaatatcaatctggccaacatagaagtctacattcaaaatctacatccctcaaaattttgtctttttttttttttgagacggagtcttgcttcttcacccaggctggagtgcaatggtgcaatctgggctcactgtaacctccaactcccggtttcaagtgattctcatgcctcagcctcccaagtagctgggattacaggcatgtgccaccacgcccggctaatttttgtatttttggtagagacggggtttcaccatgttggccaggctggtcttgaactcctgacctcaagtgatccgtctgcctcagtctcccaaagtgttgggattacaggtgtgagccaccgtgcacggctgtcatcattttttcatcagtcacatcttcaatgaaggtgaatatgtattatttcgtgaaatatttaataagaggccactctgtgcagcactcttcaaggcatagaggatacaacggtgaacaaagtagacaaaagattcctgcgctctggtggagctgacattctagccatggagaatgggtaatcaacaaacaaatactgtacataacgacccatatagtgcacagatgctgatagtgaaaaataaagtaaacccaggaaagaaaa

SEQ ID NO: 13862 - DNA, 806 bp, Homo sapiens
ctgacagagtctctgtcacccagtactggacacagtggcatgaagatacctcactgcagcctccatctactgacctcaagcaatcctcccacctcctgagtagctgggactacaggcacctgtcgtcatgcctggctagtttttaatttcttgtaagacagggttttgctatgtcgaccaggctggtcacagactcctgggctcaagtaatgcccctgccttggcctcccaaagtgtgtgggattacaggcatgagccacagcccctggcctacctaattgttgtttttttagttgagatgagattttgctacattgcccaggctggtcacaaactcctggcctcatgcaatcctcccacctcagcctcccaaagtgctgggattataggtataagccactgcacctggcctacctgattttatttcaattaaaaattctaatcaaagaagatacacaagtagcaaataaacacgtggaaaagacgctcaacatcatcattacggaaatgcatattcaggccacaatgagataccacctcatacttattcgtgtggctaaaatgataaagactgacaataccaagtgctggagaagatgtggagcagctggaattttcatgtgctgctggagggaatgtaaaatggtacgatcactctggaaaacaagatggcagtttcttaataagtgaatcatgcacccactgcaccttcacagtgacctgcattttcagtcctaggaatcgacccaagaggaataacacctacgtatttgaatgttcttaacagttctttaaaatagcccata

SEQ ID NO: 13863 - DNA, 265 bp, Homo sapiens
  misc_feature (1)...(265): n = A,T,C or G
ttagcgcatctgcagatgagcnagcatatggtgcatacatatgaggcacttgatatctgtaggaagggagttattagtgaacatcttagagagttgtcagaagccaggaaggggttctaatctgagcttttaaggacaattctgaaaaggattctgtgtcatccagggaagagactctcataggctctgccatacctgagaagcttccccagttagtctcagaagggttgccatgtttctaccactcacatcaaaaaaaaaaaaa

SEQ ID NO: 13864 - DNA, 802 bp, Homo sapiens
  misc_feature (1)...(802): n = A,T,C or G
cctgnatcgtacccacagtgcagcttagctcctggacagagagaaccccgtgtcacccctcagccagccctggactcccagctgtcctgcccaccactgcagaaagaggcgcctttctcacagcaagctgaggtgcaggacaggccaagctgagggatacctcagcttggatgtctgtccacgtgggcttcatggacctacactcaccacacacctgggtgcttggtgctcttcagaccacagtcctttcaccctgtggctgggaccaggatggacagaaagggagtttgggaagaatgacagaggaagcaacctacagcatctcaggcaactactctgtgtgggcccaggccacctgctgctgtggggcagaagaggacatgggagagatggtgcccctggagcacaccactggcttcaaccaagattggagcaaaagattctcctgctggctttgaagaagctgccatgctgtgagagggccccatggcaaggaactgcaggtggcctctaggaagggaactcagagaagcccttgggtgacattcagaagaaaagaggaaccacagtcctacagccacanaaaactgaattctggcaacaaccatctgagcttagaaaagagcctcaaactcaagaaaggcaggcagcctggctgacaccttgatcgcagtcttgcgtgaccctcagcagaggacccatttgagtcatgcctggactcctcacccgggaaactggaaaatgataaatatatattggtttaagcctctaggtttgnggtaattggtatggagcataaata

SEQ ID NO: 13865 - DNA, 799 bp, Homo sapiens
  misc_feature (1)...(799): n = A,T,C or G
gctgggcactcgaattccagctcctaccagattctggacttcagactcggccacgtgatgaggggatagaagagcggcaaccttctggcatctctgtggatttgggcaattatcaaacctagacgtggacttactatgctgcccaggctgatctcgaactcctggcctcaagctatcctcctgcctcggtctcccaaaatgctgggattacagatataaaccactgtgcctgacctgaatgtatatctttgtaatatccacccttttgttctagttgcctctaagttaattccacaacatctattaccatgtgcaatgcacagtattgatgcagtaaatggacaaagaagagcaaaatcctcttccaggaatatacagaccagtaatgcagacataaacaatgtgtagcatccttgagggaagagaccttgtctcattcatctttgtgtctccatggcatagtatacagcctgacaaacgaggggagctcaaggaatttcagtaaatggaaaacataaatgtgatgtccaacggtacaggtgaaatcagagtgctgaagaagaccagagataaaagaattatgaattatgtcatgaaataagtagcatatgaaatggatcttgaaacacacatgccatgatgtaagttgaagggattgtgcatttcagtagagagatttaataaagcatgactaaagatcanagagcttcgctgcaagaatgcatctaaaattaaactaatgaaggagaacctggtangaataatgagaacaaatattctttaattcctgacatggaca

SEQ ID NO: 13866 - DNA, 948 bp, Homo sapiens
  misc_feature (1)...(948): n = A,T,C or G
ttgcnnctgactccccgtnngnngtagataacctacccgatacgggnagggggctntacncanntctggcnncccagtgggctgcaatggggataccgcgnagaaccccaacgcctccacccgggcctcccaagnaattttanttccagccaatnnaaaacccaacccacnccncaaaanggncgccncaaaccccacaaaanannggcccccccnccaacctttattccccccccctcctccccgcgccncctttatatatctccccccgcaaaacncnnccnnagngcggtgccccccaccctaaatcacccnccccacnncnncccccccccgccagagcgccgggcaacccccagcaaccccacccacaccaccccacaacactaacaacccnnnnnnccccccncnaccccacccccccccacccacaaaaacggcccaagaaaagaaggaaagccccacccccaaacaccaccnctctctagcccggagtttttcttttatttttcttttcccctcgcgtggtcaccanccccacacccaaccggaagggcccccgagaacaaacacaaaaagataaatcattaataagggatatgggtcagtgcatanaaggagannnnccctcaccngnccctcggggcccacnncccccccaccacacaacccccccaacacccaattattttttattttttttgcgggggcacaactaaaaaccnccnnaagcggccnccaaccccacnacaatttttttatttatatttaaggcgganaaaaggagaaaatagagggggtagagacaatcaatacgtctataagcgggagagacgcaggtataaagggagaaaaaaaannccgcttgtccnnnnnncntnnnnnnnccncnntncnatnncctccncntnccgggnncccgcccacccgcgtggtgtttggtggggg

SEQ ID NO: 13867 - DNA, 591 bp, Homo sapiens
  misc_feature (1)...(591): n = A,T,C or G
ccccnngggntttancaaaaannatttcccattaagggncccattttccnnngagagnttnggtttctaagaaanccnanaaatgncnaatatggtgaagggnaanaattgnnncccntagaagctngaaagaaaattnntggnnnttcttgttgnancaaanccaaatcntaccccctttccttagaaggtcanagcccttttgaaaaaattnntttttttggnccannattctttaatttttncnaaantccatcaattataaaaatgttcnttaggtcatttctcccagggaattnaaaggcccctgaaaattatttgggcnntgtttctgtgaaataaagtnactattggcaagncaaaagcagtgttaattaagcacagggtttactagtctctataaagttagtagactattagttnaaattgcaggctaatccagccagtagagtaaaaacaaataaaaattagtttattgttgatgtaaattanaaaatgttctagtcaatataaatgtttattctttcccncaaaaaaccttttttttctgattcatganaatgttttgatagtaatgatttctttttaaat

SEQ ID NO: 13868 - DNA, 904 bp, Homo sapiens
  misc_feature (1)...(904): n = A,T,C or G
tggttgtgnatggacttcttttattnagttngttattttgngacggagntttactcttgttgcccacgctggagtgcaatggcgtgatctcggctcaccacaacctctgcctcccgggttcaagcgattctctggcctcagcctnccgagtagctgggattacagaattataaaaaaaaaaatcctgaagttgatatggaaccaaaaaagagcctgcatagccaaggaaagacanagcaaanncaaacaaaaaacacaaatctggaggcatcacattacctgacaactatactacaaggccatagtcatcaaaacagnatggtactgatataaaaataggnacatagaccaatgtaacagaatanagaactgananataaagctaaatctagtcaactgatctttgacatagcacacacaaacatanagtggggtnaaggacaccctatntagcaaatagtgcntgggatcattatcaagcnccatattaaaagaataaaacctggattctcatctctcatcttatacaaaaattaaacttnngaaggacccaaaactggaaatttaangacctgaaanccataaaaantntcttnnaggattnaaaactnggataaaactctttttagtcattgggcttacattaaagaagttattgacccataaccccaattnncaaatgcancaaaaaccaaannttttttggattggganttaattaactnaaaaagcttnatgntgcaaangnaataatntncnaggnaacagncnccttncatagtgggaagaaaaatttcntgaactttncnccancaaaggcttatttnggaantannccggaactttaancantgaccagggaaangnaattnctttanactnggctagggcctnaatanncnnt

SEQ ID NO: 13869 - DNA, 563 bp, Homo sapiens
  misc_feature (1)...(563): n = A,T,C or G
aatntnngnnccaangtgttttttnngccaaagcnanacncccaaanannaaantnggnnaaggggnccccccttttttnagccaaaanaagtggntgggnnttcnttcttcaaancnccattttaaaggaatnaaccngggatttctcattctnncnttcttanccaaaagncaaantcaaagaggcccaaaaccttgaaatataaggcnngaanccataaaaattctagaggataaaactggaaaactctttnagtcattggcttagataaagagttaatgcccaagaacccaaatagcaaatgcaacaaaaaacaatgataaatagatgggactnaattatctaaaaagcttcatgctgcaaaagaaattatcagcagagtgaacagacancctacagagtgggagaaaattttcatgaactatgcacccaacaaaggactaatatgtgaaatctactccaggaactcaaacaaatcnacaaggaaaaagaaattccatcnaaacatgggctaaggacataaatagncaattctcaaaaggagatatacanatagccaat

SEQ ID NO: 13870 - DNA, 541 bp, Homo sapiens
  misc_feature (1)...(541): n = A,T,C or G
cccccnngggatatggnngcnaaaaaggggcaacacaccgcccntggggcncgggcctttntaaggtnatcaaaatagtnaaacccangggttgggtaaanaantnaaaaaaactgnaaccctttacacatncgttggtgggnaatgaaaaatggncacnccactttgnaaagtttgttanttcntcaaaatgctaaccattagaattaccatatgacntagcatttccncttntaggatttaccaagaagatgaaaacatgtatccacncaccaagttgtacatgnaggttcacaatgcatagttgtatgattttgttaccagtagtgttaacctgaatgggatctggttattgttattttcccagtagtcgttcaggagcaggttgttcagtttccatgtagttgtgcggtnttnagtgagtttcttaatcctgagttctaatntgattgcactgtggtctgacagttngttgtnatttccattcttttacattngctgacaagtgctttacctccaactatgtggtcaattttggaat

SEQ ID NO: 13871 - DNA, 665 bp, Homo sapiens
ctctctagtatccaccgctacagttgcctgactccccgaatagaggatggccacggtatctggagggcttaccattcatgcatcctggagaggctggctaaccgacattaaaatatgcgacagaagaccgtccagacgaatgcgccatcacaaatatggccgttctcagagcaagaattcggttgtgttctgcgagaatgatgaaaaatgcgaacggttaacacaacagctcccagaacttacccgctgacagacatactgacggaacacatggagtggatgaagatctaatagagacccatacttgaaccaacgtcacctgcccaattaaaccaagagaaaaatcaacgtgtcgcggtcacaacctatgaatgaggacagccattgttacacatgattgaatccaagcagaacctgaagaaaaaggcctataccacccagacataaaattgccagaacttatccaggctgatcacttaaagtggcgagtgaaaaccataacaggaaaagacgtcgacattccgagtatcaaacagcgggctgacctccacccatcctgctgttgagagagtgcggccacaaactctagaactggtaggcacatactcagtgggcgaaaactcgccgtttctatgcggcgcaaaaatgcatcatatagttttttt

SEQ ID NO: 13872 - DNA, 771 bp, Homo sapiens
agaagacatcacactacccaacttcaaactatactacaaggctacagtaaccaaaacaacatgatactggtacaaaaacagactcttagaccgtggagcagaatagagaactcagaaatgagatggcacatctataaccatctgatctttgacaaacctcacaaaaacaagcaatggggaaaggattccttatttaataaatggtgctgggagaactggctagccatatgcagaatattgaaactgggcaccttccttgtaccttatataaaaattaactcaagatggattgaagacttaatgtaaaacccaaaactataaaaaccctagaagaaaatctggacaataccattcaggacataggcatgagcaaagattttgtgctgaaaatgccaaaagcagaagcaacaaaatcaaaaattgacaaatgggatctaattaaagagcttctgcacagccaaagaaactatcagcagagtgaacagacaacctacagaatgggagaaaatttttgcaatgtatccatccaacaaaggtttaatattcagagcctacagggagtttattttcaatctctccaaatagataaaagctagaatgaagagtaaattcaagctgaatctagaatacttgacaatatacggaattcatgtatcatagcaaggttatttccacagaatttatttaaaatattggtgaattataatttttttagtcatcatttattttggttccaggattctatttctaagcaatgctccccacagattt

SEQ ID NO: 13873 - DNA, 564 bp, Homo sapiens
  misc_feature (1)...(564): n = A,T,C or G
aaaaangggaannttccccangctggaatttttaaaanaccttggcccaaaaaaccggnaantccttgtatncanagccannggtttattttccancagaaatttaatttaaaaaaaantggtgganttaataaattttcttttagtccanccattttatttttggcttnccaggattcaaattttntaagcaatgctcccccncagaatttgttcaaatanccaaatattaataattcaaatctttatattaatcatgcatttttatttctttggaacaaatatatgtatacagaatacnctttaaaatatatacatttaccattatttagactgtcatatttaacagttattgtcaattatatttgtaagttttattggttcatatttaaagaaacaaaatgtattttgcattttgaaatataattatgttatcaattaaaattgggaaactataatgaggcacgtagatttttttaaaaactattttatgcattcatgatttaagatttttttaatgttataacaaaatggggtttagtgatccttaataacaaaataaat

SEQ ID NO: 13874 - DNA, 396 bp, Homo sapiens
caggttctaaacgtcatgaggattagactttgtctctctcactcactgctataaacccaaagcctacaatcatgctggcatatagaaccctatagtcgtgacagccacctctccacctcttggtttgatgcaggtttgttttctggctttttttttttctttctggaaacagccctggtactggcttacttcatagaaagaacttggtttgggatccacacatctccgtctgtcaattctgtccagaccacattctaactgtgtaaacttggacaaaaacattaaacttacctctgagtttcaggtctcttctaggaaaattaaaaataataataataatgcctatctcaaagagttatttcaaacattaaaaatttaccttcaaaaaaaaaaaaa

SEQ ID NO: 13875 - DNA, 210 bp, Homo sapiens
ctaggatctaaaggattgggtgttgcccgttttcattgatgaggattatcttcttcatgagtacacagctagaaggcaaccatgagcaagccaagaagagagccctcgagggggaaccaaaaggctggctggtaccttgatcttggggtttccagcctccagaatggtgagaaataaattcctgttatttaaaccgcaaaaaaaaaaaaa

SEQ ID NO: 13876 - DNA, 513 bp, Homo sapiens
  misc_feature (1)...(513): n = A,T,C or G
tgggtggaagcacattttcttacanatttggccatcctaagtggaggaggagtatcaggccataatacttttggcagacgctactttttttttgagtcttgatcaaccatgtaaataattttggctaccctgctagagagaccagatggagagtgtgacattctgaagggtgaaagtccacaaggggtggaagaccacagaaaatgaaataccacgagaagtgattggcttcaatattccagctaccccagcacaggaacaagatcatgagagaagccattttggatcctccagcctagatcgcatgcacctgaccaagcccagctgccggcacgtggagaagagataggcattcccactgagtcctgcaaaccagcccacagagtcataagcacattaggtggttatcgttttaagtcactaagttagggtgattgttatacagcaacagataattaatatgatttgaattttctcagtaaagaaacaaagatttattgaaaaaaaaaaaaa

SEQ ID NO: 13877 - DNA, 327 bp, Homo sapiens
ggactcagggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtaataatttacatttccattagcagtgtgccagggttcccttttccccacatcctcaccaacacttgttttcttttgtcttaataaaagccattctgacaggtaaaaaaaaaaaaa

SEQ ID NO: 13878 - DNA, 714 bp, Homo sapiens
gatgcatgacgagatggcccctgaccacgtacggctgagacctgatactctttcatggtgggagtgcgagaatcatcagatgccgatagaagctgagcgctcagcatttgactttgtcttgttctggaactagagtgacaagacgtctttggagctggacacactaaagagacgcctcctggggtgacgccatatgcttgcacatttctcactgacgagcctacacactgtgaactctgagactgatgctctctccatagtgaggatggccaccttggggctcaatgccagagttctatcttggatccccttagtatgcgcgtgactcatgaatcatgggctgtgacttttttctccccaaaatggctgataaaacaaacggtatggatttgattgtcgtgcggtacaaaggcatgtcacagattcgagacctgtgcgcatgactgaacttagtcccttgtttgtccttggaggccaaaaaccgtaaatgggccccgtggccgcagttttggatctgttccggccctctcctttgctgagggataattgacgatcctggctcacgtggctactgccctcaggactataaatataccagagcggttccattgactctaaggtgggcgcctgtttgttccagactgggggttacccgagatgtactctttactcttggcgaagcagggccttacctctataaacgcctgcagtggt

SEQ ID NO: 13879 - DNA, 1683 bp, Homo sapiens
  misc_feature (1)...(1683): n = A,T,C or G
aggggttnaaggggagnnaananggnaacnnnngagaggannngnnnnngncggcaggnngnnanagagcgggctgnnaangagagagnnnanagacgnnnnnnnnnnnagatgnnannnaanccnnngcggaccnncnnnnnacaggnncnnaacngagnntanannnangctgnnnncanntcagacgnnncnnacaantnnnattganacnacgagatnanngatcgggcgcgatacgcgnngnacaagagnnntngtantccagataggctgcnancagagtgcgnagaaaggngagacganaaacgcagacagcccanagcntgcgcgtctagagcgtagncncncgctcacgtcagctcgtgctccatacggaggttttncnagcgtctcagcgtgtgagtggncgcactcgctcagtgaacgcaccgatacacngctgtcgctacgtgctgacaccgcacgcgagcacngacgacagaggtgtcacacgagataaggtagcnnagngagagaggatgancaaggcgcggagagagctggcnanacgngagagtgcgcgccctcngacncaccagcacgnacgacacaccgagaagacangcagcgacgcgcannccaccgacgntgancagcgcgtcgagatacgcgcgagcgncgccacgtgaagcanatgactatagatatatatcatagtaacatctgaatagagtatttctctacagctataattatatgtgtgtattaatagtataatgatggcacagagtctcgtgtaccgactgttnttnaaggatggttcatattgtatatcgcgatgatgacgaggaagtacgctagaggtaggcggagagatggtcgagagcgagcagaatgtgagggtggatagagagatgtatagagatgagtcgaacacagatgagttgatagaatantantctggaagcagaatcacgaggtgacgcagcgacgagtgacgcagtgactgactcngtgaacgcgttagcatagagagtgcgagagacgtaganagtacgcgangnangtgcatntcgagagcagagacgagatgatgagtacgtagcgcagtattagtgtgtntgatatgaaatatagtaggtacacagaggagtaagtgcgaagtganagtgatagtagtcaagaagatcggtcgtgatacgagagaggcgttatgtagagtgtgatggtgtgcaattctangagtactcgatatacagagcgatgatgtacanctccatcggaagacagaggaatattgagtgcgtgacacagtcataacgaaaggtgtcgcgagcaccgccncncacgcagagtntcgagagatagtgntgatgagaggagtagatcacatcggtacatagaatgcgcngtangtagtncacgcgatggatgatgtcnatactagagagtgagtagtgatgtacancagatatgactgcantncggtactcntcgtcgatcggcgctcgcgactcgatcgagctctacgcgcgtgagtgtgacaccncgaacaacgcgcatcnctaggcaggtgancacctgagtctagancacagagtacgatacgtntcagntcgntgantagttcatatcganagtagcacgagacagagtcgcaatcatgtatagcgacttatcggaagaagtggcggcagaggg

SEQ ID NO: 13880 - DNA, 246 bp, Homo sapiens
ctagtactctctccagaacatatttagcattttaatcgttttctgaagattgcccaagaagtcacacattttctcatcaatcaacaactgtaggaatggccatgtgtggacacagcaagaaggcggccatttgcaagtcaggaagaaacccctcaccagaacttgaccatgacgtcaccctgatcttggacttctagcctcccgatctgtgaaaaaataaatttctgttgtttaaaaaaaaaaaaa

SEQ ID NO: 13881 - DNA, 373 bp, Homo sapiens
  misc_feature (1)...(373): n = A,T,C or G
tgcatactgcgatgcatagttgccaaatattcgtcatatcacacaacgatccgttcactaaactctgagctttgaagggttacacgagacggactgaatgaatttaaaatttcctcaacttgctgtcaagaaaggagctggaagcaaagccaaggatctcaaaattcattcctgtttatacttctagcttactacaacactcctgaacaacccaaaaaaaacacccacttgttctccatcgcctcactaccgaggccctctcgcccaatacttttttttttcgccccaccccacacacaccacaaaacacaccacaaagagggggggcccccccacagaaaagaaaacanacnnnnnccgaaaaaaaaaaaaa

SEQ ID NO: 13882 - DNA, 768 bp, Homo sapiens
cttcagagtatacatgcatagctatttttgggaaatattaatttgtagttcactatcctatagcattgctgtatgacgctcatactcaaactgctcatggtgagaaatacggacttgaaaaggaacttttatatcgtgagattcatcaatatcatcatcaaagtcagatttccaagggtgaatattgtggatgagagaacatactgatacctacgaagaactgacaatgacaatccaatgaaactagagattaacagaaaagagaataaccgaagaaaaagtcacgcataattgacaaaagagaaaatggattagacagaggaaaaataaacagacgaaaatataggataaaaaacattctttcaacaatatcggcacctctaagaatatgacttctgaagttcaatatgtggtttctttctttcagcagttaatgagtagtttggcaatataaacatagacaagggaaacagaataacagcatgagttagtccaaggctgactggatcatctacttttgcctaaaactgttcacactgaacgagcagggcccacagtcactaccagcgcttccaagagatctggagcctctgttaacggactcccagtgcaccacgaatgattaccttacacactgatgcagagtatccttttagggaaacccgcaaaaagtgaacagaaatgctaacagattatgccattccacctattggtttctttaaaaccccaagtttactgctattaaccaatatttcttttttagattcc

SEQ ID NO: 13883 - DNA, 507 bp, Homo sapiens
  misc_feature (1)...(507): n = A,T,C or G
agtaaactctcacacgatgcaagtcttacacgcgaacccgagagagtcaagaacaacctaattttctttatgagcatgaactnnngaaattnaaaaaaagatgagaagactttggtgcagaggggatnaaaaaactggcccaagattacatggccagcaagaggcagagctggaaacctcagagnaggacctcagaatttgtgctcttaatcatattttatagcctcacaataaattacaataaattaaccagttccaagcagaggattttatacttcatgcaacatgacagtacttctcaaagttgttcagggtttttttttttcagagaactcttattaatatgttgaatttcatcaaccagattcagcaaaatcaccaacagacaccaagactataatacatgtggacacaaagaatcacagatatcaatatccctgtgctttctcaataaatagaagctgccttactagaaaaaaaaaacaaatatggcctctttggcctcac

SEQ ID NO: 13884 - DNA, 1112 bp, Homo sapiens
  misc_feature (1)...(1112): n = A,T,C or G
agggaaaaagagaaaannnnangaggaggncgggtcgnaaaggggnanagagggtnnggggnnnnaaggnnnnnagagggggnnnanaannnnnaggnnacaggagaannaaggaancaagggnaganaaaagaagcgaggagganaacaagatnaaagagggtnncaagtggtaagagaaaaangctggcanaagtaaccaaaatgcacacacgtccgagtcgctacggcccagataacatagcgtcgcgagtntatcgcgccgccagactccgcacgtcgcgagtactcgtgcagncacggcacggcccctacgacggaagagacaggccacaccagggcggagaccacggccacagcgacaagcccacgagggcagagcagaaaaaacaggacactgccgcgcaccgaacagttaatcagatttacaacattatacacccggacactcaagagaaaaagaaaagagaggaagatgaggaaacgaatcgatttccagaactactacattacagcgccataggttctgaagtagcaaagttccagtgaatatgaaggttcctcatcatccactatgattgatttttttcttagccggggccttcgtagaagttatgcatagtctaccgtggcttaggggtctagaagaaaaaagaagaaaaggaattnattaatgaccgaatatatcagtggatatgttggaagaagtcgggatagttcgntatgcgataatgtcgacgtgagagaggttagagaatagagtatggatngagagtcgagattaggacagtgaggacaagatataagtgtggatgaaatgattctgatccctgcggaccgcgaacttacccgcgtgatgtccctcctctctgattcagactacttcacgcgacagtctctccgatcgtctcaacccgatctgtttcccaagtttgggcggcgacggcgccgtgtttaagatggacattcgtattgtcaccactgcagggctcggagtggggtataaagggtggaatgatcggcatcgcctagaacacatcagctatgtagctacacaggctcncgtgaggagcccgctgcaacatagagacgtccagtagtaaacaaagtat

SEQ ID NO: 13885 - DNA, 246 bp, Homo sapiens
ctaggatgaccagaacggtacaaactctgcacttgagaaatacatcttgaaatgcctagataaacaagtgttgcatcgtatcataggagaataggagagaggggagaatctgaaaacaccccagtggttagaacacaacaggaaagtccactgtcctttaagctgaaactagaaagaaagacatgacttgatagccttgaataaaacactgaaaccatactcagaaatacatcaaaaaaaaaaaaa

SEQ ID NO: 13886 - DNA, 329 bp, Homo sapiens
atggtaaaaagagaaagtggctctgcaaaaccaaactattgcaacctttaactccagtgcctctgagatcctcctgagacatgtctcagcctcctaagcagctaggactacaggtgtgcaccaccacacttggctttcttctctttttctttttacttttttttttttttgtcgatatagagcctacgttgcccaagatggtctcgaacttctggcctcaagatccatctgttttggcctctggaagtgttgggattacaagcatgagccactggacttggcctctgtcctagtcttaataaagagaataaccgtgaaaaaaaaaaaaa

SEQ ID NO: 13887 - DNA, 358 bp, Homo sapiens
  misc_feature (1)...(358): n = A,T,C or G
cctgttcatctgttgaagaatcttggctgcctgacgtgtagagtctcccacatctggactttgttaattgccttcatggtgtggttcaacatgttctgttttctgtatttcctgtaaatcagcagctagtctcaggttcaatccctttgtcaacatagtaggtgttgcattctttcacttggagacacacaatgtctggatgggctcattttctgatgttatcagctgttgattatttttgcctggatctactaattcactgaaggttgaaaaatagtaatctaatggtatcatttctctttttgaggtggaaaagttttatgaagattttggattttaacatanaaaaaaaaaaaaa

SEQ ID NO: 13888 - DNA, 446 bp, Homo sapiens
agagttaacactggccttgcccagtccatgctgagaactggacctcaggaactccgacacacacgcccttttcagaaatttgtaatttcatcatttcttgaccaaatgactccaaccacagaaaggcacgaattttccattgggatttattctgccctcccctttgatcttaccctaaggatcagattcaggccataccggatgtgtccaaatcatttccatctgacgcccaggacgacccaggaggcctggccttgaggagcagctcccactgagagctatttgtgaaggaaccaagctagaaccgcgtcaattgtttctgttcagcccggtcctggccccactggtatggtcttgctgacttccttctgacagccgagtttttaaaatgggctgctttacagtgtggccacggattaaaataagaaaaaagaaaaaaaaaaaaa

SEQ ID NO: 13889 - DNA, 522 bp, Homo sapiens
ctagggctgggcggaaagagtcgaggcccccatgggactggagtattctcagtcagaacagtgaacacagagtcatcctcaatcctctctactctcgtggtcttgaggggccattgctacctcctcctggtcctgaccttgaggcttctcagcactggctttctctgaattccttctatgcacaagtaaatcattcagcttcttcctgaacaataaggatatctcgtccagatacccctgttccatggttactctactgttactgagccatgctggacccagaggggaactctgcaaagctcaccacctcccccagcttccccagggagaaagacacacacacccactcctctgagacctccaaacctatgcgggtatctgtcatcactaccactcctgcctcgtatccgtgcacacccaaggactgtgtttggagaggcagatgcattgaggtctaagcgttcttgcatccttaactttgaaaccataaaagcatgttcttttctttgaaaaaaaaaaaaa

SEQ ID NO: 13890 - DNA, 248 bp, Homo sapiens
  misc_feature (1)...(248): n = A,T,C or G
ctactncttccaagccatgagatgtgagagtgtccttatatgaagactgctggagttccattggctgccttgtctctgcttaatccattaagacaacgttgaatgttcccggctcatatatttataaaggaaaaaaaagaagaaggaaaaagactttgaaaaatggaagtgcctcaggctgtggctggtgtttgaagggctgctccacacatatcaatcatcctttgacaagatctggaaaaaaaaga

SEQ ID NO: 13891 - DNA, 255 bp, Homo sapiens
gtagatccatgctgtttttctgctgtgatgctgattgctggctctggttcccaggaggcgcccaagatcggattaactgccagcttcctgatgcacagccttgttatcagcgcctatatccttgttcagcaaagtgcctctccaccaacttaatgttcttttcaccaccccatttctgcacgatgtagtcacagtaagacacagagtgtgcagtcccgatcccagtgctacataataaagatccagagctcaaaa

SEQ ID NO: 13892 - DNA, 369 bp, Homo sapiens
  misc_feature (1)...(369): n = A,T,C or G
ttanggagccacttcagcnctaaggttgangaaatagccatgatggcagcccaggagaactgtggcttcacttggagttgacgcagcagaaaagagaaaaagaatgttcccagaagaatttataagaaaaacacatcttatactcaagtctcaaagtaatagagaagaggagaaatgccaccagcagaattgacttttcatgatgtccttccaagagccttatgttctcagaccacaggaaattcatatctgcggatctaacagtaacatgaaagagaagaacaacagcctcactcactctctcctgcaaaagtgcaaagatttctgtttgacacataataaacagtaaatcccataaaaaaaaaaaaa

SEQ ID NO: 13893 - DNA, 787 bp, Homo sapiens
  misc_feature (1)...(787): n = A,T,C or G
cagttttaagaaataatgaagaaaacatcaatatatcacctaccatcatttcattacttgatggattcagaagctcaagaagacaccagagaagcctatgatgacaagcaggtggtcacagagatcatggcgagatgttttattccaactctgataacaactacttcctgggaaagttttcattttattggtcatgagattcgaattactgaggccatggattgttatggtgctgttgtttggccatcggcccttgttctatgctatttcctggaaacaaatgcaaagcagtataatatggttgacaaaaacgtgattgaaattggagctggaacagggctagtctccattgtggcaagtttacttggtgctcacgtgacggccacagatttacccgaattacttggaaacctgcaatataatatttcccgaaacaccaaaatgaaaagcaagcatttgcctcaggttaaagaactctcctggggagtagctttagatacaaacttccccaggtcttctaataattttgactatattttggcagcggacgtggtctacgcccatcctttcttggaagagctcctcattaccttgaccatctgtgcaaagaaaccaccatcatcctgtgggccatganattcagtctgttacttacataaagtcatttaatcctcacaaccattctaagaggtagaagctatgctatccctgcttcacggataaagaaactgaggctgagatgtcccctggctaccatctgcagagtgccagtgctaagatattcaag

SEQ ID NO: 13894 - DNA, 835 bp, Homo sapiens
attctcttttatttttgagataagtataaaattatttttaaatcaagaaatgttgcatcttgtgacggcaaatgcccatcagctaccatatataacatcaatattgaaagttacctaagattctgcaagtgtagtagagaaaatggagtacgaaacttgtctgtgcctctgtattgctcaggaaaaggcactgaaattatatacactctccaggaacccatagactgtacatgccagtggaattaaacccttgggttccaagagctctataccacagcatagcgtcagatataattaacttttatagcttttatttatgcatgcggctgattcatactagttaacaatactgtatttttcagacttgaaatgtgaaaatttaccaatttatacaaaactatttacagtttaataacataattaattttatagattgacatctattttataaagccaaatgacggaaagttgatcaattagaatgcatgattgaattaaatacatattggtgcagatactaagcttcctcatcccctgaacggttattatttatattccttgatattccctctagtagtttttttctcctaaattaaaaaatccggttgtttccttccatatttagaaaatcttaagtcgaccattatgaacaagctcattaggtgatcaattaaaattatacggctataatatgttggcgaagcaccccgctactgtatctaagaatgatgaatttaaataataacatgtttagagattagtgttcaacttttactcataatatgcatcatctactatataaacaggtccctctatccccggccatctcctatct

SEQ ID NO: 13895 - DNA, 1550 bp, Homo sapiens
  misc_feature (1)...(1550): n = A,T,C or G
tgtgtnnnannnaaatgttgtgnatttgnnaagnntnatgtngatatgaggttgnnnntgtgnnngntagtttgtggtnnnattangaatgttnnanattggtatagtnnnactgtgtaagatgtnngtnnggacntncttattgatatgttcggatagtnatagactctcctactagtgttnactcatnatnatataattatggtanattatntagtaatagtattatnactaataggtattatgctngcttaagttacgcgttggtnagtatgcacaaattcgagtagtcactagtatacactttgtattacttttgatgatntatcattgttnattttcgacatttatctgaagactatgtactgtctacgtagcagtgnatgtnnagtcactnttattatataacgtactncntcactgtgnnaattcgatagtnatagaattattattgtttatatatatgaagtatccgctgatgtatacgataagatggngaattgttgtgatattgagatgacatatccattgtatacacacgccatncacatatgtaatcttattgtcttctcttctatcccagccgctcatacttctccttcacgcgccgcttcgtcncgcccccgtcctgatncacttgcgtctcgtctnatgaccgttggtcaacgcnccactccgtatacatcttataatcgtctctccncgctaagatcgtcacatgcaatccatcgcaccactctattacactgagtcgctgatcgcgtattacttgccctcccgcacgtctgagtgtctcatntagaccngaccacaaccgtcgacaccgaggtccntcgtcacgcttcgttctcaccgcactgtgatcgacactcctataattgattcctctcacactaattccncgtatagtgtagtatagtctgatatgtatnncatagatgatactgatatatgtcgagtatannttntgtaattagctactgtttnnatactagtgtacttcatctctatatcacaactcntntcactcattatcagatgtatntctatcgtgnncacgctcgtatagtatgctcnagagtgtcgatgctnctctccacactctctactcgccacgtccgctccgctcgcacgcgctccgctatgcgncacntgccttgccacatcgtgnncacgaatgtatcctactcccacctccatcgcgccgcacacnctcacatatcatntntcnttctacgttcttnnntccatctcatctgtctcctctcatcttatatagtaaattctacaccagccncncgcgcagtcnccaccncgccgattatntctacagcttgtgtgatgtgggtctnnccangtagtggtctatctgcactatcatacgtagtgtgctgncnnncgcgacacagtncacacacactccncncgcaccacatcgacncctcctcactcaacaactnananngtcactgtcgtactaacactctcaccacagtcgctcacgtcactctctcattgtgtcacnacagatcncgtcacgctctacttct

SEQ ID NO: 13896 - DNA, 782 bp, Homo sapiens
aggttattttccattagtttaacttaccgaaaagtgatttgggatgaagagacaattaaactaatccatgttgaaagaaggtgatctaattatgaaccatggagcctcattctcataaagaagattctaaaaatgggtttctattgggaagagacggtataatatttgaaactgcagtgcactcatttttttataagagcctaccaccactgctatcatcaaatctagaagactacctttgttttctgaaacaagcaagaaacaaattacagaaactaatctgaaagccttactcacatatacccatacagaacactatgtgatatatacaaattcaaccagtacctcattgtccacattttacagaaaaggcagagaatatgagtcccaaggtttctagtgaacaaattagaatagaaaatagaacgaaagtcatctgtatgattttttgtttttcgagatggagtttcgctcttgttgcccaagctggagcgcaatggcaagatctcggctcactacaacctctgcctcccaggttcaagcgattctcctgcctccgcctcccgagtagctggaattacaggcacatgccaccacgccaggctaattttttgtatttttagtagaaagagggtttcaccatgttagccaggctggtctcgaactcctgatctcaagtgatccccccgcctcaacctcccaaagtgcggggattacaggcgtgagccactgtgcccagccctgtatgatttttttcccacaaagatctatgcctgcctctg

SEQ ID NO: 13897 - DNA, 768 bp, Homo sapiens
  misc_feature (1)...(768): n = A,T,C or G
cgtagcnagaagcaaaagaaagccattagatcaaattaccacccagaaaacactggctgaaagaactcacagattagacaaatggagaaacattccatactcatggaatggaagaatcactatcattaaaatggccataatgcccaaagcaatctacagagtcaacgcgattactgtcaaactaccaatgttattattcacagaactagaaaaactatcccaaaattcatatggaaccaaaaaagaacccgcatagccaaagaaattctataccaaaagaacgaagccagaggcatcatgttacccaacttcaaactgtactataaggctacagtaaccaaaacatcatggtagtggtacaaaagcagacaaatagaccaagaagagaataaagaacccaaaaataaggccacaaacccacagccatctgatcttcaacaaagttaacaaaataagcaataaagaaagtattccctgttcaataaattgtgctggtatagctggatgtccataggcagaagaataaaactggaccccctacctacgtgtccccatatacaaaaactaaattaactaaattaactaaagaaggattaaataattaaatggaacaccttaaactataaactttaggttttcccaagaaaacctaaagaataccattctggatattgtccttgggaaagaatttatactaagttctaaaaagcaactgcaacaaaaacaaaaattggcaagtatgacctaattaaactaaagagcttctgc

SEQ ID NO: 13898 - DNA, 788 bp, Homo sapiens
agacctttttgaagaaatatatggaacatgtgtcttccttcttcctggctgttataaaggaggagtatggcagaagaaccacaacttcccaactgtttggaaagctgcagctttcctttgctctaacaaaatttattgcaattaaaacactgcagcctcatcatcagatgtaattatagaaaattaactataggttgaagggtcatttcctcaacatcaaaggaatctcattgagagctgttaatatggaatagcaaacgtaaaggaatttattggtggagagaaaaaatggtgaaggaaagtagataatatgcaccaccaaaataaagtacatcaaggaaaaaaggcatcttttgtctttgatggaagaaagaggaagtccagtacaaaagtatggcaaagggaatcatccctagggtaatgaaaaatgtccccaagatgacagctgtacgagagacctagaggcatccagcccagactagagactggagcagtcagaagagagatttcttcaagaagatgaaattcatagaacaacctaatttgttgggttggaggagattaccccttaaaaggagatttcgtgacactagaggagagttacacataaaaaaacacaccccgcaaatgaaaaaaccacggcattcctttgggcaaatgtttaccacccaaacactcacattaaaacactattttcctacaactgatgctatttgggcataaaaaagaatgaagggcttgtttatggatgaacctcaaaaataataattggccggggcagcggctct

SEQ ID NO: 13899 - DNA, 784 bp, Homo sapiens
agaggcaccctagtggtccatgggagttactcttcttattccttgaccagcagaggccagaagtgaagggcaccatatcacctttagtaggtggaagtcatgtacagcgattggaggtcgatgtaaaaatcaatgtgatgatagtgaatttaggatttcatactgtgcaagacctacaactcattgctgcgtgacagaatgtgaccctacggacccaaataattggatcccaaaggactcagtagggactcaagaatggtaccctaaagactcacgtcattgaagaaatccatgcacaagaagatgatacatctgaatgaagtcctctcattatttcatcacttcattgatgacctataatttccatgcatgcatacctataatgaataaataattaaataaaatatatttcagctggacatttttataaacattgtgcttgcttagaagaaagaatcagaatacaaagcagggatttgaactctggaatagaagcagcgtggagaagaaaatccatgatgggaccgctaagtttagtgagattttggggccaattccttatttagtgtgaaaagcatattatgaggtcttagtgaggtattatcaagaattctttgaggagactcaggagtggggacagagttgattaagagaagtgacccctgaactagtaaaaatcgttgcaagaaatttgaaaggatattgaaatctcatactttctcatattgcttatacttcctggtttaaccttttcctttctttattggaaagaattatgaacaca

SEQ ID NO: 13900 - DNA, 795 bp, Homo sapiens
tgcaaaaagatgacacaaacttcacagttgggaaaagaaaatacctcatggatatgggttttattgcaagctatgcatctgacttaaagatgttaatgctgaattcgcccaccaagatcaaaactcctacaaaactcttccagctgcagcatttatggctccaggttttgtttcagaaaagaattggagttctcactggggatgctgatgagaagagcgacggacaaggactctctggaattcctctgttccttctttttacagactccagaggacctgaacaagcacacgtgttttaaagatgctaggcttatgatggaatcttgctctgtcgcccagtccggagtgcagtggcgcaatcttggctcactgcgacctacgcctccccacctcaagcgattctcctgcctcactctcccaagtagctaggactacaggcgtgtgctaccacgcccagctaatttttgtatttttagtagagacaaggtttcaccatgttggccaggctggtctcaaacttctgacctcaggcgatgagcctgcctcggcctcccaaagtgctggaattacaggtgtgagccaccgtgcccagcctaatgtaggatattggtaataagggaaattgatttttgggtatgtggaactttttttacagctgtcccgcagatctaatctactttgtaattatggttattggaacacgtaaaattcaaattagagagaatcgtttattggttattaaggcggacccttctataataatatttggcctgttacgaacgcttcataagaggg

SEQ ID NO: 13901 - DNA, 792 bp, Homo sapiens
caggtacaccagcagtcaaggtgctggcatatgacatagacctcttcaatcacttgcaccttttggagttggaaatacaaaaactagcaagtgtgaggaagctgttctcctgaggtctgcaccagggaagacagctacatctacattcgggtggcagcactggaaatggtttgagcaatgctctcagtgtgcagagctggtggaatcagagatgcatattgaagcgtctgtactaaatgacagctatggtctgaatgtatccccccatattcaatcattgaaaacttaatgcccaatgcaacagtgttgggaggtggggcctaaaaagaggtgaatacgtcatgagggatctgccctcatgaatgaatttatgtttttatctcatgagtgtagtcatcacagcagtgggctttttataaaagcaagttcggcttcctcttgctctctggctctcttatcctttagccttgtaccacggaatgatgcaaaaagaaggatctcatcagatttgggtgtccctatgttgaaattctcatgctacacaactgtaagaaataattttttaataaattaaccaatatatggtattctattataacagaatgaaatggaccaacacaaggacattattagcaaaggagcattggtgcatttattatgtgatataactaacttttgatggtacccttggctacatagcctctgaagttgattccagaagatccccataaccttgggtaagctatcaacattttatctgaattccctttctgtttaaataagccaaacaaa

SEQ ID NO: 13902 - DNA, 675 bp, Homo sapiens
cgttatatatatatttttaaattttaggccatttagagccaaacatgtattctttggctatgacaagacaagttgaccagaaggccttatcaatacttcagtaaccctgaggtctcaccttataatacctcatctctgaaactgtggaattgtaggtcaactgtgtattgaatcgataatttgctgctgtctagttcttaagagtgattcattgctttttttcatcatcctcgttgaattcagtttcctgcaaatatctgaactctgggttcttccagatcatctgttccgtggatgcttcccaatcaatggctttaagcacgtgataatctcaaccaaaaaatacctgatgatagacagaaagagatgggagtggaacatggaagagaagaggaaagcaggaacgagaggaactgaggacaacaagctgggtcatcaaattactaaaaagacaaacatttcttacctaccaaattagtaaaagtcagaatcttgctaatatacctgtgttggtgagatgtaggagaaattgacattgctcatatatgggctgtgagagtgcaaacatttaccatctcctatggtagtgaaatctgccacattccctcggtttaattattggctttttactctaaaaaaaaatactaactaattgctattttaaaaaaaaaaaaa

SEQ ID NO: 13903 - DNA, 864 bp, Homo sapiens
aaagacaaatatacctttcatattatcacgagccgacacagattccttaggaggcaacacacatggttagtttaggcatttggctcttctagatgacgcatccaaacttcgttgcatgagaacaaaagtgttgcccaacaggcctctctcacagaccaaagacttactgcggaaagctgagaactgcccgatacacggaattatcccatctctaatatcccctctgtcctccattcagcggctagtaccgcttcattctctaccataccacttgtgcatgcatgtgaggttctaatcccaactgaagatccgctgtagggacctacctaataagatttctacacctagaattatccgcgaccccgactatgtccacggccactctccacccataactgttctcgttgcttcctcgcgcccgggctcattggggcacactgaacatgtactatccctataaccatgccccgctgttgctacttatggactgcctctcctccatcacaaacacaattaatgctcagacattcaactacccaacactctatgtcccaccgtactgcattagctatccgctactaacactggagcgggggaatgtcaaggtcgttggtattcggcgcgccgcggaagcatacgaacccacagctcttgggtgggcgagtatattaattgacaatttgctcacttagtaaattgttattggagccgattcgtggacactcacctccattctacgtagcatgaccagccttgctctttgtgtgctctcttttgcctcgaccaccggtcaatagcacacgaaccccgtgcgaaagggacacaaacttcacgttagcgtgatgatcgcccttcctcctggtg

SEQ ID NO: 13904 - DNA, 1323 bp, Homo sapiens
  misc_feature (1)...(1323): n = A,T,C or G
agagaaaaaaaagagaggaaaagganaaaaganngaagaattgaaaaaaaaaagaagggaagagaagaagagaaagaannaaaaagaaaggttttagaaagaaggaagaaggganagcggatttttacacagncagagaaacggagggtagaaggaaataagagaagaggaacagaaagaggagttttttaagagaaaaaagtccgagagaccaatcatctaagacaagagtntacagcagacaaagcgctgtcctctagcctcagctaccctggaaccgctacgagcgcccgtagtccccggtatgcggtcggccgagcacagagagcgcggagacaatagagaactacggccgaccagcataaacagattaagaaggcacacgcgagcctcagccatgnncggaaaacgtccaagataaatagagaacaaggccccgcaccaagagtacagacagacaagaaatagtnncataattagaaagacgagtgntaacaggagagcactacnatacaggtatgacnnaccagaaaaccnaaagtcgaagacaggtncagtgataccaaagaactaccccccgcgacaggccagctatcntccgcttcgcactaacgagatgccctacagaatcccccgcccccactacacaacccactgccccaacagccaccccacacccgcacaccgccagactcncctccgcctcccgtccgcccactatacatcgtacccaacgcacacgtaagtaacgagatagactcagaaancancactgcgcagccgacgagggcacaggctnnngtgcgagccgatggtcncatcatatcgaacgcgcgctcgcggcgtannngaatgaatccacagtacatgaaaacaaagnccacaggacgaacgagngacaggaccgagtgnacactacacgtgactagcaccgcantcacgacgcacgcgctcaatctcaaacttcagcaccgacgtactcaccgactcatcctcaccccgcctgctcatgcnccaccgaagcgccnccacgcggacgtctccactatacagagggtcccctcgccgatactacggacctcccagagtccacacgagacanccaagacacaaagctcagagcgacaataccgtcgctnntcgagtcagagcgactgtccaaggtagtagtntctggcntcccgccggaggcagccgacgcggnngagaaagtgtagtcacgccgaacgatagtgtgtnnnntagagataagagcganatggcaccacgatcgcncnncctctggcnacacccgtgtctctacgttctactccgacacaaccg

SEQ ID NO: 13905 - DNA, 808 bp, Homo sapiens
  misc_feature (1)...(808): n = A,T,C or G
cctagtctcaggttgtgggacatctanagaagggtctggtgccatgtttgccccaggctggtccagagaagcagtatccccccgattaaggacagtagaggtctggtaacagaagaaggcaagtctcaataagaaggtggccacagcccccaggagatgctccatctactatcagccttggaagaaccgctgcaatttcatcaaaggacagaggttcccaaactcacccagcacaagaatggaacttgctatctttctgggactgttccagggaagtcctggccaagcctccacaatggaccaaaaagtcatctccagacttcaggatttcatgaatccgtaagattttggaacaaaattgggggaacaacataaagtcgctttttatttaggttgctaagactttaagacaaacacacacaaaactgccaatcactaccaccataatttcacgaaagaaaagacatttcagagccaaaaaagaaacgtttgaataagcctaacttcatggaaatctcaccaaatgactntattttcttcatttctttatggatcatganatccccatcacaggccagcacagagccaagagacagccaccagttccaccactgtctgttctcaactgtggactctgggcttttaaccaagatgaggaaaaattctcatcccagtggccggngtcttcaggccccacagaaagctgcctgggcagtctgtacccataatgatgccactttactgaaatgtgcaggtgtgcccacaccctgcccgacacactaaggttncccaacagcggtgggaggac

SEQ ID NO: 13906 - DNA, 548 bp, Homo sapiens
  misc_feature (1)...(548): n = A,T,C or G
gctacntttcatgtctcatgaaaactgttctcctggccaaattgaacgaatgcagctctctggactcagagaggattgaatgggcaattaatcaggagggtgccagtctcccaggagaaccagcaaacatcactgaattacgctgctcatattcctggactctgctgaagaacaatctcctccaggaagcgccttctgattgcctggcccaccttctgcccaggctaacacggatgccactgctatctggccacacttctatcaaaacatgcaagctgttctccttccactgctcttcagctctgcctctggaacctcactttgaatcccttgggacaacaatgtcagactggctggactcacatctggctccaccattgaccagctgggtggctgtgggcanattacttacattcaacgtgcctcagtcttctcacctgcaaaatgggtataaaatagttctcattcatgctaatgaaatgagattatccaggcaaagagcttatattggttttcaaaaaaatgtccaattatcaaaaaaaaaaaaa

SEQ ID NO: 13907 - DNA, 775 bp, Homo sapiens
ctaggactactaacaatgaagcactgctaccatccggagcctactgagagtgaagtgaagaaatagttttccaaagagagagagagagagaagtctacctgacagaagttgtgaccttccatccagaaagtcagcatttaacaatccttgtgaaagactgaataggagaataacactttgacttcattcccctcacactcaccaaactcgtggaagtgtcttgtattggttaaacaactgaatgctagaagacaaaggagccaattgattcagcttacaagggttgcgaatatttccaggcctcttcaaactctaccaacctagcgtttagcatttgcaaagggtgtcacgcatgtgctcacaataatataatttttctcagtgatcacatattatctgacatttttatcctctattgatccagacgaatggaaaaaaagattacttctgagaatgccaaaatcaccccggaatgccaaaacagccactgctcccagtgcccaggccaaaattgcttgtgcccatgaagaagatgacatgatgcccatgtgttgacagagttgtccataagtgctaaagcgtgacgtatttctcttcttttatcttggcccatttgctggacgttgttgtccacttgggctactgtgtttaccacaatcatgaattgcgtatacactgtgcgccacatgtctttaacagagatttaagactcagatccttctttcttcttttttttctcctcctaggaccctagtacctgtctgcaaaaggaggg

SEQ ID NO: 13908 - DNA, 813 bp, Homo sapiens
  misc_feature (1)...(813): n = A,T,C or G
ttttggcgtgacangaaactgcagcttaaaaaccacctccaagaaagaaacctgaaagaaacctgagggaggccgggtgccgcagctctcgcctgtaatgccagcactttgggagggcaagtcaggaggatcacaaggtcaggagtttgggaccagcctggccagaatggtgaatccccgtctctactaaaaatacaaaaattagctgggcgtggcggcgcgtgcctgttatcccagctactcgggaggctgaggcaggacaatcatctgaacccgggagtggaggctgcagtgagctgagatggcgccactgcactccaacctgngcaacagggcaagactctgtctccaaaaaaaagataaaaaaacctgagggaaataaatctttatttaattgctgaagaaaagcttccagattatgtaattccagaagcatctgatcctcgggaccatgatagcagaatgtacaattttaagtctctgttagtgtacttcaagaaatacctcanatcacctactgtagcaaatatccttatacaaatttatatcagttgtgtgaaaaccttttatgcaaaaagttgcatcttatcactttctgttacctagaagtatctatagcaaaaaactgctggtggacctaggtaatgtcacacacaggagatcagtcatgttctgaacctttaaatggttcggtggcatgaatattgctaattgacctatcacaaaacttactttggtggttgagagctaacactggcccttccacgcacacacatgcacagcctttaaattccctttggtcaaaaactgaaa

SEQ ID NO: 13909 - DNA, 398 bp, Homo sapiens
  misc_feature (1)...(398): n = A,T,C or G
cctacncgttccccactgactacagtaaggatgtaagaaacaccacatagagttgatacaatcaagtttccttctgccggaatgtcagcatctggaatggcaccaaaggatttgagaagaatgatgccaggacaccagattttcaaacaagcatctatcagccatgcggttgctctgaagtcacatggtcagcctgccatttggggtatcatagtttctgcaacacctgagaagcacctgaaggcaggcagaagtcctctactgagtggtttcattcgccccagctgaacagctgacacgagctcccgaggcactctactgaggataattagacttatactcagggaccggcaataaaacatgaaaacaactatgatataaaatgaaaaaaaaaaaaa

SEQ ID NO: 13910 - DNA, 146 bp, Homo sapiens
taggtggttgaaatggaaataactccaaggtagactgtcaaagacagccacgtgctgaagataacagtcagcttgtatcactgaatgactatgtattgttatgtaagcaagatataaacatctacatggtttgaaaaaaaaaaaaa

SEQ ID NO: 13911 - DNA, 469 bp, Homo sapiens
  misc_feature (1)...(469): n = A,T,C or G
caggcatcccgcagcattttcccactttgtggctgtggtagactgaataatggcctccaaagatattcacatcctaatcgggtnngagctgtgactgctacattatatggcaaagggactttgcagatgagataaagttaaagatcttgagatgaagagattttcctgaattactcagctgagtcctaaatgtaatcacaagtgtctttatgagagggagattgggctacagaagggcggggggtaacatgaccatggaaacagaaattggggtgatgagaccataagcctaagagtgtcagcaggtagcagaagatggaagaagcaaggaacaggttctcttccggagcctccaggaggatccatccctgcaatggtttcacttcagcccagtgaaattgattttcaacttccaatgtccagagcttgtaagataataaatttgtattttaagtcaaaaaaaaaaaaa

SEQ ID NO: 13912 - DNA, 533 bp, Homo sapiens
taggtgagtactcgctgtggtaagtacacatcttaaccagggaaatatgttgatattaatttaatcccttaaaaatatttagaagaaatcacagagtattgtaaggctcccggtgataactgtgggatttcagtgtgcacagctccctgtgcactgcaatcattcagattcctattcctggtccctcacccagagttgggggcattagggatgctgttggtccaaggatgggggcagggccagaaatgtctttatcggtagttttcaatgagagacaatttttcccctgaggggatgtttgacaatgtgagaagcatttttttgattcttaccacatagagggtgctgctggtaacaaataagtagagggccaggatgctcctaaacaaagcacagcccgccccctgcaaaaaagggtttttatcaggccccaaatgtaatagggcccagggtgaaaaacccttttttggttgaacaaacaattagggccctgggatgaagggccggaccccccctttggaaaaaaaaaaaaa

SEQ ID NO: 13913 - DNA, 149 bp, Homo sapiens
  misc_feature (1)...(149): n = A,T,C or G
cctaccntgaacaagattcagaacattaacaggaagaatgaagattattgaaggtttctcctattcctacatttacaaaatgtgtgagaattcccaattggacccttcaataaaccaacatgaaacaataaaatggaaaaaaaaaaaaa

SEQ ID NO: 13914 - DNA, 641 bp, Homo sapiens
ctgtgggaaattggctactctgaactgtctgcttgtttttggagaatatctacagcagaagaaatttgcacagcagtcactcggtccacatttactcttcaggatgttgtggaatgtacccccaggttgcttttggagtgcaaagaaaatgtagctcaaccccacctcagccacagtggctctgctgacttactgggaaaaacactcaaactcccatgggcatccctttcctcatcagtgaagtgagaagaggctgaggcacctcaggggccttccaactctgatagtccttgattgcaagtgtactacgtaatactttttgtaatgaagagggtaattaatgcattgataatgataattcattgtagaatatggtaatagaatagagaatcttactatgttggacagaattttttatacaactaaaaatggaggaatggacatcttctcccagcatagaactgcagtgacacccacgtagtaccggctctagtggtgctcaagcccgggtttatgtatgttgttggggttgaggtcggagggtgggttagacatgaataacttatggcagcgattactgcaagtttcttaagggccccagaggtataataataacataataattatgaaaaaaaaaaaaa

SEQ ID NO: 13915 - DNA, 557 bp, Homo sapiens
agcttcaaagtgttcatagaaaatcatccctcgccttatttctactggaaaagaaattacagctgaaagaacatcttcatcagagtcatggaggcaagaagtgattctttcaacaagatttttacagaaatgtgaaagaagtaacagaagtccctggatgactaagaaactgatctaggaacttttgtttatctgccttccatttttcagtacaaatttctttggagcaaatgtctacattagagatcaagtttttggtaattctgctgtcctaaaaagaaaacatctcgctgttttcttgagctgatttctcaacagcatcactagcttcaagtgcacgttgatgttacaaaaagcaaatatacttcaaaaattccattattcagtacattttgatgtagccatgttgtattgcttaacatataataagcatcaaatttatattcacttgttgaatgaatacacagatttttaatagatatggtaggtactgtgcaagactctgtgaaaaatatttagatgaataaaataataatcaccatgtaaaaaaaaaaaaa

SEQ ID NO: 13916 - DNA, 366 bp, Homo sapiens
ttggcttttcgatctgctgtcttcttggcctagaaagtttgtctccacattgacctactttcttccagtcgcccttcagatctcaggaaaaaaattgaaatacacttttgagactgtcaatatcttccatcactaaaagaagatatgaaaagttactgatgtatatgtgtttgcttcgaataagggaaagtgctgtacttttcttcacaatcttagggtaagagtaacctcaaagacaatctcacaattagcatggacctacagccacttgtttctaaataaatccacttattaaataagatcaccttggtaaatatttgttttaaagattgaaaataaaatctagtgctgataaaaaaaaaaaaa

SEQ ID NO: 13917 - DNA, 782 bp, Homo sapiens
ctaggtaaggacaatatagagcatcactccaacatctagtccttcacttcaagaacacttgcaggggaggcgtggacggcagtttcctgatttctgaatcacagttccagggatgtgttcttgaaattgacagctttctagtggtattcatctgattgtccactttcctaacaatggaaaaggtagcagcaacctgctcagacctatttggctgtgtaattctgggaatggttcctggggaattggcccagggcctactcctcctgtctttccagtcattttgtaagaattaaattacctatgtcaaatgtctttccttttaaaatagctagaacaacctctatttccttcaaccgagcctctcactgatttaaataaatgtaagacttattccctttttgcagcttataaaatctgatatatagggatgtttaaaataatgcaattaattatattagattatctgtattctcttttgcctacttgcttttaaaaggcaagaagttgtattaaatctctcatttatgattgtattcttctcattttcccgttgatttataatgtttttttcacatcaactttgatactctatttggtttatggaaatgttatttagtaaaacttcatcatgtataatatccttcacctgctaaaaaattgccgcgttgtccagtttaatgcttctctttttccttggattctttcttgcctgatattatattggaacttggagctttattttgtttgcatttatctgatttaaatttgcttattttaacttc

SEQ ID NO: 13918 - DNA, 823 bp, Homo sapiens
  misc_feature (1)...(823): n = A,T,C or G
gctagtatggtaacctggactcgcgngtcattattccacacaagaaaactatctgttgttcaccatccgactgagttgactagttgagagcttgagcagattaaagcacagacaggaggaatgggagcacgacaagttggaacctataccttctaactacaatgactccttctaccagaacctcagaattggtccctgcccttcctaaatctgattcttcagatttcctttctctcatatagagccactccaatattcagtctcataagttgtgtttcttctccccccacactggataaatacagtgctgtcgcttactaccatagggtcttaattgacgttgatgcctgcccctggagagcagaattctctccgcacccctagtaactggtattatttatgaggcccactggctgaatcataatacagatgcatttcacatgcttggaaagaatcaaaaaataaatggcctcattggcctcatcggaggaactttgggggcactttcccttttagcgagggataataaaggatcctcgttgactgactccctgcactcggcccgttcggttgcggctagccgtatcaccctcactcaatggcgggtattaccggtatccacagcatcaaggggaaaccgcgagaaccaacatgggatcaaaaggccacccaaagtgccacaacccaaaaaaggccgggttttttgcgtttttaccttggccccgcccccttgccgagccccttaatccttcgctaaaggcagggtggcaaaccccgcaggactttaaaaatccaggcggttcccctggaacttcctcgtgca

SEQ ID NO: 13919 - DNA, 452 bp, Homo sapiens
  misc_feature (1)...(452): n = A,T,C or G
cctgnaaatacctggcatccagnattattttccccacagaaaactatctgatatttagatctgaatgagttgactagttaagagcttgagcagaataaagcaaagacaggaggtatgggagcacgacagttggagcctataccttctagcaacaatgattccttctaccagaacctcagaattgttccctgcccttcctaaatctgattcttcaaatttcctttccaccataggagccactccaatatttttctcataagttttgttttttctccccccacactggataaagtcagttctgttgcttacaaccatagggtcttaattgacgttgatgcctgcccctggagagcagaatcctctccccaccccaagtaactgctattatttttgtggcccacgggcagaagcataataaagatgcaattcacattcttggaaaaaaaaaaaaa

SEQ ID NO: 13920 - DNA, 292 bp, Homo sapiens
tctaggggtaattatcaagggatgatgttggaacacaaagtatcatctgaataagaaagatgagcctcacagcaactctctcctctgagacaagttcaaccttatattattaccccaccacagtctacatcatcaacatttctaatgcaagctggtacctctatatggattgctgtatactcctttcttaatcaaacactattctgcttcctttaagtctcaattcaaaagtcgtgtctttgtgatttccccaagtaaagtgaatttctttatctctgcaaaaaaaaaaaaa

SEQ ID NO: 13921 - DNA, 187 bp, Homo sapiens
ctagatggggtagggctgtggatggactcaaaagatcttgagagagcattgcagccaggagtttcttatgttgctgttgctgctgttttaatcctttgttcttaggctccatctttaagctgaagaaatatttaaatgttaattagctgtgataagtaaagaaaatctacaaataaaaaaaaaaaaa

SEQ ID NO: 13922 - DNA, 106 bp, Homo sapiens
gcacaacggagccgaagaaccaccggttgagacctgcccaaatttctgacctccagaattgtgagaattaacaaatcattattgttttaagccaaaaaaaaaaaaa

SEQ ID NO: 13923 - DNA, 477 bp, Homo sapiens
  misc_feature (1)...(477): n = A,T,C or G
cataaccgcaacaacaacaaaaagactttattctctttgtatgaagattgntcactgtcagaccaaagtctattcctcaagattgcgcctgccaaagtgggctgactgcgtggaatctgaactctctcccttgtcaaaggcattcagtgaagtggccaattgtaccctgtggagatgggccctgagttcaaatcctgctctgccacttccttgtttatgaactcaagtgagttatttaattccctttcttttttttctcatttggaaaatcaggatataatagaagccaccttaaaacaggtatcttgtgaggaaattaatacatggaagaatgctggcatgttcaaattgccatgagtgtttgctgttattataaactatgcttatgcatgccactaaaaaggatctaagtttatactccaacttcttttattttttttaataaagtgcaatttaaggagtctaaaaaaaaaaaaa

SEQ ID NO: 13924 - DNA, 741 bp, Homo sapiens
tgcagagatctcaggaaacctcaggctttgatgaacaaacagtccagactttcaaaatttgttgcagggttcctataaaccttgcatatttaaacttctaaaactggaaacaaggataaaacatggataactggaaatattctgcatgactattagaaaaaaatagcaataacaccaactaggaatgtaaataacatacttaaaagcaacctgggccggacgcggtggctcacgcctgtaatcccagcaccttgggaggccgaggtgggcagatcacgaggtcaggagatcgagaccatcctggctaaaacagtgaaaccccgtctgtactaaaaatacaaaaaaaaatttagccaggcatggtggcacacacctgtagtcccagctactcaggaggctgaagcaagagaatcatttgaacctggtaggagggggctacagtgagccgagatcgcaccactgcactccagcctgggtgacaaagtaagactccatcttaaaaaaaaaaaagaaaaagaaatcttgaaaattgggcttggcaaaggcaaaagagaccttctcgtggggaataaaaaagtgactggagaagaaagcattttgttgatgagaaagggtactggatcctatatggtataaaaaaggttcaaaaaaaaattttcttacttcctggggggcttgcagagcctttcttgttcctgtattattacactaacatgtttttttgcttctaaaaaataaagg

SEQ ID NO: 13925 - DNA, 809 bp, Homo sapiens
  misc_feature (1)...(809): n = A,T,C or G
taggaagagacacgatgacagagcgctcattcatcaagcacaccaagaacataccatgtgaagacacggtgagaaggtggttgtctacaagccatgaacagagccctcagcatagacacaactctcctgtgctaccttactcttggacttttagcctacaaaactgtgaggaaataaatgtctgtttggttaataaataaagtacttctaaaaaaaattaaaagcactaaataactttccaaaggcaatcccacccccaactcctgacatataccttcacaacatcatttggctggaaggtaaagatgttctcattgacttcttcatggaatgagccaaacttgcctgttttgactctggacataccatttggaaaggaggtgaaatgccacaaggaatctacttaattatttcaggaatggcaattgtaagggactattgattttttttttggtgttacttaaaatgtatttagaaacatgcaattgtccaataaaaataaatttatatactgacaaaaaaaaaatactggcctcgctgacctcagcggtggaggtatgttgccgcattccttcaccgagggttaatttataaaactttctcactaacttgctaagctcggacaaccggctggtgctatagatataaagttattccaacgcgaaactccggctatccccataatttaagggataaccccagtaaacaacatatnaagtaaaaggtcttctaatagccaagaaccggtaaatgcctcattcgttggccgttttacctaaggttacggccccctggcgagcatcaaaaaa

SEQ ID NO: 13926 - DNA, 761 bp, Homo sapiens
tagagatggggtttcgccatgttgtccagctggtctcgaattcttgggctcaaaccatctgcccacactggcctcccaaggtgctggggagaggggatgagatggccaggcttcccaaagccaggaagccagagtgtctggaagatcatgtggcctctgtgaagcccctgcatcgtccgtgtaccaggaggagaagcagaggaatgtacaggcaaaccctgccctcgacagaggtgctgggctggaagggaaagagcatgttgccactgggtcagtgtaatgaaactgaactttttctccaaatggaattagtaaatctcaaagagaaaagaatccgggtctgcagcccaaacccgcatgcctttgggggaacacgcacagcaagaatgctttatgccttggcttttccagacacaggctcaacacgaggaaacagcaagcacaggggaattataacagggtgatcttgagattttttttttcttttgccccaaccctgatctgtggcacttgaacaatcttggtctccggagaacagactactgtaatgataatccaggaagtaaattgccttttgaaaagcaaggaagaaaccaatggactaagtatttatttatatttaatgctccaggacttctgtttccaactttgaagagttcctggcaaacgctttgtgaagtcattaatctttggggcaaatctaaatggcttgcacagctggatgcggtggctcacgcctgtaatccagccctttggaggcg

SEQ ID NO: 13927 - DNA, 779 bp, Homo sapiens
  misc_feature (1)...(779): n = A,T,C or G
agataaaaacaccttttaagttgttgcagatgttaacaaacccagctaccttagaagctagtttctttgttatgaatcgctcatgggaagacttttgttgtcaacatgacaacttccagattgaaagttcactacaaatttagaagaaagaaagtgtcttggtagctacagtatgtatcataatgcagttatttatggggtgttttcccagactttttcatgaagcaccagctgcctttgactaggctgctgctttttcctcatttttttttattgatgttcacatctatgcttgcatgtagcatgaagcttggaactgatgaaaggggatgtggatgcctgatgaagagttccaaaccacagccatcggtactaatgcatttatgagcaccccaactgtggcaaagcatactttcattttataagcctagaggtcctcataacagggctgtaagcccataaacacagtgacacatttacacggatcaagttcaaagatttaaaaatgtatctaatgtaccacatggatgtgacttagaaatagcttgctttcaattcttattgaaaacaaattgtattgaatatgctgcaacccaatccaagtttggcaaactaatgctttgacctgaattaatattttattaagaaatattangaaatcacaggactttgagagaaaaaaataaattggtcatgattttccacattacagagtttcttaaacacattgcaacaaccccagaaagccctacccgcactttattttgtgcttgacacct

SEQ ID NO: 13928 - DNA, 798 bp, Homo sapiens
  misc_feature (1)...(798): n = A,T,C or G
aggatcgacatttgttcagaagcctggttccttttactggaggatggtgtttattggagaacagagacctgggcaccagagtctcactctgtcgccaggctagagtgcaatggtgtgatctcggctcactgcaacctccgactccctggatcaagtgattctcctgtcagcctatcgagtggctgggactacaggcgcccaccaccacgcctagctaatttttgtatttttagtagagacggggtttcaccatattggccaggatggtctcgatctcttgaccttatgatctgcccatctcaacctcccaaagtgctgggattacaggcatgagccaccacaccgggcctggagggtgattttgaccaggccttctcaagttttggaaggaagtggagctcacttctcttctgttgcttttgcccacccaggatcacttattcctctgggtaatacagcaccccaggcacaggggccgcctgtcacataagcgagggcatggctcatgtgcggccaggccccagtgattctgcaaaggttgcccataagtccttcccccgccccagggctggcatattgatgtggtgggatggaagctgtccttctgctgggtctgcagatgggggcaatgtaaagcctgacattgccggatgatgtcagaagcagaacccataggcaaaagccagctttccagcactccactctcagtttcctgccatctccacttctgtggatgtgtgcccggcatctgcctctgnccctgcctctgagagcagtgactgggcaaacagtcctgga

SEQ ID NO: 13929 - DNA, 769 bp, Homo sapiens
cagggtctttctctgttgccaggctggtatgcagtggcatgaccatggctcactgtagccttgacctttgggcctcaagcgatcttcctgctttagcctcctgagtagctgagacagcagggaactgctattggctgacagttgctgcctgacctggagacgtcttgaaagttacacacacttctggggaaagcccttggccagtgactaaacagatgcatggatataacagcccagccttcttgtctctggacaagacgatttttgttttgcagttttcactcaagagctccttgtgggatcaggctgagactaagcttctaaaaccacattttgccttaggtacttcccctgccatccggcttcccttactcccctgcaggtttctcctgagaacatttcctcaataagtcatctgtacagagtccctgtctcagcctgtttctaggaagctcagtctaagacaaatgatgcgcgcacatgtgatctttatatattttggagatattgctcaattgcctccatagagattggaccaatttagactcatcctagcaatgtaagaaagtgttaacaaaaaccttgtcatccaaattgctctcagatattagtgaaactgctgggcatggtggcatggtgtaacccccttgggaggttgggataaaaagatcactggaggtcatgaatacgagattgcagtaagtggcgataggcctgtgatagacactacactcaaatgagggcaacactctgatctgacccttaaaaa

SEQ ID NO: 13930 - DNA, 829 bp, Homo sapiens
  misc_feature (1)...(829): n = A,T,C or G
cccccanccngggggnnaaangnnngnaanngggngggnnccnnnccncnttnnnnnnnnnnccannnggggaaaggggnatnngnnnnangcntnttnaanttnggnnccngncngggnnnnnncnantcnnnnngnnggaaaannanggcccggtnangcgcgggntnttcccannccannaaaggggnaaanngggncccnggcccccccctngaanttnnacgnnatnaanaaggntantagggccanagggccccccctcnnaagttaaangggnaaagacaaggcaagagattgccacacagncgtntcgaagttaagttgcagggcantnagtgattanccccccgccacatgnaacaaaagaangattatgngngcactcaggtttcacnaccnggcaactgttggattagagcaatcagggaccatatnttgtcgntgatgccccccagggcctagnacaganttgnntgaccagnttaggtgtgtaacnagacgtncnccttctccnaccnggggatagccccgtgtcaancagttcttccncaangntctaannaagaggnnngangtaattnnaagttntcacnnagaggnnggtcagnnanatacnagnatgctccnccaccccangggaangaccattgtggggcatcgtgctcccccntttatcngggatngccncaaggtaaagccngtgtggnccnnttannganggtggttcatcnntaaaatcaagngtnncnncacctnnnnacncatgngncagtnatnanggccaatccncagngnccgcagataangggaanggcgtnaannnnct

SEQ ID NO: 13931 - DNA, 1939 bp, Homo sapiens
  misc_feature (1)...(1939): n = A,T,C or G
ctactacgntagngtgtatcnatcatacgcgtcatctagnggcgtatcacgtatagctactacgtactatagtgtcntcngtnagtgntcactatacnatncgcgtcagtcangagtangantncgtcgtcncaagctacantgtgtgcgtcgtcgtcgctgctcanctacctacgtgcgcagtgcagcgatctcanctncntncantgnaancgcaatagngcatganagactgngtagtactgacactagtagctantagtatgnaagtncncaggtggcangtgcgtcgtagatttcgtncgcagtacgcnctcgcatcgctgactgcagagctgccatgncgacgcangcagctagtcgatacggcagtctcagctgtcgcattacgacatncacntatactaagcagcntgtcgctgctgtatcancaacgatcgatgtacagagacgtntggacgtacgacgagacgangtcatntagactgnagactacgacacgacatatcacncnagctcagccanagactacatcgntagtcatctatcatgatatacacncagtcatgtcgtgagtagactcaagtacgtcgangatacagtacatgacgactacgtagtgacgtcaatgntcgcagcatgagtagatgatctgatgactcgatatctgtcaatgacatnacnatacactacaatcgatanacangncatgtacatgactgtggcactacatctntnaagagagcgtcaactagtnttactagtgatatcatatatagagcagacgagatcttcacagacgcatnatacacacatcgtnacgatgagctgctgtagngacgttcgcgccgctgcgcacgaatatgacncacgatatcgacgtcgcagcgtactntnagtcactcgactctaccatacatntgactctnaactnctattagaactctctctacttatgctcatatatcacanacacactacacatncagtacacacctcttactcctacgcactgctatgtgctacgacatcgcaggcacagacaatctgcgacagtcgtcgcgcatcgcgacgctcatatcatccgtcgctggactagacaatgacaatcacagacagttagtactcgtntaacataatactatctcgtgtctactgtcacgatctactaagcgtctcgcggcncngagctgagcacgacgctctnagtgcggcgcgatactaccgccatgatcgcgtctanattcgtacagtatagactgatgcgtcntcgtacntcagcacgagatgcgacactctcatnacgcagtacactaccagancgcgncgcggacagtagagatgagagactactgtcactacgtctacgcgcgaccagcgccagtgcgcgataacaggtagacgacgcgnccgtactgcntagntatgcgatgagcagacgacagnacctgcactgtngtatgacganagtcgagactcctcggaacangtgcactgacaccgcgtncangaagttaggcacagagctacagatcgcgcagcgacgtgtgancngacgtgtgcggagacagatctaggagcacatatgatatatatgtgtngacactgctgctcagtgagtgtgcagcacgcatgatatactgctgcngcagacgctacgactacgctgatacnacntcaccgagnacantgcatatntaganagtgcgacatgtcacngtgcngtagatgtcgatgcatcacctagtatatacaggatcntagtataagcagcgtggcaaagacngaacngagcgatctgtgnacacgagagaccacagcggtgctgcagtacgtngtatgcangtctgctcacgcgcagtgcaggtagatgtgnagcatagacagangccgtagaatcacaactgtacctacagcagtgcaacgtcacatgtacgat

SEQ ID NO: 13932 - DNA, 957 bp, Homo sapiens
  misc_feature (1)...(957): n = A,T,C or G
tggttgtgtatcgtagttcgccgggttggcacggcgggcaccttgcctcgcgccatcacctttcttgttcttgggggtgcgcctcattagcggcagaaaaaaaccgttctcccctgaacttgggggggggggtatgaaacaacaaatcttcccatgttttgggtgcccgtttttttcccgtatttttggcgggcgctcagttatggtcaggttttcaatcgccgcgcgatccgcactgcgcggtttcgagttgctatttattttctatgttttttctccctttgggggggggggggcggggctttctcgtggcagtagctctttatacgaccctccgctcctccattgcccctcgtgcactcgcctctccgatgtcgggttgccaggatatcctgctgtgctcggccgtccgtggcgccacgtgcgtggggtcaccgagctgcgccttaccggcgtcgagtcgggaatctggggcggtgcctgggtttctcgccgtgtctgttcgcgcgtcgaccgtatcgctacgtccggtctccactgctgatcacctccaccgtcccccccacgcgctcgcgtctcggtcacgttctccagccgagcggtccgcggccgcgagcgccatgcatgccgcctcgtgtggcggcgccgtgcgcggcttgtcgtggacgcgggcagttccgcgcccgcgcatcgcccggttgccggtgccgccgtcttgtcgtccggtgtgcccgtgccggacacggtctgggcgccgtgggccgctccgcccctggcctgttgctcgtctctcgtggtgcgctgtattggccgcgggacccccgggttcgcctcggtgtctgttgtgtgccgtcgcggcgcgcacgcatccccccaccgccgcttgcgcgcgccgtccgcggccccgacctttccgcttcacgcgccttggtgatnttgcgcccgctccgccgcggg

SEQ ID NO: 13933 - DNA, 1771 bp, Homo sapiens
  misc_feature (1)...(1771): n = A,T,C or G
ttattatttaccattatcctttacattactcttattcatttacctaatctcaatgtataaagtatttctataaaccaaataattcaccgtgtaaacaattttaaactttgtatataaaagccccttcttatatagcccattattacaacctttaatgcgtagtaaccgcaattcgaaaccctcaagaggagaggaggggcgcgccctaaaacacacaacaaattatcaaaantctagtataatgaaagtgtatgctgtatcgtacaccgcacatctaatatcccttatatattatatttgaaggttatactatccatccagatcttctatactaccaaattaataaataataaacaatattaaagcatccgactctacctccatctccgtcatacattacaactcgtgtatcataccgatagtacatctcatttatctatntccacggatgtgggcggtaacctcaattacatagcctacagttatatnatatctacgtcatactaactgacaaataatatgttcagtcgctttacatatagaatcgagagatgtcgtntgagactgtgtactcattctcgtatatatgattatcatagtactcatatactcattcatcgatgtgatattacttaataaaggatgttatataactcntaagccatcagtcatctacatatctatatactataatacttnatatatgtgattgtcctacactctcgaatatagtatgatatatgtnatctcgctgactgagatatttcctatctccacatatgtatcattctagtatacacttaacatcacacatgcagagactgtcattcgtcactacatattcaccatatatagacacaatacgtatataatatcgagcatatatatncactgatgatatatacatcacacgaaatatacntgtctatatattgaatntantatgtcacatcctatcgacacatatactacttagtcnaattacactctcagctcagtctaattnactcgcgcattatcacactanagacactaatttaatancatgtaacacgnacctacgctatcatccacncagacactataatcacnnangtacacatattgactgtctcagtatagtgactgcacgctgccgtccacgtactctgatatcacatcnacacagtttngtgtcactcatataattaagacagctacccccagtcagatntatatacatctatcngctatgcagcgcnctgtactcgaccatacngtacnactgacngaatgagatntanagtatcatatatcatatatcatnagtatatctcaccgncccacatcttctnctctcatctatagctgtcccactgactanatntcaacgcactntatactgcgncctacttgacatcatactactactnattgatgtntgatctctctcgcncagtctcgtttagatcgcgagccgtcgtcantcntntcgagcatcacgtcagttatantacatcatnatacgatactntnatatgntnncnatactctactgcantcncagtacantacatcatngcagtntgagntgatacgncanagcccagtngtgcagcagantaattgatcacgatacgtancgngcagntgagatgcgtagtaagctcgtcactgcgtactgctgtaatnatgttgatcacgctgctgntctcttcncatcacatatcgtacangtactcgtagtgaatagctacgtcacagcacacgactnacgacatancgcgatatg

SEQ ID NO: 13934 - DNA, 149 bp, Homo sapiens
  misc_feature (1)...(149): n = A,T,C or G
tcacanngttaaatgccgtaacgcgagnttcaggtgcctttctacaaccaccaganctctaaacctaaccgtggggggctctctttaaattaacccccccctcccgggggggggggcatcttgcctacaaaaaaccaaaaaaaaaaaaa

SEQ ID NO: 13935 - DNA, 1419 bp, Homo sapiens
  misc_feature (1)...(1419): n = A,T,C or G
agtgtnacgtgcacgatagaggacggatgaggtcacnagagaacgatangatatcancgactgcagaaatncgcgacanacngtcggacacagcgcagtgcaaagtatgataccaagcgaatgtagtcactntgacggtacatatattcgagtatngacatgtgtgcggatatctatatgtgtgtgtggcgtgcgcgtgcgtcgcgtcgataccgcgcacaaactnataatcgtnanaatncatncgaaactgttctggctaatgcatccaaatacgtatctcgcgagacgctggacgcacgccgatcgcgatatcgtacacgcgcgttctcatgttaacgcgtatctccatggngtgagacacgcgctatacattagtcgactagtgtgtatatcgaatgctaacatataatctttatcttggtgtccgcactcatagtatcgtgtcacatatnataagaagacatataaacaganggcgaaacgtgatactgataggccgacgtgtcgcgacaatgatatagattgtagcacggcgctatttacgtgtgtatctgataggagagtgataagatggcgcgcatcatcctagtgaccaaatggaatgcacggcgaatatgctatcgtcgagaattaaattctgattgttcggttaggtgcactccggaatatttaaaagtggtggggtatacggggcgtgtaaatggcgatatgaagaggcagcgatactacaatatcttgtgtcgcgagcaaaccggtgtgttaaattatcgcattgtgccttagtaatatctcctgttcgatttcatagcgcaacggaatgtcctggatactcctacggcatcgacgactcataagagccgcaagattatgcttgtatctcaatacggcgacgtactgaatcggagtgttcacacggacgagatcagctcggaccacnatctgtcgangcgaatgcatgttgacctgtccgtcatatcttagttctgattcccacngatagatctcgtcacgtctcggtctgctatagcatagtagtaagctgtgatatacgggcgtaggaatggtgaatagattgtacggtgaaatgtggccggcgaggatctcgtactgaaattcgctgctatataatattgaattctcgtcgatactcattattgtgcggtgtgatcgcctccgtcacgaatcgcaattgtatatagaatgggctgtgtggcattggctttatattatttatattatattgatggatacgtcgtattacgtattgcgaattaatacaatcgggtaggtaagtaaaatatagcggcgggggtgaataagatattataaatacggatgtggtctgtgtggaatgaatataacgagagaatgggaaatatcacatactgagtaatgatattaatacactgcgttgaa

SEQ ID NO: 13936 - DNA, 1104 bp, Homo sapiens
  misc_feature (1)...(1104): n = A,T,C or G
cttcccatccttcgtttataatacttaaccaaatacaagatacttctctataccttacaaaaccaaatntaattacagtgatctgggtaaaaaaataaaaattatnaaatttataataacccttttctttaaaacaacacaaaaatttaaaattcannaancttttttaattcattaantnttcctttcttcctaaanaaaccccccttctntaaaattctcccccttttcctccttnaaantcttcccaggggcggtngnnacnaccaccttcccccaaaaaaaacaaaatataattnccctttnctcttnnncccccctnntttattctctcccnccccccttnnacatttntttccttcccataaaancaaacaatttccctcccttttcctcctaccnctttttcttttttaatcatnnattctatcttcccccccccacactaaaaacccattattctttcacattctctctactcccacaattcatacataacaaaaataaaaattttttacntcaccaaccctcttttacatttctataaatntcacaanttttattatttattaaataatctcttatcttattttcatacttctctatttctacacataatttcttctctcctatttatcaaccaacacaatctattccatcattttctccctactccccctatactatatacataccccatcaccaacancctctctctcttaccccaacttaaatatncactcatataacacaactactcctcatatccttcactctattataacacactcaactcatcattttatacttatctancatctatctaactttataaaactatttcaatatcaatatcctcttacaactacttcataattttatcctctcaacacaactacttatatnatatctatacactacaataacacatctaatatcacnctcatctcaacatcataccattancacaccactcttctctctctctctctacatcttcaactcataattaattatatatactcacctataatactatcattntttaatttaacataaaatatataaactaaattacctctctattaatatttttttatccct

SEQ ID NO: 13937 - DNA, 166 bp, Homo sapiens; identical to SEQ ID NO: 4397

SEQ ID NO: 13938 - DNA, 583 bp, Homo sapiens
tgaatgttactcattaaaatgtatatgataatagtttgtccaatatgaaacaccatttatccgcaagatattttaactgaaatgcaacatacagattttttctataatagcattattggtgtatatgttggaagtttgcttattcagcaaatactatgcctcataagcacatatttgttatggggctgtaaaaagatacaagtaattcttacatatttctattattatctatattaattgtgataggcagaatgtacctaacatagctgaggtctgcgtaaatgctcttttcagcagggaaactgcctggaatttggtgaactacaaaacatgaaaaaaaatgctaagttagctgaggacttctcaaaaggagggttatacttttagtacgtttatttgttattcaggtaactatctcctcctcttaaaagattattaacttgatttcattttgttgttggcactaataattctcccagtaaacaagtggctcaattgctcttttaatattccttcttcttcaggaaacttggagattgctgttgaaagaagtggtttccctttgtcaattaccaatagaaga

SEQ ID NO: 13939 - DNA, 965 bp, Homo sapiens
  misc_feature (1)...(965): n = A,T,C or G
aagatgccgcaacaaatacgaaccgaaggaacacgtaaagagctacatgacgatgacgacgctgataaccttggaaggacaccgtgatcacgacttatcgcgagtacgcttaccataccatagcagcttaggggtctgcgcttgcaccccccacactaaaggatcaaccacaaaccattgcacagcacgaccagtttattcacgctacggttgattagggcgttgtccccccgtttgctcctgctctccctccgtgcgtgttattgtatatacttatttctatttgttaaagggtgattattatcaaaagtttttcaactaaccaataacgccccacgcctctccctgctcgttttacgtatcttcctcccccgcgccccgcacgcccgtctcccccttccctgaagtttcccgttcgttttcactcttatatatctatgcgttctatttttcatattatccctctctatttatctttcttttttttctttccttttttcgcttctttcttttccactctcctgttccgccacgtccttcgcatatatcacgattccaatatcaccatctcaccgatttctgtttttcctccttcccccctcgggtccgattatcgcacattatcctccctatcccggtcccccatcttggtttccgttctctatttcctatccaacatccatatccatatctctaattccaagtccgccccatatcgtcatcatttttacatcagcgattactcccatatatccctctctcgttntccaactgtcccttacacacttattgtcctcgttccgtatcttacttttttcccacaccacccatctctcatatgtttcacattttttcacccaatttgtcgcactattcatattgttttcccattattccatccaatcctacataccatcgttcctcttgttcttccccgtcccgcacatttcaccattttctatctg

SEQ ID NO: 13940 - DNA, 1291 bp, Homo sapiens
caaccgaagggtcgcgtcccgcgtcccccaatcttttctgattgggcgggcccgcccgcgtggcgggacccctcttttccccccccgcccacgccgcgtccttccgttcgcccctccgacgaacgcatggtcctcccattgccctgcttacgtgtgcactgatctatgcgtgccggaacatggacgcgataaaaaaaggaagcaggcggactgggccctgtgtaccgaatggggtgaagatgcagacggggacgaaaagtgcatgatggagatcggcaagtcggtgtcgttgtggagcgtggcatcgcatcaccagttgtttttctggtcgccccccattaccacaatgagtgatgcgcacgggtcgtcgcgcgcagatgtcgcagacgcactccacatgcactcgggccagggatgttgtgtgcagttagcgggcgtgattgtggacagtgcaggtcaggcttcatgtgtttggcgcgccgcagtactcggactccttgcctgactcgggctgcggcggtgcgctcttgattttcgcgccggtgcgcgtttccgcatgccaggaccgcgcggccttttgacgtccgcggctgtactccccgcttcccccgtcgcattgctcgtatccgcgttcgcgctggcgcccgcgatctccgttcgcgcctctttcgccggttgtccgaaatacgcggtcggcgttgtcgtcgagtggggcgggtggtcgcgccgggcggtatttgtttagcgtgcggtgtcacggtagccgcgcctccccatacgtcctgtgtgactctagttctggccgagccgatatcgtcggtagcggcgagtacctgcggttgaaccccgtatataaatacgtccgcggaacccccgcaataagagcgtcgcttcacgcgcgtattgttcagatcgcgcgccatacgggcccctgtttcgttgttgacgcgcgcagttcgttccgcgcggtaggctgagcctcttgccgtcgcgccggttccccgccgcgtaatctcccctcgcacaacgcgtcgtcgtgtaaccgctaagcgctgcgtttccacgtccccccccccgttttactcgccttcgcgcatccacgcgccggcgggcccgaccacgccgggccggcgccggtatcactcgccccctccggataccgcgtcccgccctcaccggcttcgcgaagttgggatatatccgcgcggtgtccacgccccgtcgccgccgcagcgcacaggcacgaggcgtatcacggtcggttcgacgccgcgcttacaaactctccgtt

SEQ ID NO: 13941 - DNA, 761 bp, Homo sapiens
tgaatggcttcttatcattaagggctgacctattggcttggcattgaaatcaatttagaacaaatggtctccatttcaagtcagcttgaaccatctaagccccagaacatgacacagaaaaaaagaagcagtaaactgccccttctaccaatgtctaagatgaacgggaaaaatgcatataaatggaatttttcttttacgtgatgatacagtgttttggtgtcccaaagaaataaaatccagcactgtccaattgaagtataatgcaagccacatttctagtagccatattttaaaaagtaacaataaagtgttgaaatttaccttaatactgccttttttaaccaaataggtccaaaatattattattttgacaggcattatgagttgagttgtgtcccccacaaaattcatgttgaagccctaaccagcagtaccacagaatgtgactatattgagagatggggttttaaaagaagtaattaagttaaaatggtttcattagggtgggccctaatccaatataactgatgttcttataacaagaggcaatatggacatgggcacacacagagggaagatcatgtgatgacatgagacaagaagagaggcctcagaagaaaccaacctgacaacacctggatctcagactcctaccttctagaattgtgaaaaatacatttatcttgcttaacccacctagtctatgataatttgttatggcatctctagcagactaatacgctatgtaatcaattaat

SEQ ID NO: 13942 - DNA, 893 bp, Homo sapiens
  misc_feature (1)...(893): n = A,T,C or G
ggacggttcgaattttccccgcttacgccttctttctcncantcttcaggaaaacggaagcataaactgccccttctaccactgtctaagatgaacgggaaaaatgcatataaatggaatttttcggttacgtgatgatacagtgttttggtgtcccaaagaaataaaatccagcactgtccaattgaagtataatgcaagccacatttctagtagccatattttaaaaagtaacaataaagtgttgaaatttaccttaatactgccttttttaaccaaataggtgcaaaatattattattttgacaggcattatgagttgagttgtgtcccccacaaaattcatgttgaagccctaaccagcagtaccacagaatgtgactatattgagagatggggctttaaaagaagtaattaagttaaaatggtttcattaggggggggcctaatccaatataactgatgttcttataacaagaggcaatatggacatgggccacacccagagggaaagatcatggcgatgacatgaagtcaaagacgagagggcctcaaaaaaaaaccaaccttgacaacaacctgggatctcagactttctaccttcttggaattgggaaagaatccattttatctttgcttaacccccccctatcctataataattttggtaatgggcattcctagcaaaacttaaaccaatatgccaatcaatttaatggaaattaaaatggttttattaagaaaaaaaaaaaatttcggcttttttggcttccagcggttgaaagttttggggccggtttcctttatgggagggtaatttatgaaccctcccctacttaattcaccgcccttgcccttcggctcgcgcgaagacgattacctcactcacaggcg

SEQ ID NO: 13943 - DNA, 786 bp, Homo sapiens
gtctaatgcaaggagtgaagagagctttttatggcttacactgaccacaacacacagttcagaaaacttaaataaccctaactaaaatttgaaaggtgcttcaaggcatagaaagtaccttgacatgtattttctcattggattcttataaacctataaaacggtgcttactccatttcagaaatgagaaaatggcgacccagaaaataaagcagcatgcacaagactacatgctacacaggggactgatctgacaccaaaacttgactgcagattgtctgctttcaactctcaccagcaaaacagacaaaagtgctttggacatgcaagtgtttattatgttgcattttggaactccagaccctaaaccaaacatagacaattataaaacaaaacaaaaaaaacactaaagatcaaacccattctcagacccaaacacccagaaaataaaagggaaattattattatttttttctcaggggaagcaagtggttgattccatgtgggataaactctcaactctgatgaacctcatgggcttcctggatcttccccaaccaaggcttttgggacagcatttattagaaggaaagtctggggatttatctttccacctcactggtttctgttgaagcctgccttaaagatggaaaccccttcaatcatctcacaggtaaggaagaagcgatccttttgttcaaccacccaaagatgaaacccccggacattcccaaaagcctgactgacaattaatatgaaaaaagcattttttccttgggaaaaaat

SEQ ID NO: 13944 - DNA, 723 bp, Homo sapiens
tagatgtgctcttgttgttagagtggatgcccatcttgggatcaaataattcccccttttgagccgtcagcccacttttttggcctgaaagattatggttatttgtgcattcacatgctattctttgaatatttgaagtcagctctcttgacttccttaaactatctcttctctattcaaaatatacccagcttctccaactttttctaaattcattgatttttaagactttctacaaatagttccatttttgtacatttttttttcggagaaatgttcatagctgaatagggtctatttttcctacttaatctgacccatgtactttcaatacctttactggtcattagctctataccagtaaggccaaatatatggtggtgggtgatagtatcagcaccctcaactctgcaacccactggagcttaccaaatgagaactggttttcttcatgcaatttacctcaaaagccacaccatcagcaagaggaccagaactaattgtcaaagtgcaagccacaacgaacacacaattgtcacttaaaaccagtttttgcttcagtaagctttttttttctatctagtattttatctcttaaaataaagagaaaaaacaggtaagaaactagtttaccaataactttgacaaatagcccctgaggtggtgggagtgacatttggaaagttggtaaaagccaccagagtcaaagccacctaaacaaaa

SEQ ID NO: 13945 - DNA, 805 bp, Homo sapiens
  misc_feature (1)...(805): n = A,T,C or G
gcctgaagagacgaaatacagagacttaaacccaggaacgatgctttgtgatgctggaggcaggaattggagtgatgtgtccacaagctaaagaacaccaagatttctaacaacatcagaagctcagagaccatcataaaacacattctcccctagaaccttcagagagaccgtatggctctgctgacaccttgaccttgaatttttatcctctagaactgctagagatgaaatatcttgttttaagccacctagttcatggtagtttgttaaggaagccctaagaaaataatgcagtgctattgtttctttcactttacagatgtgaagacaggctagctaacgttccaaggtggtttggttctatagggcctgtgtccttatacaacagaataccagtatgtaactcatttatttgtggggataaagcctctgttttcctaatatacatattatttccaggagaaaaagaaaagattttaaaaggtatgtgtggatgttttcaaaatgcttttaataaagtcctcatcacttgtggcnnnnnnannnnnnnnnnnnnnnnnnnnnccnaaannnnnnnnnnnnnnnnnnnnnnnnnnnccnnnnnnccnnnnccncccaccncccccccccctccccttaaaccaggaaacnnnnnaaaccccccccacctagccnnnttcctcaggcccttcccctctgacgagggggctaaacctcgctccgggcgtaaatccgggtatcccccgaaatcgggggataccccccgagcaaccccctccccaaaaggccctcaaacgcgccc

SEQ ID NO: 13946 - DNA, 685 bp, Homo sapiens
agagcgtgtgttgaataggggctgagtttccagagcgaagggttggttctaactctcttttcagcggttgaggaatgcgctcaagggatggggtcgggaccgtgggggtattgtgtggggttgtttatactgggatttatggggtgatatagcctccggacgggcccgtctgactgtcttgggaggggcggtgggaggtgggcgggggtgtgctaatgttgtacggcccctcgaactttcccgaggtctaagctcacgaggcctcccgaaagaacattctccccaggggcccccagaaaaccccgtttggttccgttggaccccgtgttcggactatttttttctttgttaacgctttacaaagaccagatagtgttatgggccccctgtctcgctggtagctccttcaagtggccctaggagaagaagggggggaagagggtttgttctgggtatggcacgtaaaagaggggaattcaggtgccatgggggtgtgggtggaaggtggctggtgccttgcccccccctaaaccccaagggagatctgttttttgtggggatttagccatggttttcctcacccccctttttattcctgctataaccagaaaggaattaaagggtaggggagggtgcttttcaaaggtttttagaaaaggacctaagcaaagcgggccaacaaggg

SEQ ID NO: 13947 - DNA, 693 bp, Homo sapiens
tccgctggatctggtcatgctattgtcgcccgtatgggttctctccggccctcgcactcggccacgcgcgagctttaggtagtggccccttgtagctgcgcgccgctccggcgggggcgccgcggagaggtgggcgcgggaccgagcgcgcacgctgtggctaggaggctcggagagcagtacagaccgctcggtgccggccgcgcggccggcggcggcgtgtggtgtggggacgggccatggtccaccaactgaacaaagtgactcctgggtgtgcacggtccgaggggcgcgctggaacgccattttccccagatcctcccaaaacgggccattggggtcacggggaggcctgggccctgcgtgttttttttctttaatgctgtcaacaggctaaaaaggggttttatcctcttttcctttccgggcgagcggtgcaggggggcttggaagacgaacgtggggagataggattttcctggttccggcgcctacaacggggagagtcaggttccatgtgggtgcgggtgcaaagggggtggctcccccttccccccgaagccccaagtctcatcaaatttttgtggggctttcaccgtggttttccctaccaccctttttattcccgccaaaaccaaaaaggaattaaaaaggtctgtgagggggttttgaatatgttttttattaaaacgc

SEQ ID NO: 13948 - DNA, 199 bp, Homo sapiens
tgacacgatccccccaagagtccagaaggacagaactcattgacctgttgatcatcttcgagattcagagagagtctgtctgaggcgtgcttctctcattgctgccagaggcccttagtggtgctgctgtgtttcagtggacaactttggtatcttactcaattaaaaactctccttttgattatcaaaaaaaaaaaaa

SEQ ID NO: 13949 - DNA, 793 bp, Homo sapiens
  misc_feature (1)...(793): n = A,T,C or G
cctagagcctgcatttcccatcaagtaagcccacttcccgggctcccagctccagctctccagggctttccccagaagcgcagaggctgggtggacagccaaggcacaaggccatggtttctgcatcctctgtcttttcccagttcgcagagccggaagtggtagactacagcgacagattcctcttggggtctctgtgatcacaaggagcagaagcagcggactaagctggttttgctggagatgcagaatttctgctcatcagcatatggctggttggccacatgaataactcttctctattacataatccatctctttaatttcctgtccacacgagtatataagtctgtgggtacgtgtcttgtcgtgttcgccatatatgtcgaagtgtgtgtggaggtggcgggaggttacatgcatgtgtattgtggtggctgctggttagaaatgagggtcagctcctccgatattcttccttcgaatggccattcagcaaggatcagtttttgagcctgatctccatacaagaatggttgggtattggtttaaatggaggattgncttatttctaaatggccttgaatggggatcaaactaacattatgaggaagaaacaaaacctccctgtgcactttgaccttaaatgttcagcaccattggagagtccttgactgcttaccaccaagggacaaaccccctcccagtggatgttaccaataaaaaaacgtcttaaggggttaaaaggccctggaactggattttcttccaaattttccaccttgggaaaact

SEQ ID NO: 13950 - DNA, 785 bp, Homo sapiens
ctgaactcacggtttaagcagagcaagcctgtctgttttcaattcttaacttttcacacatggcaaacgagtggaacttctgagcactgcgatcatctggctgatgaacaagccgttttccatttctggcaacaaatacttctggcttatcgtgacgggatgaaaagggatgaaaatatactctgactagcatcgtgattctcagggccactggaatccacgagactgacttccctgaggagagactgccttctaatggcgtgaccatctgctccacttccttcgtgtttggtcagtgaatcacggcaagtcacaggccacctgagcattctactcacttcttttggatgcatccaggccaaaggctcagagtgtgtttgagttgagatagatctgagcatattcagttaaatgaggccctcaaagagtatgatggggaattatgccccactgcctcccaaacttcaaatgttgaagccctaacccttagagcctcagacagtaactctattcggagatagggtctgtaaagaggtaattaagaaaaggagcaaaaatggagcaagtttccttctcccttgcgctatttctaaggtcatgttataaaaatcaaatggagaatacctgtcaaacagttgatcaagcagtgaggagaaagagaaataatattaattcaaagggcatgcttcaacccattagtcagaacaatctattagttaatcaagcaagatttattgatactcacccagagactggatatacaaatggacaacggccaagccata

SEQ ID NO: 13951 - DNA, 784 bp, Homo sapiens
ttagatgccagggaaagagattgtgaggagggggagaaggctgaggaaaagggaagaggctaaaaactctctccaaggaggatatccaggacagaaatatggaaagtaggagtgctgtacacctctttctggcaatcagtcccccacatttacaactaaaagaaggagaaacaggacccagaagatgagcctcaaagacaaaaggaaaatctcgaattaaatatgagttcaataaatacatgtaattttactaccataggagaggagcaaatgaacaataactaagggaagaaatccaacaacaaacaagtgaaaacccacagtcaagggtaaactagcatactcgtggtctcaaacgagacctaaggagaaatggtaactgtaaaagaatgagggggtgtaccaaaaggtgccatgaatgctgggaccactatagaggaatggaaacatgacctataggaagaagcactggagaaaaattaagaactaataatgcattcacgggatcaggacagacactcctaataagaacagaattccgcagacagacggctacaccagaaaagatgacggacttaaagaattattgcatggaaaaagaagaacacggccagaccagtgcttgacttggtgctgtttctcgcagaggtttgacccgactaacaggagagacgtgcattatagccctttgtgctattaagtgggagaaattgtaattgcgaggactttgagaatgaagggagccttgttgggtaaggaggagcgctgtatagaaaatatacag

SEQ ID NO: 13952 - DNA, 741 bp, Homo sapiens
ccccatgagatccctctcaccccagtcagaatggctatggttaaagcccaaaaatacagatactggaggttgaagagaaaaaggagcccttataccctgttggtgggagtgtaaattagtccaaccattgtggaagacagtgtggtgattcctcaagacctaaaagatccaaataccattggatgcagcaatcccattactgggtatatccccaaaggaacataaatcattctcccataaagacacatgcacgtatgtattaattgcagcactattcacaatagcaatgatatgcatggaatcaacttaaatgcccatcaaggatagaccggataaagaaaatgtggtacatatataccatggaatactatgcagccataaaaaagaacaagaccatgtcctttgtagggacatggatggagctggaggccattatccttagcaaactaatgcaggaacagaaaaacaaatatcgcatgttctcacttataagtgagaactaaatgacaagaacacagggacacatagaagggaaaaacccacactggggcctatcagaggatggagggtaagaagagtgagaggatcaggaaaaataactaatgggtactaggcttaatacctgggagatgaaataatctgtacaacaaaaccacatgacacaagtttacctatgtaataaacctgtacatctacccctcaacttaaaataaaagttaaaaaaaaagaaaaaaaaaaaaa

SEQ ID NO: 13953 - DNA, 784 bp, Homo sapiens
ctagggaaaccaggaggaattccatgatcaaagagaaccgcattcctctctaccacaaagtactcacgcttggcaaatggcaaagatttgggtcatcattttttaaacgacagccaagcattaaagagcccaggcagagagcaagtaaaagagtctccgtggttcctcccagcgctagtctgtggcctcaacaacatagcacgttgcaggaaaaattccaaatttctgggtcccaaggggaggcattactcagcagtctcagcggtgacggcgtcagcaggacaagagccatttgctccgggaggactttgatgtttctttaaatggtttctgcatctagtccaatagaatggatacggaattatctttattacaaccacaaggatgtgcaaatttatttacagtataaatggttctttccacaagtcctagctgtcatcaactctttattttcctggagtgacttagaagccaagaatgttttgtttcttaagcttcctacctagggaggtaaaataacaaacttgttaatgagaagacaaagaagctaactgttctgttttgcagcgttcctacagaccgtaccttttaattgcctagtgctggcaacttaacacactgtaatgagtacattgttccctttttttctgtttgtttggtttttcttttttcttttttttctttttgtttttttgcacatagctttcctggaagggcgtaggacactgaagtttggtgtacagaacagaaaaaatttttattaaaaactggcggaagcatttag

SEQ ID NO: 13954 - DNA, 733 bp, Homo sapiens
tcgcctttggtcaatgggaaagagtttggttcctccttttttagcgcacacccagcctttaaagagccccagccaaaggccaagtaaaaagagtttcggggtttcttcccagggctatgtttgggcccccaccaaccaaggccggttccgggaaaaatttccaaatttttggttcccaagggggggcgttttcgccagttttaagggggaggggggcaaccagcccaaagcccttttgttcggggaggattttgaggtttttttaaagggttttgcgttttggtccaataaaagggttcgggattttttttttttccacccccagggtggtgcaattttttttccagaataaagggttttttccccaagtctaagtgttcttcacttcttttttttctggaagtgctttagaacccaaaaatgttttgttttttaagcttcctccttaggggggtaaaataccaaccttgttaataaaaagccaaaaaggttacttgttttgttttcaggggttcctccagccggtcccttttaatggcaaaaagttgccaccttaccccctggtaatgggtccatggttcttcttttttggttgggtggttttttcttttttcttttttttcttttttttttttggcccaaagttttttggaagggggttagaacttaggtttgtggccaaaccaaaaaagatttttaaaaaaacgggggaagccttttaaaaaaaaaaaaa

SEQ ID NO: 13955 - DNA, 781 bp, Homo sapiens
ctgatggactgtccttcgagtaacctagcagacatgaggggtacatcatgatgaatgctgtactttgcatccatgacagtgactagcactcgacatttgtcattacgctgtgctcattatgcgccatgtgaactatggaatataattgacacgctattggggctcaagaactatatgcacaaaaccacttattaccatgagatatgaaatccgacttatccttacaacagcgttaagagtatagaacataacaaaagctcctcatctgcttgattagtatctcaaaagactacattggtccagatgtaagaattattaaatactccatttccgctcaggctacagattatgaataccttagaaggtacctcttttataccaccattatacactcctccttgcgacaatagaaatattctacagaggagaatcctgcaggaagaaatgacctggctaatagaacctacggaagaaactgatcctaaagaggaactttgaaaacgttccgcaagaagaaaaattcttgtgtatacttttacttagggcccaatcttatcttctatatacaagtgacctgtgtttcatagaggcagtgctgtcttacctcttgctcgcggagtcaatgattacaaaaactgtagcctgaatagaagttgggaataacatttgtgcttatgaagtaattggaaataatgttaattatctgaagcaacagtacagcaaaaattctgcacactgaagggcaaactgatgagagtcttaaacagaacctcttgtagca

SEQ ID NO: 13956 - DNA, 1503 bp, Homo sapiens
  misc_feature (1)...(1503): n = A,T,C or G
ggggggggagaaggaaaagagnaaaggaaaggngggggganggaagcgggnaggggggagaaaggggaagnnanaaaacttaagagagaagaacacaggaaccgagggcgaatgcgaggggttcccggagagcagaagggcagggagagggagagaaaataaagagagaggtggacgaagaggtcagaagaagtttaaagaacaaggacaatagagcaaaaccgagcagagcgacgcggcgcacgcggatacgaatgacaccacgcgcgcggccgtggctcaagccccacccacagaagggaggtgcagtggatgcgcagacacgatacacacacataccaacatcaagataagcgtccgatgtgcccggaagctaacagctgacgccggctcgctgtagagggaagggctggcacgccgccgccacgacaagaccacccgacctcttntaaatgaatgtcaacagcttacagagtcacggggacgagtgcctcacgggagaatgagtcaggtancaaganaaagacgcgcgcaggagcgatcaacagatacaanagagtgacacgaatagaccgancaccaagcgtgcncncctaccatgcagacaacagantaaatagagtgatagtagaaaaacacgcaccatcgcggagaaggacgagaggacagagacaagagganaagacagaggcaacgccacacggccgcgacgccaccgcgcacgcagtccaccgtcctcccatatccggtctcgccgacgcgcctcatcacattacacagtaggcagacgatattgaccagttctcgcgtaagatatatgctactccatcgtgtggtattagcacgagtagcgagtaacacgactgcgtcggccgatgngtgacgtatagagacgatgagacgtgagtacatatgataagataatgatgcactgtgactatagcgtgcggcgatgcgagacgcgctcgagatgccgcggagagcgctcgcgtagatgngcactcagactacctatgagangtatagtgtcggtgcgcgcgcgcgcgtagtctatctcctggagacacgagcacacgtctntctgagcaganagcgcagtcaccgtcgaggaaggagggaagtgtgcgacgaggacgcgtatccgctaccagagtgataagagaagcgacgcnccgccagcggacgtgctccccacatgcgacctcgcnccgcngtaattataatatatgtagcgaacgagncgacacacgacgagccacgatgtcgagaggngcaccggagtcggcaagagagcggtagatgacgcatgtgtaggtgacatagcgagagagatgagntgacgtanctctcaatctagtactcgcaacgccgcaagtacgtaggttctagcacacgagacatcatgcttaatctcatatatcncacnacgcatacaatgcnagagaacacagnacaccacncagatcgacgagcagcagctnacgcgccacantatgtcatcgt

SEQ ID NO: 13957 - DNA, 1567 bp, Homo sapiens
  misc_feature (1)...(1567): n = A,T,C or G
cgtgtctacggtcggtgtgtgtctagcggatccctcgcgtcgttgccggactttgttgcgtttggttgtggtgtgtcgcttcgtgatgtcatagttggtgtgaggctttacgttgttgtctggtgctagactctgcgcatgtggtgtgttggtgtcttgtgtagcgtggactacgatggtgnctcgctgcgtgctcgtggccgtctaccttacagtctcgctcgtacgctgtgtgctantggaccacagagtaggctcgtcgcgtggtgcgcgcgtgcntgccgactantagctgtacgtntcagtcagcgtgcngctgtgctcngatcgtctctatgcgcgggtgtctcgncntagctcatgtgtgtggggcgtagagccgcaggccagcgactcttcgctaccgtctgtncgatgtgagcttgtctgagtgtgtacactcttctatcgatctatgacgatgacttagtctcgtcactntttactctgtatatggtcgtgatcgaacgtactcacagagacgctctctnctacgtnactcgtacctaccttgtagtagcatactctntctactcccctgcgccagtcgactcctcgacggcgtatgtgatgatnacgtcgtgcagtagctgcagccgcctctgtactagtgtgccgcgcatcgaggcagcgtcggtcgcggactctgcntggctactcgccgtgtcttgtcgtggtgtgtggtgacgcggcgctcgcggtgggctgtgtctggtggtaggtgcagctggtcgngcacgtgtgttcaggtgtgggctgagcggcaggtgcgcgtgtgttatgcgtagtggtgttgtgtttgtctgtctgtgttanactatctcttctttctttgatcaataaatacanaagactcgacaacatggttcagtcactacatcttccgtcttctattcgtgctcactgtcttctcacattcacctagtctcgcgtgtgtggtgagggcgctgtatgnttggttgatggtgcgtgagtagtgcgtgggtggtgtgttangttgtgatgtagtgtttgtatgtntgtntntatgtgtgtgattgtgtgtgagtactggatatgaggnacagtgagagagagagcgtacagagactcagagagagtgtgcgcgttggttctgctcgtcggtatccagctgctgtagatcgtcagtgaagagagagacaacagagacggtgagagtagagacagttcgactaatcttctcgtaagatagtcgcatagatngataatatanagaatatataaaaaagagantnaatanagaaaagagaganagtagatagatattatagatagatatagagagtatatagagatatatanagagagatgcggttgtctctncnngtntgngaccaataccnatgtctgtgtgtganaggccagtctggtcnngcagcacaagcgctagtattcgctgtcttactcctcttctctacaaaccccnnctctcttcctctccatnntcntccatctcnctttcctctnctttctcctcctctctctncncctntctcatcttctctcc

SEQ ID NO: 13958 - DNA, 764 bp, Homo sapiens
cgcgagtggcgccggggtcgtgctcccccgtgctccggggtcgcccgcgcagcgtgcgtcgcgtgtctgacgccggccacgcccaggctgtggggggccgtctcgggccctggccgccgcgcgccattggtctctctcgtgcccgcccgcggcccgtgcggcattcgaccgcccctctccccccgcgtcgcttgcatctacatttccgcgccgcgccgctccctccactcgcactcccacccgcccccgcaccgcgccccccggccgggctgcgctggttgcccctacccttctctttattcccctctcggcctttcctcctttttcgcgtgtgccgccgttctgtgcggcgttgcgcggggcgctgcggcggccggcgccgcgccggcctcccgcccgccctgccgccgcgcggcgccgtggcggtcggcgcccgggtcgggcgcgggcccgcgggtcgtgccgggcgccctccgctcgtctcgccggcccgctgccctccgcgggggggcccgcccgcccgccccgccgcgcgctctcgccccagtcggcgcggtattgctgccgcggtgtcgtgtgttgtcctctctcgctcctccggccctcgggggcttcttcgggggcgcgcggggccgccgggggcggtgggtgggcgggtgggtgggagagagggggggttgccgttttttttggtgatttgcttctgtatgagtccgttcggggtgcgagtcaagtctttcctattccacccgtaaagaaaagcg

SEQ ID NO: 13959 - DNA, 943 bp, Homo sapiens
  misc_feature (1)...(943): n = A,T,C or G
actgcgtgcggcgtgtggggtgtcgggtttggtgcgcggcttttccctctctttgtcctcggtgctccggtgggtcgcttctgtcgccttttgctgggcggtttgtctccggttgctgccggtccttcggggtcgttttgtttttcctcgggcgtggtagtgggtgagtggggggggtgggtgggggctcgtgagttgtgcgttgattttttcgtggtttctctcgcctgcttttcgcctccgctcctcgtcgcggggccgcggcggtcgcatccttgtgggcggtccctgctccgcgtgtcgggtgccgtctttgctgctgtttgtcctggcgctgcggcgccgtggcggcggtgggcccggtcgggcgttggtctttgtctttctctgtgtctcccctccgctgctggccgtcgctggtgtgcccctcgcctcgcgcgccgtggcctgcggtgcggcggcgggtgaggggtgttggtgtggtcttgggtgcgtgggggtttcgtctggtttcggcttggcggtgcggggcgcgtcttgtggctcccttgttcgtttttttttgtgcctcgtttgtctcgttggctgtctttgcttctccgtgcggtgctgtgttgttgcgttgttgtattttctctctcgtgttttttgtttcttgtgtagtggttgcgttcgaccgcccccggtgcttctgcttgtcttcgccgccgtcctttctaggctgtcgggttgttttttttgttgtgtggttttgtttactgtctcctcctgccgtccgccccctccctcctccgtttcccctttctttttcaaacctctctccgtttccctgcgctgtcggctccttcgtggtttcccntgctaaccgttttnttcttgttccctttagctttctttctttttttcttcctcgcttctcttttctntttcttttatttttttt

SEQ ID NO: 13960 - DNA, 1034 bp, Homo sapiens
  misc_feature (1)...(1034): n = A,T,C or G
tgcgcggcgcgtgcgtctggccgtncgcgcgcgccgggccgcgcggcgcggcgcccgccgcggcggccccgctccgcgcgcggggggccgggcgccgcgcggcgcggccgcgggcggcggcngtccgggggcgggngcgcgcggcccgccccgcgcggtnnnccgcgcgcgcgcggcgcggcgccggcggcgcgcgccgcgcgncccccgcccgngccccgccgcgcgcccgcccgcgcggcccgngcgcgccccgcgcgcggcgccggcgcgcgccgcccggcgccccgcgcgcgcgcggccgcgcgcgcccgcgcgcgccgcccgcccggccgcccgcggngccgccgcgcgcgggcggcgcgcgcgccgcgccgccccgccgccgccgcggcgcgngcgngcngtggcnngnnncngcggggggcgccgggcgcggcggcgccgcgcggcgcgcgccgcgnggnnccgccccgcgcgcgngccggccngcgcgcgcgcgcgcnccgccgcggccggccgcngcgcgccgccgcgcggcgcgccggcgcgcgncgcgcgcggcgccgcgcgcgcgccgnccccggcgctcggcngncgcgcgcgcgcgcggcggcgctgcgcgcgcgcgcgccgngnggcncgcggcgggcgcggngggcggcgcgggcgcgcnncggccggcgnggnggggcgcgcgcgcgcggngccggngcgnnggcgnncgcgcgccccgccgcgcgggcgcgcggcgccgggcgcnggcncgcggncgnggggggcgnnnggcgngcgnccggcgggcgcgcgcgggncgncngcgcgcgcccgnngcgncgcgcgccgcgccgncncggcgcgcgcngncggcggccgccggcggcggnggcgccgcgcgcggcgcggcgcnngcggcggcgccgcgcgcgcgcgcgcgcccgcgcgcgcncgnngcgtnttncgtanatgagagagagagagactctctctcctcttctcttctcttctcttcgtctcgctncncccctntctcg

SEQ ID NO: 13961 - DNA, 789 bp, Homo sapiens
ctaggagaaacatagcaagaaggttgctgtctgcaagcccagaagagagccctcaccaaaactccaccataatggtcccctgatctcagacttccagactccaaaacttctccccagcagcacagcgaccacctggaactgctaactaagtgaactggagcaagtcatcccctcactcagactctgacccataatacaagagggaaaacaactatatcagaggattacttcgaggaacaaacaagataatacagctgaggacctgtcacctcacaatcacaaggtggctgcgcccccttcagtatcacatccccgttctgggcaagaagaagctgagggtgaagtgcataaagaatatgtcccagatgagtgtgactgccactgcctcctaccccacctggagccttcctggaagctatagccaattacttcacttttattggtcaaaactatgtctctaacatcaaagaaggctgggaagtataatttttaaaactaggcatgttgacacagccaacaaattgttgttgtgtcagtatggaggaaagaacactggacattgtatgagtatctggcattgctaccacatccttcagtttagaattatcacatctaagaatttttcacagcacacaaagacatgaatagtatgagaatgttcatcccaaaatgattaatatagaaaactggaaaccatctaaatacatgtagctggtgctgatggtgccccaccaagatctctttaatgaattggcattcctccccttaaatagcagtgagggttggctg

SEQ ID NO: 13962 - DNA, 772 bp, Homo sapiens
gctaggatgtatggcaaaaaatagatggacagcaaaccattattgcatgtattgaaagccaacagttccaagcaaaaaatttttggtaagttaaaattttggatattggggagttttggcattgttttaagtctttgtagttctcgctttagtggtttgggctacaccttgtttgtttatgattaagaacaatttagagatggtataaaattttagccttttgatataaggaaggtaaatttgctcaacagcctaatcactaaaggtagtggtaaatctgttgacattcagtggaaagagtatgggactagcaaacagcatcctgagggagcatgtgtgcctgcgagaacaccagttggcaatccatatgctcattctgtgaaggggctgttcctgaatgaaacttatgtgcaggagaacaaagataattatagaacaaaaaatgatactacttttgtgaactttgtggctctgaagtagaggattgctttgtacttggttagccaatgtgaggaaataatgacatgttttatacaatgaggaagattacattcatgccttgtaattttgtgaacaaataataccatgattccttataaacttcaagcactcaggagcactgatttaccatctggtcttggaccttggcgaggtcgtggcattcttatttttaatcagactatttttgagtccctgtcttaaagtcttagggtctttgagactttcgagcccttgttggttgaattttgagtttatccttgtttacaagtgg

SEQ ID NO: 13963 - DNA, 776 bp, Homo sapiens
ttagagtctcgctctgcagcccatgctggagtgccgtgacaagatcttggctcactgcaagctctgcctccctggttcacgccattctcctgcctcagcctcccgagtagctggaactacaggcgcccaccaccacgcccggctaattttttatatttttagtagagactgggtttcactgtgttagccaggatggtctcgatctctggatctcatgaaccgctcgccttggcctcccataaattggacttttaacatttatcctcaagaggaaaatgaatgggctaaattataatgtcgaagtataggtcaaatttggcaactctcctcttccctcttagccatgacgataatgaaaaaagccagcaagtgtgaccaggctgagagacgcttgaccaaggtgtcttctcggggcgcatgctgacaggtcgtaagggggctcccagctgatctccccaggtcagtcactctgaaggctgacaacaagttggaagctggaagacactgaatgcagttgcggcatggcgcacgtggatctctctagaagccgagtgtccaggacctttcttccttccctgctcagaccacagtaatttttctcctggtttccaatcactctgtgagccttcaacttgggaaactcgaactgcacattgagggccacactgcctaccccaccctttaagctgccaccgagttggttgcataccatcgaatgtagccagctcgccaactgaccgccgattggggctaccaccctgggaaacaaatgaagc

SEQ ID NO: 13964 - DNA, 716 bp, Homo sapiens
aactgacccccgacttgtggcttccaccctgggaaacaaaatgaagcatgtcatagttttccgatgaaagacaatcaaagatgcagaaggatcacaattgcaacagtgtgagaagcagccagcaaataaccattcactatggagtgggtgaccctttcattgaaagcaacaactatgactaacagtctcttacaagagggtgttgcaactgaaattctctaggcctgactcgtggcttttcaaccttggtccaggctcctctccacctggtgggagagcaggttgtctctctcaacaaactctgggaaagccccgccccaggcctgcctcagaacacaggaacatgctgccagtgttttcctttatcatttaaagtttgtttgtgtgctgggcaaggagacgcttgcaagcaggttcttgaactgggtgtaatgaaagctgtagggatcgcatggcgccctagacccactgccaaggccaaggggagagacaaaggcttaatggaagaaaggggctgcagctgctctccaaagctgtcattactttcttgctggaaactttgaaatattatttgtttcctgtttcgaacttctggagatataccatcccagtaccatgattaagggcaatagtgtcacagggaggtgggctggcctctgcgttttacatgtgggcttttccatctttaatactatattgctttataaatgtcaaaa

SEQ ID NO: 13965 - DNA, 1032 bp, Homo sapiens
  misc_feature (1)...(1032): n = A,T,C or G
gttctctggtggtcgggttccacgtggcggtcttccgtcctcgttctcctcgtgcgcgtgtcgcgaggttgtggttgtgggattttgtgctgtcgtggctcgtctgcgggtggcgtttttgtgaggccgtgtggtcgcgttctcgttgtgttcgcgcgcctttcgtgctccctgtgtcgtgttcttgtcggggcgcggtgcgggcgggggtcctctgccgtggtggcgcgcgacctacgaaccactctggtcgttgcggctgctctcgctcggttggctgccgtctgccgtgtttgtgctgtggtgttgtttgcgctgtctgctcccttctcggcgcgctttcgtgccgcttcttcgtcttctgtcttccgtttttccgtctttgtgtatgtttttgctttcttgctgttgttggtgctctttctgttcgttacgctnggcttggttctctacttttctttttgcactcgcgcggtctcgggccgtttctccccccctgcatagccgggtgtggttttcggcgtggggcgcgcctcgcctgctgtctctccgtgtttgtttctctgggttgtttgcttcttttccgggtggtttgttctcggtctgtggtttttgttttggtgtctggcgatgtgctggtttcgctcttggtctgtgtgcgctcttggcgcctttgtgttgttttgtttgtcttgttggcgtntttttttttttttgttttgtctatttttcttttatttgttttcttatcgttttctcttttcctcgattctcttgctctcttttttttttttgcctccttcccccttctctctctttttcccctccgtccgccccccgctttcgcctcttccccctctcgccttttttttctttttttcttttttcttttcactctcccttnttcttnntttcttttcgtcttgttgggttcttcccttaaaccttttttttttgtttccctaaggttctttttttttcatttttctttctccccctcacccntntccttctttctcttccttcctctct

SEQ ID NO: 13966 - DNA, 774 bp, Homo sapiens
  misc_feature (1)...(774): n = A,T,C or G
taggccacgtaagatgcttgctcctgctttgccttccaccatgattggaagcctactgaggcctccccaggagcagaagctgccatgcttcctgtacagcctacagaacccactacctagaagcaaaaggtttcattaggcactctagagaggatgtccccaacccccaggctgcagacccatacagtctgtggcctgttaggaaccaggcggcacagcaggagaatgaaatccaaactcctatgacagctgtgacctggctcctgccacactgactcccctttctgtcctagggaatgtcaccaaatgctttcccagctccagctcttcctaaagagtttcactcttgtggcccaagctggagtacaatagcacaatctcggctcactgcaacctccgcctcctgggttcaagcaattttcctgcctcggcctctcaagtagctgggattacagacaactgccaccacgctcggctaattttgtatttttattacaaatggggttttgccatgttggtcaggctggtatcaaacttctgacctcaggtgatccacccacctcagcctcccaaagtgctggaattacaagtctgagccaccatgcctggccctgatgcattttttttggnttgtttggtttttgttttttttttttttagacagaagtctgcactgtcaccaggctggagtccagtgacatgatcttcagttactacaacctgcgccttccaggttaaagtgtttctcctgcctcagccttctgagtagttggg

SEQ ID NO: 13967 - DNA, 1010 bp, Homo sapiens
  misc_feature (1)...(1010): n = A,T,C or G
ctcttccggctgccgctgcgcgtcctcccgctgtcagcttgaccgcccgcaccgtccccgtgtgactcgcggcgggcgtcggcgcgcacgcgcgcgcctacaggggcgtgtgctgcgggcgtgcgccgctccctctcgtctccttttccgcgcgggtgcccgccccgcgtccgcggcggatctctcgtctgtctcgtccacgccatctcgtgcccgtgcgccagtgcgccgcctacccgggcgtcggcctcttgctcgggccagcctncgtattgactggccgcgttcgcacttngttgttcgttcgcggcgtggcctcccgctgtngtcccgcgcgtagcgcctccccgcggccgcggccgcctctcactggctggcggcgcgccctgcgcgtcctctccctctccgcgttgcgtggtggtctcgcctctctcgcgccgcgccgccccgcgctatccccgcctcccctcgtctccggcggggtgtccggctcccgcgggtggatggggttgggtgcgcgcggggtgattgggggaggaggcgcgcgggggcgcggcccgtcctccgctcctctccccctcctccctccgctccccccgcgcgcgctcgtcccccgctccccttcatcgtgctctgcctttgtgtgtttgcgttgtctggtggaggagtctcccgctcccctgctgcggcccctccctccgctcccgccctctcctccttctccccttttctctccgcgcttccctccgcgtatgctccccacgcgtgggtgtgtgcccttcggttttcgtccctctctcgttctgtgtgtccagccgcggccccgcgccgctccccctcggggccatccccccccggcctcccgggtccggncncccacctcaccgcctttccttccctctctccctaactccttccttccccccctccttccctcctcccngttggttccccccctctaaagcccttctttttttgtttcccctntaaggttctttccctntcctctt

SEQ ID NO: 13968 - DNA, 802 bp, Homo sapiens
  misc_feature (1)...(802): n = A,T,C or G
ttgaagcgactgcttcttttgttaaaggctggaccttgaaacatcttgttataagaaaaaggaaaaactctactatgattatttcaaaaatattcatcaaccaactgaagaattttctacttgccaaagatgggatattggagtattagtagaataataattatgtgatgcattgatgaacatcaactatacctaaatctatgagttcatgaacgagacaaagaatataattcatcagtcatctttggcagatactgtgggactaaattatcattttcataaccaggaaatatagggaaaattttaaatatactttctgcctttcctataaccaaatagtagacaagggaagtttttctttagaaaattatttcaactgataagcaaagatagactaatagaatttgaatattaatttttttccttttttcttttcttttcttttctttttttaagacggaatctcgctctgtcaccctggctggagtacactggtgcgatctcggctccactgcaaactccacctcctgggctttagctcttctcttgtctcagcctcccgagtagctgggattacaggtgcccgccaccacgcccagctaatttttgtatttttagtaaggacggngtttcaccatgttggccaggctggtcttgaactcctgacctcaggtgatacacctgccttggcctcccaaagtgctgggattacaagtgtgagcctaatgaaatactgactggagtctatgaatactgatggcaactaagatcacacaacanaaacatgagaaccccgtatgat

SEQ ID NO: 13969 - DNA, 715 bp, Homo sapiens
cccagttcataggattcagaataaaaggacatattaaatcataccatggaaccatagtgaaaaaatcacttgatagagggaaactccaaaacaaacatcctggtttattcaagaaatgaacagcatgaggaaaaagcaagatgaacctatacacttaaaagatatatgaggagatgggaggtttcagaaatgcagattcccaacctactccacctggaaacaccagtgctgctttcatacatctactcgcactaagcaatttaagccaaagaacacaggaggcatcaagaaacagcaccaaggactagctcggaggaggggaagaaaaggtgctgtggtgtttccttagaaatggctggagaaaaacagaataactgcccagagataatctaatccagtccaggtttctgggcccagggagccagtggaacacgccctgaagaaacctagaaagaggatatttagactcccaaagacagccccaggaactgagaggtctccagagaatgggtcaatatgcacaggcctagattctgaatctctgcccatttcctgaatctctgccaatttcctgctttctttccttttctcttgctatgacctcttcctctggtactggaaacccaaaacattctgtggtcctttcttgctgtctcttgcataaatgtaatgttaaaaatagagaaagaataaaagagatacttaatgtctaaga

SEQ ID NO: 13970 - DNA, 822 bp, Homo sapiens
  misc_feature (1)...(822): n = A,T,C or G
ccttgactgtagcgaagcctaaaacttcaggtaacatggcaagagaaaaaaagatgtgagagaaaaaagactttgaaggctatgatgcactacttatgctacttatacttactactatgacttatactactgtacatatagaactgtgctctatggaggccagagagcccctggtgaagtcatttgccaagatgtttttggttatcatttactcctttatgcctgcaatgaacaacatgtttgtgtcctaaactaaatgtttgtgctctaactaaattcatatgtcgaaattctaaagtgctgatgccaaacatgaggcctttgggggacaattaggtcatgagggtggaaccttcatgaatgggtttagtgaagcccttataagaagagactagagaccactctcagcctcattttaccatgtaaggacacaatgagaaatctgctctccacaacccagaagaggccctcaccatgtaacggagctcangctcggctgctcaccgcttgcagagccaatgacaaagttgaagtgcagtgaaagaaaccgtgatttattttctaaagctagcagtcgggaactggctggcttgcgcctttagaaatggcttccaactttaggctgagaaaattgggttaatagggggacctggaatggaggatgccggagtggtgctgagtacaaggnctgcgtttcttgttccggtggctgtcagaaggggctggtttcatcctaanaatggccggggttgagactaaaagcctggaggaatggctgaaatttggctcctgggctcctgaatagacagtcccaggattacc

SEQ ID NO: 13971 - DNA, 683 bp, Homo sapiens
ttttgtccaccggcccaaattccgtaaacaagggccctatttttaaaaattattttctcacaggtaaccgaggttggtttttgccaatttgggagataaaaaaaaaaaccctttcccccgttccggtataattcaagcagttcaaacaaaaatgtttcaccgtgggtgatttccaaggaggctggaaaaacaaattttgggcaagaatcgatctgccttgaatttttttttgaaaaggggatttataataataaaaacacccatttccagtgggttgtaataatattttatttccattattattttattggtactagataatatgaggcaagagcccttatttcctctgtttttccctgaagaacttgagtcattaaaaaattaagtaacttgacaaaggtcaaacttttttcaaaaaaagctgcaggatatcagaaaggttatcagtggaggatatccccagccatttgttcaaacccgctttccatttataaaatgtggagatgaaattttttatttgatttatatattagttggcagggtaattttagaacccaaagtttttttgggttatgaatgttacagttgcatttattttatatttttttcccttttattaagtagaattattttccattttatttgtgtgaaacataattgtgttatgaaataaacatccctag

SEQ ID NO: 13972 - DNA, 1740 bp, Homo sapiens
  misc_feature (1)...(1740): n = A,T,C or G
ctctgtganggcatcgtctaacncgacgtggatcgctgcgcgagggcgcacgctacngtaggcacgtagtatataagantatatacagantngcactctatgaangactctcatgnaaaatgacgtgtanagatattgtgatcggtacgtactacgatcgacgtgtgcgatgtgcagngagtgtactagcactgcacgtacgatttangagcgatatcgcggagtcgacactgagtgagagcatcacactactgccatacggctaatcgagnttggacttagcnatatgcatacacatagcgtatggagaatgagtgggtggaggtngcgacgtgcttcagacttgtgaacaacactcgtgacggtcgatagtcgcatgagagactcagtcgtnntagcagatgtgatattcatgagtcgctgtctcgacgtgcattgntggcactcantnantacaatanatagaaacgtcgtangancaacntatgatactaaaatataataactatctaacatcgagctgtatacgcacgatgattgatactcgttatattgaanattactatagtctatatgactcacaatcataatattcgtattananttctctactatgtctatatcagtactatatcagcttgagactacgtcgtcgcggagcgcgtancgaagacctgcgagcgtgcgaagcagtatagaagcagaggtctcantactatacagccggncgagcgtggtacgcaggactgcacactgagaatgtacntgaaatcatgttcgagtgatgtcgtagtaagattagatatcgcatgatggagacgtgtcgcgncactagctgcngcagcggcgtcggacatctactcacgatgngtcgccgggtagtcggcgaccgtgctacctcgcggcgacgatgacgcgctgcgatcactgcgagntacgagnactctacggncacttcacgaaagnggcgtgagcttcttatcgctatctagcgctcactccttggctagntcacctcacatctacgtgnacatgaagatcatngncgcactaatttctgcngcgtgtcgcgcgcagtaaatgtatacattctacnnttctatatcctcactgatnttncgacactaaccctaaactatnatcatangctacatctacacngtgttgtctagganaatactaccatcatanngnnaatatcacgatacacatgacataactacatnantcttatanagactcattcacacgttaactggtanatgtaagattaagatanacttnatataaatgctanagaagggcatagggggtcganatagtatgtgatatgattgttaagactagtgatgtatantgggtatcagatatacagttgatatggcaggtgtggnntataacgacgtgtagtatgcctnacaatactgattgcntancactatataattatctaactannnnnnggagccgtaccacatcanctgccngcaagcctgcagagcgacacgagcntatggtgttggtatggctggtgantntgtgttgtggtgtctgtgtntggtcgacaaaggcgtntttgggtgctngtntgtcgntntgtttttctctgtntatcaaaagntcttttctttctcnnnatcttctactcnnncncnccctcacttcactactctcnctactctnnnncnnnacactatctatccctcttcttcctcctttnntncattttttatttttttt

SEQ ID NO: 13973 - DNA, 857 bp, Homo sapiens
ccgccccaccacttcacaaacccaaatgcacaagatacaatataccttacacagtcatgatggcactgttatgcatccccgtgttctgctacactgacaaaacagattctctcatcagagttgaagaccctatccatcagccaaattgattgcaagtgacatttgacaaagtgggtaatcagagcagtagtcaattcccctcagtgcagacaccatccaatcaaacagactctcactggctaaggggaaacaaaattggaagaaaaggaccaagaatactctccaccactctttaatgagataaactaatatccagatactgggtaatacatttttcccatttaaatatattaatataccctaacatgaatgcagaagacttccattgtctttaacatccattcacacattaataccatatagatttcattctattacattatattgttagtacattttacatacatcgaagaatttctattttggctacttgccttcagactgatttccattctatagtgaacagcatttttaaaataatatagagcacatgttttttaaaactaaagcaatggaaattttactttccaattaaagctaattttttccatgcctaatacttttcacatttaccatggaacactgaaaaccagtaagcgctaaataaccagtatttgagttattaataaaacaattttgtatttagctaaaataaattaacccttaaatattaccattcaggtaatccccccaacccattttattcattaatttatcacctatattaacccacccttggaattttacctttcatagaccgcgaatcataaccacccaacttatcttgatgctcaact

SEQ ID NO: 13974 - DNA, 743 bp, Homo sapiens
caaaaacagtaaacccgcacaataaggggccgttcaagtttattcgcccccactcctttgcccttagtttattattcccgtgaaggcccacaccgcttggggttttacgttttttgtgggggggaacaacacaatagagtaatttatcttgagggtaaaaaaaatctccgatttggcccgggaaacccttccccggttccagggttttttttttatggtcccggcatttcttgaacacctttttccctccccggggaggaagaatttttagacctatcttgtttccctaatgcccccgtcccaaagtcatgatccccttccctaagggctggcctcccgaaactaaggtcaggatgctagaaggggtcattggtactaaaggggccatggttttagcccccttccgccggcataggtaagataaagatgatataaatgtgggaaaagttaccgaaaaacaaaagtttgatggtaaaactgcccaaacccatttgggggtttacccaaaatggtagcccttcccccttacaaatttggaacttttttttttaacagggagaaaaaaagtttccccctattttttaaaaaaataatttggcccctcttagaaaaaacaggaaaaactttcaaaattggtccttcatatccggggaaataaaaccatgaaaaaataaaaaaaaaaaaaaaaaaaaaaaaaaaaaaaaaaaaaaaaaaaaaaaaaaaaaagaaaaaaaaaaaaaaaa

SEQ ID NO: 13975 - DNA, 642 bp, Homo sapiens
acgcatcggggaccttgcgggaggtgtttggatcatgggctcagatttttcatgcataacttggtaataagtgagttcttgctccattagtacccaagagacctgattgttgaaaagagcctggcaactcatcccttccctcccttactctctccacgtgatgcctatcgcccttcactttccactatgggaggaagcttactcaggtcctcaacagaagcaaattgctggcgccatgctgtcttgaacagcctgcataaccatgacccaaatacacctctcatgttaatcagccacccacttccacgctcctcccccacaaaaacgaagaaggcgcatccctgcaacgaacgcgcagaaaaccttgatacaacacccagagaccccgggcaagcccttaccttccacagaggggagtgagtgtgccaccaaggccacaacccccacaaaccccttcatcatcccagtgataaaatcgaaccctggggccccgaacactgctgcattgaggaacaagggacttgaatggccacccctataagcatgctacactttacatgaaacacccctcaccatcaaaggcctggatttgaggcgcctcccactccctccggtaatataggagatctcgccccaaaaaag

SEQ ID NO: 13976 - DNA, 1300 bp, Homo sapiens
  misc_feature (1)...(1300): n = A,T,C or G
gtgaaaagaaaaaagaaagggaaggagngagggnaaaagtggaaggggagaagaggggagaatgaggggnttaactccctccgngcgaggacacggaaatgaggaagcattttaaggaggagaaaaggaacatgcaggataagacactaggaaaaatagtggagaggcgtgagtacgtttatacaggacnagagacgaggttgtatctggagatagagaagatcgatcgtttcaagatcatcgaggtcgcgtacacctactcataataatatcgtctacgccctaatgcgtggggaggggcggggggcaggctaatggggtggatggcgttgccgttgaggcgtgtattgtgngacgacgtgcacgtggtgtgagcgtattgtgggtatcgaccagcgcgcgagtagcgggcgtatgttggttatagtgatagttgcgttatatcncgctaaatagtttaccanagatgcgcgcaagcnagaacgttcgacaacgctgccctcggtggaaaagaatagcacgtggcgacgacatataagggagcacatcgttgcgattgaacggagaagagaagtgatagaggcgcgcacggatcggccgacgtgcgcgcgcgagccggcacgcgaggtgcagatccacagacactcagcgcgctcaccagccgaccactactatcctctctaaccactccatactgcaacgttacggccgtgaatctctgctcgcgcacggtcgtcctactcgaaatcgcgactcacagagttgtaagtagatgatggagtagaagtctatgncgtgcacgaagatgaagacgtctatgtatatattattcgagttttgacattatagtatactgtggatacatgatagtatatcgtgtcttgtatgcgtgtcaatcgngtagcctctacaccgntgtgatgtgagccccggccgccacgcgccacgtctaccaactacatatctgtatgatcacgctcgctagctaacgcaagagatacgctcatacgcagctccgctgaggggatagagtagggncgcagcaagacgcttctctcgaatgggaccccgaaaatatattatatggtcatgagacccgcgggcanacatagatgaagancaatggaggggcgaggtaagntctacgtcatgagtgttcantactgtgaataagtcatacccgctcatgtcccggagcgtaatctaacatcagtcaacttctacgagtctacgtcatacgctcanacggtcaagctgagcgcaccacaccgtgtgattactagtctcaagagtacctaag

SEQ ID NO: 13977 - DNA, 513 bp, Homo sapiens
tgagaatctctgcctcaggcctttaaataggctcaggcttaaagacacctctgtgttatattttgtaaacttcatataatagtggttggcatttttcaaattttttgctcaagcatcctcaagagaattttgaaaaattatatatctctcttatacatagtggacattaagtacatactaagttgacatctataatttttcatcatgagtttaactatttttaaacaaaagaatacagtttgtgtattgtaaataatgatagtttaaaccattaccacaccctttcaaatgtatctacttaggaatatatacatatttgtgatttaaattactccatcatgaatttaataatacataagtaagcttttcaagaaagtcaggaaatttctctttgaacttctatttccatttcactacccccatggaattttatcctaatgtagtactcttgtatgcttgagtcatctattgtttatcccattatatgtatctgcagcaaaaaaaaaaaaaaaa

SEQ ID NO: 13978 - DNA, 820 bp, Homo sapiens
ctaggagaaccagcaagaagatgatcatctgcaagccagaaagagggccctcatcaagaactgaatctgccagcaccttggtcttagactttccatcttccagcactgtgagaaataaatgtctgttgtttaagccactcagtctggtattttattatagcagcctgagcttactaagatatatgattactttcaaagcctttgagctcacattatgaccttttgtttagacatggttttgtggttctgcattgatcgagccactgctgcatttggttgacttttcttccagctgagaagcagatgaagtctttgaaactcggtccttggaagcagtctgaagaaatatgatggcaatatgatggcaaaataatttagagaaatactgtgagatacaacaagttctcctatcccttggtgatccaccacattaggaagaagaattgcttggaagtacaatgaaatagaagaaaacctcaggaagtagcctttttaaggcggacttcatggatctcagaacatctaacattgaaatgcatgctcaggatttgcctatgcccagaccacaagactttcatatgaagatgagtcttagaattccaaaaggcaagaggcttagctgaattaaaagactgaaatacatggtgattgactttggagaagattattgaatatgttaatgggtttaacatttgcttagccccaggtcattgtctgcaagcacccttacttgacactcagaaatctgggccctgggtgaggaaaaggatgaaccccttgatggctggaaccagatgatcacaggccgaatgcaagacat

SEQ ID NO: 13979 - DNA, 632 bp, Homo sapiens
ctacttcctcctactctggctatgtgatgtgcctcagtcctgctttgcctcctgccacgactggaagcctcctgaggcctccccagaagcggaagccactgtgcttcctgaacagcctgcagaaccctccatcccagcagatcaaggacaggagcagctgagcttgcttcctggggtgtagctcctgacaggaagaggaactgcacgtctgttttgccttctttcaaactcagcatgatgtacaatgaaaatgcttgtacagtatttgctggaagggccaaagtcagatggaaaatttttcaattataaaattccggccaggccagaaaaactcaaaagccctgaggagaatcgtaaaggccagcacaggcccaccgtaaaacttggatgcaatgggaatgtggttcttagtttaatttgtatgtctgcctatatttctgcaacaaataatttggaaagaaaaggtaggtccttccttaaaagacaaacaaaaagagacctttttcaaaaaaaaatatatataccattcaagaccatgtctatatgtcaaaaaatcaagtttgctttattttctcattaaaggtattatgagccaagaaaaaaaaaaacaaaatccggtctcgttggcctaa

SEQ ID NO: 13980 - DNA, 619 bp, Homo sapiens
taccagagtgataggaaagtaatgcttaatttatctctagtctcatacaactactttcctactttcgcaccggacttcccctttacatgtctatgtcattaactttgtcctacaggataagaagacttcccccaataagtacctggatgtgcaaagacagatgtagaatggaaatgacatattcccaggagcacaataactgacactaactgtggtcaaattcaacaaatgagagatacattatttatagttatgtattttttatgatggtactcttttagccatttttggaattttgtcaatgtaataattgttttactttacaatttttcatagcagtttcttttcttttttaattgtaacaatttttgttaattttgtattcattgttactatcaactaattatctttttattttttttcctattgttatattttaatcttcttatttacttattactcatatattcattgtatcattaattttatccccttattattactattcctttttcccttatcttgcgtctttattcggcattcctgtctctttattttttatcttttttcatcttctttctttttttatcgtttttgtcattttcctttactctctact

SEQ ID NO: 13981 - DNA, 697 bp, Homo sapiens
aaatcaataataaaacaaaagaaataaaaaaaaactgggccaacacagatgctgtctatggtgctgatgtgtcacctggagagcagatgtcctatgggcatgaaatgttgccttacttccttttaacaagaatcaacccctcaacgttggctttgtagcaaggctacataaaattaccaggctttcagaatacctctaaagcaaaggtcaattataatttgttggataattcctcttctaaatttataattctgagatgtttaattttagagtgataaaaattatgactcacaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctaaatatccaacaaaggacgagtatccaaaatctaaaaagaactcaaatccacaagaaaaaaataaagccatcctatcaaaaagtgggctaaggacatgaatagacttttcccaaatcacatttataaatggccaacaagcaaatggaaaaatggcccccatcacctaatatcaggaaaatccaatcaaaaccaccatgcatacccccccacttctgctaaaatgggcatatcaaaaaattaacaattaacaat

SEQ ID NO: 13982 - DNA, 507 bp, Homo sapiens
ctggagtggaatggtgcaatcttggctcactgcaacctctgcctgccggattcaagtgattatcctgcctcagcctcccaagtagctggaattactgaggcccaccaccgccctcaggtgggaagaggcccaaaagttcccaaagggactggaatttaaactctctgagtattgggagcagaataaatctccacaatggatgatatttactatgacttttttaactactgatgaccctggaaaaagagagacaacatgaaaacaaacgaaatctccagatggaagaaatacacttttggaattttaaatgcagtttttcattgctattgaattcttgtgaaattagatgtctgacccttagaagctgatgattttccagcctgatgtgcatatttttgagcagatcaagttggatcctaagaccaggtctggatgattgagaagacatgaaattttcattactgaaagggatacactgaattttttaggaagaaaaaccaaacacag

SEQ ID NO: 13983 - DNA, 816 bp, Homo sapiens
  misc_feature (1)...(816): n = A,T,C or G
ctaggtaaaacctataggaattctgcgtttcttctcaaatgaattgccacaaaagtttaaaggacatatccagctaccagcgacctacaacggaatgttcaaaagactatgtgtatctccaccacaatacccaggtatctgaacacgcaccactacaaatgcatgtctttggattgtgataggctttacctttaagcctaattatttctatgtgcaatactttaggtatgtggttaatgtttaaaatatcttactttccacttccaatttcatccaagtatgctttacaatcccacactgattgaaccatgctctttacactctttattaagaaaaatatatgtgtgtgtgtcagtgtgtatgtgtgcatgtgtgtgtgggcatgtttatttacatgaagtcttctactaccctcaatgtaggcgtttctatgtttctatatccccaacaggaaaaaaatgttttttagccctatcacagattatttntgtattttaatctggaaatttgtaaatctatgaattctgacttctaaacttctatatcatcctcagatctgttcagcagaacgaacttctcttgcttacaataatatcttgctattcggattttactgtctctgattcatgctgctctggggccacattaggtatattatgagttgaaaagcaggctttaaaaaatacagcacctgatgcatttaatataacattaccacttcagtcaattttgaacgtcttctaacaatacatttttatatataattattttaagaatttttactcattctctaatgaaaaaaaactccttaaccaa

SEQ ID NO: 13984 - DNA, 1058 bp, Homo sapiens
  misc_feature (1)...(1058): n = A,T,C or G
ttcggtggtccttctcgtgcgtgctttgtgctcttctctcgcctctctttgttttcgtgtctttcgtgctgtctcttgtggtctctgggtgtgcgcgtcggctcgggccgntccgcttctgcgcccgctcgcctggggcggcggggggctgtttttgttcgtcgtgttcctgtggttctccctcttcgtcgtcttctccgggcggcgcggcgcgtggggcgtctctgctatcgttgtctctgcttccctttcgcctcctgattgctgcgcctcgcttccgcatctccgtctctgtcctcctgtgtgcgtttcgctctctgtcccccgtctcctttcgttgctggcgtttgttcttgcgctgcccttctcggctccttctccctcctccctccctttccccttacggttcttttggccggggggggtggtcgggcggcgcttgtcccctcctgcgcgcctgctccggggtggggcggtggctgcttctgctgtgctgttgtgggtgcgctgtgtgcctggggcgcgttggccgcgtccgcttgcgggctcgtgggccttgtcgtcgggcttccgcgtgttagctcggcggggctgcgtctcctggcgccccgctcggctgcgcgcgccctttgtctgggtttgtcttgttcttggggcttggtgtcttgtttgcgtggctctgtctcgctctcctttccctctgcttggtgctcttcctttccccgctctctcgccccggcccgtcgctcctctctctcctcctcttcttnctcccctccgtccccgcgctggggccctgggctctttcgtggtgtgggggttctgtcgcgttgcggcctgccgctctgccttcccgctgtgctggctggcgtcctccttcgcgccttgtggtctgcttgtccctcgcgcggaagccctgcctcgcctcccgcccgctcnnccttttntctcggttcctcctcnccaagcnccgtggggtgcgtttccacccagggtttcttcctttttcctttctttcttccctctctntcctcctcttttntntttttcccttcttc

SEQ ID NO: 13985 - DNA, 795 bp, Homo sapiens
  misc_feature (1)...(795): n = A,T,C or G
cctagggctggagtgcaatggcacgatctctgctcaccacaagctccgcctcccaggttcaagtgattctcctgccacagcctcctaagtagctggtattacagggggaaaggctacactgaaatgaacattgtaagaaaactcaatttaatgataccttggagtatattctagcttcatgtactgctgttttcattacaagaatatatttgtgcatcgtctatattgatgggaacatcaaaaaacgggtttaatgaaaatcgacagaaaagagctcttttagcagcacagtttgaagctacttctccgagatactttttccatgatgctattaattggggtgagagcaaaataaaaggttcttgtccttatgaatgccttaatggagctttctgttctaagactggaacatgtgactgtcaaatatttcaggctcttgggacaagatgccagatcatcccaaacatgggcaacggcagagatgggatttgtaaaacctgnggacagtatcattttgaaacattcgatggcatctactattacttcccaggaaactgttcttacattnttgcaaaggactgtggtgatttggagcctcggtacactgtatgggttcataacagccctaaatgccttggttcggtgtattcttgttatcggtcaatcagcttgttcttttcaaaccaagaggaaattcgaattatgggcatgaaataaaaagaatggatcagtttaacattgcctcagacaattggacagattttcattgagaaactagctgactacattcttggg

SEQ ID NO: 13986 - DNA, 898 bp, Homo sapiens
  misc_feature (1)...(898): n = A,T,C or G
cgatgtaaaaaaatataataagattcaattgtctaattttcgagtgtcatttcatacaaacaacgaacattaaatcaagctctgattttcagcatttgccagttttcacggcttggatactctcatcacagatgaattcaaactatcaacatgaacatggatttggcaagaggtaccaacaggataccatgttctacaggtctcatgaaggacgaagcataagaatttggccttgtaaaacatggggaactttgtatagacccaaatggagggagaggacattcctggcaaaagacacacttaaataacggcaaaatatggaaaccgttttgacatatagaggcatcaacaggcctacagaagacaccactatacacctgctggacccttgggaaaaagatttgcaatgtgattactaacgaatctgaattcctttctcatccctatgaactttagttttcatcctattaaacgctttgtntacttttnctttttgttagtagagccattattctctatgccctgatttgatattattatatggaatggaagactacaaaggaccttattaaagaccgtgattaaatggacgtgagtcaatcttttaaggatagtaacttctaactaccagaagttgatttatgggatgggaatcttgatagactagatgcggcgcgaagcccgggaggtacttacaaatggctccccaccaatgggtaatgcgactagcccccctcctctacacacattagttctattgttccgtggtgtctggtaaacaactacctcccgtccctgccctgcccggataatctaaatggagctcgcataaacggagtgtgcaccatatatatcttgaacgatgaacaaccaaatataattagcgagaaggggaatg

SEQ ID NO: 13987 - DNA, 864 bp, Homo sapiens
  misc_feature (1)...(864): n = A,T,C or G
aaacattatagactgatatatcacaaccgaaacaaaanctaacagaatgtagccgtttttgtcctgccctgcccctatcctttgccgatgaaagacttcagctggcagagcaacacaagtggctgaatgacgaggatacaagcagctgagtggtgagcagagaagcagtgcgcgtcagagactatggatagacacggctaacctcaggcggtgcggcttcggagaggagcccagccggagacggccgggcttcagggaaagatcaccctcccatcccctttccagcctccctttctgctgagagccacccaccgctcaataaagtctgcattcatcacctttctaacagttcatcggacatgaacccaggttctgagagggcagggtttgccacccccaccctccactgacctggttggcacttggtcatccccggatggcagaactgaaagagcattggtcgaaacatgcttggacgctgctgcagggcccacaagagcctgctcccaccacaaaagaatgaccagtcgggcccaggaatcatttgctctgggtcctgccttaattattggacgcttccttcttgccagaagtaacagagcgggcctgagtggaatgagcctcttccagttttccgcccacgaagggatttcaagataacctaccccgtccctattaggaatgggaaataagcccaatggaatgaaccatggttnaccctattaaatcttttcgcttctgggaatccctatagcttaccgagtgttttggaaaacaaactggaggggatggctagtttggctaagaaccactcagccttctgtgtaaaacggctaatcgggggcgtaatggctccaattgctc

SEQ ID NO: 13988 - DNA, 817 bp, Homo sapiens
  misc_feature (1)...(817): n = A,T,C or G
ctaggaggtactgagatgtaatgatgactctgaaggtgccagccacagcatggagaaacagagcctgtcacctgtctaccttcggggaggctctatttctccccacaacgaggctcctatgtctactcaggaaccacagctccaccaccttccagactgccctgagggacatcctgacttcatgctcacataacagaacagatctgaccttaggttgaccaaatgcagcccagcatgggaccaaattgccattataccaagactggactactggacaactcaaaggagccagtccacagctgagcctccctgaccccagctctgcctattcagactgattctcttctccctgccagctatcctggaggtcccagcaggtctgctcaacttaggacatgtatggtgaactgcataaattccattcaggaagtgttagtgagctcctgttgcatgtaaatcccagtatggaaatgcaagtataaataacttctgcctctcccaccccaaggacggacttcacatttgaacatggccatacttgaacagactgtattatactcaaacaggagtaaaggtcataagtagggtgaccatacgttttggtttgcctggagcatcccagnttatgtgtgtttgctccctataattaacagtgcctcctttaactttcccagtttggatgataaattatccggttggcctagccctaaaagagtcttaaaagagttgggaaaatggagaagattgtgaccttttctggggtaggaaaacaaggaaggctcttggagaatgagattattatgccttgggaggaaag

SEQ ID NO: 13989 - DNA, 784 bp, Homo sapiens
cttccagtctattactcagcaggggtttaaaggtaaaaataatggaccataaatccaacaatcttgagagtttataccccatacccaaaaataaataaatcaggtaatgcatgtgtcattaagctttatgtaggcattttactataaaaatatctaaatcgaaatatcatgctgtacaacataaatatatgcattttgtgtatttaaaaacaaatgaaaacacaagaaatgacataatggcaattcttaagcattatctaaatacattaaactaaaaacaggtttcaggcttctaactagcttgcagagatgaaacatgtcatgcttatcctcattgcgctatattctgttataatataaatcttcaaaacagcggttaataaggaatatttgcttacctctaaaaatgaatatttccaaataattatctaatttattaataaaaatgtatctgcaattaaactgaattaaaaaagtaaatgcatccttaaaatgatgatgatataaaacgtctaattaacattattaactacaataccaactcaatgactatggtttctaacatttataaccccttactctttttgtcaaaaatactatctattcaaggccaggtgtggtggctcacgcctgtatcccagcactttgggaggccaaggcggatggatcacgaggtcaggagttcaaaaccagcctggccaacatggtgaaaccctgtctctactaaaaatacaaaaaaaaaaatcggccacgttggcatcattcggtgcagatctgctgtcca

SEQ ID NO: 13990 - DNA, 397 bp, Homo sapiens
  misc_feature (1)...(397): n = A,T,C or G
ctagatgaaacatgaagaaaatgttttctactggccttgatggaggaaactcaccacattatgaagacagttccatgataggggcccaagaatggcttctagaggataccagataagaaaataaacaactgcattttgggaggccgaggttgacggatcacgaagtcaggagatcaagaccatcctggctaacacggtgaaactccgtctctactaaaaatacaaaaacgaaattagccgggagtggtggccggcgcctgtagtcccagcgagaggctgagacaggaaaatggcgtgaacccggcaggcggagcttgcagtgagccgagatggcgccacagcactccagcctgggcaacagagtgagactccgtctcatannanaaaaaaaaaaaaa

SEQ ID NO: 13991 - DNA, 820 bp, Homo sapiens
  misc_feature (1)...(820): n = A,T,C or G
ctagatggagaggagaagtaaagtcaactcatcaacaatgctcaattcaagatctatttctgcgtacactcagatgacagtgcttatgttctgcatccacctctgatttgacacttgcatgtttggcctcagctttgaaggaaaagaaaatataattggggccagtagcattgcgtgcagctggtttgccattgctgaagaccttttgtacctttctgattactttctgaaacttgtgacacattaaccccttcagaagatagtaacggcatgccctgcaaatgccaaaacagtgtcctctccagtgcgcacatccgtgcatgcttttgggttttttgttctctctgcagaggaaactgttctactcaagccctgccttgaattgggctccaaagtgaaagaggcttagctgcttaacacatctctagccatgttgatgactagagcatccaaatgaggagagagtaacagtgaggaaaagtatcaggaatcaatgatacanagacgacagaagccccaaagcctccaaatggatacctctttggcttagcggagcagagagtcaggctggagctggtcctacccgaaacaaactctcagtgattcctaaaagtgaacatgtgggacgcanattctttcatgttttcagttagtgcagccagagccttggaggtcgggccataggcagcaacagaatggagggttttttgtggcagccagcctttatttacgtttgaaggctccctcttgtgtgagtgtcgactagtcatctcacttaaacaatccctttgcagggaatggttggactacacataacacc

SEQ ID NO: 13992 - DNA, 796 bp, Homo sapiens
  misc_feature (1)...(796): n = A,T,C or G
ctagtgtgaccctggacacatcgtactttgctgaacgaaccatggaaagagcgactgagctaaggggcatggaagcacccaacaaaaccacagaacaccatggaaacacaggtggcggtttagcatctatcaaaggagccagatgggcagacaaagagagaagcctccagctacgtatcagacaagcagagaaggtgaggggtgcaggcgccctggccaccctgcagctggctcagcatctggacaggagaacaaagccgtggcccaggaaacctccatggagaagactgaattctggtccagctgctgcgtaatctacatcgcttgagcggaagaggatctgtagtaactgatccttggctctacactctcccatccatcatcaggaacaatagcgggctgcagttgcctttccaaccctgctttgaagggcttaatatgttgatggttgccatggcaaacaagcttanaacaccactggatgatgtgaacggcagagataatgcttcataactttcgacggctagactccagaaggaggatttttgtattgccattgggtagtggaagacggcaaatgaggatcagaagaactggatctgtcagacagccattaactggctatgtgggcctggatggacaacatttacccggctgtgcaaagactaactcattgaaaaagctgaattattaacaaagcgtaactgtggaattataagaaagtattttatcattgccgcccaaagttggaatctggccctcctctcataacccagtttagattttgaaattcaca

SEQ ID NO: 13993 - DNA, 741 bp, Homo sapiens
ataagctttagatattcacccaatggtctgggtccctctgttttcattggaagttaagtggtccaagattcatattatatatttggtcttggtgccataccaacaatagataaggaagagctggtgttccaggccagctaatcatcatgggagacagtggctgtggctgtcacttctctagtggccctgcagctcacaccaagtgtgttaaagctactccggatgagccaagtgttccactgtgattgtcactgtggtcctctccatcaacaggatctatcagaaagcagaaaatgaagccctaacagcgtacttactctcatcagtggattaaacttcatcttcctccttcaccctccgtagagattagcaaagatcttgagttctgcatgtttctgaattaaggtaagtgttcaatcatttatgtgcttgaagaattccctgacaaactggttctatggttacgagttcatatgaaagcagtctcaccaaaagttgccttttggccgtcaggcaacgggaaggctgccattttgcaagccaaatagttcactcttactgattatggtctgggggaaaatggctgactagagatgcagaatagtcccctatctaagtgtagtgagatggtttacaggtccggaacctttgagaacgttatttaatcacacagtggttttgatagagaccagatgaataaaagaataataatgacagtaattataatgaaaaaaaaaaaaa

SEQ ID NO: 13994 - DNA, 737 bp, Homo sapiens
aggagagcagaaacaggaaatcaagagaaagctgtaaaatgggaatcatagttgtattttcttcatagaatgttgtaaagttaaatgagttagttatataaagtatgtaacagtccctgacatgtagaaactgttcaagaaatgttcgctattattggtattaacattgtttaaacccttgggtcaaaccgtacctaaagtcaggccttatccttgggcatttgagttatatggaccaaaaactttctcctacctcatcccctcagttttaattggttttctgtcttttgtaactgaaaaaaaaaatttttctctctctttatatatataatgtgtatacaatactatatattatatatatgtaagaaaggaacatacattaatctaaaatttgtattccttactcagctattctacttacaggcatatatgtaaaacgtgggtgacgtttatgcacagagacagtcattgtagtgtgaaaatataataacaaaaaagctcaaactcctaatttgtcaataaaaaacaggaaagatgaagtactttaaggtctatctatagaatcatgtttgtgctgtcattaaagttacatccagtaactatttttaatgtgttggcttctgatgttgtgatgttacgttaaatgaaaaaaaaaaacaacagaacacacagcatgtatttatagcacgtgtgcatgatctcaaatatattaaataattatattaaaaaaaaaaaaa

SEQ ID NO: 13995 - DNA, 1366 bp, Homo sapiens
  misc_feature (1)...(1366): n = A,T,C or G
tggtctatacatttaacacacagttacnctgcggcacgcaaggctncaccaccacatccatgcaggtaaaactgttaataatcgacacccacagcagcgtacaagaatatgagcttcacgcacaaagtgtaccaccaggcgcccgcccncccaccgggcagcgtaaaagacgattcacacgagttatagttctcagttcgctgcggagaacgtgcnacgttccgcactagtccaatagctgtcacaggtttcgacgtgtgactaaggtcactacattcatgggactacaatccnatcgtntccaagagancaaaagcgggctccgctnacggagtctatacgggttctatgcgcgactcgcatggccatccacacgacaatccgcagccgacagtgagtcctgagtgtggcagcgncacgatcctctcgcaagcggctccaattcatatttgtcactacagtctaatccctacgatggctccgcgtacataccaagccttatagatgntatgatcaacatctnncagataattgcatatagtatgacagaacatatgtaccgcttagaacaagcgcagtgagcacaatgcgtgacgcagaggagagtatacgnttccaatgagtcactacagacgtcgctcatccgccggcccgctccaatcgcgcactcaccccgcnntcgtttagaggtaggtggcgatgtgtgctcgtggattcgttacgacctctcacagcgcgagagtgcccacccacactcatccccncnacaaagagacataactaaataccacacacacacagccgatacagctacgagggcgcatgtgcagcgatagttatccctgtcatgtggtntcgtatgagtctagtagtgtagtcttntacaggttctcgtctgctcatacgactacgtgctatgatagacgtcttatcagatcgcgcnatagatcgagtgataccagatgttgtgtagcacattcttnataatgatcacatgagacgtctatgagtgtctnactgcggtcagacggatataccaggaggcggagcgccagaggggtagtcacctaacaacgtcaagtattaagttctcaagcggccacaccagcagagatcctcctcgcgtacgtacacctatcagcattacacgacggcgccctgcagacccttcggaacggacaantataagagtcatactgagacactgcacctccgtactcacgcgaccacagtatatcaggtacggcatcacacagagagaacggatgatgagtaagcgtaactcacacgaggcgcgccacgtcacacatactcccaaagtagcgagatctattcaagtatcattcgcnnntcataatagtaagtg

SEQ ID NO: 13996 - DNA, 777 bp, Homo sapiens
taggccgaggttggaggatcactcgagtccagtaattcaaggccagcctgaacaacatggcaagatcccatctacaacaacaacaaacaaacaaacaagaaacaaaagacaaggaaacataaaaactacactcaacttcccacgtgatgaccatcaacacggagtgaaataatatataacaagatcacgactaacccaaaggatagtcaatgttctattgaacaatgttctactgaatacagtacttattgtaattggtgttaatgttgttattatcataactattcttatttttattccttaaatatatttcaacctgacccttcaacaatattttagataggatattgaattagaacatttatgaactaatgaatagagataaaataggagatgtgagttgcaagttttgagtgcttcaaaggaaaaaaaagacattttcaaaaacataaaatttttaaaggagagtgcagaacattatatgttgaccaatttttgacaagtttcatatggctaccaggttgcctatggatattcattttatagagactgttgaattgttccacagttctggaaaaaaaccattgaaatttccatataattatgtattactgcctctgaatactgggggactttcttaagaaacataaaataggggactaaaatcattggacccatacagactgaacatgattatattagtgcaaagtatgaactttctaaaaaaggtaaagaatttaaaacacgttaacaatttttaaggttgctatttctatt

SEQ ID NO: 13997 - DNA, 638 bp, Homo sapiens
cttgggtgttatgtactgttcgtgttagtctgcttggtggcggttggtccatctcttagggtgtgtgtatctttcttcgctcggttgcgtgtttgtgggccggttgctccggccgcattcatttgctgtatggcgcgggtggtccggtactctatttataatcttagcgtggtggggcgtgtctatggtggactacgtgggctgtggtcctgggatggagaggtggggggccctttttctgggagtgttgtggttgcgcgtgggggggtgggggtgggggcgtcgcgcgggatgtcttgcggtcgtccgccgtcgtggctgacgggtcttgtcgttgtttgattggtgggggggcgaacgtcatgttgtcttttggtccccattgttggtggtgggggtcggtgggaggtcttggggtcatggtggtggatccctcgggtgtgtgctgatgtcgctccttgtgggtatgaggtgtggtgcgtggtactttatgttcgctgagatatgttggttgtttggtgtctgattcattaacatgtagggtcccttccctctctctttcttgtcatatggtctctgctcatgccagctccccttctccgtatgccataaatggaaataacggtaaagccctcacc

SEQ ID NO: 13998 - DNA, 1429 bp, Homo sapiens
  misc_feature (1)...(1429): n = A,T,C or G
accccccccacacacaanncacntcaaaccacacactaccttttatgtaaaaaaaaaattctgaaaaatatttttagagagtcggaagtaaaggaagcaagtggggcggtggggcacgggcgggggatggcggggtgaagcctggaggagcgggtgggggtcgatagggtgtctgagtgggttgagtggaggggaggcgattaatggacgtacaaagtggacgtagggcagtggaaaagtgaagagacggagccgcgggcggcggcttggtcgggatgcgcccgtcggcgcgcaccggggggccgggctgggcggggttgggtgggtagacgatggaatacaccagcgggataatgaccagtatcacacgactacttctgcgagaaaagcaagaaccgaatagtaacatccacgaattgagataccacaagatgtcacacccaaataccacaacacaacagccaaaaaactatatcccaggtgtcggccgatgtggagccgcgcattagagtccgatcagcgcgagaaggcgattactggngtggcccacccacagtagccgcgcgacccgcgatcacatcctacacccaatcgatccgcacatgatgacacgcctcgacctagtgcgcgcaattggtagcacgacgtcccgccaagttgaccacgtctcgcccctaaatgttgcaaatccggttaagtagcgcagcgtcacaagtacaaattattccgcccagccgaatagcacgtttacccagatcccggcgcgataccggctgtgtacaacgtgagagcccacgcaagtaatacgcccccgcattattcccaccccaacagccgacgaattaatgtttaccgaatcgcccgcgtcgcggtccaacatcccgcgcacgaatgttaaggcgtatcatcgcgccaatcacgattaacgcgatagaagcgcgcttcccgacgtgcgccccccatatccccgcggcagatacgcgacccgtcgcgaccggcagtccacgggagttggtttacagccggcctccccgccatataatgcgcatacgcctccgcatttcgataaggcgggccattgagacgatgcgtatgccgatattttgcgcacttgtgacatcgaaataaacgacgaatgatagctttngattcgacgcagatgtctgatgtaagagcgagcgagcgcgtgtaaggcggggtcgtctgagtggagagggtggaggtagatacagtcgtacacgagttatattattcgcacccttgttcagcgggatgataggccgcgcccggcgcaccgattaagcggcgtcggtgtgtctgtgcgtcatcgcgggtatatcgcgatgccgacacgacgccaccgttagtgcagtatggattcgccggcgtcacangagtatcggcaggacattatccacaggtttctcgc

SEQ ID NO: 13999 - DNA, 1892 bp, Homo sapiens
  misc_feature (1)...(1892): n = A,T,C or G
ccaacccaagacacnnccagagaananngaaagaggggaaaaggcgctttttgcaccgcggaaggagggcgccaggagaaatttttttgtggnnnggttcgggtgaagatggaggcgggaggaaggcgcggaatgaacgaacgcgcggtttttcgcgttgttgtgctgtgaggacgggggcgatgtgtgattatccatagagtgtttcccgagacacagtatggtcggtaccagctccttcgcgtgtacacggagataataacaatgcgacaaccacggcgcggtgagaagtaatagaacgagagagcagggccgcaaggttgtcttcttttggcggagactcttctgatccacgccatacgacgctcgcgacgagcgttttaacgtaaaaggaataggtagntaacgaccagagcgtcgcgcagtgtcacgagctgtgcgagcggcgtggtgttagcgactctgttcgtgtgtatatgtacaacgcactagcgcgaccaccacgccagccgcgcccgcgccgaatgccgtggaggccggaggcaggccggttgagccgactgcgcacaccagtatctaccagcacacgacgctgtgtcgttgtgcgctgtcgacacgcgtgnagacaagagctgaacgagtatcaccgacagcgactacagcacccggcaccacgagcgcantctatgtgtctccccacgcgcnagttgctntcccgcgccacgttnctggcacgctgatcgccgacgcttatagcgcacgccattggttgtgtcgacggcgttgcgncgagcacatgatagtcacgacaccgtcgactcgccgcgatttgtttagtagagttnactcgtatattattgtatacgcccgccgtacgcgacaagaggcaagagtacagtccgcgacccccgcggagagcaggacagtagacatgaccatataacatcgcgcagacacggtacagtatgtgtgacgcccgtcgtcgcccggcgcccgcgttgtgccgcgacgacgcggctattgcccgtcgcaggacgcgccgccatatatcgatattacgttgacgcctgcgacgcgcgcantccacccgtcgtcacattacgccgcggtggntgagtgattcgtcggtgcgcgccgccaggcgccgacgaggtacgcgagtatggcgacgggtatcgaccgagtgccgcaacgcgcgatattgcacacgcgcacgtaatcctacgcaccctgtaccgcgtaccactacatactacgccgcagatcggtccctctgaggacagcacaccaggttcgccgagccgcagatagtgcgccgcgctacgcgccgcgcgcgcatcgatatacgacgcgctacggtcgtgtcgcgacgcgcatagcgagtgacacgcgccatattanagcgccacgcagtcactggtaacttatcgaacgcacatcagcnctcacnaagcaggagcggnacncgacagtgtcacgcgacagacatagctgtgtctgngcacacttccgtcaganagcgcncgagataggcnagcgcgagantcacgacgtccacatangcgntgagtcgagaaggacagacgatanacgggcgctggtctaccatacgagatacttgatgtgatgtcatcgacaccncnacgtatatatacgcgtagcacgtattgtacagagtactcgcgcnactcgaggcgcgctgctctcgattcatacgcacatgcgactaatgtcccntcccgctcatctctagtcgtggnatgctccgatctatatctgccacgtgtacgcgccatccgaagtcgcgcagatagtntagatccggagccgcancaatatgtcgtcatccgacgcgcggctgataatcgacgacgcctagtnacgatcgcgcg

SEQ ID NO: 14000 - DNA, 795 bp, Homo sapiens
  misc_feature (1)...(795): n = A,T,C or G
cctagtggaggcttttactcgctgtctcttaagacagctgaagtattttaacatcagaaccaaagaatccactgaagtccaggagcttctggatgactgtctgctacaaacaagaaattggaccgggttatatttgtcaacctctattctgtgtatgattttaggagaagaattttaacaacccagaagtcctgtctttcagaaaactccaggcctggctctcttcttactcaaagaaaattaatgaaaacataaagacataacagcagaggactgtagaaatattctgtatgagagagtaacaggaaaacatagcattgaacatgcagaaaagcatcattttatacatgatttatagaagattcattttaaataatttttgtttgttaacaaaggggtttaggtctatagaggttgtatttgttacctttttcacattgcaggtagtttctaaatacatgacatttcaatcatggcttattctttaacctaagaaattgtcttnaaatctcctagttgttagatnttttgattggatatcttaaagttggttttaaatgtcttcattggtgttgtactatgttttggcagattggggggctctaaatatctatttttttctatgaaataaaattttatttatgagctcctgcctgattctaataagctatggtatttgaaatatatggcctcttttagggaaacaaataatatatatcttgtaaatgcctttattaaacctctgatatatttaaaggtttacttgataaggaaccgttgcaatttcaaaccctt

SEQ ID NO: 14001 - DNA, 451 bp, Homo sapiens
ttatatgtataaagttagttatataggacaaaaaaaaagataggtcagtactggacaactgaggcagtatcatggggaaagtgctaactgccaatccagagctgctgacaccttaaaaacactggcctttaacactaggatggccccaagaaacaagcaaacaggaaaagataacacctgctagcgtgtgacaggcacagcaagtaaacgttcaatacggatatgaaaatgcaactgcataataaaagtcaacatgaaaaagaaaaagattgcaaaatatactttctcagaagaaaccatcacatgatgtttaaaagtggtggttcctttagcattgtctactgatggctggcaacatacaggaacatagaggtggcccatttacatcctcataaaagtgggatgtaagtgatcacaaagccaataaaactacaccacattttcttcaaaa

SEQ ID NO: 14002 - DNA, 761 bp, Homo sapiens
  misc_feature (1)...(761): n = A,T,C or G
gcctaggggaaacctcgctacctnctgagaggcctatactgattatgaattccacggggtgaattcttgaagtaataacacttaccaccatgaagttctcagatttcttttccaaacaggaactctgagagcaaagaaaattgctggactctcacggccaggcatttcattgtatagtcctggcaacgtgaccctaatgagaagaagtccatacttcagttttggtttatgattcagtgacagtttgattgtgggcccaacctcttctgcttccattggaatgtgagttacatgctgaattaatgagcaaaaacattaaggctttgagtctgctttgcgctttcctagttcccttcattttattttcactggtttattttatttttgtatcttgatccaaaattcatctgcatatgatttttgtgcacactaagatcatcctgaagaacatggacttgtaaaacactgggaatcaattaccctcaggagatccgtcgacttggtgaggtgtgtcctttacagttagttactatgaaattccccttttctaaaaatcctgtcattaaacaccatgatggctttccgttgctcactgctgatcttttgcctctcagtaagcatgaagaacactttctctttcttgctgtgagttaatgctatttatatnttagaaatgccagattccttcacaagtcacttgagactcggtgggaagaatgaattaccctgaactggcttgttctctcctgacggtctgcctg

SEQ ID NO: 14003 - DNA, 789 bp, Homo sapiens
ctagcttcatacaccgaattcgatatcagtggcaacgtcctcgctctgatcttcaaccaaggcatgatctggatgggctccttctttgctcccagcctcccaggcatcaatatccttcgactccatacatccatgtactaccagtgctgggccgttatgtgctgcaatgttcctgaggccagggtcttcaaagcttccagatcaaataacttctacccgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctagtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctatttccctgttctacccttgatggattttcaaggtcatgctggccaattaaggcatcatcagtcctacctgagcaacaagaatctaaactttattcccagt

SEQ ID NO: 14004 - DNA, 777 bp, Homo sapiens
tgtgttgagactacagcataaagtcacgggactgactcactaaggacacaatgcatatttcagcgataattcccagtgtccagtttcctcccgctggcctaaaacaacagagctcttcattttgggattagagcttctctctggaattatggcacatttctgagacctgtaattcatgttcactaaaggagaaattctcctctcgtgatgggagcctggggagtacttctcagtgagacaacatacactgattttgatcatggtgctcctgccatgaagtttttgtgggtgtactggggagatattgaaattcctcctaggtactactatgactttacttgtgagaacagccatgaagagattgttggggctcctcttggttggttttatcacatagaccctgacttctgctatctgtaaacttttcttctggtacctgcagtgctgcaaatcccctctggacagtcatcctttgccctctgcttgcctgtgtggcttaagtggtgctggccccaggggtgagggtaggtcctacacctaagtcagccaactctacatagcccctcagccacgaaggttgcttcaaggacagcatgtgatactaaacgagtcaatgaactctatgagacctttcatggagcccctggacacacacagatgctttccttctgaagactgactttgtgaaaagaggagggagaactacctgggatgtcttgcagccacttggaggctgaatccaagccaccaccaagtgcagtgctgggaatgaaagtg

SEQ ID NO: 14005 - DNA, 459 bp, Homo sapiens
tagtagagactagaagtggccttaaagaagggcacagacaacatggtcctggttctagaggaagctaaatgtgttcacttttcctgtgagctttacacaggagtttctgcaacataggagagatcacaaggccagtatcgatgaagcccttgatcctgtgcttgttacctgggaaagactgacagtaataccttaaaaatcattgtctctgtgacttaggagaaacaggacaaattatcctagcatgaaatatagcccaagaatattgtgggaataacgcagattgattttttttttctcttttctgaattcacatctgtatccctctttcagatatttattgactgctcagttcagtcccttttcatatagagaatgagggtatatttcatttgttcaaaactacaagaataatcatacctcttatctttcaaataaaaatcaactttgctctcaaaa

SEQ ID NO: 14006 - DNA, 791 bp, Homo sapiens
cctagacctgaagcgggtagctgtagactggatggatgaatttgccgagtacatttaccagcggcggccggagtacaggcatctctccacgggggacatctctgtccagaaggagctgcgcaagcagctcaagtgcaaggacttcaaatggttcatggctgctgtggcctgggacgtgcctaaatactaccctccagtggagcccccgcctgctgcctggggggaggtgaggaaaggttgcctgaaacctgcgcctacctatgagactgtgtgcctcccccatagcctcaggtggtgggagggactgctaaaaccttcacttttaccttgcagccaagtagcattcatttaaatcatctcaaatacatgaatgttcaacctctttttagcaattactagatttagcttcagagttgatagcctaacccagaattagtgaccactgttgattccccagatgatttttgtttgtttgtttttgtttttgttttttttttagagatggagtctcgctctgtcttccaggctggaatgcaatggcgtgatcttgactcactgcaacccccacttcccaggctcaaacgattctcctaccccagcctcctgagtagctggaattataggggcacaccacgacactcagctaatttttgtatatttagtagagacggggttttggcattttgggcaggctagtctcaaactcctgacctcaggggatcctcctgctttgggctccaaagttttgggattacaggcattgagccactatgcctggccataaatttttt

SEQ ID NO: 14007 - DNA, 781 bp, Homo sapiens
  misc_feature (1)...(781): n = A,T,C or G
ctggctgaactccttgttaggtcaaccacccanaaacacatgaataccgtcattctcctccgccaaggccggtatcagcgcctcaaggaaaacaactctgaagtcgaacgcccactgcttcaaaacccacacgccgagtacggcacccctattcggaaggaagtagccagacaatcaacaacacaacacccctcttccttttatattaaagtaaaaggcaagaatgttagccaaactgtaccatgtttcaagttccttgctattttgcagaccttggtcaaagcgaaacatttcacagggattcaggccatgagaaacatcctacctaaccacctgaccacagggcggacaaaggcccaacgaaagaaacatccctggcctggtgcaatggctcacacctgtaatcccagcattgtgggaagctgaggcgggcagatcacttgaggtcaggagttcgggatcagcagcctggctaacatggtgaaaacctgtctctgctgaaaacacaaaaattagctgggtatggtggtgcacacctgtaatcccagctactcaggaggctgaggtaggagaattgcctgaacccaggaggcagaggttgcagtgagccgagatcacgccactgcactccagcctgggcaagagagtgagactccatctaaaaaanaaaagaaaaaagaangagaanacaaaanagaaagaaaagaaaaagaaacctccttgtcatatcttgctggacaaaggtccaagggacaccatgatgacatcccgctggaacaag

SEQ ID NO: 14008 - DNA, 770 bp, Homo sapiens
  misc_feature (1)...(770): n = A,T,C or G
ccttcaggtgagataaaaattaggtttacanatgaaagaacttgcccaaggtcacgcagcaaggatgtagctgcgcctagaatttgctctccatctgtctgatgccaaagcctccttccatgatgttaagtccacatctccattaacaaatattcctgctgagcctccactgtgtggacacaaatgctgcaaaaaactacagaagcaacagaagacatcgtttctgctttccaggcagttaacatctaagaaacattctgaagactcagattctcaattcatgagaagtagtgtgaaatctacagaggaaagagcactagaccaggaagaggcagacgactcacttactctgggctttgctatttaccagccacataaccttaggtataataatttctgttattttcttatctgcagagaagatatatctgccttaatcgtctcgtcagccatcttatagaattagaactcatgctcaaaggtctgggccacctccaaacccaaagctttacctcagattctaaattcacctcagagaataatgtgagatgacccatttctcaagggaaactgaaggaagaaagttcagaagccaggtgattaagaaattctctgtggaaaatgagagtttacaaaagaagaaactgcatctggctagttgggaggtccatgaactagttagcatcaaccaccacaagcatttaaaataaataaactaaattactttttctggcttaagtactaatatcacaacacaatttttattacaa

SEQ ID NO: 14009 - DNA, 450 bp, Homo sapiens
ctaggatggcctagatttccttatggcatcgaggacgagatccaagacagcaaaagcagactctgccaagtctcttaatggcaaggccctgaagcagcagagcttcacttctgccagctcctattggttaaagcctgtcacaaagcctgtcgagattcagaaaaagagagatagaacccacctcctgatagaaaaaagctgcacatgcataaagaaaggagaggatttgacagctatctttgaagagtatctgccccattaagccatgggatattttccccataaaagaaaggactatgatctggattgtagaaactgatctacagacatgaatctgaacttaagagaatttgactaattccatctgttcaaactgtcatcactcacacatatttctgtaagtattcactctcacatgttagcatcaataaagatttcatgaaaattaaa

SEQ ID NO: 14010 - DNA, 783 bp, Homo sapiens
gtggaacatgactagcgcgaacattatttagaatgctttgctgcttttgccattttggtgtacgtttgaataaaagggaaagcttgaaaggggacacaaaggtaagaaagaaaagaaggcctagaattaaagagggagaaaaagaagcgtgagtacccggagagctgcgaggacgatagcagccgtctgcggctcggaagaactgattgtagatctacaggaagtgtgctgttgtgctgctggcggaggccgtccctgaggaagtaggagaagaccactagggctgtgtctaagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttggcctggtgggattattgtaagtattcagagggatcattttgagagaagtgctgtggacattgacagtgccagactctcacaggtcaagctttcattgtctcttagttttggggctgatatgaaatgaacttgggtctttttctgagggcttttataagttagcattaaacaagaattctaattctgatttctgaatacaccaaccgtgctggtctctggtcttagactccttgtgcatggtacgggactgtgaggcatgatttttaatgatgattaagaaagtgttgttttctctactgaccctt

SEQ ID NO: 14011 - DNA, 535 bp, Homo sapiens
  misc_feature (1)...(535): n = A,T,C or G
cttaggttgacccagctacatcctagnaggccctcagaccccagcaccttgacttggacagatgtgggagctcacttaccacaggctgaatgtggacgtgcagcaaaggaaaaatgcattctgtgggtgtgtatagtacggacgacagatccattccagatccagttgaggtcaaatctgacccctactatgtgagcaattaggatttttataaatttcactctttctgccatttttaaaaaattaagtataatctttacttataaagaaactaacctaatctttaaacagagttttaaactaaactatagagcttgtctttacttttgttttcctttttttattaaaaaaaagtgagacagaaagtttttaaagggcaatactttatcatgaattcacatatatgtaaagaaaagcacatagacaaatttgcatttatgaaaatgatcatttaaattttctcctttattttgttaatatggtgaattacgttgattgatttttaagtattaaatcaatcttgcatttctggaaa

SEQ ID NO: 14012 - DNA, 902 bp, Homo sapiens
agcctaccaatacaaaagaaagggatttttatgagtattgagtgctcgttgcacacccaaacaagcactttgtgatgtgtctaagtatatacgtctatacaggagagggtgcagaaaatgaaagttcttcatgattacgtgaactccagagaaatccagaacaaaagagttgataaaacttacaagaagaccttctctcaatgaacacctagcagtgcttcttgaaaactgtatttcattttgggaccaaaagagctcacgctatatcttagacagtctctgcatgagtggagtcaagcaggagtcctgagtgtatttatataactccacttccctagaggaaagcccaagctggggacgtcagctgagaaccagatagttaaaactatgaacccgcgcgtagaacgcgagtagccgcgatagtgacaccccaacaagacgtcatgcataccgacgaagtggtgggcgcgggcggataaaaaacaggcgtccccgcccaggggtagtcacgccccctcccgacggtggcagaggcaccccagtgcgcaccacagcgcccacgtgacgcgagaggcgagtagcacggaaaggccggacgacggccggacggaagcagcccgagagaaccgcgccgcaggcgcagcgacgaccgcgacaggctacggggcctccgcgaacggggagcgtgatatgggccaccgcgcccgcgagaaaggctgtcggacaccgggaataagcgcgtcccaaggcaaggggtgtcagcggcagggagtggagaacatctgcggtgtcttggtgaggtaggacgagatccaacagaaccccctggcatgtacccgccgccgcgccgtggcctccccgcaccgccggaacgtgcgaggcagacacaccccgggcgcgcg

SEQ ID NO: 14013 - DNA, 793 bp, Homo sapiens
ctcgcaatacccatgagtgagagttgaaggatgaggcagaggaagaatttgaactacaatgcacctgcaactacagaccttagctgatggcacttcagagatatcccgaattgggacaagaagattgggtctttgaacctctatggagtctcgctctgtcgccgaggctggagtgcagtggtgcaatctcggctcactgcaagctctgcctcccgggttctcgccattctcctgcctcagcctcccgagtagctgaaaccaccggcgcccgccgccgcgcccagctaatttttattctatttttagtagagacggagtttcaccgtgttagccaggatggtctccatctcttgacctcttgatccgcccgcctcggcctcccaaagtgctgggattacaggcgtgagccaccgcacccggccaagattatttttaaaagtcttttaaacttcaaacagacaggaaatatgtaccatttctgaactttgaactaagatttaagcgaaggaataataaaaaaaagaaaatttattcactaatagggactttccagtctctgtaggccctcagggcttattccccaagtgattttgaaacaaccagatctggagtgatctcgggcgaaatcatagtccaggggaaattcaaccccgttgtccacgaggtatgaaacggctcccgtaagccttttaacggtacctgtatgtgcttctgtcgaactcccaaaaatacaaaaggacgtgaaatgatccgcactcgacgcatcgagggcgacttcgccagcccaggctcg

SEQ ID NO: 14014 - DNA, 802 bp, Homo sapiens
  misc_feature (1)...(802): n = A,T,C or G
ttgtttgggaacgcgggatganttgacaggcccaaacgcccatggacagtctcaataacaacaaaaaacttgatatcttcgtggtaaccgaatgatcccaggaggctgaacctataaagacgtctggtccctgaccccttctgcctccatgtgcccagaacagcctatcgtgggccttcacccttggcaggtggatgccgttgtctcagctaaggttgaggactaccatcctgggtaatttgagcaaaatattgaggaccaaataaatatggctgggagaaatctcatcttcatccatctcctttattccaaaaataaattttgagaagcttccaaaatcatatgtaatatgttgccgactaggaagtagaagatcagaatgggcctcactcctctggtaacagtaaaacagcagataatctacaagatcatacctttccctgaacccatcagaagctgaagtcacagggcaaccattcagcctgaggttgaaggaaggcaggagcctctgagaagaggaggtgtgaacatggctgtctgtggccatgcgtgagaaggagacagccctgccacacaggtggggaagactggctcagtcgatgcctttaaagaatcactaaaggctgtgtttgagtcagcatgaaagtgtggacctcctgagatctttggacaagcagagttcacgctctcttgcaggtgcttctctatagaaggccactgaagcccactcacacatgaatgtattgggcacagattgggagaacacatagagccttccacaacagtgccagcttggggcaag

SEQ ID NO: 14015 - DNA, 781 bp, Homo sapiens
ctaggtgcatggtaccaccctctgccctacccttgcagctacagacgggaccccgatcccacagagcaactgtgactctggaactcctgttctccagctgttcatcaaactgagaaaaacttcagagctgtgtaggcttatttagtgtgttgtcagccttggatattggaaaatggaaacagatgaggcacatctacctccctgtgaccccagccatacatcatagctcatgtcctgccaccccaagtccttagggaaaaaagactttggagaatgtgtctctgcttagcttggctaggtagttggtctcttttctctgccccaagcgtcccctgggtaattttggacaatggagtgtaggcatgtttgactcttgtggtgttatcacttgtatatgtcagtgaaactaactgattctcccatcggaatatagttatctcttgggcctgatatatggtaggataaccttatgctcatctgtccacttctgcagccaagtcgcctggccagtgtgtgtgtgtgtgttgtgagtgcgtgagtgtgcgtgtgtgaaaccttatctgtgtttaaaggcgtgtgtgtttacacagggcagagaggatggagcccaccgtactgcaacattatggtattatactcagtgcttagaaccatcccagcctccttggtaaaagaaaaagggaagctcacctgtgtctggtgaggccgtcatatgggcaaaagctctgtcgggattctgtgcccgaacatacctcattatgtgatttggtgttgtcctcct

SEQ ID NO: 14016 - DNA, 796 bp, Homo sapiens
  misc_feature (1)...(796): n = A,T,C or G
gtagatcatatctcagaaggaagtcanttgccatatcatgagaacactcaagaaaccctatggggaaacctatgaagcaaagaattaagacctcctgtcaacagacaatgaggaattaaagcctcctgccaatagccaacatcaatggaggctcctgccaacagctatgtgaattatccatctgagaagtggaccatcgtttctcaattaaatcacaaaatgattgaagtgcgggccaccatcttatctgcaagctcacgagaaattcggaaccagaacaacccagctaagacactcccaagctctaactaatgaatatgcccatagttagttactcttttgtactcttatcaatcgatactctccgactttcagtaaatctgacccctaccaattacaataccagagagagtagtttcaagaagccatccaaatactgagtttcttttgcccctaatattctgttactgatatctgggaagaaattccatatgatactttggtccttaggagatgcacaggcttagatatatgtagagtcccatttataagtatgcacaaaatattataacagtcacttttaatcgacctaatacaaaatgaaaatcttagatcaaacatgtatcatacatttattataatgtattgtgattattgatttggttataagaacttctcgtaacttgtaagctatttctgggttccgaaatcaatttggaaacatgtaataaatacagaaaattatgggggctcagaaaaaacattcctattattatatattcatagatctgcaagt

SEQ ID NO: 14017 - DNA, 361 bp, Homo sapiens
tgactttgcttttcttcaactaaaaattgaagattgcactaaaagagtaataaactttaaaaaactcatagctcctggagtgaagttatcatgcatgggagaacaaccattgagactactttgcagaaccatatttttaaagcctgataattaacctacaaaatttggaaagaaaaacacctaagtggacgttaatgaaagaaggcgcatatcctgaaagaagacatatttaaaaacagactttattggcttgcaaagggatgattacagaacacctggaggctgtgttttctgagttaaacacttatttttaagccttaggacaaaattattatctacctgatataggcatccaccataa

SEQ ID NO: 14018 - DNA, 448 bp, Homo sapiens
tatacagcaagaagatagtatctgcaaaccaggaaaggaggccctcatcaggaaccaaaacaattgaccccttgatcttggacttttcagcctccagaaccgtgagaaatgaatgtttgctgtttaagtcacccagtctatgaataccgaagactggcagggcgtggtggctgatgcccttaatcccagagatttgggaggcctaggcgaacagatcacctgagcacaggagttggagaccaccctggacaacattgggaagcccatccttacacaaaaatacaaaacttagccaggcacggtggcgtgtgcctgtaatcccagctacttgagaggctgaggcaggagaatcacttgaacctgggagacagaggttgcagtgagccaagatcgcaccatttcgctcaagcctgggtgacagagtgtgaccctatctcaaaaataaaat

SEQ ID NO: 14019 - DNA, 1353 bp, Homo sapiens
  misc_feature (1)...(1353): n = A,T,C or G
tgatatacaacacgctacagcctagtatctgaatgatccacggtattcgctcgagaggagaatacagcacgcagacttcatgtaggtgtacatctcgctcnaagtcgcggaccatttttatacagcgtgatcatgtattgtcctatgcatgatgttgatatatgtagataatgagcgtacacgagtgaagcgagacgatctctcgacagcgcgcgacatcatagatgagtctcgaatcagttaggtcagagatgtgtgcancactatgtagtgaacgcactacgcgtgttccttacgcatgtgctgcgcgctgcgcgcactatatgtcaagacagctncgtactttatgcatcatctgtccggcgtgtcacgctgtaattctcatttntttatacgttatgtgtcgccgtgataattcgctgtctgcgggcgcgcggtttgatacgtatatatgcgcgcgcgatgcgtgccgtctctgcactatccacactnagctgatagagaantatnacgacacggccgtaagcatcgcatgacgttgacgtgcgtacgacatgacacacaacgnattcgcgatatgggtagtgcctgcgctacaagtaggtctactcttatgtagttgcgtgtatgagaagatcacggatatcgatcactctctgatcattacgtcctgagtcttcatgtgtatgnacgattcggcaggataggagaatgcgatcagaccacctatgagtgcgatgcctcgcgcgcacgcctatgtgcttctcgccatttggtacaatagtgagataccgcacgcgcatttcgagattcatctcaacatatcataatagataagantntaganggcaagtgccgcgcgtcggtcagctggatagcatgcagacaacccgacatgctctgcgtaagtgatctaatctaaactttgagtgcagtcgcgtgtgagtgtactccatatcgcaccgtctgtcagcaccctggtaggtagctgcatgctcagtttcgaatgattgtgtatgagctcntacggtggtagtagtggcgttgggtggtcgtcctcctcttatctggtccttgtcttatatttacgatcagtacgtagatcctgtctctcnacactactgaatatcggtctatatcgctccagcgcactatatcatggattcgagtcctctttctagtttcccgtttgcttagtttgttatctagacaggttatcaattaatcataggacatggaacacgttcggcctctgtagctcagcgacccagatctgttgtgatgccaggatcttgtctcctgtaatcttcgtactgactacatcgccgtgtgtgtgtcacgccagcccgctcc

SEQ ID NO: 14020 - DNA, 735 bp, Homo sapiens
tttcctgggatcagctgcactccttagcaaaagtatattggagaatcaactgagaaagtaactgagacatttcaatcatttctaggtgtaaagaaagaccagatcccaggaaaatattacggtgacttcccaagtatgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaaggggaattctacagaaaactgcatgctgtggctgccagtgctggcatgtggacgctggtgattggatttgtggtacccctggttgcttcccggtatgggatccaagaggaaacgttggggagcactggtttaaatggacaaagaagttggcttcgcattgtggaaatcatggataattgatcggcgtttttggcttagccggtggtgggaatctgacgggctgaaaaggcg

SEQ ID NO: 14021 - DNA, 1054 bp, Homo sapiens
agagccgggcaccggcgaaggcccccgccggagacagaaaagaccaggcttgaaagagaagaacgaaaaacgagcggctttcgagacggagaagaaagcaaacgcacaggaccaggcaaaagcacacggacagaagacaaagactggggaacgagcagacgacgtaggcacgacgaacgaagcgagaaaggccggcgcgcgacccacagacaaacgaaaggcgaggcgagcgagcagagcacaggtggcagacggcccaaacaaaaaagcgcgagcccccaagctataaaatagtaggacaggcgccacatccaggccaaagacgcgacagcgccgccgggatgcgagagccatcaatgcgcggaccgatcgcaagccgcgaggaccccagaacacccaagaggcgcgccatccacaaaggaaagagagtcccaggcagagaccacccacgagacgagggagagcgggagagacaaacgcacaggtgacgggaccgagaggccgaggggccagagggcggagaaccccgcgccggcggccacgcggcccgccgcgatgcccgcgcgaggggacgaagcgagagcgccacgccaacagaagcggagcaccggaggggcaaggtaacggagcgcagtgcaacacggcgcggagagagcgagaggcgacaccgacggcggtcgaaaggagggcgcaagggcaaaagggaggagcaacaatcgaccaccacaggaagcgcgacccgcgggcgggcgcagagcgagcgagcggaggcccaaccagcacaacaatgacatccacgacccgccacacagaacatcagcgccggcgagcggacggaggcgggtaagatagtgcgcggtgcggacgcggagcgacgccgcgccgcgaacgaaggagccaggcatcatacgtagagcgaccagacacgacaacagacgacgccggggccgagtgcacccactaagacgacagagccgatacagatgggcgacgcccgccacccaagaatcgcgcgaccaacgaccgccacagagccaagtgaggcgacgcgtcg

SEQ ID NO: 14022 - DNA, 1807 bp, Homo sapiens
  misc_feature (1)...(1807): n = A,T,C or G
ctccgcggcactgatctcttaacacactaccggtggcgacctcgtgcgtaccgncgtactgggctggccgcgtctagcatncgtcgtgatggtntggatgtattgagcactgccttctctctgatccgcgcgcatgcttgccgagctggtcaacgctcagtgtgcggtggcaagttggcgcgacgtncntcgacgcgttacacgcgagtactacacctactctacgtatggctgncgacaacaagataggcaccngtatcaatactagagagcgtagctgctgtaatagtanagtagtagctgagattnattactgacttgtagcatttganctcncacgattccctactatgtcgtgatcggacgaggnaggtagagcgctcgtgacatcctactcatgcgctgctcgagagcgtgagactgctagancacacgcgacattattatagtntactctgcatacgtccacataacgacgcgcggcgtgatgcctgatgacacgtacgtcagcgatnaggcgctcncatgcgttcgcctccatatgtctgcctgtacttgtgcctactgcagcggtagaagcanccagctgtctgactgacccagcgatacatgtccgccgtgacgcctgcaatgcgtgtgtgtccgtcgcgatgcgacatgagttacgacggagcgactgacgatcatgtgcgtacgtgcagagagactcactngtcactnctcatgcgagcgcgntagagtgttacgcgacagtatggttctgtngtccgngcagagangtatctggtacacagcgagtaagaagatagctanatcgcgatactcnatcagccgtctcgccagatgtatctgcggcgctcagtcatagtttntgtcangactnacgcgacagcagtgtagtgccgacgctggatcgnctantgcaactgcntctncgtgcgcgctatctgtacagatagtntagtgtatcgatgacgccgctgagcatgtactcagcactatccactacgccagttcgacctgatggacatacgtatagtggtcgatatatgctccntagcagcagaagcgcnctgattctgcctctgacgctagtagcgtagtacgatgtggcgtcncggtngcgtgcgcgtcactnatgtatctactcactactgctgtgcacttcagagtataggacatgtatntgtgaggcagatgatcataanatgtcatcgtcagctgagtccagttcgctgcttcgtggagctgcacctagtgctcgtgactcgacgcatgactagactgcngtacgtntcagctccgcgtngatgagtncatagcantgtcnttatcgcgtngtctaggntctgattatnctatatcgtagcgtgcgcatntgcgtgaccantgtccgcagctagtccagcagagcagctgacgagatgatagtagtgtagtagtgntgnagacgcgatncatgtgtcacgtagcgtactatnacgtatcgtgagtcacgtgcgccgtcgcagtagcatctcgcgtcgtacantgctncgctgngtgaganacatgagctcaacgngttcgcacgacgatgacctacgtcgtaccanatcgtcnntgccagtacgtnctatccgtctcaggtcntcangttgagactacgtncannatcgtcacangatntgcagntagtagtgatgatgtagacgtcganannatgntagtagcatgcatatgatgcngctggcgcntgcgatcgtagttactcgaagttcgctcanctncgctgctgcggcatgcatgccacgagcagngacggacg

SEQ ID NO: 14023 - DNA, 731 bp, Homo sapiens
  misc_feature (1)...(731): n = A,T,C or G
cccntttttaaaantnnaaanagnttccttttcncccnnncccggaaaancanctccttnaggnngggcttaaggtnncttggaaaccncancccattaanttggncccaagttgngtgnaaaaaaacaaaaaactgccanttctacttgganggnacacaaacaacatttaaaattttggttctngtgccntgtttntctcntccttnagcttctgtcntggtgagtnaactgtntcgggaaggactcccacntccnttgntgagacgtgccatggggcctaaagaataatgctccctttctcagggagccgagacacacttgagacggtgaataaacccagtccccaataaaatcccactttgggctgatggccagcagatgcctctggacccatttctcagacaccgaagacgaggcacagtgacttggcttacaccagctaacagccctgacttgctggagggtgaggagccttccttccaggccctcacctggtgtcactgcctggactggagcagtaaactggaacgtgccaccagggaaaggaagccacagatggggcggggcagctgcagtaattgctgacttgttttgatgctgcgcagggccctattaacccatgagtacgttattggccctctggtctcttaatctctaaataataggtatgatgctaattaccttgcagagttttgttgcaatgatttgagaaaacaaaagcagctcta

SEQ ID NO: 14024 - DNA, 201 bp, Homo sapiens
gtcacctgcagtcgtgcacaagcgcctcatggtgctatcccaggaacctgcatggcatcacccatgcagcatcgatcgactctcaacccgcgtcgaggtcactgcatggcagatacatatcacctctcaagcaggccgtcagcagcgggcagctggagctgtcacggcaggcacactaacacgtcaccttcctggcccccg

SEQ ID NO: 14025 - DNA, 594 bp, Homo sapiens
ttagaaaatacctactcatttgaagtcagccacactgtattctcttttcatttccatgagtacgctgtcggaggcagactggactggacatattttttgagtatctattacgcaaaaggcacatgacccgacagtgaggccagccacttcaccactgggcacctactaactttcatacttaagatgcttaaaaagaagagaaagaagagatgaagattaagaagaacgtatcttgcggggcgaaagagaatacatttaagtgaaaaacattaaaaactcagagagtgtttaaaaattcctccaaggatacaaagggggcgaataagaaagagtgacagaggtgaagttctgtaatgtcaccattcatgtaagcattaggtaagatgactaatgtggcccttctccactgctgcatgctgtcaggtcatcgatttgaaagagagggaggaaaggaaggagagaaagagaaaaagaaaaaagaaaagaaacaaagaaaaaaagaaaaagaaaagtgaaaagaaagagacagcaggcacatacggcctttcagagtccagtagtgaataaaaatgtcataaaggaaaaaaaaaaaaa

SEQ ID NO: 14026 - DNA, 1271 bp, Homo sapiens
  misc_feature (1)...(1271): n = A,T,C or G
gggagcaaggcgaggctctaccgaaaacactttggaacttcacaaaaaaaaaagttcgtatnagttnaacctcgcacnctcgnngcctgnngnnacganaacnaccnnaanannatgcatcgcngnnntggnannatcagagnnatcccaggnattacntnntcagcntagggagtataggacgaacnnttcagataaccaccacgggtagtgaagcccttactgtncgctgtgcattggagaaactaaatggaacaccaacgatcctcaagtcatgtcgtgttcgtgtctcgcgaagctcctctctnggaccactcccatagtngaaggccgaacagagggttgccgtcggggcacactctaatcgggaataaagaacaangtactgttcttttgttttgaaaatngagtgggtggcgacngaangaaaaacgcnnncaaagcacaggacatgttctggacaatatngaaccatggtgaattgccaccccacggatgaacatgaagactggttgcaaggctggtttgtgctcaatntactaggtcctgcgaggtgtgcaaggaaaacatcttcccaagtagaggaagagcaatgtggctctgatggtccttccagtctcgcttaggttgcgcgcagaacacgccctccttatcctattgtcnccatcgcttgagaaacaccacctcaaagatgtaccaaccccaattgcgattgcttggtccacacgtgagatatgtaacagaaagacaacaaaaccacctcgcttaatgagataggaaaggtgcactctccatcactcaccatattcgcaaccaccacacgccattaggcgaaggacgctggcagaatgtgcatggtggccagagagaccccttgtggattattgttgatacgcccgttggggaggggaacgggctcttacgaacaatcttggagatttgtggaaggtaaggccttaaatactccttataggtgtccttctaccatattttcgattgcgctncctggccaacctatttttggcctttggatggtccgcaatctaaaactgaaagtttcccgtatcaaaaaaagaagaaaattcgggcctccctcgggccctcagcagggggaagcttctgggggccgcttttccttgtaggcgggggtaacagtcatgagacctccccgactagaccacattgcgactcagtttttccgcctccgcggaggcgggattctgccacctcaagagggggacagctgtgttccaccgatatcggggtaaacg

SEQ ID NO: 14027 - DNA, 1573 bp, Homo sapiens
  misc_feature (1)...(1573): n = A,T,C or G
aggggggnggnggnnggaggnggagagangagngngagnngagagaggagaaggagaagangaagagagagggaggaaagagaagagaagnagannannnannnnnnnnangacacctcgaagnnnaaaaagcaacacaggannancnnaaagagagaaaccttaanagaagaccaaagaaacccnnnnanangcacgcgaggnnnngaagagangagagaaganaanaaaagaggaggagcggagtgctttangnnngggngnacgagngagagggagagccgancgngagngcagcngnaggggagancgngagagcggagagcgcgcacgcacgaacccagcgacggcccagcagaangcaagcgcgacgcgcccaacacccgcgacgaggcctacgcgagggtacccacggcgcancacgcgacacgcatgagaccgccgtaagtacagtagacaacgcagaaaggagagacaaanagagacncacgcaaagcgatgacgacaagcacggagaggcaacaaccagcgagcgagcaaaggagcgcaggnngcacgacgcgcgcgagagagggaggggaaggaganaggngacaggcgaccanaggccagcgagcccganacacacgcgaacgaaggcgcggcgccaccagacgaggcacgccagcagcggcgacgagaggctcccctacacgaccnccagacgcccgcgcgtagtagacgcacccgcgtccgagcgagcagcgantccgccacagccgatcgaggaccgacagcccacacacgcgcgcgcggcacagacacacacgacgccgccgcacaccacacgganaagcaccagaacaccacanacaacacccacaaccaacacancagcgacacgcaccaccgccgcggcgcgaggcgccgaggccgcgcggctcgacgaggacggccggaggcgggcgggagacgcggaagacgcgacgagaggaagacgaagacgcagagagaanaagcgagggaacgcnagagagaagcgagagcgaagagaaggtaatgaagacgaaggcgagaaagtcgcagacaacaggggcgcggacgcgagcgagagcgngaggacgagaaacaaggagaagaagagcgnccgaggcacacgacgcgtcacaacgaagagcgcanacgaacggcgcggcgcgagcgagcgcactgcacggagcaccgcagaacgcagcggagacgccgaacaggcgacgtggcataggaacgaggcgcgacaccgcgaaacgcgacagcgagcaacaccgagcacatncgagacgcagcggacagacgcaccgcgaagcccccacacacacacaacggagcaccaccagcccggcgcacgcacacaacacggcgacatagcaagggcggcgcccggacgacacgagacgcgaagacgggcgagcgaggacgtagcattancggcgacgcgccngagactcacaatagcgacgacacaacgcaagagcagctcacggcggacgccccagccgcgacccgcggccgcgcgcgcgccacccgagcgagacgacaacggaataggacgaag

SEQ ID NO: 14028 - DNA, 794 bp, Homo sapiens
  misc_feature (1)...(794): n = A,T,C or G
agagcctcctgctggccttgaagaagtaagttgctatgccatgataggaccatttancaagaacggtggggatttctaagagctgagagtgaccacctactcccaggccaacagcctgcaggaaagcaagaacctcagtcctgcaatcacaaggaaccacaaagaaagaaaccaacaaccacatgagtttggaagattacacctagctctagatgagactgtgggcagctaatgccttgattacagctttgtaagactctgagcagaaaacccagttcagctggacctgaactcttgacccacaaaaactgtgaggtaataaatgtagattgttttaagccattaagtttgcggtgatttattatgaagcagtggataactaatacaaatacgatggtggaaaatgaaagaaagaaacatggaaaaagtaagaaagaaacataggaataatgaatataaacactttatataaatatggcatgacaacttatatgtttattttacattttcttgttttctctttcagccattgatttatttcaagcccttatctttcttgtatttaaggggctagattaacataatatattaattggatgtgatatatatatatataccttaagattctaccaatggttgtttggacgttaaacaatgaaatcagacttcatcagcaacggaataattgtggtggaaaaanactttggctgaagctctataattaatgggatggcatgtacaaaagccacctcaagattcttaaagacttaaatttaaaaaaaaatcgggcttgt

SEQ ID NO: 14029 - DNA, 921 bp, Homo sapiens
  misc_feature (1)...(921): n = A,T,C or G
aatatagttatattatgtnccttagngaaaccgatctacatcctccatggncagaccttgactaatccgagnggacgatcgcagcgatggtttttgttgnntactacttccaactntaatatagggcccgttggccttctcctatcaccttgtgggggaagcattccgtatcgtgtaggatgggggttgtgatgcatgggagatggggggtgggatctggatttgggggagtttgtcgcgggctcggttctgaactagactctacgtaggnnnnagaagtgtatgtgatagaaagtggagggagaggataataganccatgtttattgctattaataatcttnnactatttttaaataataacatgggggatggggtggagcgcgcggggtngagtgtgtaaggaaatgcggagatggngcggggctgtggtggtttatgtctggtcctgcgggcattgggttacctgtgngatcgtgccctcgtagagggaaatatgnnggagaacggcgagcgctactaatatcggaatcataggttactanatcaaactgtnaattttcaattcggccctctaaacctttcaaataactgaatccgcactaggtgaccgacaaaaaaaaaaaacgtatctctaatacacaanaataccttaaccttnaccctctncctgcattatcctttaancaatgtctaatcaaacctcatctacaacttgatctttgcggtcaataatacttaggtncaaactttataattnaatctattgtcatgttctaaaactattacaanantcattaaaactttaaatataaaaataactttcggcctcgctggctccatcggtgcagtnctcgttccgattcctcctttcctccccctactccttttcttttncctcctttctcctctccacttactt

SEQ ID NO: 14030 - DNA, 901 bp, Homo sapiens
  misc_feature (1)...(901): n = A,T,C or G
ggggtaatgttgtacttgagagagggagaatggggggaacagggaagatatcagggttgtgcgccgcccagcatcaagatctggcttggtttccctctcgagcagctctcctattactatcaacagcacaggggcagggcttgaatgttaacctgcctccgagcccagcaggttcacaggcactcccgtcatctaggaggaccgagtgagcagtgcctgctgccgatggcggttcacttggagtgacacgcttattccacttaccatggggggtggttaatagttggggggtggctgatgctatcttagctgctgagagcgcattctgcttattattccttacagtttactccagaggctgtgacacatctggcatacttcagggtccgcgacaaccatcctgatgggtcaacggctttactcacggagcttaactacacagaccattgtgttaaggacactggtttcatcgaagctttcacaagtagggaggctcattcacggggagccggttgggggcctgtaggtgnagggtcggattgagatggccgcttgaggttggagaaagaaacggttagggggccttagggggctcttgtcggttttggactggttttccccgcagacacgttcccgtattgaaaaatgggcaggncccccgcggcgggcgtagaatgaagcgcacgccgccaaccgcgcccgactgctccagaacaccccgccgcacccgagatattaggggggacgcccgtcgtgggggaanaaagcggccgtcgccgtgtgtcccaagtggaagcgatgcgggggacggccccgcggggcggagaggggcgcgcagaatacaattcgtcgtgtgtaggcggnaagggggtggggtacctgacgcgcgtcctgtcatact

SEQ ID NO: 14031 - DNA, 883 bp, Homo sapiens
cggaaacgtttcaagtctgaggtagtttttgaatatatgtttcgcaggattctagtatgtacaaacaccaaggacaattgtgcttccaatgctaaggacttccagtgctagagatttccatcttcacagctctacaggtgttcacaaactctactcactgcagctctcaaggtgtgtggtgagacagagattcagcattttccaccagtgtcttctaccctgcttcttggttatcagctgggcacatggcttccccaaaggaaaactgcatttcccagaccctcttggagctgggaggccacaggcataaggctggtcaatgagatccaggtgaaagtgatggatgtccttacaggaaagacttgtcttttccatcttcctgctgcctgtgaggttgataacatgctaatgtggctgatgtcatgctggaatgaaagccaagccggccagacagccagaaagaagaccttgagttctttgaccctatggaaagccatccctggaccacctaactgtggacttttaagtggcatatacggaagcttctgaaacagaatcctttcttccaccaagacttacgcaattgggaattccccaatgaacagggttgagatgtgcaataaataaccactcctcccaagacctggcgacaatgccagcctcttagaaacctgagcttcttctaccacttctcggggtcactgtgtgactggaagggcgcggactttaaaattactgtaggtctggaggcacatcattcctacaaatctccctgggaccagaggggactatacataatatttatattcaacaaaccccttgtgactggcctttgataaaatggggttacactaccaggaccccttagagggagttgctgccc

SEQ ID NO: 14032 - DNA, 722 bp, Homo sapiens
  misc_feature (1)...(722): n = A,T,C or G
ctttgaccagatcctnaatctggagcacactcccagcgagcatggcaccctaacatcaaaggcaccttgtccatccacgccctaattaatacctttagcttgctcccctcatttcagcccattcctcacccacttaaggtttgcacttttaattactgggtatacaatcttncgcgctccgggtcctgtcttcctncaagagtctcggcaaattgtgaattcccctcaacactagggtcacgctgtgcacccactctagagttatccccacgccngtggacaatgacacccttctagaacctgggtttctttacagcttttggtgtcagtagtgtgantcaagacagggacattaaaatcgctcaggtttgcagccaaaacttccttcagtctcgcctggaacagagggactcataaagaattggttgttcagcagacccgctggagctgccccttgaacaacatgggtttgaactacgcacacccacttataagtgaatttccttctcctctgcgccctgagacagcaagaacaacccctcatcctcctcctcagcctactcaatctgaagctaatgatgagcatgatgacctttactatgactcacttccacttaaagagtaataaccatattttcttttccctatgattttcttaataaaaactttctctagcttattgtaaatgtgtaatatataatacatagagcatacaatataaa

SEQ ID NO: 14033 - DNA, 681 bp, Homo sapiens
  misc_feature (1)...(681): n = A,T,C or G
ctgtgtctcactgagcacgtctgttcggtggcacctgggtcacgtgaccaccccctagctgcaagggatgcttggaagagtgagcacctagcaggttcaacatcagtgatggaggtgtgcagactgtgcttcaaaagatggggagcctcagaccattgcagggtgtttaacccttcctcaactgatggatatttaggttgctcccagtgaccatcttgaccatactccctgtgcctgtgtgtggatgtttcactaagggagatgccacatcaaggaactgcagtgtttcccccaaaaatgtgaacttacagttttactggctactgtgaaaattgtcttccggagaggctgtttcaatttacactgccaccggcagtatatcggtgtgaccgtttcccagtctccttaacactttacatcaccaatctcattcatgtcaacctgaggcatgggaaatgttctcgcattgttgttttaatttgcatttgcctgattaccagcatggttgaacatctttcatgtttatttgccatctgtattttatgtaaattgcctattcacatccactacccattattctagtgggtttgtggttttttccttattgttctgcaggaactctttatatattgtggaaataaattcattgtctacaaaaaaataatannaaaaaaaaaaaaa

SEQ ID NO: 14034 - DNA, 740 bp, Homo sapiens
gtcgatcgtctggctacgccagcggtttttatgggaaaaccgagctacatgatgaaagggtctcaggtacattgtttcgcctgcccgcccgttgatactcacccattggtagatgtcaacgggtcatgctagatgttcccggcccagacaaggccatgggtagggtaatagtctccccctccgctgtcaggacgaggataattacgtcaagccctgtaggctgtcgccgtcggagccgttgacccggctccaataatcatactcccaatagtgcgtcgggattttatcaggatcctccggctccagctgtataatggcaaccaagcttcttcactgcatgcagctttcctccaatggtggtcaccggcagcgtcttaccatgggacttagttccaacacgtgctgtcccatcagagcggcggaagggcgggtcctagcacggtcgtcaatggcgccctccttggaagtcggcatcacagtcacaggcttccccctcctcctgaattgcctccacttggtcgtcagtgttgtgtagcaaaactgtttcgtgcagcagtgtccgccatgttgtttgttccacgatcacgagtcctcgttgctcttcgttgcgtcgtgtcatgccgccagcatcttggcttcatgcctgggcaagaattccattcaagtagtgttattacaaactacttgtatgactaatgaatcattaatgatgatgcaaccctccaaaaaaaaaaaaaaaa

SEQ ID NO: 14035 - DNA, 401 bp, Homo sapiens
cctagataaataaggaactgatctgactgtcatggatggtatggattaactctgtcttcctcattttgtgacattctcacccatgagggccctggtgaaagcccacttatccagcctcaggcccactggtgggctggatttgaaaatatggatcagtcagaaacaactccagcgactcaaggaatcgaactgggcttgactcaatcctgcatcatcccagagggcagactgtgaatgcgggcttatgccttaacttggggaaatggaattactgtgactgcccatgatctttgaggtttagaggtgtaacaaggcacacgtctgcctttcatcagcatatgctgattaaaaaacgctgtgtgaaataataaaaaaagtttaaatacagaaaaaaaaaaaaa

SEQ ID NO: 14036 - DNA, 238 bp, Homo sapiens
cgtagtacgagaaacacccacagctctgtagataagcatgctacctgataaccaggctgcctgaaatcctgcctaaccctggaagcattgcagttgcatgagtacaaaaggagggaattcccctgaaggcaaaaatgaagtctgtctggtcctgctgaatacctatgtctggcccagcacctggcacatagtgcatgctcaataaatatttgttcagtgaaggagaaaaaaaaaaaaa

SEQ ID NO: 14037 - DNA, 440 bp, Homo sapiens
ccctagggcccacttgatgaccacaataaggaatgtccagtgcagctgcgggtccacttgagccctccaagcaagcactctcaagcccgctctgtctgggagctctgtgttttcagagcctgttgttgcagcgatgcctggaatccttaacacctgcacaccagcttcctgggcatttccacaccctccccctccccacctcctgcatctcccatttgcatctgaaatgcagctgctctgggccctatagaggaaagccaaatggacaggacatctccttgtttgttctccctcccctgagtcaaaccgaatctgaagctcctctgtgcgacgcctttgttgcctcctcattatgtttaaatgagcctcatctgcaggaggatttttttttaataaaataaaataaaaccaccacaaagaccaaagcaaaaaaaaaaaaa

SEQ ID NO: 14038 - DNA, 1175 bp, Homo sapiens
  misc_feature (1)...(1175): n = A,T,C or G
cctgtgtggccgtgctatgtggtgtttgggcactctgtacgctcgcgggggtgatcgctgctcttccacacagggtagtcgccgtgccatatgagaggaagtgtatcgcgtcgtaatgtaagctggtcgtcgcgatgctagggtctggcgacgtcgcttggctgtgtctggacacgtctggcgncctctactcccgcgtagattgcttttctctgcgtacaacgccgggctcctctcccgtggcattggtgatgtggtcggcacggtcactcgtgctgcgtcgcgccgctaccgggctcttnccagcagacctggatgtgtctgtctctccgtcttacgttgggtggttctctgctttcctcgctcccctttttgctcctttgcggcgtgattctatttgggcgcgtggtgttggcggctacagcgctcaccgtggtgcgctgcctcgctctgtgcgcgccgacattgctcacctcttctcccatcggttaggtgtggtggtggagtgtatggagcgcgtcacgcattgtgtctgagtcgcagcggtggaggggcggtcctcgttgtgtataggggtagtcacccgcgggtgctataaactatatgagtctttggtcgactcccgctatgccgtgtctgttgttatcataacggaagtgggctttggctcgacggccgcgagtcgttccgccggatgttatttattgggcgccggcgggcccgctccagtgttggggaacggcgtgtgacggatggnggctcttctcgcgcgcgtattatacacacctgagttgttgatgtcgtggattccttgttttatcggcggctgagaactaagtcgtctctggcgtttgtctttgtattggagaaaaccgagttcttatcatcaacgtcttagtcgcgtgtctcatggcttcggttgctctctcttgtttcttgccancaccactaagccgctccgaataaacagtggacgagaaaacaacataaaacaacacaaacaaaacagcaatagtaataatagtaataaatagaataagaatagataatatgcgtcctncgtctggtcctaacagtcgtgtggtagntgtttngcgcgccgaaagacatttttttctatctcgccctttattctatattcggtggtcgtggcgagcattctgtctctgttgcag

SEQ ID NO: 14039 - DNA, 729 bp, Homo sapiens
  misc_feature (1)...(729): n = A,T,C or G
ttataattataataataaaaatacacgtattgcctcttgctcgctcgctccagtgtgtgcactcgtctcccgccatattgctattgtgaaagtaatgcgctcaacaccacctcaccctaccactcttttagattactttacatgtatacacataatttttataaatctggttttgttgtactgtcctttgtatgtattatatgaggtgtaggggattangaggatacctaatacttttttttacaacgattgacagaaaaaaacgtatgtccactacaggtgcgcggggttcactgcaagtcggattggtctattactagtgctcaccgggccgcacttaatatacgttttgaataattagatggatggggcacaataggactccaagcaccaggcagggtcttttccccccttggttcctttcctaccgtataaggatggggcagggacagcattagcatcaaatacataatgtagatggcgggttgatgggcgcagcaatcaaccatggtatgtgtatatctatgtaacaaacctgcatgttctgcacatgtataccagaacataaagtataattatacaaacaaacaatcaacaacaaaaaaattgacttgtatactgagaccttgataaattcacttttgatttatggtagcttattcgtagagtttcctatgaatcatgtttatgtgaataaagcccctttaacctctaaaaaaaaaaaaaaaa

SEQ ID NO: 14040 - DNA, 826 bp, Homo sapiens
  misc_feature (1)...(826): n = A,T,C or G
gtaaatggggttgagcgggtgaatagtgcagatttcaagtaacaaaaaaaaaaaaaacctcaatatgagnactgagncaccngacctcagnggnggcacaagcgcaacagggncgaatcgagctacatggagaacggcatctaaaccatcatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgttttgtttaaacaacagctgaaagaactaaagaagcaatgcggttttcaagctgacagagaagctgacggagcagaaggagtggatgaagatataatcgggacccaatgtcagaccaactttacctgccccattacaaaggaggaaatgaagaagccagtgaaaaataaagtgagtggccacacctatgaagaggtaccccttgtcgcatgattgatgtccagccaaagcggaagaaaaaggcctattgccttaaattggctgtaaccacaccgtttaagatgtcatatctttttctgatgaagtccttagcatggttatttgcaatccctgtcaagaaagacattctcttacgagtgtgaaatgtacttgcctggaggactccgacttcttacttactactccattttctgttgtagccacttctccaccatatttaaggactggccgctagcctacggctaggagaaaaattgcgacactttgtacgcctaaaacctctctctattgcgtatcagagtgttatatct

SEQ ID NO: 14041 - DNA, 783 bp, Homo sapiens
  misc_feature (1)...(783): n = A,T,C or G
ttacaccagacagagactccttctggcctgtatgatgaaggaagactgtctcaataaataaatacataaataaataattctataacaatctcagaacgcatgacacctctaggacccattctcatcctacatcctcctctttctggtgctgagaaaaaaaagaaaggaaaaagaaaagtcaaaagaagagggaaggaactggtggtgattgactagcagactggctgaaatcagtgggaacccggatggctgactgcaatccgcacagaacgagcttttttttgtcacagcctgaatttccacctgctgtttcatactaacgccacccaatttgcacatgcgacccacgattaaccttggagatggccagacctgataaccgacatactatgaatgtgaacagtagaattgagggtgtgggtggtattccacacatactctcgcatatcataaattacatattatttacccgtttctgtggtttttttttcatgatgaatctattaatctatttgtattagtaattaacatcacttatggtccacctgtgagatcaatcttcattcttatttttgttaacacttatntaattcttataacacaattattataaagtccccctataactcatccccccatttttttttcctcccccctccaccccgccagcttcctccacacctttatgtcattatatatcccccagttgcgactacctttacgatcccaccatgctagccccgccccccaccgggcatcaaatcaagtgatataacataaaat

SEQ ID NO: 14042 - DNA, 671 bp, Homo sapiens
actgagtttgtttaagaaaaatttgactatggagagacaaattatattgcacatttcaaaaaaataggaatgtggcaggttaaccagcagttagaaagcttaaaaacccgatcggttttccgcccccaagaaattccggaccaaaacgagggaatcaaattaaaatttgtgcccaaagtcggcgccttttaccgtcccccatagcataagaggtaaaatagacacccagtgataaattaagggttggccccacctattaaaaagccgccactgtttgcagaaattaatccacctaaaagttgaaaaaaaaggccaattgcccttaaaattggttgtaaccccccggatataagaaagtcaggttttattcaggattaagcccttagaagggcaattttggaaccatcacaagaaaagccatcgtcattccgagtaggaaaagccacctgcctgcagggacaccaacagctttcctcttaccccaactgttttttaaaagcagttctgaccccaccagttagggaatggctgcaaagcataattgttgggggtaaaacttgttgcttttatgtgggcttgaaaacatttttcaaagttacccaccagaaaagcactcatattgtttatttttaagtgttgtataatgttaaataaaactttgatcgtctgcc

SEQ ID NO: 14043 - DNA, 744 bp, Homo sapiens
agttgccccttcataaaaaagaccgggtcttcggtagcccctggtccaaggagaatgaggaaatatgtagagcagctgtgaagcctatcaagcagtctgaagtcaagccccagtggattccagccaagcacaagcagaaccactgccaatctatagaactatgagaggggaaataaatatttgtggctataagctattgagagtttaaacttgattgataggcagcaaaaactttcaaatcaattgttcttattaaacattttgcttttgttttgttttgtttttcagacggagtgtcactctcctccaggctggagtgcagtggtgcaatctcagctcactgcaaactccacctcccaggttcaagcaattctcctgcctcagcctccggaatagctgggattacaggcgcctgctaccacacctggctaatttttgtatttttagtagagatggggtttcaccatgttggccaggatggtcatgaactcctgatctcaagtgatctgcctgccttggcatctcaacgtgctgggattacaggcatgaaccactgcaccagcccttataaaatattttttaaaagtttatgctgatctggctctattggattgactagataactcatatttactgcctgattgacttggacattatttttagagccatatttggctatctccacaattattatgatcattctaataaaagatttaaaataactgcaaaaaaaaaaaaaaaaaa

SEQ ID NO: 14044 - DNA, 1876 bp, Homo sapiens
  misc_feature (1)...(1876): n = A,T,C or G
cantgacgtgtgtcgcagcgtatngtacatcgcgtgcgtagtntgtgctatatcagtgnactcatgaagatgngntgtatggtagtgctgcgttcgcgtcatgtatctantcgcgtntntctcgcacagtgagtctcactnatcggtgcacgcactcgtctacaagttgagtggtcgactacaggcagtanactggagtgtcgtatcgagatactacttggcgcgtctctatgtgacantagcactatagcgtgcggngctgcagtntctantagtccgtcgtgtantcgatgtctgctacgtctactgtcgtngcgncatgcttanatgctcatatatgcgagcgcgtgnggatatctggatcttgtggagaagtgtgtcacgccatctgctattcttcatctcgtgtgataactatgtctgatgataactgtggtcacgtgtactcgcggcagatagcactcnttcggtgtgtctgcaatcgcgcatccatcgtgtgacgttattctgntactctcgttgtacgtctggctcgcgtgttatcgtgtacactcgtctggtgtacttcatggtgcgcgcgtggcntcgttgtcgctgatcgatattcgatcgtatntctctgtgctatgtgtggtactgtggacgtgtcgtatcgcgctagtcgctcgtgcgtctctcgaacggttcgcatgagcacgcttacatatgatcgcactacgtacataagcgnagagtcgcgtgctactcgcgccaaacgtacacaccgttgctcacgcgcgatccgacngcttcgcacgatgattcactttgatcgttgatgtatgcgtgtgttnatctatgtgacgtatgcgntnantnattgntacgataatgtgacaactctatcattcnctgctgcacacagcatcgtgatcgncaccnctctatatcagctgagtctcaggttgtgacgtcggtatgtgtgagatcgtgtantgtgctcctctcagtagtgcgcgacgtgcgcgctgatgctatgctctggcctgagtacatgatcatacgagcntnggcntacttgtgctagtgttagagctgtgantatantgtctagcgtccttngatcatgctgtcgcatgtgatgtgctcacncgagacggttctgncgcntngatgtntcgacgancgtcncacanctcgtctgtctcaatcgtatngtcngtnacgatntgataganacaactcgcgcgttcatactagtcngngttcgtcgggcagnctncactcgctcgacnctcncntcgtctgatctgcagactanctncgctgtcgcgtcacgcgacntgcgccgcatgcgngagatcanagtgtgagantacgagcgtcactgctanntncgtgacttcatngngcatatcttctgcaggcgacgccgcgcgtctgtcgcgtctgttgcgtacgnatcagagtgtgtagtagtancgtggacggagtcncactcgancgcgcacctgtgtgnctcgtgagtcgtangctcgagtctgctgtgacacacactcgacgtnctgtgactntanatactctagaccatgtacgatcatacgtgagctctgtgatgagtgtcgagcgcacagacatgactgagatgagatgtgatagatcagatatctgacactgagagatgtagnagatatatgatataganttgggnggcctcttgctngttatcgtgtactactaaataacgatcggtcggtgcgtncagnnatagtgtacagnctgacgtcntnggacngcanttcntcctgtctgtncatgctctgtatnctctacttctactcttgatgctgtcgtgacgtatgccagtatctcatcttcataacatctcaacgtccgt

SEQ ID NO: 14045 - DNA, 1390 bp, Homo sapiens
  misc_feature (1)...(1390): n = A,T,C or G
ttgtattgagttacatgttgaatgcttatnaaatatttatatctatgnncccttatgttagtttgtctgtgtgtctatatggtggatttgtgataagtgattggtgtgtgtgtatcagtgtggcagcttatattgtnnnnnnnttgtatttgacagattttgttactattatnactacttcgtnaggacgtctctctgtacactcgngcgtacctcttgagacgtgggctcgagtctactgttgannngtgatgtcgtctgtcgtggtatttgtcggtgactactgttctacacattgtnttcgtactcgataagtgtacttgattagagntactatgacatatgantctactgggcgttggagaagagtgaggagngnnngncgtctctctcatatctcgtgcgttaggatctagtggnnagtagtgtgagatatgtgcgtgacgtggtagcgtttgtgtggagtcatagtngagagttgtggagacgctatgtggaaaattactacttctncacctttcgggtgtgngcgatgttggaataataatcgatactgatgcattatggtgaggagagtgttgctgtgnnnctcatagacattgacggaacaccgcgcgtgcgatccacgcgcggnnaagaaacgttgacgnactatatatcgttnnnnnaacgtaatcttattatatgattatataagaagtgtataatatttataatagagagaattatatagnannatatttctctcttcnnnncctttcaattattattcnctctcaccgtccaaaactgcgcgtaagcgngcntcatctttgtgctctntagtctgtgccgtctttatctncncggtcacacgatctcgctgagttctgtgaagncgaacaagtacatgnnnatctctaatatactatattttacacgnacccatgaacaatacatcaatgaatattaaatcggaaataanaaatactataaatttanacttatctattncactcaaatnaatattatatttatattatattattaatttattnnnataaataagtattagtgaanatctctttttgcgtcctattttagcacgnactaatattataataagtagtgagttggagattgtnaganacatagcttagaatatatacatctactccttcccagtttcctctctgtattttgttgngattgnccttganatataaactctcaaccaaaaccctctaaaaataccacatnnaaaaaatattactaaaaaaaattatnnctaaagtgcataagatggcaaataaaatctatttattttttttttttaaataatattnaatttaaatatttaaatttttttttnatttaatttatttantccaaaactctttcctcttcttcc

SEQ ID NO: 14046 - DNA, 289 bp, Homo sapiens
  misc_feature (1)...(289): n = A,T,C or G
agttttgtagtagatagaaccatcataaataaaacntgttcacaaaatacaagccacaccttcatgcttgtacaacatgtcaagcacttacagtataaaaaggcgtatagggagaaccctatgtgacgctgtaacanctgaaaaaataaatggaacaagatgatgcaagaagcaaaacatttatacatagaagatttgtgattatgattttaaataatatatttgcattttatgttctatcagcctggttattgttgggaaatgaaaatcataaacaaaaaaaaaaaaa

SEQ ID NO: 14047 - DNA, 868 bp, Homo sapiens
  misc_feature (1)...(868): n = A,T,C or G
cctgctgggcttgcctcggggcggcctcatcgacgcggcgggcgggggggggcgtcgttcgtggggcgagggcgattggtagctggtactgtgggagggggaatggcgggttatactggctcgttgttggggcgaggcggctctgttntcacgtgcctgggtcttgctattggctccctctggccctccggtggggtgcgggcgcgggatgggttgaccctcacccacccgctcgctcctttgcgcgcgtggccatctcgtggcctcgtccttggtgtgctgccagctgccggntgtttggtgtccgccgtgcgtctcgcactgtagcttcccttccgtttttcatgcggtgagggtggggcggcctctctaatactggtcggtggccctctactgctcgcgtactggcacttcgcgcctcctcgacccgtgtggggtctatttctgcgggccggccgcttcatcggctcgtgtctgcgctatgactgggcggtgctgtgcgtccgcgcgttctcggttgggggtacgcagtatcgtcagcgggatggttgtgggcgtctggcgcacatgcgcgcgcggtccctcgtcccgttgcccgcctccgcctcgcgcctcctggtctccggcgcggtgggtccgggtcggaggccttgcgctctgctttgcttgggcgctgctttcctggcgggcctacctggcggcttgccgcgcaaaaagaacccctcccttccgcgcgtttactctgctatggctcttgttttgggccttcctcttcttggtgtgtggtccttatagttagtcggctttgccgggcgtgctcctcgtcttcttttggctgtgttccgacatgggctcagaaacgtgtgat

SEQ ID NO: 14048 - DNA, 1054 bp, Homo sapiens
  misc_feature (1)...(1054): n = A,T,C or G
ccccccacctccgctccccagcgcacgcaccttccgcgcgccgccgaagaagcttagaggtggtcacacatgtaagcacgtagtataaaaagcgtatggagaccctatggagctgtaacacttgaaaaaataaatcggaacaatgatgaatgcaatgaagcaacaacatgttatcacatacgacagatttcgcgcattatcgattcttaaatcaactatatttcgcacttttgatgtatctcatcatgcctaggtctatctgctcgggacaatccaaagtccatacaacaaacacaaaacagaaacaatatggcactcattctggcctgcaccacgacgcgagcctatcctgtgccgccttctccttctagtcgacgggtctcaattccatgatcccgtcgcctcacctagattcagtttgcacttttgaccattcccgaatgttagctcatcggaccttacagactaacctgcacacggcctgccctcatcgcgtctttcatactagtttccaccggcgcgttcccgcacggatcagcaccttcgcgctcctcgacctgcctcccgacaggcacctgtactgcttgtctccctctgcctgcccccgctacccttctctcttcttcatcgtggatcccaccacccaattgtctggactcaatatcatctcctgacgtcgccttttctacctcggcccatgccgcgcatcacgtcccccacgtgacagtgttacgcaccacatctagttcactctttcgcaccactatntactcttactctgactctcctcctcacctcctctacctcctctcccgccctccctacgcgcctccttacaactcaacttccctacgctgtgacccgccgtacgtcccgtctccgctcgtcccgcaccttactccagatacccctaactacccacgccgcatccgntcctgtgtgtcttctcgtcgcccctcaccggcctccactatccatagtcaacgcactacattcctgctgctgtccctccaccgcctcactccctctctccgtgtattatgttctagttttg

SEQ ID NO: 14049 - DNA, 812 bp, Homo sapiens
gctgaaagcactggaatttctctttcttcaactaaatttcttcacctgaaagaaggtacttatgatcagttggcatcaatgaagcatcctcaagaaatgtaaggaaatgacaactggttcacaggttgtgtctacaggagggaataaatggagacaaaacattcctccccttggaacatctcaggacctcgtctcaatgtcttagctcttacttggaaggcctctgtgtttgtctctaaccccctaacaacctaggaccctggttacagaagattcttaatagagtactggaagaattccaggtaatatatgaatattacttagcaaggacaattaaactttcaaaaaaatgaattttttctactggtgttttgaaatttcaattaaattgcaattaaaagataaacaacataaaagcaactccacatttacaagttctaagctctaacattgtacacataattgtgttggggtatgttttttctgataaaaagagaatggcattctacaaatcatcagtcttgagtactcaggaaaggcattgagatagtcttaagtatgaacatattataatgctaagaaatacaataaaaggtcaagctaattagttgatttctacattggggaatgttcaggtacaccccaatgtactgtcaatatattcctagagtcatagcttatcttaaaaaaataggctaaggccgggcacggtggctcacgcctgggatcccaacactttgggaggccaaagcgggcagaacacgaggtcagaagatcgagaccatcctggccaacacgggtgaaaccccgtc

SEQ ID NO: 14050 - DNA, 781 bp, Homo sapiens
agggttttaacgtataagatcatgatatctgcagacagagacaaattgacttcctccttccaaatttggatgagtaaagagacaacctacagaatgagaagaaatatttgcatatgatatatctgacaattggttaatattcagactatataaggaatttaaacaattcagtggaaacaaaagccaaataatatgattttaaagtgagcaaaaggccttgatggacatttctcaaaagaagacatacaaatggacatgagtatatgaacaaatgtacaacatcactaatcatcaggagattgcaaattaaaccataatgaaaaaccacctcactccaattacaatggctattattaaaaagacaaaagaaaacaagtgttgacgatatgaagaaaagacaactcctgtatactattggtgggaatgtaaattagtataccaattgtagaaaatagcatggagatttctcaaaagattaaaaacagaactaatacatgaaccaggaattccactgctggatatatatatacaaaggaaatgaaattagtatattggagcaatgtctgtattcccatgtttattgcagcactgtttacaatagccaagatgttgaatcagcctaagtgtccaacagcagatgagtggatatagaaaatgtagtatatatacacaattgaaaactattcagccattaatagaataaaatcccatctttgtgacagcaaagatgaacctggaggacatcgtgttaagtcaaacaagccagaggcatagagacaaa

SEQ ID NO: 14051 - DNA, 514 bp, Homo sapiens
tatacggtgagaacatcatgtctttggtccatggcaaccgatcattattgtacccgtgcctggcagagaaaggaagatggagctaccatcttgaccatgtctagtccttagttcctgccagcattcactgtcaggcctctgagcccaagtgaagccatcatatcccctgtggcctgcacgtacacatccagatggccggttcctgccttaactgatgacattccaccacaaaagaagtgaaaatggcctgttcctgccttaactgatgacattgtcttgtgaaattccttctcctggctcatcctggctcaaaatctcccctactgagcaccttgtaacccccgactctgcccaccagagaacccccatttgactgtaattttccattaccttcccaaatcttataaaacggccccacccctatctccctttgctgactctcttttcggactcagcctacctgcacccaggtgaaataaacagccttgctgctcacacaaaaaaaaaaaaaaaa

SEQ ID NO: 14052 - DNA, 501 bp, Homo sapiens
  misc_feature (1)...(501): n = A,T,C or G
ctagtgcgtcatcggcagaagggattgagnacaagactttggacttggactttgaagtaaaatgttggaatgaattaaggctttgggggactcttgggaaggaatgattgtattttgaaatgtgagaacatgagacttggaagggaccaggggcaaaatgacatggtttggctctgtgtccccactcaaatctcatatggaattgtaattcccagtgctgggggagggatctgttgggggtgattggatcatggtggcagatttttcccccttgctgttctcatgatagttagtgagttctcatgagatctggttgtttaaaagtatgtagcactctcccttcactctctctccttctccaccatatgaagaatatgcttgcttctcctttgctgtactgccaggcttgtaagtttcctgaggcctacctaaccatgttccctggacagcctgtgaaactgtgagtcaattaaacctcttctttttataaaaaaaaaaaaa

SEQ ID NO: 14053 - DNA, 1524 bp, Homo sapiens
  misc_feature (1)...(1524): n = A,T,C or G
tgtggattgatagggatnnnacatgttatggctcgtcacatctgtgcgggcacgtggatggagatgggatgtgtnatgactggtntggtgatgaaatagtgtaggtgagttggtgtgagatgnggcacatattatgcggnngcaggtgnggcgatatgtgctccgtctctnaacatatcttggnngangtgcattgatggtggatgcgcggcgggcgtgngangngcttgtggagcgtgtgnngggcggcgagcacataccggcctcgttgatgngaaactgtatgngatgatgtagactaaggtatgtagtcggatgtgtgagngcatctgatgcgacatgacagagangngacgtggcggagcacgcctttnngnnngacgtgagnnactactctagacagcgcgtatcagtagttgngacactacttaatcgcaggncgcgagtcgagtggaccctgcggatggagactagtgagagcgtgtaggtgtgcgtgtgaactgtcggcgcttgtttgttgtagtgagtgtaagtgcggagggttaaggaagttagtgaaggtgaggnngacataaagattgnnncagggacgacgaagtagagtggggacagagaggatgtgncacggtagnggnactatgagagggnnnacagagggcactatattatgaattaatgaaaggaagatagcatcagatgtaggagattgctcgnggngacgtgaggcgacgggnggngcngcagcgctctatacgacacatatgcaantacacataaacatacgaacgcangnaagcatatatgcgnatcataagatgaggagagtaacagtagacgatgannggagtacgacgtggcgggatagagtgtatgaacaataaaaacaganaaacagagggatagcgctacgcaactgagggnaagctatatgnaacatatatatacanncatctagattttaagtgtggtcctatttcttgntactctnanacatattatntatactttataancaactataataatatattaacaaaacaattaatnnanaatataataatgatatagttaacactactatagtacttagcgagtacatnngatgtgnnnnnaatangtgataccgtgcggtngcgtntatggcgcgactggnngtngccaatgaggtagggngacatgtngacctgcgaggcagcgaannacnaccggcncgaccgacgggcgcactgctgggggactgtngngctaggnnncatgtgttacactctcttntcctatatatcatcattcatantcacatatccaacgtnnnnacacacacacagacttaacatanaaaaatancaaaaacannnactagaccgtggcactccgctntgggacnctactagactgtcgtactnannacgactacctngnttcaccttatatcttnntnntctttcttntatacattcttcnactcttcccttcttncctctttcaatcctcaatacactcaactaaaacaaacacatatttccc

SEQ ID NO: 14054 - DNA, 880 bp, Homo sapiens
gtgcggataggagagaaagtatctagtacatatagtaaattaaataaaaaatcttcgagaagaactggcacatcaatttctgatgatccctacagattctactgaaatctaatcaagatgtcctcactgccatcaattcaaaagaacttgcgaagaaggctctcgaggcttgtgctctcagattgtgaaagtgagatgatgcgtaacgaaagccatatatgggttgtaaattgcaatcatggaattcccaatagctgaatacactccatctctccagaaacaaatacctgttaaagcaaaaccagaggtaccatccacaacaaattactatttatcaatattttagagcgacacattaacataaacaactgaaccctcccccccctatacttaggttataacgcccatcccgcccccacgaaacgcaattccactaatttattcttctatttcctccttctatatcctgaactgatcaaccacctatatattatcggcttcatattaagcggtgtcctatttttcccttctctcacccctttcttattacctttacacaactactcccaacatcttcgtatcaaatttttcacgtgccattgaaggcgatacatatacttactcctccacttacgatataacctcatctcacacattcaccctccaattttgcctcccaataccttatcttttcttagcacgcatttactcttccagcgaaacacacattgtaccatcgttatcatcctactagttaggtaaacaacatcacatacatctctacggtatatctatattacacatccactacattgtattttctttagctgtatatgatgatcgcaccacccgcgaataactaagatccacgagagcctcg

SEQ ID NO: 14055 - DNA, 828 bp, Homo sapiens
  misc_feature (1)...(828): n = A,T,C or G
ctaaaaaaacacctaaaaanaaanntncccctgcactcttccacttttatcccttattattccaaattactaggaacctaccttcagtcattcaacctgaattgcaatgactagatcttggcccactggaacctctgcttcccggggtcaagcagatccttctggctcatcctcctgagaagctggaactacacgcacacaccaccacgcctggctaggtgatgaaccattagtaaagatggggtttcagcatattgaccgggctggtctaaaactcccgacctcatgatccacccaccttggactcccaaaatggtagtacttcagtcagtgaagcgcctctcctgacacctaacggtttctcgcataacgacacttaggacggtgtcaataccagcccgatatgagacattttacttgcagaggaacctaagtacaacaataccaacagaacacaaaaaaaacccccaattatccacaagcccaaatatataaactttttttatacccatatatattctagctgccctcctcactaaccctatactcagatctacatccccccatatgcgattctaatccttcttcagtatagcttaatatctcgacacctcattaatttaacactatatccacgtgattgggaagcttaaccttatggtttaatgcctataactccctatcacccgatttatatactcgtccttgccctggattccatagtgtacgcttcaacgcgtctctggcttttccctcccattacactttattacgcctcgtaaatcagttccacacgtatcatactaattcatcttacccaccacccct

SEQ ID NO: 14056 - DNA, 739 bp, Homo sapiens
  misc_feature (1)...(739): n = A,T,C or G
agtgtggaagtaagtggcggtgctcctcgcaatgtacggttggtaacaacggacgtcaataatgttgaagatgtcacagggggcaaatgcagataataaagggggggtttatagggtgtggtagctttagaatttcctctaatcccgatgaacagatgccataatggttaggaaaaagggtaaagcgccatcttcatgtgagaggtgcacaggaggatgggactccctcggctagccacgtgttacgaattttaactaccagtaggtggaagtgtgtgataaatataactgtgggcgtcgcaatctaacataaggattggtgaaacaatgctggaaataaccgggatgttttgccagacggcttgaccatttagttcatggagttgggcgaaaaatgcgggtcataataaccatgcggatagatatgggagcagtagaggagccaggctaaaaccanagatggtgacatgttggacctttggtcgtcctgacgagggaccctgccaatcagtgccgtggcagtttacaaatgccctggcaacgtaagtaggattccctatatggtttaaaaaggacaggcatttataatccaccccttgtttagtatgtcatctaagggatttccatgaaaataggctaaccagctagcccttggggatgctttaaggaagagcctattattatattcccaaactgtaaaaaaaaaaaaactttcactaaggaaaaaaaaaaaaaaaaa
